United States Patent 9,518,277 (GENETICALLY ENGINEERED MICROBIAL STRAINS INCLUDING CHLORELLA PROTOTHECOIDES LIPID PATHWAY GENES) - sequence listing, part 3

SEQ ID NO: 5750 - DNA, 1266 bp, Chlorella protothecoides
  modified_base (253)..(262): a, c, t, g, unknown or other
atgtccggggggacggggtccctgggacggctggtggctgcctggctgggcgaaggctcccagtgcgtgaccctgcacgcgcgccgggccctgctcacccagcttccagcgctgtccgcttcaaacccggcctgcatctggaccctgctccagggtcataatgccctggcggccaatgcccacgaccgccgcgctgtgcacgctgtgcacgtgctggctggcggcgtcctggccgacgccgggatcgcaggcnnnnnnnnnnctaatagtgccctggcggccgatgcccacgaccgcctcgctgtgcacgctgtgcacgtgctggctggtggcgtcctggccgacgccgggatcgcaggccagtcaccctcctccctgcgcgcggtcgccgcgcccaaaagcacagcatcggcctcccatcggcaccagaccgccgccgagccggtgaacatctgcctgctgttcggctcggcggccgccctggtgggcaacgccggccaggccgggtatgcggccgcaaatgcgactctggatgtcctcgcgcagcgcgcgcagcgtgagggcctgcgctggcacagcacgcagtgggggccctgggcccacggtggcatggccgacgcgggcatcttgcgccgcctggcaggccagggcatggtcggcatcgcacccgcgcacgggttgcacgcgctggcccgagcaatggcaatggcgaggcctctgccgccgcccgtcgtgctagccatgcgtgtcctggactgggcccgggccctggggccggtccatggccagcgtccccggttcgctgaggtggcgcctacgaatggcgccacaatcgacgacttggctgagagcatcggggccctgatcgcggcgcagctgggctgcaggcccctgcccaaccagacctttgccgcggcggggctggacgccgacggcagacgtgcgctctgctccgcgctgggcgctaaatacagcgtaccgctggagccacaggacctggtggatcaccccgacgccctgcgcctcgccctgctcatcgccgagcgggcgggtgagacgcctcgaagcaagcctgccgagcagcttgcacgtcaaagcctgggctctgcgggcacccaccagccactgacgcgagcagacacgttgcgccgggtgcgggacaccgtcgccagcgtcctcggctccctgcccggcgacggggcgcctctgcgggaggtgagccgccgactgggcgtgtgggatgggggctgtgagcgccagtgctga

SEQ ID NO: 5751 - DNA, 642 bp, Chlorella protothecoides
atggtggcagcctccctggcagcactgtgccggggcggtgcctgggttgaagtaggaaagcgcgacatctggtccccgacacgcattgcgcaggagcggcccgatgtcagggcgtccctggtggccatcgactttgcgccgccgccggtgctggcacccggcatgcagcgcatcgccgccctgctggcagctggccacatctcccccatctggtcctgccactacgggctggggtccgtggctgctgcactgcgcacgctgagtgcggcacgtcacgtgggcaaggtcttggcggccgcaccggcccctctcccgggcaagcagggctccgcagggacgtggctcgtcaccggcggcaccggcgccctgggagcgctggccgctgcacacctggtgacagccggggccacgcacgtgcagctgtcctgccactcgcggcctgcgcgctgggagggcatcgacgccggctcagcggcctgcgtcaccgccgtccagatggacgtggcggcgtgcgccgacggcgcgggctggttgacgtgcacgccagctgcggggctgctccatgccgccggcgccgtgagcgacgccctcctccccaggcagaccctgcgaggtgagagcgtcgtgggaactgttttgtag

SEQ ID NO: 5752 - DNA, 1731 bp, Chlorella protothecoides
  modified_base (997)..(1006): a, c, t, g, unknown or other
atggcggcgagcggaccggcggtggcgcgccagctggcgcgcatgggggtggccctgctcagcccggcgcaggggctcggcatgctgtgggaggtgctgggcgacattgccgggcccccgctggtcctggcggcgaccatgcgctgggccgcggcgatggcggccgtcggtgacgcagaccgcgccttctaccgggccgtggtggcatcagaaatgtgcgacgagggcagtacggagcccgatgcctcgagcgaaggcccgagcggcagcgagattgtttcagacaacagagctcccacagatgtggcggccagcacaactcacccagaccaggcccctcagcggcaaaggatctggacccaggaggcggtggaagcgttggtcctggcgctggtgggagaggtggtggggtcgtcggtggaggccactgcccccttcatggctgcagggctggactccctggcctccaccgacttcctggcaagtctcgcgaaagatttggggctggaggtacccgtcaccgtcctgtacgaccaccccaccgcccgccagctcgccgccgctctcttccgcgagctctcttccaaatcaatggttggggaaggccaggcgagcgccgcgccaaaggcgggagtcccgagcactgcagcgcccgccgccgagccagcagcgccgaccagaggccagacggcagccagcaaatcgacagccacagcgccgccccctaacccggaggcccccaccctgtcggcgccgggctacttctgcatccccccgccccaggcgctggcacgcctgtcctcggcgcagctggccgccctaccgcgattcgtgctggggcatagggaccacggcgagttccagttcctgcagccggtggacctgcgcggcgcgaggctggacgccatgctcagaatggaccggggacgggcacggttcgtacccctgcttccagacggcgccccagcgccccggggcgccgcgctcaaccggcccnnnnnnnnnngcgtggaccaccaggagctggccggcctggccgagccgctgttctccgccgtgcccggcggcccccccgccccctcaggcggctccgcctacaccggcggcgagttccggcgcgccgcccccggcggcctcacccacgccatcctggcctttgagtttgccggcggctggcgcgacgtgcagggatcggtggcggccaccgtcctgcagtacctgctgggcggcggcggctcattctctgccggcggcccgggcaagggcatgcacagccggctgtaccgccgcgtgctgaaccagcacggctgggtcagcaactgcaccgcgctgtcatccatctacaacgacacgggactggtgggtatctttgcctccgcagacgcggaccgcgccgaccacctcgtccgcgtgctggccgacgaggctgcggccttggtgtcggacctgaaggacggcgaggagctggagcgtgccaaggccgccgccctgtcctctgtgctcatgaacctggagagccgcgcggtggtggccgaggacatcgggcgccaggtgctgacctacggcagccgcaagcccgccgccgagttcgccgccgccatccaggcgctcaccgccaaggacctgaaggcctcggtcaaggccgcgctggccaagccgcccacgctggccacgctgggcgacgtggcgcgcgtgccctccctggaggccgtgcgcaagcacctggcttga

SEQ ID NO: 5753 - DNA, 513 bp, Chlorella protothecoides
atgcacgccatgagacctgcgcaggggctgagggcacttcagggctgcctagcagtctcctacccgcccgactgcctggcagtctcctacccggccgtgagggtggcgggggcctttcagtgggatgcgctgcgccgccggccactcctccctcactataatgaggaggcttctgaccctgcgggtgccatcagcgaggcaagtgagcctccagcggcacgcagcaccgctcctaagctccccgaaaccaaggcagcagcgccgaatggcatgcaagaagtgctggatcggatcaccgacctggtctgcgccgtgctgggggcctcggtcacgcccgacgccccgctcatggccgccggactcgactccctggcggccgtggagttgcgcagcgagctgggcgccgcctttgggctggagctggcgcccactgtggcgctggactacccgaccgtcgccgcgctggctgggcacatcgctgccctgctccgagaggcaacgagtgaggaatga

SEQ ID NO: 5754 - DNA, 1272 bp, Chlorella protothecoides
  modified_base (947)..(956): a, c, t, g, unknown or other
atgtcttttaccagtttacagtccgtcgggaatattggtggagcgcagggcaccctgcttccccggtccttctcccgggccctcccctccccccggcgcacgtcgcgcgttgaggcggccagtgcgagccaggcgagcaccgatgaggccatgggcttcagatacgatgccagtatgcagcgctgggtcaaggacgcgcggtacaccggggcgaagtacaacaccctaatcacccccaagagcgggaccccctacaccatctggcccgtgatgcacaccgagctggtgcggcgcaaggtgcgttgcgtggagccggaggaggcacacaatgccgtgtccagcggcaaggccgtgctcctggacgtgcggctgcccaagcagtttgagaaggggcacgcggacggggcggtgaacgtcccgctgtaccgcatcaccgcgggcaataagctgtgggacaagatcaagcgcatcgtcatgggcggcatggtaatggacgccacgggtcggggggaggcttgcatgcccctcagtctccagaactgtgggttgcctccttgtcggtctccggctcagagaccaaccgtccccctccctcccccccaaacagagcgcgaccccgacttctccgacaaagtggtggcggcgctggggcgcaacgcgcaccgcacgcgggtcattgtggtctgcggcgtgggcggcacgctggagacggcggtcaccgtggcgtccacggggaaggtggcgcacaacgaccccgaccgcgcgtttgggcgggagtcgcgcgcgctgaaggcctgctatgagctgctaaaggccaagttctccaaggtggagttcctcaagggcggccatggcagctggcggcacggcggcttccccatggactacggggcttacagcagcgccagaccaccacgggccccgggtttgggcggtgttcgtccagnnnnnnnnnntatcacgaacagggcttacagcagtgccagaccaccatgggccccgggtttgggcggtgttcgtccagcagatgtggcagagtgcatcccctccgacccctttcccggccgggcagccaccccggtcaggtcaggtctgggggatgctctgctgcgcagcatggtgcttgaggtcgcgcatgtggtaggcggtacgcgcccgcatgtactgctccgcccacgcctccacgctcatatgcccgccagagacccctgccaccagggcatccgacgccgcctctgcctccttagccgaggcggcgagccgctccaatag

SEQ ID NO: 5755 - DNA, 798 bp, Chlorella protothecoides
  modified_base (248)..(257): a, c, t, g, unknown or other
atgacctcgccatttcctgccccccccaaaaggagcgctcaccacaatcaccgtgccccacagattcatcggctacgtccctggcgaccccacgctgccacccctggacgacgccatcccggccccgaaccccgcctttgcgcagaacaaggtggtggacctgaggacctgggatgcggtggccctgcaggtcgaggccgatcgtttcaacccctcggaccccttcgagcccttccacctgcccgccnnnnnnnnnncgtggccctgcaggtcgaggccgatcgttttaacccccccgaccccttcgagcccttccacctgcccgccatgcctggcgtgcccaccgagaaggtggccaccttcaccgggcacgacccctctgactacctgggcgcccaggccgggcccgggcggggcaggggcccctcgcgaccccgggcacggtccacgctgtcggacgagcagatcctggaggtcatgcgccggaccctgccccaccccggcaggcccatcgcctgggtggacctggggtaccgcaacggaggcctgacgctggctggaaaggaggtgcagctgcgggacctgtgggacatggttcagggcgcgggcgggtttgcggccgtgtgctccacccggaagtggacgagcgtcgccatagcgctgggcgctgacacctcaaggctcaccaacggtgggtggctgggaggagtcaggagtaggacttttcattcatatttgcagggtggtgggagacctcgtgtgggcatgcgggcgctgctgttgggcgcgccaggctga

SEQ ID NO: 5756 - DNA, 2805 bp, Chlorella protothecoides
  modified_base (1999)..(2008): a, c, t, g, unknown or other
atgagtgctggttccagggaccagtacgcgcttcgtctcacgatccaccgagcattgaccagacgaacccttgaatctcagctatgtattgtcccaaccccgttgcaagcatgcagcaaatcagatctggacatgaattgcgcctgttcggatggtagacatgtctgttccagtttcaatgttccgaatccctcccagagatcgcgcccagaagatttccgctggtgtgtcgcacatgatcttgcgtttgtaaagggccataggcatcgggatggagtcaaagctgccctcgacaactacaacggatgcaggctagcttctattgagtctcagatcagtcgaaacgctcttgggcctcaacctcacatggccgacgaggctctgtccttggtctgcaccgactgcaatgcccagctccaatccgtgaaggaagcccaagcccacggcttgcgtcagtggtcccctacaggcgaagccacagggcactcaaacttcgaggagagcaccgaagcgaccacggtgagtggtgttttgcgatgtcgattctccatccctgatcgagtatgctctgcccgtgttggttccacttccaaaagcttgcgtcagtggtcccctacaggcgaagccacagggcactcaaacttcgaggagagcaccgaagcggtcaagcgcctggtctgcactgagtgcagcaagccatgccgcaccatagttgagcaggagctgcacacaaagcgaacagggcacaccacgtttgaagatcaggtgtgtggaatccgttgggtgctgagaatggccattcctggtgttaagcgacatggggggacccgcgctgctgccaaggccatgagcacggagatggagatggcaaaggcgagggcggtggaggcaggggaagggactgacaagaaagatgttgagcttgtaagtcaattctgggtgaatggacgggcatctgggtctcttggattacattcatcatggcgtgctgtgctttcctaccgcagtgcaactgcaggctctgattgccaggatgaatacgcccatgtggagcctgaggtggatggccaagcactggcagaattggaggccatgggctttgccaggaacaggtgtggtgtggacgtcaggtgctgttgcgatgcatacagcaagtcgatccctggacctgaaaacagtctcagggcaggagcgttgatgcgccgcggcgccgtttatgaactcttgggggtacgcgcattgcatgggagtggcaataccggggtagaaagcgcggtggcctggctcgctgatcacgaggatgatgcagacctggacagtcctctcctcctgcccaaggcaagattgcctggctctccagcccccggggaagaagctgagaaagtcggccatactcggagacacccaagcccagcctcacgcctgaggaggccaaagccttggcagcagagctcctcgccaaggccaggtgagggaatgggttggaggtgtgtcgccggtgtggctcagctggatttaaaggggaaaccatcgtgtggctcgagggaacaatgtctaaataccatggcgcacttgcactcctcatgcaataggagaaagcgcgaactcgaggagaaggagctccagcgactcagggagcaagaacggattaggtcggggaaggagctcgctgctgcagcgcgtctggaggccgagctgaagctaaaacggtctatggaggcacggcggctggggaaggaggaggagcgcaaggcgcgggagagggtccgcgagatgctgggtgggtggtgggaagggttgtgcaggacaggcacgcagagaggctccttgtgtcggggattttggtttgaaagatcttgcagaggggcgcgggcgcccacccctctcctgctcccatgcactgcaaaggtgtgtacacatcacagttcctctgcatcactcaattccagtctctgtcaggccatcccaccccttcccctggagcagaggaggacaagcnnnnnnnnnngagggttgtgcaggacaggcacgcagggaggctccctgtgtcgaagatcttggtttgaaagatcttgcagaggggcgcccacccctctcccgcgcccatgcactgcaaaggtgtgtacatatcacagttccctctgcatcactcaattccagtccctgtcagaccatcccacccccttcccctggagcagaggaggacaagcgcgcgcgccgtgtccgcctgggcctcccccccgagcccactcccgaggagctggaggcggagcgggccaaggcggcggagaaggcggcgcaggaggccgccaagcggctgccgcccccgcctgtcatccccgatgcggaccgcctgcgggacctgctggtgggcatgaagcggggcacggccgatgcggcggcggtcacggtgtgcttccagaccctgctgcgcctgtgcggcaacgcggccaacgaccccggcaacgccaagtaccggcgcctgaacctgggcaacccggcgctggcggcgcgcctgctcccagacgcgcgcgccttcctggaggccgcggggtgggcggccgcggaaggggagggcgagggcgtgctggtgctgccgggcgccggctcgcctgcagaggtcgtgcggctgaccgcggcgggtgggcagttgcactccgccctgaacaaccccttcttcggggcgctgtgaaaaaaccggtcacacgcaacgcggtgtcacaggccgggggcgcttgcgcccggcacacaaggggggcgtcaggtgggcaagaagcaggggcaggaggacagcaccgacgatga

SEQ ID NO: 5757 - DNA, 528 bp, Chlorella protothecoides
atgcccgcccgccttgtctttccatggtcccctgcagggccaaaaatacgacgcccacaccgacaactgccggcaccgtcccagcggggaggagctcccccccgcctgccagtgagtctgggggattgcactcccctgctcaggatctccctctcgcagcctaccatgacggccctgagatgccgtgcagggcgtcattgcacgccgccaaacactccaggagtctccccacacggaccccttcacacggattcctgcaggtcattcctgaagcgcgcagggggccctgcgtacggccccggcgcgggcggcgtgtcgggcggcgaccggctggccaccttcatcatgtatgtgcatgcccccgacgagggcggcgagacagtgttccccaaggcgcggaccccgcccgccgccgccggcgaggcgcgggccttggagagcgtggacgccgaggccgacgacccctgcttccgcagcgacacgctgcgcctctcgccggccgccggcgacgccgtgctcttctggtga

SEQ ID NO: 5758 - DNA, 921 bp, Chlorella protothecoides
atgccgcacctcctcccaaccaccctcgatgcagacctgcatgttcctcttgcaagccacccactacaacacctggtgggcgagcacctcacgggctcggcacatggcgtggcggccttgggggcgatcgacggcggggcccccaccggccatcccactgacggtcatcccaagatcgtgtcctctgtcaaggatccccaggaagcgctgcagagcaccaccctgccctccccccccccaaagaaggccaagccagtggtggtctccccacctgacgaggtcatctccgggcagggcccctcgctggaccaggcgaccctggcgggcggctggaagctgaccccagagatcttccacagggcggcgagccaccccaacgcggtggtggtgagcaaggagaagccgtacatcgtccagtacaagggctttctgagccaggccgagatcgaccacctgttggagctgtcagggggtgagccggaacctggcagcgtgaatgagagggcagtacgtgccagcctggagctgccttgtgcccccatcggctggcacaaatcgagcccctgcacccctcggccattcaaccttggcaacgtccctcgtcaccccctcccaacagatggcttcgtgcgctccggcgtcgtgtctgatgagagcgtgaacgaccggcggaccagctatggcgtgtggctcagcggcgcgcgccgggacaagaccgtgctggacctgcagcaccggctgcactcctggatcggcatccctgaggagtttggggagtcgctttacatgctgcgatacgagcaggtgggcgtgaggatggaggggcagagggtgtggagatgttgggagggcttgagcatggggcggaaaggccatgcccaggtcatcaaggtagagtccccagtccagccctgtgactga

SEQ ID NO: 5759 - DNA, 1365 bp, Chlorella protothecoides
atgcaggctggagattgggccttcgtggatggtcatgcagactgcccgtcagtcagtgagggattcaaatcagggcgtaatggatgcaataaatcactgaattgccatacagagtctgcttgtgtagaatccaagccacaaaagctggttcgccctggcccaacattcaaaaggctggctaggaggaacatgcagccgacaatcgcgccagtcatgagcaggatggggagcatgggcaccttcccctgccggcctcgggccctgctgggccgctgcacctgcagggaccccagcaggctctccatgggctcgaaggtgcttgtcatgggtggtatgttttattacacatcacagatcatctgtcgaggcgtggtcgagactgctggaggcatggatcctggcagttggggagcccggcacgagagtcaggaaagggagcgcgtcaacgtgtacttttctctaagagcaatgtcggagctccctgcctcgacagatgtgcccctgctcgctgggtccatgtacgcctcgcgcgcatacaccagtatggcgttccgaggtgtccacacctccagcctgccggccgtgtactccgattccatgggcgcgacctactccaagaccttcaagccatctcgtgactcgtcatcgggcgtctcatggcgcgtgctcacactcctgctcctgggcgtaggggccacggtgtacaccctgcgctcctccagcagcagcgaggccgctcgcgtggcgcggcaggcggcctacgacaagctctaccccggatccacccggtatggcgccaggggatccatggaggagccgagcaccgcccacgcccccgtgcgcaagtggtcccagaggggtgtgcggagggtgctggagtcggagggtgccgtccaggcggaggccgccgcggccaccgtccggccccccgcctccggcttcgacccggagcggcaccagcagtacctggacctaccccccctgcccgccttcccgccctccgagtacatgggcggctgggcgctgacccaggatgtctacgaccgcgcggcgcgccaccccgccgccacggtgctcagcttcgacagcccgcgcctagtcctctttaagtccttcctgtcccccggcgaggtggaccacttggtggacatcagcaaggaccacatggcccgcagcgaggtgctacacgccgacggcgacggctccgtcagcgacatccgcacctcatacggccactggcccacccccacgcccacgacgcacaacatcacggaccggatccaccgcctggtgggcatcccggagaagtttggcgaggacctgtacgtcctgcgctacctcctgggccagcagtatgaggcgtga

SEQ ID NO: 5760 - DNA, 2688 bp, Chlorella protothecoides
  modified_base (1900)..(1909): a, c, t, g, unknown or other
  modified_base (2417)..(2426): a, c, t, g, unknown or other
atgaccccagatcaggagttgaatctttgtatcaccactattttctgcctgccacgcggcatgcctctcactcactcagcccttgtgaagacgccacacttcacaagcatcccttcatcttgttgtatacctgggcagagacattcccgtgtgctcatacccaaatccctctcagcacttgccctgctgagcttatcgttgctttcaagaccgctctctatcatgccatgccgtgctttccaacgttcaagattgagttccgatccgcttggcctgtgccgagcaggtcgcgatcgagggtctcatgtccccacctgcgaatccttcccagcacattcgacccttccagcaggcgaaagtggacatcatgacgatgctcggcctgaccccttccgcgacctgcactttccgggggactacccgtcccttcgtgccgcgcacggcctgcagggctcgccaggccatcaagacgcccactcgtgccatcgcggaggtcaacctggtcgtcgggggtacgtaggaaggttgatgggatcagcatggccctgcaggatcgtgcgggggactttgggctcgatcgatgcgctggctggagggtacatgcttgtcccacatgcaagatatggtggccttttggatttcgtgccaagctcaggctgcatacccttccttcctcatgcggaccacgattcacgcgaatcccacaggtttgtattccttcccttccaccgcgacaacctggcacggcagggtctgccccgtcagaacggcatcacccatgccgaggctggcgacagaggtgcggaggaggcgaccttcctgctgaagacgaacgatcccgctggcttcaacatcatcgatgtgagtgctgtagggtgtgctcgagagcgcgtgtggtctggggctgctcctggcggggagcagctggggacccagtgcttgcggatgtctttgagatgcagagcttggtggccattcctgccgatgtacgtcttcccttcagctcctgagtctgcctccccccaaaaattctcatatcaggtgctggcctggggcgccctcggccatgcagcagctttctaccttctggtgcgtctggtgtggtcatacagctgcgttgcaaggcgtgcttccaactcaccgctgacatggcgtgcaccgtctctcacatgcatttaccccgccgctgcgcaggccacgacttctctgaacagcgcagctggacccccgggtcagttcttacattgtccttggctgcaggccagcaagggcatcggctgccggcaggaatcacgagctcgtaacgagaacggagaagggcgagacggtactgtcaggtcgcagtgctttggcagaagcctacaccgcatgggtacagcggaaaatcaaatgaatgcgtcttgtgagctgggtcagaccttgagccagtgcgcttggggccaggggtctttgtcggggaggccacccaccggcggcggcagcctggctcatggctcccgcctgctggaggagtcgttccttggacccatgctcaagccgtgttgggcgggacgtaatcgaagcctgcgccacgtatccaccgtgtcacgatccacttctccccctccagcaccgggcagccgctgtgcagcgcctcatacacaggcgtggcggatgggtctgcagtgccgtcctcgtacgacccctgcccagagccgccgcccggccggtagtccctgccgagaggtcgtgagtggggagctgggtgttcgcatgctcagggtggtgtgtgggggggggcaactgagcgacgcgcacactggactcaggggcatcgctccggacatcatgcagccaagttcagaggtgccaatgaagaataacaatcgatatcatcttctgcagtgcatgaagccatggnnnnnnnnnnggggcatcgctccggacatcatgcagccaatttcagaggtatcaatgaagaataacaatcgatatcctcttctacagtgcatgaaaccacgacatggtctacattccatttcccagagtctcaccccaagccctgccagagtgtctcaccagaagagcagggcgtcccctgcctcgggggcagcacccaggaccccagagtccttgcagtaccaggagtcgtctgccgcatggccatggttcttgacagatgcctgggtgatggtggcctctggaaacactgtgtggccccccttggacggatgcctgtggaaccctggagagattgcggcccctcatccaggcctcatgttcttagagaaagactcaaacgtgtacgtgtacccagccccacatcctcatcacggctccacaaaacacgcacactcacttgaggacgaggatgaaggtcgccatccggtccccgcaggtctcgccgccgtggccgggcccgcactcgggaccccgcnnnnnnnnnngtcgggtgacgtcggaatgcagggaaccctagagagactgcggcccctcatccaggcctcatgttctaagagaaaaactcaaacgtggagggaggcgtggatggcttggacttgggtcaaggtcatggagtgcacggatttgatcagtcaagcgctgcccccatgccagcaggtgtgctactccagaagatgcgactggcgctatggctatcgccagctgagagcatgtgggcgaaacctgtcctcctgcccctccccttga

SEQ ID NO: 5761 - DNA, 273 bp, Chlorella protothecoides
atgtcgataggagaagaaggcacacggggtgtctcctcggtggaagtgtacggcttcgtgggctggatatcctccttcgtggcctacgtgctatacctggtgtgggcctacacacccccgcatctccttgcacgcatcggtgtgacgtactttcccaccacctactgggccctagccatccctgcctggggctgcgtcacagtactctgcgtcatcctcggctatgaagcgtgcgtgggtgggttgctgctgcgcctgctgcttcccggttga

SEQ ID NO: 5762 - DNA, 453 bp, Chlorella protothecoides
atgtgcgacgccgcggtcagggaaggggtggcagcctgccccttcctccgcagagtagctgccacgcagggccaggagtttgccgtgcgcctggcgataaacccactgaaacccgttgtagattgcggaccatcgtcccccctcttcccggaggatgccatgtccttccagtctgccttcgccatgttccacggggcgcgaggtgtcatgcctctggccccgtcgacggcgaggacgacgggcagctgctcccacgcgcagcccaaggcgcagccgagcagggggtgcgacgctccatccgcgccacagccttcgctgagcgggctgccggtagcttccatgagcatttcaggcttcgggaagctggtgagtgggaggttgtgcagcactgatggggtgcaggcacttcgtcacgtggtgttgtgcagtctggatcagggcacggatgtgtaa

SEQ ID NO: 5763 - DNA, 570 bp, Chlorella protothecoides
atgacctcacgcctatgcaggtggccctcctgctctgggcctacctggcaacctttgctgccaacccgggactggtgccccctggctggcagccttttgagctcgacgaggtgggttgtttgtttcgcgcggtggggattccagctggagaggggatttgatgtgtggcgatgtgaactactgcgcgaaggacatgcaaagaaatcgagtagctcaggactacgaggtcaatgtaagcgcgcgggccccagcaagccttggaggcaggggcgagggggtccgtgcgccgtggccagcctttgctccgcccctcggtggtggccctctgaatcaggccccctcactccctcccttcctcccggccgtcgagagcaggagcagcaggtcgggagcgcagacctgcaggccctggccgacgacttcaccgagctcatccgggactcggaggacccagtgcagtggcacctgctgcgcccccgcttctgcaagaagtgtgcggcctggaagccgccgcgggcccaccactgccgcatgacgcagcgctgcgtcctcaagatggaccactggtga

SEQ ID NO: 5764 - DNA, 567 bp, Chlorella protothecoides
atgcgggacctgctgtcgtacctgcccccctccaaccgccacgccgcgcccctagtcccctcgcgcgacccccccacccgctcctgcccggcgctcaactacctggtcccggactcagatgcggaggcgtacgacatgcacgccgtgctggcgcaggtcctggacgacggtgcgctgttcgagatcgcggccgaccacgccaagaacatcgtggtcggcttcgggcggctgggcgggcgcagcgtgggcgtggtggccaaccagccggccgtgctggccggctgcctggacatcgacgcctccgtcaaggtgcttgagagggggatcggttgctggaaaggggagatttcagtgttgaggcaaccggatgtcgtcgatcgcatcaagccatgctggagcggcgcggttcgtgcgcttctgcgacgccttcaacatcccgctggtgacctttgtggacgtgcccggcttcctgcccggcaccgcccaggagtacggtggcatcatcaggtgtgctgggtggggaggtttgcggcggcgcccatggcattggtttctcatgcagcctga

SEQ ID NO: 5765 - DNA, 225 bp, Chlorella protothecoides
atggcgaacatcctacgacagggtctgggtgtggcacggaccgccctccagtatcagcagcgccggtttgccggcaacctgccggtgaagccgaacaagttcgtggaggagtgggcgacgcgccgtgagctcatcgagcaggagttcaagtgggacaggaagaccatgacgcaggtcctgaccttcggtctcctagtgccctatgccatatactccgtgacgtga

SEQ ID NO: 5766 - DNA, 294 bp, Chlorella protothecoides
atgtcgcccgtgggtgcagcccagcatgcggctgaggcacctctgactggaagcagggcactccagctccccgccccgctttcctttcgcagcgtgatcctgctgctcgggcccacgctgcgccagttcagaggcacggccggcccgctgagcacgctgctgctggccttcacagcctttgtcttcgcagcggcgttctcgctggccctcctcgcctttctcatcatgcacctgcgcctgatcgcccgcaaccagaccaccatcgaggcctttgagaaggcgccggtcaagtga

SEQ ID NO: 5767 - DNA, 180 bp, Chlorella protothecoides
atgcaggtgcccgacaccgctcgccggcaacaggagttgaaggcatcccttccggtcctgcgtgccgagatcgcgcgcctgaatgccccccagacatttgtgcagtgcgccaaagcggagcgtaagctcttgatcatggagcgcgagctggagcgcctggctgaggtggaggtgcgctga

SEQ ID NO: 5768 - DNA, 771 bp, Chlorella protothecoides
atgcctcatgtcaccatggcacacaggggcctgtttgagcacctcgacaaggccgaggcgctgctctcgaagcagcgctacctggccggcgatcgtttcaccgaggccgacctccgcctcttcgtcaccctcatccgattcgacgaggtgtatgtggtgagcagcctgggccctctccggatgggggacctagccgtgaggccagacgccatatggggcaggcatgctgggtggagtgagggtgcggtgtccatggtgtggagttccttacccttggcaccgcaacggtccgctgcaggtgtacttcaagacgaacaagaaggccattcacgagtaccccaacctttgcaaccacacgcgcgatgtcttccagatcccaggcgaggtctagtgtgtgtgcagggcaggagggtgacagaggggcagggggaagccctccactcatgtgggggtgtcagcgatgaccaggccctggcttgcatgtgggcctggttattacagctggtgtccgcagaccagcaggagtggtcgtttctcgcgccatgttgggtatgtgcaccgcggcgcatgccaacatgtctagcccagtcactctttaatgcccgtgcaatcccttgtggccttcgcagaggtgaggaagagcgtgaacatcgaccacctgaagcggcactactttaccagccaccccaagctgaacacctactccgtcataccggtgggcggggaggcctggtgggagcagcctcacgacagggagcgcttctcctctag

SEQ ID NO: 5769 - DNA, 2601 bp, Chlorella protothecoides
atgacatggtccaaggccggcatcctgctgcgcacacccaccaacatctgcgccatcggccaaggcctcttcggctgcatcccctggggcatgctgctcaccttcctcaatgacttcctggcccaggagcgacgcctgagcgtccaggcggccaccacggtcctgctctgcatcggcatcggcggcgccctgggcgtgctggggggcgggctcctgggccagtggatctacaaccgcaggaaggccgccatgcccgtgttcatcggtgagcgcatgcccagaggggttggttgtgggatgcgtgggtggggtgggtgggcgggaggcggccgcaggattcctggcctggcctccggggcagcagtgagggcgggccggtcatcgctggctccatgctgcgtctggctgctggggccgggccaggcctgccgcaccaccccacttggctgtcaggctcaaccacatcgctcccatcatctccccgctccgccgcccccgcgctcaaagctgcttgagcaccatgctgggcacgctgcccatgtggtacgtgctcaacggcgacgtcggccggcgctacacggcggcgctggtggcggccctgggcgtgggcttcgccagctccaccatgggtcccaacgcccgggccatgctgctgaacgtgaacgagccggagatgagggggctggccctggcgctgcaaagcatgctggacgacctggggaaaggcagcagcagctgccggcagtgggaggggttgccgggggaatgatactcccacatgtctgggagggtgtcggtcccaaggtgggtttattgctatggttggagacgctatctggggcgacggaaggaccccccgcccccgcctctgacgaccgccgtgagagcatttcccccccttcctgcccaggcctaaaaggtcccatccaccaatacccccccaccctcctctcctctttgcgttgcaggcctgggaccggtgtttgttgcggccctgatctctggcctgggtcgaacggcggcgctgaacgtggcagctgccggctggctgccctgcggcgcgctcatcctgctggccgccttctcggtggagcgagacgaggaggcggtgcaggccaggctgcgccagtcaatcgtccgcatggcagaggaaggtgtgtgggcgtgggtcggggagcaaagtgggccaagaggggtttgaatgcgggggagggagcatgcatggcgaggaggagcaggccctggtcgctaggtgccatgctgtgggatgccaggtggaagcttgggggggatggcagtgtggcagtgagcatgctgatgacaaggacctgctcaaggtatatgaggcccggcaggtggcattgcggatggtttggacgatcacccatcacaaagatttcgtactcgattgacgtcgtgcacgtggtcacccctgctcaccacctacctcaccgtgacagtgggagagcgggagctactcactgctgccgggtctcagcactgatgcagggcagaggctcgccaacatcagttctgcagcaggttgagaccatgcgtgcccaggagactcattgtcttcacttttcgtgtgtgcgtttccccccctctgctcctgcttccaagatgtcggcaaggctgaccggctggccggaaaatctgttacaagttgaagagggccacgagcagtataccactgcccgcctgctcatacatcatctaaaagtacaggccgtgcagcgtcagggggagcagggtgggctcgagcacggtgcgcgtggcaaagtaggccagcgtgcccagcgcgatggagatgggcagcgcgggcagcgccgagtgcgcgaccgagagccagagcagcgtgcaggccagccccgccacgacagcgaggaaggccgcgccggcggccagcgcgctgtgcatgctggcgcgcgccacgagcaccgacggggtgcggtgatggggcggggcgctgctgggattcggggccggtcgctgtgccccgcagcaggcctgggtggtctgtccgggtccacagcgagatgggaaagggtggtgggccgtccggctggccggaggtgctcgaccggggccgcagcaggcgctctgattccaccgcggggcccggcgaggcgtcgtccggcgcagtctcgcgtccagcctggaccgccagctctgcggggggcgccctggagtcctgactacatcaactcgcaccatgccctccacgcccgcccacctgtctcaccggggacgggcacagggcgggcaggtctggccaggagcgggcctgcttcagcgctccgtgcgcccgccgcctcagcagcacctccggcgggccgggcggagtacaccagggccgggatggggtcgccgctctcgctggccaggtccaccagctccttcagggggccccagggcgccagaactgtgcggaaaatggcgatccaggagggtcagggtgaagggcgaagagcctctgcaccccactcgggagttgcctgtccacatgcaggcacaccagatggtgtcaagtgccccacatgtcgcgactccctttccccctgggagctgtgcaacagaggctgtctttcaatcccatag

SEQ ID NO: 5770 - DNA, 381 bp, Chlorella protothecoides
atggtgcgtgggaaggggcattcgttggcgcttggccatgccgacatgatgaccagtcccaagctcatgccatgccatgtaccttgtccgccagccaccagtcaatggcctgcgaggccgacctgccgcagcccagccgtccgagaacacgcgccactagtccctgtcctcccaccactcccatcctcccaggctccccccagcgtgggcgacgcccccctggtcgtcgacatgagcagcaacttttgcgcccgccccgtggatgtgtccaagtacggtgtcatctacgccggtgagtgtagggtgctgcgacatgcgatgtgggtagcaccttcaagtgtaggatgcgcacggagcatcgtcgacagccgcacccgctag

SEQ ID NO: 5771 - DNA, 654 bp, Chlorella protothecoides
atgtcggcatggccgagcgccgacgaatgccccttcccacgcaccatgactaccatccctctcccctcgtcccacatccaagcctctcccatcaccccgccttccccccagccctacaaacagcaccttgaactccacgccgccgatggtctcgttggcgcagtagtgcacgtacttggcgccctcggtcaggttccaggtggaggggtcgggaatgctcttgttgtcgcccgtggccgcggcgttggcctgcaggaagcgcttgccctcgccgatggccttcttggaccaggcccccgtgaccacgtagtccgccttgtcgccctcctccgccaggttcagggggatggcggcgaactgggtggaggccccgccctgcaagaacaggaccttgtagttgtccgggatggagagcaggctgcgcaggtcggcctccgccttgtcggtgatggcgatgaagtccttgccgcgatggctcatctccatcacgctcatccctgtgtgggagggatgaagatcaaggggtgggcgcggctgcaccgaggtctgatggcctggcaagcaggcaggagcaggtgggagactgaaagggcttggttgcctcccgacccgctgtcgcagagtccattcgagacgcttgcgcggatggcgtga

SEQ ID NO: 5772 - DNA, 1482 bp, Chlorella protothecoides
  modified_base (43)..(52): a, c, t, g, unknown or other
  modified_base (151)..(160): a, c, t, g, unknown or other
  modified_base (234)..(243): a, c, t, g, unknown or other
  modified_base (639)..(648): a, c, t, g, unknown or other
  modified_base (1260)..(1269): a, c, t, g, unknown or other
atgtcagtcctcgatgcgcgctggagactctgtcaagtggacnnnnnnnnnnagaccatgacctgtggggcaaaggaatggggggggcgtcatgatcgtctcctcaccatgtcagtcctcgatgcgcactggagactctgtcaagtggatnnnnnnnnnnaggcacgacacagtagccctgcgccgggaacacgagtcgtgccaggagtgaggacatcagcacgccctacaatnnnnnnnnnncccctcctccgcacaagccaagcacgacacagtagccctgcgccgggaatacgagccgtgcctggagtgaggacatcagcacgccctacaactcgactgaagcagcacagcatggcccctggcaggacgaccgacatgacattccagacagcctcgccaggtcctccacctgaggaaggaggtggtggggagggggggttgtggggcgtcaagagtcgaattgagaatgttgctggcagtgccctgcttgtgcgatgctgggcctcagaatcccacttcttttgggccttgagataccttgcaagatgcatgttcacaaaactgttcgaccccaaccccccccaccatcccccggtccatgagtgggttccttcccctgaccccccgaacacctcnnnnnnnnnncctcgccaggggacacaaccacaccttggtggtctgcgtggcggagaagagggccgtctggcgctcccgcggcagcagcttcatgatctggcgcatctcctcctcaaaccccacctccaggatgcggtcggcctcgtcgatgaccaggcaggccaggttgcgcaccaggaaccccttggtgttctgcaggtggtccagcaggcgccccggcgtggccaccagcaggctcacgcccttggtcaggcgctcagcctcggcccggcggttgcccccgcccatcaccaggccgtgggtctgggagtggcccatcatgaggtccaccgccacgttgtagatctgcagcgccagctcgcgcgtgggggagatgaccagcacgcccgtgccgttgcgtggcatgaacttggcgcggtacagcagctccagcgccgggatcagaaaggcgagcgtcttgccggagcctgtgcggggaatgggtgcagtcttgcaccttcagggagtgggaaagactaccctagccccaaatccgaccaacgcagctgcagggcggcctgctggccaggcaggtcagcagaaaagcatgctggagaatctcagagaaatttcgcagggcannnnnnnnnntccgaccaacgcagctgcagggcggcctgcaggccaggcaggtcagcagataagcatgctggagaatctcagagaacttccccagggctgacagcacgacaacccagcgccgtttgcctgcctggaaatcctcaagagggtgccccccgacctcagtctcaccagtcttggcggcacccaggacatccttccccaggaggaggggcgggatag

SEQ ID NO: 5773 - DNA, 1023 bp, Chlorella protothecoides
atggtcttctgctcctcctgcaatgccgtcaagtactactccgacctgctcaactacatcgatatcccggtgaacgccatccacggcaagcaaaagcaggccaagcggaccgccaccttttttgagttctgccaggtgtgtggaaatttgggttggctgggagagcatcagtgggacctgcgtgaagagggaggccagttgttgcgctgtgaccaacatacccagcgacccattgccatcgccaggccaccaccggcatcctgctgtgcacggatgtcgcggcgcgcggcctggacatccccgccgtggactggatcatccagttcgacccgccggacgaccccagggagtacatccaccgcgtcggacgggcctgctgaggaaagtaacccacatttattcaccttgctgagcctcccagttaagaacttgcatgatctccacaggacggcgcgggggaggagcgggaagggcaaggcgctcctcatgctgctgcccgaggaactcaagttcctgcagtacctcaaggtgagccaaaccagcgttacttcaccgaaaagctggcagtgcagggcactgcatggggtccctcaaaggtctgggatgtacagtgtcgtggggtacaggcaggagctgcttgtgcatgctgcttcccactcgcatgacctgccctcaaccatcctcaccccccctgagttcaggccgccaaggtgccgctggcagagtacgactttccagtgtccaagctggccaacgtccagacgcagctggagaacctgggtggattcctgggcgacgtatgctcaagtggtttcagccatcatgcatccaccaaacactttcctggctgagaccaaccttgtgcacaacccggcatcctcaatcacacggtgcaggtcgtacattctggcctacaactcccaccaactcaaggaggtgttcaatgtccacgctctggatctgaaggcggtggcacgtagctttggattcgagacacccccaaaggtgtgctgtgggggttaa

SEQ ID NO: 5774 - DNA, 702 bp, Chlorella protothecoides
atgcggcaagagagccggccctctcacctgaggagaacttggcatctagaatattcaatacgatcatggccagcgatggggagcaaagcctcacaggtgaggccgctgccgtcgtaccaggcacatcccggacgtgtgcagcgacatcccctggagtggatgccggtcactatctgcatcttcccacccactgccattcaaaccactgcaggcacacttgggacgcacaatggtgccgggagcgtcatgggcgccccctcacctcgaccagccaacagtctgtcgcagatgaccccaggagcttcgcagcaacatgggggatactccacacagcctacccccgtgggaagagcggatctgggctactacatcggtcaccgtcccaacactgtctctgggacagggcgaggttcggtgctcgcgccctcggaatcctttgctgccatggaggatgcagagggcgacgctgatgccaccttcatctggggcaccaacctctcagtgagcagggtgcagtcccgcttcacatccttcatcaagaccttccgcctccctgaagagttcgaccccaagtacctgcagctgctccaggaggtggggtgcacgggacaggctccaggcaattggagcttgcatcgggtttggcggggtgcctgggagctgagcccctcggcagctggccagggaagatgtggagactga

SEQ ID NO: 5775 - DNA, 987 bp, Chlorella protothecoides
  modified_base (397)..(406): a, c, t, g, unknown or other
atgctcaccctgcaggcacgcatctacaacctgctggagatcaaggtgatcagggacttgaacccctcggacatcaaccgcatgatcgccgtgagcggcatggtcacccgcaccagcggcgtcatcccggaccagaggtgtgatgaggagggtggggggggcgggggggtccgggagctcagagtggagctgtgtgacaggaaacgggcagtgcctatcgagtcagatgcataccagagaggctgccggtggttggttccagcaagcgcggcgatctcgtgcattcatgccatgccagggtccttgcatcacattccacatcccccatgcggagccgcaaaccaatcccctccctggtcctactttgcagcctggccctgttccgctgcatgcagtnnnnnnnnnnctcatgccatgccagggtcctcgcatcacattccacataccccatgcggagccgcaaaccacccccctccctgccccctacttcgcagcctggccctgttccgctgcatgcagtgcgggcacgaggtggtggagtggaacgataggggcaaggtgaacgagccctccacctgccccagcccctcctgccaggtgcgggcaggggtgtgtgttgcctggggactggagtgggccgagcgggaatgcccagggggaatgggagtgggagcccgcctgggcctgggcccggcactagggagcacagactgcactcaaggtggcagtggcatggacgtcgttcacccctacaccatgccctgccacaccctccacatgcaatcctcccaccaccacccatcctgcgctgcaggcgcggtacagcatgcagatgctgtacaaccgctcctgcttcctggacaagcagctgatgaagatgcaggagaaccccaacgacatcccggagggcgagacgccgcacaccgtcaccatgttttcacgccaggcacgcttgcagagggcgggagggaggcgtcagggacctga

SEQ ID NO: 5776 - DNA, 1095 bp, Chlorella protothecoides
  modified_base (137)..(146): a, c, t, g, unknown or other
atggctgactctcctgttcaatgcttgccgtctgccgggtgtgtgtcctctggaggtaacctgatggtctcatccctctgcgacatcaccctcagtcggtctaagcatctcaatcagacacgatttgcgaaacagannnnnnnnnngccgtctgccgggtgtgtgtcctctggaggcaacctaatggtctcatccctctgtgacatcgccctcagccggtctaagcatctcaatcagatacgatttgcgaagcagctggagaagcaaaagactctcgctgcgtgcccatacacaatgatgtcgaagggctggaccgggagcctcgtcattatggcctgcctcgccgtggcagtggccgggccagacctgagtaactttagagccgtgttccagacggaccatggagacatccacatggccttctatgccaacaggcccctccttatcagcttgccctgcacccctcaggtcgcacccaagaccgtcgacctcatatacagtctcatggaggctggagcatacaacaccaaccatttcttccgcgtggataagggcttcgtggcgcagactgcggatgtggccggcggccgcctggcagccatggactggcgtcagagggtgggaagcttcttgagatctggcagcaaagcacgtgcccctggaggtcactcccgcggtgaagcacgacaagcgcggcgtgctttcgttggcgaggcacagcgaccccgagtctgggggctcctccttctcaatcctgcttggcccagccccccacctggacatgcagtacaccgtgtttgggtgcgccccggcatggaggacgagcctgggtgggctatgtcattatttcgtgccatgggtgtgccaagcaccttggctcccctggccagacccgccaagtcgctcactcctcaatgccccaataccgcccccgtccacgccagtgaggtgaccgaggggtgggacacgctgacggcgctggagggggtggagaccaggcacgagggcatcttcgtcatgcccacctcccgcatcaccatccactccacctacacgtgcgcgacggctgaggtggaaagagggaaacatggttga

SEQ ID NO: 5777 - DNA, 1965 bp, Chlorella protothecoides
atgaggggtgggtccatgatcgggaaaaagctccacgcccctcctgctatgtggcttgaggccggttggggccggaggactagccctggcgtgctaccatgctcagcgatcccctctcacaaaactgcagcttcaaacaagtctttgggatggtatcgtaagcatggacatgagttagacattgcatcatgcgtggacgttgggccatcccctcgtcccgtcgcgcgcgctggtctctctgtttcgtcgtcaagcaggaccagaagaatctgcgtaacgcgtctcaacctttggtggcattcgcaaagattgcttctgagcgtgcacgccatggcggactcccggttgtgtaccatcctactcgtggtggcatgcctgttgcacctgggcaatgcatctcgtccccacatggagcatgcattgcgtgagcacgatgacgttcctgccctcacatccgcaccatggttttgccatgacatcgactgccccaagtacacggtcgtgaacacgtccacggattacgaggtgggtgatgggccacagacagttgcggggcattttcaccgtgaggcgctgccctgggattccaggccggtgtgccggtgcatgcacccttgggacaggctctcgggccaacagatccctcgcccgccgtcgcacaatgctgatcgcgtcggtgttttctccactcttgcaggtccggcactacaaagcatccgcaagacgctttggcctcaagtatcaatccgcgcacccctctccgacacccagcaacctgggcatccactgatgtccaagcctatgcgactgccctggcttcgaccgtcggcttcaagccatgcacatcatctcatacctcctgcccacggccgtcacttgcccaatgccgaacagcgcctgtatgcctacattgggggggccaatgaggaggaggtcaagatccccatgacatcccctgttcgtgtggaagtggaggccgcggccggaccattctgcaagaacaatttcaccgtgtccttctttgtgcccttctcctacgaggtcaactcactgactccacaccgctatagaaagcaagatacagatgtcgagctcatgtactgttcgccctccaggttgggaaccattgcagctagcctgtgcattcccaccttgacccatttacacacaggggaaaccgccggcacccaattccacggatgtctacattcaacatccttccctctgcacccacaggttcctgccttcacggcatatgtgtcccagttcggggggtactacatggatgactggtccatctccaagaaggcaattgccctgctcgaggtaccaggggtagccagctcactgagaactcaccatgctatcacatgccactcaacatcccgcccgcaggccatccagcgtgatcatggcgcggtggagggtgatgggtacacctttgcagggtatgaccctcctttcagggtgagtgtgggcgtggatgcccagggagcagcggatgggagggcaggggttctatcccccttgctccccctcccacgtcatggcagctgcaaaaccgccataatgagatctggatcagagccgctgagcaagtctgagacatgggcagcagccaccctctgtcccagaggagctgctgccttctgtaccccagccacgctatttgtaaaaagctttttgaggtcttgtgagaatgttggcaaggtatcatggacacccagcaagtggggcgcaaaaactgatgtagacatttaccaagctctgagactctcacaagatgatgatgaagagcacggcgcagcgcgcgcgaaagtagggtggacgttgccactcccgttccctgccagccaacgcccacacccacaccggttccctgaaactcctttccgctcatttcacctcgtcgaccaccacaatctcattcgaggtcgaatcagaaactcaactctttacatctga

SEQ ID NO: 5778 - DNA, 1476 bp, Chlorella protothecoides
  modified_base (313)..(322): a, c, t, g, unknown or other
  modified_base (743)..(752): a, c, t, g, unknown or other
  modified_base (1225)..(1234): a, c, t, g, unknown or other
atggacaacatccggtttgcggagtcggggctgcgagacaacgtggcgcaggtggccacctttgagctgctgccagccgaggagcagggcagggagcgggagggcagccccgtccccagcagcccccctccctcccccggccggccagcgtcgttgctgagggaggaggtgctgcagcagcagcgctcctgggcccagtggcagcgccggcggaggcaggcggccggggaggggagcggacaggcgtcccccagacagccggggtccgacccccccgggtcgaggggcgaggccacctccgccgccgccgccnnnnnnnnnnggccggggtctgaccccaccgggtcaaggggcgaggccacctccgccgccgccgccgccgccatcctccccttcaccttcatagtgagcaatgtgcacgtgctgttcaaccccaagcgcggcgacgtgaagctggcgcagacccggaacctgctgcacgcggttcatggtgcgagccgccgcgcgggcggcgcgccggccgtcgtctgcggcgacttcaactcggcggcctacagcgacgttcactgcttcatcacctcgggcgagctggggctgcaggccgtggatcgacgctgggcgtccggccaggtgcggggcggtatgtgtgtcgagccggaggtgggagatgaggcggagccggcgcgtgcgtgcgtcgactgctgtgtgttgtgcgtcgggcgatgtctacagagaggcgtggnnnnnnnnnncgagggagaggcggcgcatgcgtcgactgctgtgtgttgcgcgtcgggcgatgtctacagagaggcgtggcacgctcgacacacgcggcatcgccgtgtgattgcgctgcccaaacccaggccggtactgagcacacccctgccggcctgcgctgccatcgcaggtcgagggcatcggccgcggctggtaccgcatgcgccggcgcctgctggacgagctggcgtccggggtcattcgcggctacgcccccaaggtccccgtcccctggacggaggaggagctggcggtggcctttgcgcgcctcaggtcccggccgggcgtggaggaggaggggggcgaggagttcgacggcgcgggggcgggcgggctgaacggcgcgggggcgggcgtgggcagctcggccggcggaccgcggagtggcgactggatcccggacggcctacccgacaccgatccaaggaggaagatgctnnnnnnnnnnccccggccgggcgtggaggaggaggggggagaggagtgcgacggcgcgggggcgggtgggctgaatggcgcgggggcgggcgtgggcagctcggcttgcgaaccgcggagcggcgactggatcccggagggcccacccgacaccgatccaaggaggaagatgctgctgacacacccgctgaccctgcactccgcgtaccaggccgtgacgggggaggagccggtgtggaccacctgccatga

SEQ ID NO: 5779 - DNA, 1029 bp, Chlorella protothecoides
atggggcccccagcctggagccgcgcggcgtgctgctgccgcccgtggcgcagtcgctgcgctcgggcctgcccaatgcgcactggcccagcgaccacgtctgcctggtggcggactttgacgcgcgcagggcgtgaggtttgctcatttcttttgtggagaaggctgctgggcggctggactgcacctccatcacagagtccagggtgtgcccttccagcactggctaacccgcagcatgcgtccttgttgtgggctttgacacacaatccccaggctgctgggcggctggattgcacctccatcacagactccaggcacctcccccctggcaccgctcacgagctcaccggcgacgacagggcgtgctccttacacagtccagagtccagacaggcacaaatggcacggggaggacctgccacacatacgcaacactcactcgtagatctgggagtagaggacgggggtgttgtccaccaggccctcggggaaccagagcgccagctccttctgcgcgttctccacagtgtcggagccgtggatgatgttgcgcccgatgtcgatgcagaactggccgcggatggagccaggatcggccgccagggggttggtggcgccgatgatcttgcgcgcctgctccaccacgcacttgccctccagggcgatggccacgacggggccgctggtgatgtactcgatgaggcctcgccgctcacacagaatgcatctgccacaccccggaccaagttccccacctccgaagaagggcttggaggagaggtcggcgtagtggcgctcggcgtgctccttggacacgttcaggaacttgaggccacgcagggtgtagcccttttgggggagggcagattgagaggggcttgcacggattggaaaccctctgctaacgtcagcgacaccttgcaggaacccgcccctccttggcagccgtgcttgctggccccaccttgctcaggaagcgctccaggattggcgcgaccagaccgcgctggacgccgtcaggcttga

SEQ ID NO: 5780 - DNA, 1476 bp, Chlorella protothecoides
atggcaccactcatctcctcctcacccccccacacccccccacaccccccacacacaggcctcatcgagtacatcaccagcggccccgtcgtggccatcgccctggagggcaagtgcgtggtggagcaggcgcgcaagatcatcggcgccaccaaccccctggcggccgatcctggctccatccgcggccagttctgcatcgacatcgggcgcaacatcatccacggctccgacactgtggagaacgcgcagaaggagctggcgctctggttccccgagggcctggtggacaacacccccgtcctctactcccagatctacgatgctggaagggcacaccctggactctgtgatggaggtgcagtccagccgcccagcagccttctccacaaaagaaatgagcaaacctcacgccctgcgcgcgtcaaagtccgccaccaggcagacgtggtcgctgggccagtgcgcattgggcaggcccgagcgcagcgactgcgccacgggcggcagcagcacgccgcgcggctccaggctgggggccccattcggctccaggctgtagaagatgtagtccacggtgcccatgtagccgtcatggcaggtggtccacaccggctcctcccccgtcacggcctggtacgcggagtgcagggtcagcgggtgtgtcagcagcatcttcctccttggatcggtgtcgggtgggccctccgggatccagtcgccgctccgcggttcgcaagccgagctgcccacgcccgcccccgcgccattcagcccacccgcccccgcgccgccgtccgggatccagtcgccactccgcggtccgccggccgagctgcccacgcccgcccccgcgccgttcagcccgcccgcccccgcgccgtcgaactcctcgcccccctcctcctccacgcccggccgggacctgaggcgcgcaaaggccaccgccagctcctcctccgtccaggggacggggaccttgggggcgtagccgcgaatgaccccggacgccagctcgtccagcaggcgccggcgcatgcggtaccagccgcggccgatgccctcgacctgcgatggcagcgcaggccggcagggacatcgcccgacgcacaacacacagcagtcgacgcacgcacgcgccggctccgcctcatctcccacctccggctcgacacacataccgccccgcacctggccggacgcccagcgtcgatccacggcctgcagccccagctcgcccgaggtgatgaagcagtgaacgtcgctgtaggccgccgagttgaagtcgccgcagacgacggccggcgcgccgcccgcgcggcggctcgcaccatgaaccgcgtgcagcaggttccgggtctgcgccagcttcacgtcgccgcgcttggggttgaacagcacgtgcacattgctcactatgaaggtgaaggggaggatggcggcggcggcggcggcggaggtggcctcgccccttga

SEQ ID NO: 5781 - DNA, 330 bp, Chlorella protothecoides
atggggattcatgccgacatgcgcgtggcgtacttggctttggaacaaggcggatgctgggatggtcaccttggcccccaagtctcaccttttccacgtcaatgcaagacctccacacacttccctgctgcccaacaggccccgattgccgccgaactgctcaaggaatacatcgcctttgcgcgcgccacctgccacccggccctgtcctccgaggcggccgaggccctggcgacatcgtacgccgagatgcggagcatgggcatgagccggaaggtgtgtgagataggcatgccagggcttcgttgtttgggggggggaggggagtga

SEQ ID NO: 5782 - DNA, 351 bp, Chlorella protothecoides
atgccctcggacagccagtccagtcggccggccctgcaacgctctgcgcgcgccgggaggagaatgctgggcgggccccgtagcacggagcacggggtcgtccatgagctgagcaaacccgtcgcgggtgcttcctgcacccggtctatgactcgacccagccatgtccgtccccgtgctgccaggacggtgagcaccagcgccgtggcgagcgccgatcgccctaccgcccccaagcttcaaagtcatggccgcgtattcaacttctccgctggccctgcctgcctaccagccgccgtgctggagcaggcccaggccgatctcctcaactggcagggcagcggtgcgtga

SEQ ID NO: 5783 - DNA, 519 bp, Chlorella protothecoides
atgaccgaggaagcctgcggtgatggatgcatgccagggagcgcagccctcgctgttccgttggcaatcgcgagaagttttgatatgtttagaaacctatgttcatcaactgaccgccatggccctgcgtccttgcctctccgcggtgcggcccttccccatcaactgatgcactcttcccctgctcgtgcagctgggcggtaccacctgtatgtcagcctggcctgcccttgggccagccggtgcgtggctggcctgtacctcaagggcctggaggagagcatcggcctgagcgtgacgcaccccacctggcagcggactcgccccgactctcctgacgacacccatgcgggctggacctttgcgagcccgggggacacccccttcacccccgtctccggccatgggtccgtggactgtgcgggctgtgtgcccgacccacactaccatgccaagaatgtgaggcagctgtatgagctcgcagaggacacatttggtgagatgtggcgcgggtggtga

SEQ ID NO: 5784 - DNA, 1167 bp, Chlorella protothecoides
atgtgcttctccgtgttcagcgtcttcttcacgctcaacggcctgatctgcgtggagctgctccaggccttctccctgcccttcgactgggtctccctcaccctcctcctttacaatacggcggtgctgggggcggccaccctgttccacttccccgcccccctcctgctgaagcaggccaacctcattgccgtgggggtgggcaccgccttcaccttcacctttgtcccggagtggaccagctggacgctgctggtggccatggccctctatgacatcgccgcagttctggcgccctggggccccctgaaggagctggtggacctggccagcgagagcggcgaccccatcccggccctggtgtactccgcccggcccgccggaggtgctgctgaggcggcgggcgcacggagcgctgaagcaggcccgctcctggccagacctgcccgccctgtgcccgtccccggtgagacaggtgggcgggcgtggagggcatggtgcgagttgactctcgcgcggcagaggcaaagagagggagtcttgcatggctttgcagggactgtgggctctgccagaccacgtcattggatcagaacgcactgtagtcaggactccagggcgccccccgcagagctggcggtccaggctggacgcgagactgcgccggacgacgcctcgccgggccccgcggtggaatcagagcgcctgctgcggccccggtcgagcacctccggccagccggacggcccaccaccctttcccatctcgctgtggacccggacagaccacccaggcctgctgcggggcacagcgaccggccccgaatcccagcagcgccccgccccatcaccgcaccccgctgcctcagagcgcgggagcgaggatggcgtctggctccccgacggcatccgcttgggcatgggcgacttcatcttttactcggtgctcgtggcgcgcgccagcatgcacagcgcgctggccgccggcgcggccttcctcgctgtcgtggcggggctggcctgcacgctgctctggctctcggtcgcgcactcggcgctgcccgcgctgcccatctccatcgcgctgggcacgctggcctactttgccacgcgcaccgtgctcgagcccaccctgctccccctgacgctgcacggcctgtacttttag

SEQ ID NO: 5785 - DNA, 753 bp, Chlorella protothecoides
atggacaagaaatggcagtttgcacatccagcactccatgcccgatatgcagaagccctggatgcggggtataatctgttgagctcgggccaggagcacgccacactggatcagcgcaagcgcttcctgcggcgcgcccagagctaccacccggcgaaggacgatcgggccagggtattcttgagactggcccggcttctcctcgagcatggcggcgcagcagaggcctacgacctcctcaccagtggggatcgcctgctggagagggacagtgccaggcaggaggttgcgagcctgtgcggtcgcatccgccatcagcagtggactggggtgagtgtcatttggaggggtcagcgggaggtggtggtctgtactagacctgtcaccctgggggagcagcatgcgtgccttgaaagtctgcaggccgcagcctcctggggtacctgcgatgtggtctccaccatctacctcccccgccaccccgatctcccaggcgatggcggatgcatggagcaggggacgcggtgtgtccaccaggacccgggaagagtgggaccctgtgaggaacgaccctgcgctggtggctctggcaggacggctggcaagggagctggcgacggagggagaggcgcacctgacggtacgaccgggaatcgagtaccgggggctggtctgtgcgtgagttgtggtgttcaacgccctgacatgggttggcagtgtcaagcatgcaaacccgtgcgtctggccccttga

SEQ ID NO: 5786 - DNA, 327 bp, Chlorella protothecoides
atggcgcccagtgtcctcgatgacctggggtcagagctgacggctgtcgtggcccccgtcagcatctgcattgccatcacggtgtggctcgtggcagtgctgaaccccgacggccagagcaacgcccgggccatgtcgatcgccaccgcagcctacgccgaggacgtgagcggggaacgtcaccatcttgagggaaaacatgtcctggctgcgaggcatcgggtggcatgccgtgcctctgcccccaattgttgccctgttgactcctggttccccatgtccaggccatcaccttccccatgcttgctcacaggacaccgactctga

SEQ ID NO: 5787 - DNA, 405 bp, Chlorella protothecoides
atggcacccacgctctgggatgtcctggcatggcacatgtcccagcccttcaggcaactgagcttcaacgcccacgcccgccagcagcaggcactggtgaatctggccaaacagttccggcccccgcctgggatggtcaccatcgtcggtgttggcgactggagcgctgacgatcggggggggattatgcggggtcacccgcctggcccctggttcgagtttgtgaagtacttgcgagagttttgcacggtggtggtgatccacgagttccgcacctcaaagttgtgcgcactctgtcaccgccccttgcagccccttaagtacccgccgccgggggcaccggaacccaggtgcccaaaaccagctatgccaccaagcgctgctccaaccgtgactgtcccgtga

SEQ ID NO: 5788 - DNA, 2904 bp, Chlorella protothecoides
atgaggacatgcgacgttcaagctggggtatatccttacattaccaacgcgctggtgcacaaccgttgggtaatcgctggacgattcgaggtacgggtagggtttcggagatttgcggctccgcagagattccacctcaacgacaagagtccagaatcccatcgtactcaatttcaccctgccaatcgcaggatcttgcggagatgtcccgtgacatcgcattatgagcctctactctcgtccaccggatctgtccacggtggtgatcaccacgcggtcgccggtccagattcctcagtcaccacatctctcgcgcacagcttggtcgtacccagcagccggtctaccacggcatacaaaagatcgccggttgagggcatcgacagaatgtgctgtgcagggccaaggctggtgagtcatattgggcgcggcttggccatggagacgggaatctttcttggccctccggccccgtgccggacgctcgcgggtcacgtgcccaacgccagccagacacaccgtgtgaagtcgggcgggagcggaccccctctgtgcatgtggctggcagatttcttgggttttatggttgaagaagccgtttcaatgagaatgtggagcaaacaaacagcagggaggggatggtcaagcatgcccagcggcggcaccgaatcgggagcgggctctcgagccccccatgcattcggaggggtgcgacctgccagtcattcaagcgagcagctgtgccaccagccacgggaggcccaacgggtgtgcactggatcaacatggggtgtaaagtacgcgccgagcttcatcaaccgggcgcacccccgatcaatccaccaatcaggccttgttgtcccccccctcggtgaactcggcgtcgatgacgtcgtcgccgcccgctccggcaccccccgcgccgggcgcggcgccgccctgcgcgcccgcctcgggccccgccccgggcgcgccgcccgcgccgccgccgtacacggcctggcccagggccatggcctccttctgcaggtcctcgatggcagccttgatggccgccgcgtcctctcccggcgcggccttcttcaccgcctccacccgctcctccagcttggccttgacgtcggcgggcgccttgtccccgaactcagccagctgcttctcggtctggtacacgatgctgtcggcctggttcttcaggtccaccagctcgcggcgcttgcggtcctcctccgcgaacttctccgcgtccttgaccatgcggtccacctcctcccccggcagcgtgctggcccccgtgatcttgatgtcctggctcttgcccgtgcccttgtcggaggcggtgacggacaggatgccgttggcgtcgatgtcgaagcgcacctcgatctggggcacgccgcgcggcgcgggcgggatgccgtccagccggaagttgcccagcgacttgttgtcgcgcgcgaactcgcgctcgccctgcagcacattgatctccacgctggactggctgtcggcggcggtggagaaggtctccgtcttggaggtgggcagcgtggtgttgcgcgggatcaccttggtggccaccccgcccagcgtctccaggcccagggacagcggggtcacgtccagcagcacgatgtcggacacctcccccgccagcacgccgccctggacggccgcgcccagggccaccacctcgtcggggttcaccgtcacgttgggcttcttctgggccagccgctccaccaggcccaccaccgccgggatgcgggtggacccgcccaccagaatcacctcgtccaggtcggagtaggaaagcttggcgtcgcgcagcgcggcctccagcggcaggcggcaccgctccagcaggtcgctggccagctgctcaaacttggagcgcgacaggctggcgtcgatgtgcttgggcccatcggcggtggcggtgatgaagggcaggctcacgctggtcgtgctcgtcgcgctcagctcgatcttggccttctccgccgcctcggtcaggcgctgcagcgcctggcggtccttgcgcaggtcgatgccctcttgcgccttgaagtcgtcggccagccagtccacgatgcggcggtcgaagtcgtcgccgcccaggtgggtgtcgcccgaggtgctcagcacctcgaacacgccgtcgcccacctccagcaccgagacgtcaaaggtgccgccgcccaggtcgaacaccaggatggtctcgttggacttgcggtccaggccgtaggccagggaggcggcggtgggctcgttgatgatgcgcagcacttccaggccgccgatgcggcccgcgtccttggtcgcctggcgctgggagtcgttgaagtaggcggggacggtgatcaccgcctgggaaacggcgccgcccaggaaggccgacgcgtcgtccgccagcttgcgcaggacgatggcgctgatctcctcgggcgcaaactctttcttcgcgttgggggatgcgatcttcacgttggaggagccgtcggagaccacacggtatggcacctgcttgcactcctccccaacctctgccatcttgcgcccgatgaagcgcttgacggagaagaaggtgttctcggggttcaccaccgcctggcgcttggcgatcttgcacgacctccgaacgacaacccactcgcaaacccagaaagttctacacagggccacaaactctcccctgatcgtctatacactccccccaaagccctcacctgcccgaccagccggtcgccggccttggtgaaggccaccacggagggcgtggtccggccaccctcggcattggtgatgatcgtgggcttgcctccctccatggctgccaccgcggagttggtggtgcccagatcgatgcccaccacctgcagttgggtgccgtcgcattga

SEQ ID NO: 5789 - DNA, 1884 bp, Chlorella protothecoides
atggagggaggcaagcccacgatcatcaccaatgccgagggtggccggaccacgccctccgtggtggccttcaccaaggccggcgaccggctggtcgggcagatcgccaagcgccaggcggtggtgaaccccgagaacaccttcttctccgtcaagcgcttcatcgggcgcaagatggcagaggttggggaggagtgcaagcaggtgccataccgtgtggtctccgacggctcctccaacgtgaagatcgcatcccccaacgcgaagaaagagtttgcgcccgaggagatcagcgccatcgtcctgcgcaagctggcggacgacgcgtcggccttcctgggcggcgccgtttcccaggcggtgatcaccgtccccgcctacttcaacgactcccagcgccaggcgaccaaggacgcgggccgcatcggcggcctggaagtgctgcgcatcatcaacgagcccaccgccgcctccctggcctacggcctggaccgcaagtccaacgagaccatcctggtgttcgacctgggcggcggcacctttgacgtctcggtgctggaggtgggcgacggcgtgttcgaggtgctgagcacctcgggcgacacccacctgggcggcgacgacttcgaccgccgcatcgtggactggctggccgacgacttcaaggcgcaagagggcatcgacctgcgcaaggaccgccaggcgctgcagcgcctgaccgaggcggcggagaaggccaagatcgagctgagcgcgacgagcacgaccagcgtgagcctgcccttcatcaccgccaccgccgatgggcccaagcacatcgacgccagcctgtcgcgctccaagtttgagcagctggccagcgacctgctggagcggtgccgcctgccgctggaggccgcgctgcgcgacgccaagctttcctactccgacctggacgaggtgattctggtgggcgggtccacccgcatcccggcggtggtgggcctggtggagcggctggcccagaagaagcccaacgtgacggtgaaccccgacgaggtggtggccctgggcgcggccgtccagggcggcgtgctggcgggggaggtgtccgacatcgtgctgctggacgtgaccccgctgtccctgggcctggagacgctgggcggggtggccaccaaggtgatcccgcgcaacaccacgctgcccacctccaagacggagaccttctccaccgccgccgacagccagtccagcgtggagatcaatgtgctgcagggcgagcgcgagttcgcgcgcgacaacaagtcgctgggcaacttccggctggacggcatcccgcccgcgccgcgcggcgtgccccagatcgaggtgcgcttcgacatcgacgccaacggcatcctgtccgtcaccgcctccgacaagggcacgggcaagagccaggacatcaagatcacgggggccagcacgctgccgggggaggaggtggaccgcatggtcaaggacgcggagaagttcgcggaggaggaccgcaagcgccgcgagctggtggacctgaagaaccaggccgacagcatcgtgtaccagaccgagaagcagctggctgagttcggggacaaggcgcccgccgacgtcaaggccaagctggaggagcgggtggaggcggtgaagaaggccgcgccgggagaggacgcggcggccatcaaggctgccatcgaggacctgcagaaggaggccatggccctgggccaggccgtgtacggcggcggcgcgggcggcgcgcccggggcggggcccgaggcgggcgcgcagggcggcgccgcgcccggcgcggggggtgccggagcgggcggcgacgacgtcatcgacgccgagttcaccgaggggggggacaacaaggcctga

SEQ ID NO: 5790 - DNA, 447 bp, Chlorella protothecoides
atgacatgcaggcacgaaggcttcagcaaggcggggacagtccgcaccacgaccctccatatcatggggctgtcgatgtcggccgtgcaggtgagcaccctggagatcctgacacccagatcgacgaagatgatcgtgaatgtggagtgcctcaaggccggccagaagccttgcacggcagacagtgacggcaacatcggctccggcaacaagggcaagaacaactttggcaccaacaacgttgggaactacaacattggtgagcaaggactggagtgtaatctcactttcaagatgggtacagccgctgcaatccttggtgaaacaggctcacatggaaaaccgtgctgcctgttgcagggaactccaatgtgggcaccgccaactggggagacaacaattccggcacgagcaattgttgcttcaataagactgggcatcgcataa

SEQ ID NO: 5791 - DNA, 684 bp, Chlorella protothecoides
atgggtgggtgggcaaggggagatgctggcagtcgcgtgctgcgccactcggcaggccatgcgcccccggaaaggttgctgaggagtggaatgacacctaggaagatcctggccccccaggctgcaccgccccgctgcctgcaccccactccctgctccccgcccttcctccaccccctggtcatcagcaccccacccccccttcctcaccccaacactgcagaggctgtccagctggtcaagggctccgacaccatggacgtctggtttgactccggcaccagctgggccagcgtcctttccgagggggggtctgcaaaggacggcacccccccctcgccgcgctttccagccgacctgtacctggagggctccgaccagcaccgcggctggttccagagcagcctgctgacggcggtggcggcgcgcgggacggcgccgtaccgccgcgtgctcacccacggcttcctgctggatgaggcggggttcaagcagagcaagtcggtgggcaacacgctggacccgcgcgccgtcatgctgggaggaaaggatgccaagaaggagccggcctacggcgccgacgtgctgcgcctctgggtggcctccgtggactacaccgccgacgccagcgtcgggccccgcatcatggcgcaggcaggcggggggactgggaaggggggttag

SEQ ID NO: 5792 - DNA, 819 bp, Chlorella protothecoides
atgctggtgtggtttgggcaaaccacacaaacacacaattaccaattctatatcttctcctcacgacccttccccttctccaccctcaagggcatcgccatcaagtacaagagcaagtacggggccctcctcacccgcaccaccgagcgcggcttcgtcatccgaaagctgacgggccccggcggcgagatccggtggtccgcccccgtcttcctccagggctccgccatgggcgtgggcctgtccggcggctaccgcaagtcccgtacctgcatcgcgctggccaacgaccaggcggtgcagtcggcgctgcgcagccagagcgagtttggcccctgcatgcacttcctgctggacatgaatggcacgcgcatcaagcgcgcgcactttgactcctccgaccaggccagccagaccgctgtgagccaggaccgccacggcggcatgaccgccaagtactaccaggtcgacgcggccatggttgacatctcggtggaaggcggcagtacgtacgtggacaaggacttcaacgccgcggtgtacgggcagggggtgacggcggagggcatcctggcgggcgaggtgcccccgcccgcggagttccagctgctctacaccgtgctgcagcagtttgtggacgagacgcccagcccggtggtcaagcgggagctgggcgccagcgggcacggcgcgcggagcatccgcagcgtgcgcagcattaacatgaagtcctcgcctgaggagggcacggcgctgccgggcgtggcgctgcagcggaggacctccgccacgcccagcgtggctggcatcaaggagtga

SEQ ID NO: 5793 - DNA, 1386 bp, Chlorella protothecoides
atgccccactcttgccaccccacccccgccccattacaccatactcttccgcaggggaggaaggccatctacgtccccggctgggacacccacggcctgcccatcgagctcaaggcgctgcagtcgctgagcgaggagcagcgacgggacctggagcctctggccctgcggcggcgctgccgcaagtttgcgctcaagaccatagatgcccagcgcacccagttcaagaggcatgtggcatcggaaacaggaggagcagattttcttgtgggccagaagccggtgcactggagcccgtcgacaggcacggccttggccgaggccgagctggagtaccccgacggccacgtctcgcccagcgtctacgtctccgctccattgttggaggcgggccccggcgcgtcgcccgaccagacgcgcgcgctggcgggcgcctcgctggcactgtggaccaccacgccctggacgctgcccgccaaccgcgcggtggcggtgagcgtgggcatggagtactgcgtggtggaggagcgcgcaggggcgcgccggcgcctggtggtggccaccgcgctgcgcgaagctgtgctcgctcggctgggcggtggcgaagactgcgacgtgggtgccacctggtccacgctgtgcacgctgccgggcaccgcattgctgggcagccggtacgagggccccttggccggggacgacggcccgcgccccgtgctggacggcagctcctttgtcaccgccgactccggcacgggcctggtccacctcgcgcccggccacgggcacgaggactttgcgctggcggcagccgcgggcgtggcggctgtctcccccgtggacgacgcggggcggttcacgcgcgaggccggccacggactggagggtctggaggtcctgggcgagggcggcgaggcggtggcggcggccgtggcggccgccgggcgcctgctggcgcgcgagccctacgcacaccgctacccctacgactggcgcagcaagcgccccgtcatcgtccgcaccacgcgccagtggtttgcctccgtctctggcctgcgcagcgccgcgctggccgcactggacgacgtgcgcttcgtccccggcgcgggacggcgccgcatcgaggccatggtgggcgggcgcagcgactggtgcatcagccggcagcgcgcgtggggcgtgcccatccccgcatttttctaccgcgagtcgggggaggcgctgatgaacgaggccaccctggaccacgtgacgcggattgtggaggagcgcggcgccgacgcctggtgggagctgcccatcgaggacctgctgccgccgcagtaccgcgcaggtcaacctttgatcgtgctgatgtttgggggtgtctggggaggaaggcggtga

SEQ ID NO: 5794 - DNA, 900 bp, Chlorella protothecoides
atgtcgagcgtggcggatggatcgagcatgagaggaagttgcaagatcgcggtggcccagatgacgtctgtgggagacccggacgccaatttcaagacgtgtcagaggctggcgcaggtgtgcctccttcgggccatggcagaagcagcaggacgtgcatggggctcagctccgacgccactggcgcttattcggcacattctgggctggtccacttcactgagcttcgctgcacccacaggaggccaaggacagtggctggtgcctgagggttgcatggtgcaaagactccggcatggggatagcgcctgcatctggggatcaatgtttcgagggtcctgccccccatctgtcaggcgcggccatgcaccgccagcgcgcggccatgcaccgccccagcgtgtgacctgtcctcgttcctcaacgcccgacccacacactgcccgcccgcagtccctggcccaggcgcagcccctggagggccccctgatggctcgctaccgccagctggcagcctccacgggcctctggctgtccctaggcgggtttcaggaggagggccccgacgacagccacatccacaacacgcacgtcgtgctggacgaccggggtcaaactgcggcggtgtaccgcaagatccatctgtttgacgtggacgtgcccagcgggccggtgctgctggagagccgattcactgcgccagggtcgcaggcggtgacctgcgccagccccgccggcgtcctgggcctgaccacctgctacgacctgcgctttccggagctgtaccagcacctggcgtttgacaagggggcagacgtcctgctcgtgcccagtgcctttacagtgcccacaggtgacgtggtggaggaagggggtgttgaagtggggtgggataattag

SEQ ID NO: 5795 - DNA, 1572 bp, Chlorella protothecoides
  modified_base (209)..(312): a, c, t, g, unknown or other
  modified_base (1181)..(1190): a, c, t, g, unknown or other
  modified_base (1559)..(1568): a, c, t, g, unknown or other
atggctcctgggctgggcctgcccggtgatgttcagcgccaggggacgaaagggcaacttggaggctttgactttccacttggcatctcccgtgtctccacggggggtccccggaatccagccacccaatcacccgctcaccctccccgcatcacaggagggaggcaggggggtgggtgcgctgcctcgcagccgcgcccgcacatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacccgcattccgcccccattctgggcacttgctgacgacggccgcaggccctgcctcctcatgaaagtaccacccctgatgtgtgcgcgtgcgtctctattcccttcccctgtgcgtgacttatccatcccatgcatgcatgcccaggctgatgggctgaatccacagaccctaacccccatgacacgtgggatcctccattgcagcaggtgctgtgccaacctttcccttgtaaactcatccatggcactcgaagtgtgtgaaggggctgccggcgacttggggctttcaacccgcgtctgggggaatctcggtgcgcctcgtaacgatctggatcacttcctcactcggcgacaccaagcgctcggtaacaagccactgaccatcccctacttgcttcttgcgtttttattctgtgacagcctgcactactcccggagcgggcatgagacgcacggcttggttacctttcggaaactccctgacatggccggcgaggagctaaatgaccctcgccttctgcacgtgctctccaggagcaggcactcgttggagcaggttggagctgagcccaacacgcaggcatgggtgaaatcatgcgcctccaccgagcctggcacggacaagttactgcgtcttctggaggagcatgtctcggagccctccttcctgcactccctcgagtcggcgcgggcggagagcgaggccgcaggccagccggaccccaccccgcccgctggaggggttgaccaggcaccaccccacagccatgccttgcaggcagactggtgggagctcaagcctgatggcgattttgcctccggtgggttgaacgagatatggagtcttctgttgctgtttggtannnnnnnnnntgggacggtggttgtcacctccaatttatcccagcctgaacgagatatggagtcttcttctgttgctgtttgcccaggccagcatcgctccagcctgcgcactgcctcccaccctgctcccctcccttcctcagtgagcgaggacacgggggattatgtcgtggtggagcatgccgacgccgtcgccgccatgagtcacttcatcgccgcctacatcgtgacccttccggaggcagcctcctgtgactcacggcagctgcagaaggccctggctgagaccatccaggcaaggaggggcagggaatggcatgccccttcctcatccccacatcgcccgccagccatgcttgacctcgcctcgcccttcannnnnnnnnnctga

SEQ ID NO: 5796 - DNA, 783 bp, Chlorella protothecoides
atgttccccgtccagaagcgtgtttttgagccggccatggccgggcaggatctgatcgcgcgcgcacgcacggggtccggcaagaccctggccttcgcgctgccggtggcggagaagatcatggcggagcgcggcggcgcggaggggcgcgcgcgcggacgcgcgccgctgtgcgtggtgctggccccgacgcgcgagctggcgacgcaggtggagcgcgagttcgcgtcggtggcgcctcgcttggccacagcctgcctgtacggcggcgcgcccgcggaggcgcagcgccgcgcgctgcgcgcgggcgtggacgtggtggtgggcacgcccggccgcgtcatcgacctggtggagcagggcgccctggacctgacccaggtgcgcttcgccatcctggatgaggccgaccagatgctggccatcgggttcgcggaggacacggagcgcatcctgggctacgcgccgcgcgagcgccagaccatgctcttctccgccaccacccccgcctggatcaagaagctggtggcctcccacctccgcgcccccgtcaacatcgacctgattgggcagggggccagcgggaagctggcagagtccatcaccgcccacgccatccaggtggcgcccgaggtgcggcgcagcgtgctggtcgacgtgctcacagtttacggcgcgggcgggaagagcatcgtgttcacgcagaccaagcgtgaggctgacgaggtggccgcgggcgtgtcctcccacctcccctgctctgtgagtttagactttgtctga

SEQ ID NO: 5797 - DNA, 447 bp, Chlorella protothecoides
atgggggcggaactgcagcccctgcaaagcgcatgcccgcctgccctgctgcgttcgcctgcccgcatgcctgctcggccaatggataccctgccttgtccccaatgcacaaacacatgctcgccctgtgagactcccccctgcccacctccaataacccccctcactctgacaaccccatcacccacgcaggttcacggctcggcgccggacattgcggggcaggacaaggctaatccgctggccatggtcctctccgcggccctcatgtgccgtcacggtcttggcatcccggccgtcgcggggcggctggaggcggcggtggcggccgtgcttgcctccggcgtccgcacgggcgacatcgcgcagcccgggaagcagacgataggctgcaaggcgatgggtcgtgccctgcttgaagctctggccgcccctgtggctgcttga

SEQ ID NO: 5798 - DNA, 969 bp, Chlorella protothecoides
atggcccgggcggacagagacgaaggcaggcaaggtcgctgcggggcgctggcaagtactgagggtggcgcgtcacccgggccatggcgcaatgggccatctaccgaagcgcatgccctgcgaaacgggtgggggtggccaggtcgcaggtttccatcaccgcacaacctgccgctggccctccctccaaggactggctgcatgagttcctgccacgctgcccagccctcactctccgaaaagccgcgccacaccccccagggtttcagcgagcgcgacggcgagaaggttgggttcagcactgacatctactccgagtctgagccccttgaatccataaagaggcgacaacccccggccgtcaacataccccctggcccagaccccaacccctcactcacgccctcctcaccaaaggtggagcgcatcgcccacgtcgccttcaaggcggcgcgcacgcgctcgcggcggctgacctccgtggacaaggcgaacgtgctggaggtgtcgcagctctggcgtgaggtggtgacgcgcgtgggagcagagtaccccgacgtcgagctgagccacatgtgcgccgcggggcatgcagggttgcctgatggttgttgggaagggggggggccaccgcaaccccccgaggaccctggccccctcgccttccttacgcactcacccccttcccccccgcccacccttgccctggccaggtacgtggacaacgcggccatgcagctgatccgcaaccctcgctcctttgacacgctggtgaccagcaacctcttcggcgacatcctgtcggacgaggcggcgatgctgaccgggtcactgggcatgttgccctcggcctccatcagcaacgatgggccgggcgtgtttgagccggtgcgcagcccaggctgggctgttccttgcacgagggtgttgcggtggctggagggtgtcccatgtgaggggccagggtga

SEQ ID NO: 5799 - DNA, 567 bp, Chlorella protothecoides
atggcggcactggctcccggcgcgcgtttggggttggccgccccctcccgtcgggccttcgtggctaggacacccataccccgggctcgccccgctgcctgcgcctgcgccgcgcaccgcgtgactgtcctgccgggagatggcatcggtcccgagatcaccgccgtggccctgtccgtccttgaggccgctggccaggcggagggcgagaccttcaccttcaccgaggccctgatcgggggggcggcctacgacgccaccggggacccctacccggatgccacttaccgcgcctgtgcagacagcgatgcggtgctgctggctgccatcggagggtacaagtgggactcgctacccagcgccagcaagcccgagacggggctgctgcgcctgcggtccagcctgaatgcctttgcgaacctgcgacccgccaaggtcatcccagagctggcggacgcctcctccctgaagcgggaggtgctggagggggtggacctgctcatcgttcgggagctggtgggcggcatctactttggccagccccgggtcttctggcggtgggagtga

SEQ ID NO: 5800 - DNA, 993 bp, Chlorella protothecoides
atgctgctggtggagcccctgaagcgcatcaccatccccgagatcaggcagcacccctggttctcggtgcacctcccgcgctacctggctgtcatgcacaccgaccccgtggcctcggccgccgcgctggacgaggaggtggtgggcgaggtggcgcgcctcggcttctccccctccttcctggccgccagcgtgcagcggcgcgagcagaacaaggcgacggtcacctactacctgctggccgacaaccggcggcgcatgccctcctctgcctacctgcgcgaggagatgacggaagggcaggagggcggcgccggcggcgcgcgcgcgccgccggcgcccggtgccaaccccgccgcgcgcctcgtggtcgcgcggcagtggcgcctgggctggagctgccgcgcgcgccccgccaccgccgtggcggagctatgccgtgcgctggcggccgcgggcgtggcctggaagaagctggcgccctactcatacaagtgccgggtggcgctggctcccgcaccgaccatggtggcggcgcgaaaagaggatgcgcatgcatgctcctgtgcccctgcccacatcggtgcatccagcccgccccaccctgctcccacgctgcgaatgcctccctcactaccaccaccacctacctctacccttacgacagagggcccggccccttcccgctccgacagcgtgtcggacggcgttgccatggaggcctccggcatgatgtgcggggaggaggtggagatggagggcgaggaggagagcagcgtgcgcccgggggagcgcgcgcctggcgacggcgaggacggcgacggcgcgcaggccatggacacctccatcgccgcgggcggcggtggggaggggggccggcacgtcgccgcgccacgcgatgcgccgacgggcggcgagcgggaggtcaagttcgaggtgcagatgtacaaggcgcgggacggcgactacgtcctggacttccaggtgtgttag

SEQ ID NO: 5801 - DNA, 414 bp, Chlorella protothecoides
atgagtggttcctcctccaccacaggcgcaacggtacggggtgcgagccagtgcatgaggagacgaatacaagttgtatgtatcaactccgtgcggtcagtcaagggcggatgcaattccgtgaagcgcctgcgccattgtcaccacccctgcccctcgtcttcgtcatatgctgcccagggtgctccccctccatcggaagaggcgctgcaggagcagattctacgtgcaaaatatggcggcatgttgccaaagaagaagcagggcccgcgggaccacaagtactttgattccgcggactgggcgttgagtaagcaggggtcaggccagcctcccccctcccagggcctggagcccaagctgggcccctctgctgtccccggccggcgagtctcccagctgggacaacagtga

SEQ ID NO: 5802 - DNA, 780 bp, Chlorella protothecoides
atgtacaagagcatcgtggcggacctgcggctgaaggagacggggggctggctgtcggaggcggggtccaaccaccccgccaactacatgcggcgcaacatgtccaagctggccatggacaacgccgacatgcggcggggggtgggcctggccaacgccgcgctgccgcagtcggggcctgagaccgcggagcacgcgccctggcacggcaagagcccgcccagcatcgtgggggccgtgatccatgtcgtggccctgctgcccaccgcctcgcgccggcccagcctggaggacatcagcaaggcctgcggcgtggcggaggccaccatcaaggccgtgtaccgagacatgtacccgcacctggtgggttgggttttgggagggggcattccctgctcacccacgcgcgcctcctcatggcactcgcgcaacttccatgccgcctgcgcaggcgaggctgttccagaagatggaccgggccctggtgaacgtggaggacgcggccaagctgcctgcgccggcgtgacggccggggccctggtcagtgactgtgatcctcccctcgccatgctccatccaccgccctgcgctcatgctctcgctggctttgcactgggaacctccgtgcaatccaatttcgttcacaacaaacacagcggcaaacagggtggcacagcacatgggcaaacagatctcaaagcctttgcggcatggacggggctggacatggtgctgaggggtcccgtcagctcaagaccacagcccgaatggcaggattga

SEQ ID NO: 5803 - DNA, 627 bp, Chlorella protothecoides
  modified_base (413)..(422): a, c, t, g, unknown or other
atggcctcggatggcatctgggaatttatctccccacaggcagcggtggacctggtgaggcgtggaagggtggaaaggggtctgctaggttgggctagaactgttgaggtggcacagtacaccgacccgctggaggctgcggagaagctggtggagcaggcgtacaacacgtggcttgccaacgagccccgcagcgacgacatcaccgtcatcatcgtggcgtttgacgacgcagcggcctcccatgcgttgaaacacccaacactgaagcttgtgccctctgtgactgggcgccaccctttcctgacggaaacactttcttctagcctacatcccaaccctccccggagtcttggtgcattggccctgcaccagcacatgctcaccttgcccgtcgcaaagcgtgcacagtnnnnnnnnnntgtgactgggcgccaccctttcctgacggatacactttcttctacgctacatcccaaccctctccggagccttggtgcattggccctgcacaagcacatgctcaccttgcccgtcgcgaagcgtgcacagcgcagatgctggcgcttcccaccctgcctcgcacatcccttcaaccctgccactcgggctgtgctcttgagctga

SEQ ID NO: 5804 - DNA, 636 bp, Chlorella protothecoides
atggcagggtacaacgtggccctgcgcatgaagttcgagcagcgatgcccggagtgcggggagagtgactttgtcgaggaccactcatcgggggacctcatctgcagggacaaggagtctgccgaccccacacgtgtgggcggccccatcaaccccttgctcaaggacggcggcctgtccaccatgatcacggggggcaagggcgtggacaagggcctgaccagcagcctgcagcgcatgcaggcccgcaccgactccggcgccggcgaccgcagcctggtggcggccttccgcgagatcgggcgtctctgctccgacatgagcctgcaggatgtggtccgccaccaggccaatgagtactacaaggaagccgccgagaagtcgcggtcggtgcgggggcggagccaggcggcggtgtatgcggccgtcgtcttcatggcctgccgccagcagaacattgcgcgcaccttcaaggagctctgcgcctacgcgccccaggccagcaagaaggtggggcgggaaggagggcgtggggcagaggagggctcacgacgcccaccccaggcacatggctgctgggtctttgcgtcagcagagtgcctgcgcattcatgaccacacgcatcgtgcggcgtga

SEQ ID NO: 5805 - DNA, 702 bp, Chlorella protothecoides
atgggttgtgcatcctccaaacccgaaatcccactggggccggcggaggtcgtgaagccgcagccctcccccgtccagccctcccccgcccaggccatccccgcccaggccggcaccatcacctactccagcacgccccccacccgcgccagcactccccccacctacgccaggccctcacccttcgatggccccagcatgcccaagccacccgccccggcggcgccctcccccgccggcaagcccccgccctcccccgcggggatgagccccgccgcctccggcggcatgaccccgcgcatgagcgagacggtgtggatggcgccggccatgtcctccctgtccagctggctgtcccccgctagctctggcacgacctcgctggaccgctggggctcgcgccagtccggcgaggtgctggccccctccctgcccttgcggtgcgccctggtcagcaaggtaggcacctaccccaacaagccggaccgcgagaacgaggactccggggcgtgcatggatctgacggggcaccccggggtctgggtgtttggcgtcttcgacggccatgggccgcagggcgcggagtgctcccgccttgcgctggagaaggtgagcggtgggcggctgcgggggggcctatgcacggcgatctcgggagtgcgcccgtcggtttgcgggcgtgcacgagattggcgccgatga

SEQ ID NO: 5806 - DNA, 501 bp, Chlorella protothecoides
atgaccctctgtgacgcaccatcaacagtaacccagcggctgcccgtgcagctgcacaagacgcacagcgacgtgggcaaggcgctgacgcaggcgctgatcgaggccgactcgtccctgcaccggcacaagacgcggaccacgctgagcgggaccaccgcgctgatgggcgtggtcagcggcgccacgctgaccgtggcgcacgtgggcgactcgcgcgcggtgctggcgacgcgcgccgcgccgggcgcggcgcccaccgcgcgccagctcaccgtggaccacacgccgcgcgtgccggaggagcacgagcgcgtgacgcgggcgggggcggtgatcctcaccgtggaccagctggagggcatcaaggacaagagcctgcagtgctgggggccggagttcgacggcgatggcgatccgccccgcgtctgggcgcccaacgccgactggccaggcaccgccttcacgcgctccctgggggacaggggtgagtcggtttga

SEQ ID NO: 5807 - DNA, 357 bp, Chlorella protothecoides
atggccagcgtagctggcaccctgagcaagagctccgaggtcatgaagctggtgaacagcctgaccaagatcccccagatgcaggccaccatgcgcgaaatgtccaaggagatgtataaggctggtgtgctggaggagctggtggcggacaccatggactccgccatggacgaggaggggctggaggaggaaagcgcggaggcggtggacaaggtcctccaagaagtggcaggggagactctggcgcagatggcctcggcgcccagccgccgcgtggcggcgccggagcgcgccgaggcggcgggggcggaggacgaggacgacctggcctcgcgcctggcggccatgcgctcctga

SEQ ID NO: 5808 - DNA, 2130 bp, Chlorella protothecoides
atgattggtgcatgcagtctgcttgtccagcctgtgggccgaccggtgtgcattcaacgactgctgtgcgccggagaggcatgggaggggcgccccatcgggggccagccatgcgccctcggtgccaagaaatttgttggtaggggtggcaggggtctcggcgaggggcgctgcgcgttcccccggacccctgactctccgcgtgctcgttctccaaagaaaccccaggccccgcgctcagtagacgcgggccttgggcgggatgtgtggcatctcatcgtccaggggctggtcgtgcacgggcctgtaatccacgcgcactttgtccttgccccagtcgaaccaggccacggtgtgcttcatccagtccttgtcgtcgcgctccttgaagtcctcgcgcgagtgcgcgccgcgcgactccttccgcgcctccgcagagtgcatggtgatcgccgcgttgatcaggcagttctccagctccagcgcctccaccatgtcggtgttccacaccatgctccggtccttcacccccaggtcggcaaaggagtcgacgcaggcgtcgatggccgcgcagccctcctccagcgtggactgggtgcggaacaccgccgcgtcgcgctgcatcacgcgctgcatggtccgccggatgctggacgcgggcagggaacccttggcgttcctgcgagcgatggcctcatcgccggcgccctccggcagcggggcgtgggtctggccgggcttcaccgtctcgccgacgcgcagcgcgcaggcgcggccgaacaccacgatgtccagcagggagttggcgcccaggcggttggcgccgtgcaccgaggcggaggcggcctcccccgcggccatgagccccggcaccacggcgtcggggttggcggcggtggggcgcaccacctcgccgtggtggttggtgggcacgccgcccatgttgtagtgcacggtggggatgacggggatgggctcgcgcgtgacgtccacgcccgcgaagatggccgccgtctccgagatgcccggcaggcgctccgccagcagctcggggggcaggtggtccaggtgcaggtggatgtggtcggcctcgggccccacgccgcgcccctcccggatctccatggtcatggagcgcgagacgacgtcgcgcgaggccaggtccttggccgtcggcgcgtagcgctccatgaagcgctcgccctgcgcgttgcgcagcacgccgccctcgccgcgcgagccctcggtgatgaggcaccccgcgccgtagatgccggtggggtggaactgcacgaactccatgtcctgcatgggcaggcccgcacgcgcggccatggcgccgccgtcgcccgtgcaggtgtgcgcggaggtgcaggagaagtaggaccgccccgcgccgcccgtggccaggatggtctggtgcgcgcggaagcggtgcagcgtgccgtcctccatgcacagcgccagcaggccgcggcagacgccgtcggcgtccatgatcaggtccagcgcaaagtactccacgaagaagcggacgtcgtgctgcatggccgcgccgtacagcgtgtgcagcatggcgtgccccgtgcggtcggcggccgccgcgcagcggtacgcctgcccgccgttgccaaagtccaggctctgcccgccaaacgcgcgctggtagatcttgccctcgtcggtgcgggagaagggcaggccgtagttctccagctcgatgacggccttgggcgcctcgcgacacatgtactcgatcgcgtcctggtcgcccagccagtcgctgcccttgatggtgtcgtacgcgtgccaccgccagtcgtcctctggcggtggggaggacaggaggaccatgtgagtgtgcgtgtgaaggggtgtggggatctcatctccaggcgcaaaagaagagggcgcagcagtgtgaacgggggtggcatgggcattgggaggggcgcatccgcgcaggaccgagccgcagcgccacccgacgcggcacgacccacccagggccacacgttcagggcaaggggaatactccccccaccaccacaccgacccaccacccaccccccaatccaattctggcacccaccagtcatgttcccgagggcggcattgatgcccccctga

SEQ ID NO: 5809 - DNA, 3888 bp, Chlorella protothecoides
  modified_base (340)..(349): a, c, t, g, unknown or other
  modified_base (1085)..(1094): a, c, t, g, unknown or other
  modified_base (1901)..(1910): a, c, t, g, unknown or other
  modified_base (1978)..(2024): a, c, t, g, unknown or other
  modified_base (2218)..(2227): a, c, t, g, unknown or other
  modified_base (3443)..(3452): a, c, t, g, unknown or other
  modified_base (3870)..(3879): a, c, t, g, unknown or other
atgcactgggtgcaatggagctgtcgaggagctggggtgtcacagtcaatctgtaaccctgattcgaggtgggcggtgggcggtcgcagcaatgctggcaccacgctggcgactcggtgtcggaggccgagcgggaaaagcgtgttgagcgcgcccggggtagggactgagaagccagatcagcagtctgacaggtgcagggtgcagcttcctttccccgctaaggcaggtaatgaatggggaggtgatgttcaaggccgtaagaaaaggcgtccttcgagtccaaactgtcataagaaactcagactttgggtctggggcaatgcttggcttggttgcnnnnnnnnnnaccttcgagttgaaactgtcataagaaactcagactgtgggtctggggcaatgcttggcttggttgccgaagctttcccacactccggaggtgaagaagagaatctggatcagactccaccaaatcacgcgctgggtacgccatttggcgatgcacattccgtggccatcattcccatgccagccctggcatggaccccatgcgcatcaggccgatcgcaagccccaccaggcattgcggggatggcgacggaagtgcaaggtcagagaaacatttgtaatggatatcacacctggcagccggcaggggtgcgagcatcacgcggcaggcacccccaacccgcatcgcctgcctctatgacctcgacccggcatggcaccaggcggtccctactcagcctcgcgaccgcaggagcggcacctccacccgcttcccgggaacctcgcgctgcgaagctgagctatgccgatctgtctccatccgaggtgcgcgtggcggtgctgggggccaccgggtacatcggccggttcgtggtgctggagctggtgaagcggggtttccaagtgctggccgtcacccgcccctcctcgggcatcggcagtaagcaaaaggtctccgacgtcgagaaggagggctgcggcggatcaggcccccttctacgcattgttgacattactgtgactggtggcccccaaccccttgtctatgccaaggcgctggagggggccaccgtggnnnnnnnnnnttcaggcccccttctacgcattgttaacattactgtgactggtggccccccaatcccttgtccatgccaaggcgctggagggggccaccgtggcggtggccgacgtcaccgaccccgcagacctggagcgctgcttctcggagcaccccgccccacacgccgtggtctcctgcctggccagccggaccgggggcatcgccgactcctgggctgtggaccacgacgccaacgtgaatgcgctgcgcgcggcgcgtgccgtgggcgccgcccacttcgtcctcctcagcgccatctgcgtgcagcgccccagcctggaattccagcgcgcaaagttggccttcgaggccaagctgcgggagggcgggacgagctggagcatcgtgcggcccaccgctttcttcaagtcgcttgcggggcaggtggagctcgtggccacgggcaagccctacacgaggccagggtcaaccgcgtgctgcccatcggcgggccggggcgggcgctcaccccgcgcgaccaggcgcagctgctcttcaaggcctttggaaagaaggagtggaccctgggcctgccggtgggcatcatggacggcgtcatcggcatcctggacctccttgctaagcctttcccagggctcaaggtgggtggggggccctggctcgaaataggggatggggggaagtgtagcaggcatgcctcccatgacggttgcgaggtcaagcatcctggtatgcatagcttcttgaggtgccatctcctgtctatcggccagggagcaatgttgtgtgatccgcaaagtgtttcagggcnnnnnnnnnngtgtgagggcccatctccccctccacccgactgtcaggaagcggccgagtttgggcgcattggcaggnnnnnnnnnnnnnnnnnnnnnnnnnnnnnnnnnnnnnnnnnnnnnnngtgtgggacgagaaggaggggaggtatgacgccgacgcgacgccagagtatggctccgacacgctggaggccttcttcaatagggttgcgcgggagggtctggccggccaggagctgggggaccaggcggtattcaatatcaatcgagggacctgatatgctaagagtgttgcctgatccattcgttggtcctnnnnnnnnnngttcaacatcaatcgagggacgtgatatgctagagtgttgcctgatccattcgttggtccttgcgcaagtagctgtaaggctggtcttctgtgaggccagctcaggtggtgtggtgctctcggcgtgctgctgcccatgctgcgcggagaccactacgatccggggcgcagacagatggtcggtccgcgtatgcgatcgcgtgccttctgggcccccttggagcaccccagtgcctcgaatagcgcacatgtactcgtgcgaatgctcctgcccgggtcagtaccaggcacagtcgccccggagttgcgtgccctgcctcctccatgctgggtcggcctcgcgagaggaagtcttcccatatcaccagcccctcccgcctggataccagggccggcgccgaggccaaggatatcatgtctccaccccggggggtcttgcaacgggtgcgtgggatcgaggggatcgcttgctgggggcctgtcgccgggggggacgactgtacagtggtggggggtttgagaggccgggctcggccgctgcccacccgtcccgccggtccctcttcgaggcatgtacccactccgagccgacgatgcaattcctttcgcacgtctgtcctgcccgccacacccacagagctcccccctccctcacaccatcgaggcacccccctccagaccagcagctccgcccgcagctcccactcctgcgaggcggccccaacccccccctccctccagggccccgaaacggccaaggccacgccgcggcagagcgtgttcacgctggtgaatgcggtgctgggcgcgggcgtgctgggcttcccttacgtgtacaagagctgcggcctgggcctggccacggcgctgatcgcgctggtggtggccgccagcgcgctgtccatgcgcctgctgctcctggcggcagggcgcgcgcggcgcggcagctacgaggcgctggcggcggcgtgcctggggcccgccggcgcgcggtgcgtggacgcctgcgtcctgatcatgaacctggggggcctggtggcctacctcaacatcctggccgacacggggagcagcgtggcgggcagcgtggtgccccccggcgccgagcccagccgcgacgcgctcctcctcgcagtcaccgcgctcgtggcgctgccagtgacgctgggcgtgcgccgcgctgcactgctggccgtcgtctcccaggtgtccgtcnnnnnnnnnngctcctcgcagtcaccgcgctggtggcgctgccggttacgctgggcgtgcgccgcgccgcgctgctggccgtcgtctcccaggtgtccgtcaccttcctcttcttcttcggcgccgccaccgcgctgaccgccgccgcacccgccgcgccgctggcggagctgctgtggtggcgcccccagggcgcgcccctcgcattccccgtcgtcgtctacggattcaccgcccaccagatcctgtttgacatctacgagaccctgcagtcaggtttgaggggggggaggggcgtgtggaggggcgtgatgcatcgcgccgccgacccaggccgccccgatgccccacacggtcccctggcggggaccagacgtgcggaattggcatatcctggcgctgccccgccccacccgcttcaccggtgnnnnnnnnnnggggcgtga

SEQ ID NO: 5810 - DNA, 390 bp, Chlorella protothecoides
  modified_base (312)..(321): a, c, t, g, unknown or other
atgacgcgtgtgatccaccacagcatggccctgagcacggccatgtacgtgactgtgggcgcggcggggtacatcgcctacggccccgccaccgctggcgacctgctgcgcaacctgggcggcgacagggcctccgccccgcgccgcgcctttgagtccgcgctccgcatcggcttcggcctgtccatcctgggcacgctccccctcgtcatgctccccctgcaggccgtctgctcccgcgcgtgggagacggtgcgccggagggcgggggcgtgcgggccggcgcccggggtcgcgcacgaccccgcccgnnnnnnnnnnctgggagacggtgcgccgcagggcgggggcgtgcgggccggcgaccggggtcgcgcacgaccccgcccg

SEQ ID NO: 5811 - DNA, 1341 bp, Chlorella protothecoides
atgttttggctgtatgacaaccgtaatgagctgccggagcaccatagggtaggcgtcgtgcccatgccatgtgtcgtaatttgggacgatcatggaccctgcgtcggggaagctgagcaggtgcctgcggggcccggcaggacttttcacaagcctccatctgcctggggcacgaacggcgccagatccccaacctcgagggccgtcacccaccattccccatttccttcccacaaccataataaaaaggcgctggagatctgcgatcgggtgaagggcgtgctgggtcccgacacggagtgcagcatctcactggcccccctggactccatcgcggagggccccagcctggtgcggcgcaaggcctgcaaggacgcggtgtccttcagcaacctgcgttctatcatgacgcggcggcgcacagccgagcggcccgtccccgtgcccatccccgcggaggtctcgccacggctggcaggcgcggcggcggcggcgcgcgacgcctggtcggacaggccctccgccgtcaccgtcagcgtggacaacgagacctctccctcctacaccatgctgagcctggagtgcgcggatcgcaagggcctgctctatgacatcctgcgcgctctcaagggcgtggacctgcgtgtcgcctacggccggctggaggtggacgaggacggggccggcgcgggcgtgaccatcgacatcttcatccaggacaacgacctgtgccgcatcaacgacccggtttggatgggcgggatggtggaccgtgtaggcgggtacatgggggaagagttgggaggtgaagaagaggtgcagtatcctgagcgccgtggtcgcataactttggagactcatccagcaggacccggggccctgccatcccccgctccctttgcccgtcccgccctctcctccctcccctttttaaactgccccccccccccggatccccccctctataaaaagggacgcgctggaggaggtcaagcgccgcgtggaactggcggtgacgctgccggtgcgcatcacgctgcgcgacgtcttcgacgcctgctgcaccgagctggtggtcaccgcaccgctggacacgggggggcgcgggcggcccagggtcacgttcgacgtgacccaggcgctcagcgtggcggggctgggcgtcttcatggccgacggcgagagcaaggggaggacggggcacaggtgcgcggccgtggggccagccccgcggggcggggtcgggctggcccaccatgcaactctggcccatgccttgaggccccaaaccatgccaacaccctcccgaatccgcccgcgcagtcttcatcgagtcggtga

SEQ ID NO: 5812 - DNA, 1401 bp, Chlorella protothecoides
  modified_base (176)..(303): a, c, t, g, unknown or other
  modified_base (1007)..(1098): a, c, t, g, unknown or other
gaggcgctggccgaggcgcgcggcgtgacggtggacggcgcggaaggcgcacctgcggcgctggcgctgcgcggccgctgcctgtacgcctgcggcaacctggcgctggccgagcagtgcctggcacgtgcactggcggccgacccagactgccccggcgcggcgcgcccgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaggtggcaggaggcctgggacgagtacagcgcggccctggccgccgacccgggcctgcgcgccgaggcggtggcgcaggtggcctgcaaccgctccgcggccgccggccggctggggcgctgggcggaggcgctggccgacgcggaggccgcgctgggcatggagccggggtatggtcgggcgcgcgcgcggcgcgccgcggcgttggccgccctggggcgccacgacgagggcctggccgagctggccgagctgcggagcacgcagcccgagtacccgggcctggaccgcctgctggccgacgcgcggctggccaagaagaaggcggagcgcgtggactactacgccgtgctgggcgtggaggaggacgtccatcccgacgcgctgaagaaggcctaccgccgcgcggccctgaagagccacccggacaaggtgtctgtgggtccatgcgtgtgcgagtgtgccagatgtccctcggacgggtttccttcgtccccaacctctccccatcccccccccgcaacccaccccaccccccaaaggcggaggagggcgagcgcgcagaggcagaggtcaacttcaagctggtgggtgaggcgtacgcggtgctcagcgaccccgccaagcgccagcgctacgacgcgggctggtccagcaccgagatcgagagcggctgccccgagggtggctgctgcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaacggctttgggccgagctacggcggcgggcccaccttcgcatcggggccccagttcagggcgcggtggtgatcggggtcctagcacccaaccccggcgctgcgaggcgccgtggtgctctgggacaccatggatgctatccttccgtctcaagggaggagcccttcggcccttgcctgcgaggtccttccccccttcagtaactcaatcgctgggcctgcggcgtggtcccgctccagtcccatctgctgattcaaatacagtgtgcagcgtgtgtacagccgcagtcaagtctcagtag

SEQ ID NO: 5813 - DNA, 1467 bp, Chlorella protothecoides
  modified_base (109)..(118): a, c, t, g, unknown or other
  modified_base (215)..(224): a, c, t, g, unknown or other
  modified_base (938)..(947): a, c, t, g, unknown or other
atgggcaccgtgcgcgtcccgggcccaacagacaaggtgtacaaggacgagtgtggattcagcttcgccactccagactcccaaggcgggctgtacattaatctagccnnnnnnnnnngctcttcgagagtcgcctccctcctgcctccagttaactgcctgcatggcaatattcttgagcaagcgcccactcaccttcctcaggttggtcgtgnnnnnnnnnnacctcgaccagcggcggacggggcaagtactctacctgcacgaacgcggcatcaaggtgagggtgttggccactcttcaagagtcgcctccctcctgcctccagttcactgcctgcatggcaatattcttgagcaaccgcccactcaccttcctcaggttggtcgtgagtcagggcccaccgctgatgccccacccacccagctggccattggggtggagggtggcttcgacatcggcgacacccccaagtacgatgtcgtcaaggagcatgcgctcgtcctcctgccagcccagatcagggtacccctgccatgtgccgagctcccagagctggtgctgcaggcagtagcggctgtgcagaactggcgccccgttttactatcgcaagaccctgcaacccccccctgggaccccccctcctcccaacaggcgcatgacagtgccaggcgtcaggatgaggtggcagcgtggacggaggagcgggtggtgagcaagtatgcagagggactcgagcagctgccggccactcggagtatccccatggacccagcacaggtgccaagagggaggcgagggagtggtgtaggaaggggtgggcttcttgcccttggggtgcgttgcactgccctggaaggtgttccgtacaccctaacctatacgattcctgcatccactggacccctcccacagtggaagtgcgacgaatctggcgnnnnnnnnnncggaaggtgtgccgtgcaccccaacctatacaattcatgcatccactggacccatcccacagtggaagtgcgacgaatctggcgccacggagaacctgtggctgaacctgtccaccggcttcatcggctctggccgtccggtgagccactttggggtgtcaaatgcgcgaccaccaagcatcagcatggggttgtggggcctgcatactgggtctttcgcccatgccagacctccacctcaggccctcgccaccacacgcacgagcctcactctcccaccccccctgtacagaactgggacggcacgggcggcaacggcgcagccctgcggcattacgaggccaccgggcgcaagtacccgctggccgtcaagctagggaccatcgcaccccagggcgccgatgtctactcctatgccccggaggaggacgacatggtgctggacccccacctgggccgacacctggcgcactggggcatcaacatgctgcaggtggctggtgggaaaggtgtcgtttag

SEQ ID NO: 5814 - DNA, 1113 bp, Chlorella protothecoides
  modified_base (280)..(289): a, c, t, g, unknown or other
atgcggaccacggaggccgagatcctgcaggcgtcggtggatccagcagggttccccatcaccctcacagctgagacacagtccctggccaggtctgctggaggagtgggtgatttgcccaatgcatgggccagctctggccgatggagctcatgttggtttgagtgcaagcctgagaatgacgactcgtccaaacaactcatccctgcccttccgtctaggttgctggccagttttcagtggggcctggaggaactgaccctggttgctgtcccatccnnnnnnnnnnaggctgctggccagtttccagtggggcctagaggaactgaccctggttgctgtcccatcctcggcatcagaccccaacggagccgtacagctgcacagccacgcagaccccagcagaggtggtatgggctgggggcgctgcatggtgggactgggggatcccctttctacacagcagacaatggtcaaggcgctctcgtgaccaagctggccattgacgctcgccggactttcctcgagtaccagcacacgacgggtagggtagcgctgcacccatccccactgcctcccggcatccctcatccgcccccagatggtgtgcggtctgtgaccttcaatgtcaaggacttcaaggccatgctctcactgtgcgagcacctcggccgccccttggtgctgaggatggagggccccggcctgcccttgatggcagagccagggggggaggggggcggggagctggaggcgcagctggtgctggccacgctgatggagggcaacgacggcctgacccaggcaactggaggggcacccgccccaacgcagccagaagtccacacggatggtgagtacgggacggaatggtgtcgcagacgtgcagaagggcatgtgctgagccgcatactatgcaatactgtgctacatgctcgcctacaatgcccttcccaggagaccgacaatcgcatctccacggcacgttgggatgccccagacgcagacctcagtggagcacatggcgaggagcaggaggtcggcgggagtccgctcagagaggagtatgtcgggggcttgccaggagtcatgaccgaccatgaatgggcctga

SEQ ID NO: 5815 - DNA, 1242 bp, Chlorella protothecoides
atgttccggattctgttctctcggtgtacgcaggaatcagaagtagagtgcatcagaatggctacatttccaatgctgctgagctgcacgccagcggctcgactcgcccgctctccaaagggcccagcggtgcatggatccatgcagcgatcgacatgggcgactgccgcatacagacgccaagaccgtttcccaagcataagggcaagcagtgttgatgccgacaacgagtctcgactggaggccttggaatccatggcacgagggggaaaggagcagaagggcgcagtggagaagagaccatcggttcggcccaatctcacacaggctgcaaaggcggacatgggaccctccaccgagtggggcgagcgtgatctcttccccaagggctgggacgacatgccgcttcccatgaaggtgtcccagctttggatggggaagcgaggtctcctcttctggagcaacaaactggcatgggctgccgtgataggcgtcgggcgcgcggactctcgtgacgactgcacagatccgaggaatttgcatctcctcgatgtcgtcctcggcgctatctgccactccatccgccaagctaatcctccctctccgccctttctgagctgtgctctcaagacgatgggtgcggcaggcgtgcccagttcaaagggtccgggaaggactcggccccgacagcaccagaaaccggctgctgacttgcgcctgccagccatctctcacgaggatgccgaacatggtgaggtcgccggcgatccgacatcacgagtctccccctccatcgagcagacctggtgcacctatatagatcccaagtccctgcaagcctggtacgcagccttcaggctggtcgctgagcagcaagcggcgctgctcaaggggtcacccctcctctcgggagctctcccagatctcgatgacctggcattgcgcacacatccctacacctcaccttctcaggcctcctgggtgacgagcgaaacgtcattcagtgtatactccctggggacctcccctgggcgccttctggtgtgtgatgctgagaagaacatatatggcagccattaccacatcagggagcctgagtcgagcaccatcaagctgacagcggcagagttcgtgcagtgtgcgcggaaatggaagagcaagctcttggtcctggaggtgagcctcgtccactgggatgatagtggcgcctggctgaccaaggcgctgctgctgctggcatga

SEQ ID NO: 5816 - DNA, 2094 bp, Chlorella protothecoides
  modified_base (331)..(340): a, c, t, g, unknown or other
atgaacgacctcaatatcctggcgggagggatgccggtgagccaaccctatggccctcatcctgccatgcaggcgctatacccactggcaagcatcaagccttccacagagagaaccagtctccgaagaaacctcccaagtggtctacaaaccttggtagactgggactggctagaggcgtggcttgcagcgcaagagtttgggccgctgtcttcgttgcgcctcatggctggtgtgcggggcaccctcctgccggcaagctatgctgtacgtgacaggatactcacccaggcgagtaacagacaggaatggcgatatcgtgaggatcgtnnnnnnnnnnctgcgcctcatggctggtgtgcggggcgccctcctgccggcaagctatgctagtcccgccgtctgtgcacagaactgcaagaacacttggcctgctgtcttcttgtgagggattctggtccactctcacttttccatatgccagcattcaactatctcaccgccttcttcccttggccctgtcccctgcagctgactgggagatccagggtgttccttttccctccatccatggcatttcagggcttgtatccctaccccgtccaccatggctatgacaagtactccatggtgaatctggaggaacccgacgtggccgaatggcccctggccacgcggctgaaggcagtgaaggctgactggggacctgggggctttgctggacgcgactggacgcaaggtgcgaggcatgccataacttgcaatgggggaacgctacgactggagttccaccgtgttcccaggagggtcggtcgatgcaatccttccagtagggtcggtcgatgcaaaccctccaggtttgcacatgtcgagatgctagctccagaggacctgatgctgacacttgagctaggacagggcgctcgtgggctcactcctggtgcagcggcggttcacctgtcacgtgcactggaggagagaatctgtgaggccgagtccccaaaggccgtgagggagtggctcctgcgcatcgccgcggggatggagattgaaggtgtggacctggctacggtgaaaggatacaagcggatcgtgctgtgccagggggtgcgcgatgatgtcgaggctgtcctcggccagggtgcctggtcgacgttcctgccctccatgtgcgagggccgcctgcaacctacgccttggctgaacaaggtaagagatttaaatcagatatgcatcgacctgatgccgggccagaagatgtgcccttccttcaaatactcctacttctcgctgtcctcccctgactcctccagaactttcgggagccgctctatcttacggatgtcccagtcaggctcgaggatgaccgcaccgaggaagagaaaaagtatcctgagctcttcaggcaccgcctcagagctggaggctggacggttcccgagaacaagtgcaccatcccaattcctggatataacgttccagcatcataccagcctcagagtcagcaagcttaacaggagtggtgtcaacaaatgccctccccaccgccccaactgctgtagcaccatgagaaggggtggagatcttctccgaggcacatggaatggggtcacatctctcaaacataaaagtcttgtcgggagctcccgcctcccacctccttcagcttctttgagatgctcacagccagacatcgcacctctccatgtgcaccacgacccaattcaccctttcaaccacacaccgctctccaaaattccttcctaccttaaggacctctgcaaaggccaggcgatctgccgcgtcccctgcccactgcagcgagcgcaggatggaccgcgtgcccttcagcagccagacagggatgttgcgcgtcttggcgtccgtgtcggccagtcgctcgcagatcccgatgatctcctgggtggtgtaggcctgcgggcccgcgatgtccagtgtcttgttcaccgcctctggcgtcctgcatgcgatggttttggaggagacgatgatttggggcgggatgaagaaggcggcaagaatgacgattcacagaaggggacattcttctggagagtgatactgggaggatga

SEQ ID NO: 5817 - DNA, 1350 bp, Chlorella protothecoides
atggcagcatctcaccgacgtattgactggcagaactggaggggaacgcataatgatgggttgaaaaataacgtatccacgagcagagacgcaagatacccggcccaccccctcgctaccatcacctcgcattatcctaatctcaccggggacgtcagctgcgacagaaacaataaacctggcgtcgtcatgcagatcgtagtcaatagaacagtaacagaccacaaggagggagaggcttgcgaggacacacagctgccgcgacagcctaacgagatgcatgaaggctatccaatatttacaccgccctttggtttatcgattcaaccagccatcaccgacatcgggccgtctctgttcttgcagagtatggggccacgggcactacccggtcgcatgaggagggacgtgatcgattcatcgttttcggcgggacctctcaccgagctcagccctccacgcccttgccccaggcccgctttcccggtcataccctcgcccagtcttgtgcgctgcgtccagtggctcgacagtcggaaaaaacaccctgctggtggtgggtggcaccggcacactaggcaggcaggtggtccgtcaggcactggacgagggatgatgggggtggagtgtggcgtgggtacacgccctgcatgcaccgttgcccatggtgttgctccctacggtaatgcttcaatgcccatgccgcgcatgcaggcggatcttacggaccctacctctctcccagctgctctggttgggatccattctgtgattgactgcgcaactgcccgcccggaggagtcgaccatggcgatcgactgggaaagcaaggttgccctcatccagtgcgcacaagccatgtccatccaaagcttgagcctcgaagacacagcaagcggcctgtgttcttcttgtcagcactgcgccagctttatcactagcaacatggatctttgcactccttgcgccaccctcatccatgccgggctcatcgccgcacaggtatgtcttctgctccatcgtccactgcgaccgccacccggaagtccccctcatgaacatcaagaacgccacggagaagtttctgcagcagagtggggtggactacaccatcctgcgcctgtgtggcttcatgcaggcgctggtcgccagctacgccatcccggtgctggaggatcgcgcggtgtgggggaccaaggacgacacacgcacagcctacatggacacccaggacattgcccgcctggtcctggcatctttgaggtctggaatggtgtcgggctgggtattgatctgaaggattccctgctgtttggcaagggcatcgtcgacaggggcacttccctttga

SEQ ID NO: 5818 - DNA, 1383 bp, Chlorella protothecoides
atgtcgggcgcaagcgtgcccggactcaaccgagagcaggttgagaaggccgccaaggctcttttaacgtacgcgcagaagaagggacaggagagcagtaacctgctcctggacgacgagctcatctacctgaatattgcactgaaaaaggtcccccagacgccacggaaggacaagcctgtacggctaaacattccgcaccccatctacagcctggagggggcagagcatccgaatgaatgctggagatggtctctgatggcttgcacctgcgaatctcctccaggtgaagggcacaaggccagcaagaagaaggtgaaggaggagcagattgccggagttacaaaggtggtgggcctatccaaacttaggtacgggaattcaggcatacgtgaaggattggacggtgggaggttgctctggaaacaacaaccaacgggcacctaccatcctgacctctccaggacaaagtacgagagccatgaggcgaaacggaaactctgcaactcttacgacctgtttctggctgatgagcgagtgctaggatctctaccaaagctcataggcaaatcctttttcaagaagaagaagcagcccgtgccagtcaagttggtgggaaaggactggtctggacacattagcaaagctgtgaaggccacatactttttctggacgggtgcggtggccccagcctctcaatccgggtttctcggtcctcccacacccaagatgaggtacagagtaggactggcaaggtttgcggtctgcttgatctgcggatactatcttttgttcgttcctcccacaccctgtgcttttacgtctcgggcaaccaccaattccgaccaccctcactccttgcaggtcgtagagaacgtcattgctgccctcaaagatgccttgccccacattcccaagcagtggaatggcgtcaaggtgggtgggagcgctggcaggggggagttgctctctacctggggggggggtgggtctgagaggttgtttgctcttgcgcttccgttttgttgtaggaagaacgccaggtcccctggagcgttcccattcagcatgcgctctgcacaatcctcaatcctcgacacaggcgctgtacatgaagacagcagactcagtggctctgcccatctatcaagcctccccggttcccgatgtagtgcgcatcaaggcctgaggctctcttttgctccggcttccatgctacctcttgtcgtactgctgacatatgtcctgggaatgactgcgtcatggccaaattgccatctgcaaccgtgccctccatccctttgtggaagctgtcatgatggtacagagcagctgagggggcacagacacactagaatcgtcggatgtccttgggaggcttaa

SEQ ID NO: 5819 - DNA, 1998 bp, Chlorella protothecoides
  modified_base (904)..(913): a, c, t, g, unknown or other
  modified_base (1470)..(1479): a, c, t, g, unknown or other
atggcagccgatggtgctggcgcagggtcagcactggtcgtggaggaattccctattgagaagaggtcgctcaaagcgctcgccctgctatccctgaagcggacgtatgatctattccatagttcacactgggaaagcatccccctcgatgaagcttcgcagaaagtaaaaatttcctgcaaggtcagtgtgaaagaggggatggatgcatgcattggtggcccagcattgctcgtggcaggccactctgtgagggatggcagagttcctgtcacctctgtacctttacatgcagaacaaatgccagtcccgtgcgattgtatattcctcctgcagatatccgatgagtatgcgagcttgagcaagtacaaagcccaagctgtcccaggggaacccaaggcgacaggctcggcacccaagaccatcaactccacgctaatcgattcggtgcaggctcaagagaaaggggctgcatcaggcagtcgagacaagcagctggtggtccacggttccacggcaagcatcactcctgctgccaaggcggcactcagcaccactatcatggtacccactgcgacaggaggccaggtaagggcaagcacccagaggtggtgcagcatggcgaatgcttcctgcacaagaaactgcaatctgagtgtcatgtcgcattgctgtgctagatcgtatcagtcagatttgtttgaagcatctgtcaccgataatgtctcagcaatgcaaagagacgcccactcatccacagaaggagtatgttcccagctctgtcattgcccggcgaatccccaacaagtggccacggccagaatggcatgctccctggaaaatgtaccgtgtcatctcggggcaccttgggctgatgagacccggctcgagagtaattgccttnnnnnnnnnncggggcaccttggctgggtgcgctctgtcgcgtttgagccaggaaatgaatggttctgcacgggctctggcgaccgaaccatcaaaatctgggacacagcctctggacacttgcggctcactcttactggccatatagagcaggtgactggcttggctgtatctgagcgccacccctacatgttctcctgtgctcttgacaagcaagtcaaatgctgggacctggagcagaacaaggggtggggagtggccttgcacaaccattcctcacagggcgccttatcctcgaatttaagatctcatcttccattgcctcatgtcctggtatcgttgagggcaggattggggattaaggaccttgctgttccttcgattgcaccatggatctcgacggcattgacgtgcgtccaagttcttggccgttttgctccttgcccacagtttgccgggtgtgggacattcggagcaaggtccagatccactgcctgtcgggccatgaagacactgtttctgccatcctcggccagcccacggacccccaggtcatcaccgcttcgnnnnnnnnnntcctcggccagcccacggacccccagtgatgcatggttaggcacaacctatggcatcgaccttcttcgtgatatgcgcacttgccaaattttacaggccgtgcgtggtctgactgcccacccaaccgagcacacatttgcatcgggtggggccgacaacatcaagaagttcaagctgccacggggagagttcctgcacaacaccctccaacagcagcgggtgaggtgttgcacctgcagtgggagaagtttggtggttgtgagacacaaggcaatcatcaattgcctggcggtgaacgaggacggggtgcttgtgtctggtgcagacaacggctcaatttggttctgggactggaagtctggcaacgcctttcagcagcaggagacagtggcccaaccgggatccttggagagtgaacaaggtgggtgggcagtgttggggttgggagctaatggacattctcttagatctggttgcggttcgttcctagatgaggtgttgcctgctaccctaacgtaa

SEQ ID NO: 5820 - DNA, 642 bp, Chlorella protothecoides
atgttccacggtgagcaggtgctgtggatgccggacacagaacaaacaaggcgcagagtcagagctcccttgccgagagtggtgcgcgggaaggctcgaacttgggcgcgaggtggcagcgtcacggaccgatgggaaggccactgtggtgacaaagagccaccctccagtttggagcacttcctccgcgcagacggtccagccccaccactcttgctgcaacacagccacctcctccaaataaatataagaggagcaacagcgatggcaactgtcgatccgcgcctcgatctcatcagcaaatcaattagggtcgtacccgacttccctaaggctggcattcaattccaggatgtgactaccatcctcttgaatcccgaagccttccaagcgaccacagacctgcttgtggaacattacagagatcagcatatcgatgttgtcgcaggtaggcaccggcattcagggcagcttcgcatgccacccttgcatgctgcatcggcatgtggcccttttgctgctgtgtactgcatggtcccccacaactcattaaaagtgtgcctcaacatagtgcattgcaaaacaatactgcacaaagaatctgagagtacatcactgcaggatttgaggcccgaggtctga

SEQ ID NO: 5821 - DNA, 768 bp, Chlorella protothecoides
  modified_base (93)..(102): a, c, t, g, unknown or other
atgcactgcaattgcgcagctctcatgtgttgtgatgctatcaatcgcaaaccaatcccttcttctccaggtgccaccgtgtctgtggagtannnnnnnnnngtcagggcagcgtcgcatgccacccttgcatgctgcatcgccatgtggcccttctgctgctgtgtactgcatggtgccccacagctcattaaaagtgccaccgtgtctgtggagtacaaaaccgagtactctgtcgacaagatcgagatgcacattggtgctgtcaaggagggccagcgtgtactcctggtggatgacctcatcgccaccggtggaacccttggtgagcttgtcttgcgtgggaagagtgtgggagttgcaagcgtggcttgtgatggtgcagtaaaaacgttaatagtagttgacaaatgtcaaaggctcagctgtccccatggcccttgtccagttgctggggccgagctggtgaggaaggtgggtgcaattccagtcgaagctgcatgcgtcattgagctgccggagctggagggccggaggccgttgggctggacgatccagtgcgacctccaaagggatccctctcacaccagggcaaagcatgaatccgaggaagatcacaacactgcgcacggctggccttccccattgtgtcacttattgcggagactaaggatctcgggtggaggccgggtatcaaacgctcgtgcgaccgtccggcaatctgttgcaaacgggcactttacaaaaggcatctgccggcactgctga

SEQ ID NO: 5822 - DNA, 1440 bp, Chlorella protothecoides
atggtgtcttcagtaggagaacgagcatccacttccagtgaggctacagagacagacgatgagaatacatcgcaaggtctcaagcagcgtaagcggcatggaggcgtgcctgccgccgagcagcaggagccaactcatgccacactgcaccataggccaaccacgagggcccgagctcgtcgaggagcgatcacgctcaagtatctgatagacaagggggtgctggaacccggcaaggacgtcctctcacttgtgcgggagagtgtgttgggtgcagctaggcaacatgattacaaggacctgcggcaactcgccagtctagaaagcgatgggcgaatccatgctacagttgggggcagtaccttcgtctttgaggtgagggatgccgccttcacaccttcacaccaggccgacggtggtggtgatactttaaatgacacacaaaagcccaccagcctccgtcccttcgttcccaacagtccccatcgggcttttcgatcttcatcaagaggctcgtcgtgcccaccaggaaggccgatgatggctggaaatctgttcggtatggagcacagtgagttggggttaggggagggcgctgagaggatagatggcgcagcactcgaacagtcatcaagtgcaggtcctgcaggtaaggtggactatcgatatatcgacctagtcgcgcatacctcactcttcagccttcactgtagggcattggattgtctcaatagcaccgtcaactcactgtctgatacagatcacgaatctctgagcaaagaaacgatttcagaagcatccctgccgccccctgatgcccatcaataccacctgaaggagataatcccgcacagaagtcagcatcatcgttgccgctctaacttctccatacccactgcttgtgcgtattacactaccgacctttgccaacgtatggacgaacagcgaccatccatggggagatcagtgacttcagttctctctcatccttacgatgcggccactcgtaccaacaagaaaagttctggggttggtactttggcagatgaaccttctcatgagtgctcaacgttaagctccagtagtcgtagagcatttttgtcacagacggtaatcaggaaattaccgctccccgagtacattaccgagatatttggcctcattcaagggcaatcatactctgcgcggaatcaaccaaacaggacgtctgcgaatgttgcgaggcttgctcagatcaggctcgctgcacataagtctgcacaacaacagacccaagggttcttcgagcacagcaggtatggagcacctgagggagccgagggtatgcttccaaaagcgataataaaggctgatcagaggaaagaaagcacaggacccacctcgcatatggattggcgtaggcaattggtcttgctccctaagacgccactcgccccttga

SEQ ID NO: 5823 - DNA, 459 bp, Chlorella protothecoides
atgtctggcgagtcggaggccaagctgcggggtgtgtttgccgaggcggccgcagccgcccccgccatcctcttcatcgacgagatcgacgccatagcccccaagcgcgagtcggcgcagcgcgagatggagcgccgcatcgtcgcccagatgttgacgtgcatggacgacctggcggcggccggctccgggggtgcaccccggggttccgccgcagcagaggccgggccgggcatggaggtcgacgaggaggtccggcgggagcctgggaagcatgtggtagtcattggcgcgacgaaccgacccgatgccatcgacgccgcgctgcgccgcgccgggcggtttgatcgggagatcccactcggcatcccctctgaggagggaagggcacgcattcttgaggtgatgaaagaaggtgttggggaatggaaggctcgagggatgggagccctgggctga

SEQ ID NO: 5824 - DNA, 321 bp, Chlorella protothecoides
atggcaggcctgaatattggtgagacgactctagaagccacacccacaggtcaagccaccacttcagcgcaagcggtccagcagcagcaggggaagcgtgctggcaccccctcaaggccatccctgtgtcaccagcgcctccctgcacaccacaggccagggtcaagcaagagggctcgggttgctgggggcgtgcgccttgcctcagccctggccgacccacggcccgtgttctacgctgatctgggcggcattgagagcgtgctggaatccatcaaggagctggtggagcgaccattgcgccacccagaggttggctga

SEQ ID NO: 5825 - DNA, 1065 bp, Chlorella protothecoides
atgactcccaagattcggaacgagctggactttgccatcacccagcccatcgccaacccaggcatctttgctgccatgggcctgcagcaaggagctggcgtcctgctgtatggtccaccaggttgtggaaagacgctggtggccaaggcggcggcggcggcgtccggggccaacttcatctccatcaagggccccgagctgctcaacaagtacgtgggcgagagcgagcgagccgtccgccagctctttgcgcgcgcgggcgccgcggccccctgcgtcctcttcttcgacgagatggacgcgctggccccgcgccgcggcggcgagaccagccagagcagcgagaggcttgtcaaccagacccacacccactctccccaaccactgcaccagttgctgacggagatggatggcgtggacggccggacaggggtatacctcatcgccgccaccaaccgccccgacatcatcgacccggccctcctccgccccggccgcctggacaagatgctgtacgtgcccctgcccgacgccgcggggcgcgcctccatcctgcgcgccctgacccgccggaccccggtggggggcgccctggacctcgacgcgctggccgcctcccagcggctggagggcttctccggcgccgatctggcggccgtggtgcgggaggcctgcgtcgcggcgctgaaggagggcctcgcagctgctggcctggggggtctgggtccaaaccaggcagggccgctggtgacccaaaggcatctggaggccgcggccaacagggtgcagccctcggtgtcgcgccgtgaccgggccatgtacgagcggctgagggacagactgtgcagtgcgaggggccacatactgggcgaggtaggtgggtgggtgggggagcgggcgtgggctgagttgaggatggggagggggtatgtgcgggggagggatgcctggtgccgagaggggagctggtggtgcgggggagagattgggtattgttggaccccatggtgtgccaagcaacccaagcgacaacgaggtctgagtgccccttccagaatcctttga

SEQ ID NO: 5826 - DNA, 954 bp, Chlorella protothecoides
atggccgtggacctcctgcaggctctcaggtcgggtgggcaagcgctcgtggccgcgaaatcctactactttggcgtcggcggcagctccaatgcattcaagaacgcggtggaagccaagggaggcttttcgatcaggtctctggcagtggagggcggtggcgcctcgatccagcgtgaaatcatagtacaaatgccaccagggcgggttagaagaaacaaaggggccaggggcacagcgggtgctgagtgcaagaaggcgacgcttcgtggctcaaccgccaactggctttggtacagaggaaaacattgcttggaaagagggggtgcatcgcaagaacagcgtgatgcatcaggggatgtcctggcgggttacgacatgagactcttacgcctggccacgggtgggctgcatcaggccccgcatgcgcctacgggagcctccgctgttggatgggtggacatggttgtccacccaggtgtcgttcatgccaggggctggtgcggcgccatgcctgcgacgcgagtccctggggagtggcgcatccatcagctctcgctccttctgggcggctccctcctccaattgaccctcagtgaaggatgggactggggagcccctgaggtcggagaaaatcacgccactcccgtcgctgaagacggtggggctggtggggatggaggaggcctcctcgaatgcccccgaccaggggcccaaggactcgcgaccggtgggggaaagcatgatgtcggtgcacccattgctcgaggtcacggcagcctgctcatgccgggttttctggggacgtccccgggtcaggcgtaccctaatggatcgaggggtgtcgtgcgagaactgcgcattggggtgggggtatggtacatgagtggtgtctcgggacaagagcccgaagggcgatggggcgaccgcacaccagcatgtacgagatgctga

SEQ ID NO: 5827 - DNA, 351 bp, Chlorella protothecoides
atggagaagacggaggccaccatgacagagctgcagatagcaaagaacatcgacttcgagtttgagcggatgaccgaggccggtgcgacgctggagcccttgtctggtcccgggcatgtaggcctgaagaatctgggcaactcctgctacatgaacagcgtgctccaggtcctgtggtccttcccagagctggatgcgcggtaccttgcgcagtaccgctctgtcttcgagacggcgccgcgggtcgtgccagatgacctcctgacccaggtgaccattctgggagtgttgccactgtgccagacaagggacttgtgccatgggtttgaggggcgtccctgggtgctttag

SEQ ID NO: 5828 - DNA, 744 bp, Chlorella protothecoides
atggaggtagcagtggacatgccggctcggctgtcgctggaggcctggagatccagcggtgtacaggaggatgaagagttgcagcctgagacgcaggaggaccctggggctagtgccactggggacgctggctcgaacgcgcccgtgccgacactggtggatgagggcctgattgcgcaactggtgggcatgggtttctctgagccgggaagccgcagggcggccgctgcggtgaacagcgccgggcccgaggcggccatggagtggctgctggcgcacatggacgacgccgggataaatgaccccctgcccgacggcggggcgggcagccagtcccagcccagcgccgaggccgtctctgccctgaccgggatggggttcacgccggcggcggcgagtgcggcgctgcaggcctgtgcgggggacgtggagagggccgcagactggctgttcagccgcatggactccctggccgagctggagagcgcggaggtgagggattcggaggccacgcccttggcttcccgagtgagggacgggccgggggagtacgagctgtcggccttcatctcccacatgggggcaaacacggcctgcgggcattatgtctgccacatcaagaaggtgaggaggatgccgttgtccagatgtctatggacggtggtgaagatcttcctgcacggggattacttggtggtgccagggatctcaatgcagcacggcccttcagctgtcaaggcatga

SEQ ID NO: 5829 - DNA, 303 bp, Chlorella protothecoides
atgagcgctcgtacggggttggggcgcctgggtgggtctctgtcggaggaccgcgccctggccgagcgattggaagccctgctgtcctctctggagggcagcttagacctcgacgatctttcctccagcttgagagataggtaccccgagtataggaggaagaagacaggaccattcaagcagctggtggtgaggggcctcgagactgtgcgcagaaagcacccggaacttttcgccgacgaggtgcgagaaggtggtgcaagaaaggagcttgaagattgggagccagtcgaccttctctaa

SEQ ID NO: 5830 - DNA, 348 bp, Chlorella protothecoides
atggcagagatggtggatgcgccagcgaccccgcaaccccacgtcagtgggcccacggcagccggcgccggtgcagatctgcaggagcctcctgcggcctcgggcaggcaggcaggggagcaggataccttgacccgcgctgagctggagggcctggcaatcacgatggcggatgtggagtcagcggtgggcaaggtgcagccgtctgtgagacgtgaagggttcgcaaccacaccagacacgacgtgggaggatgtggggtccctgcaggaggtgagtgggcgagtggcttactatgtcgggatgtgtgtcagatcgtgtgcgctcgatgagcagcatggccagtag

SEQ ID NO: 5831 - DNA, 777 bp, Chlorella protothecoides
atgctgccctccagcgccgcggttcgggaaacatacctgggccccaccgggatcttcagcctgccgccccgcacgctgcggccctccctgctcatcgactccagcaccatcgaccccctgacctcccgcgacctggcggctgcagcggcccgcaccaccctccaccccgacgtggttgagggggcggctggagcgcccagcactgcgccggccatgctggatgcccctgtgtccggcggggtgggcggtgccgctgccggcacgctcaccttcatggtggggggcccggcagaagccgtggcgcgagcccaggggttgctgggcaccatgggccgagccacggtgcattgcggggaggccggggcgggacaggccgcgaagctgtgcaacaacctggtcctgggcgtgagcatggccggggtggccgagggtctggccctgggccagaggctgggcctggacgcccgcaatctcaccaagatcttcaacggctcctcggccaggtgctggtcggcagacacctacaatcccgtgccgggcgtgatggagggcgtcccggcttcgcgggagtacaccggcggctttgcggcagcgctgatgagcaaagacctggggctggcccaggaggcggcggcgcagtgcagcgccgccctgcccatgacagcagccgccgccgagctgtaccgccagctggcgacggaggctggaccggccatcgatttctcaggggtgtaccagcacgtgtacggcggccaagcggtggctgcaaactcatga

SEQ ID NO: 5832 - DNA, 576 bp, Chlorella protothecoides
atggcctgcaaggggtgcccggggcgtgctggcgacacgagcacgaccacacgcctgccttcgcagtgggtcaagctgggaagggcactggtgcacggcctgacgcccaaggaggaaggcgaggggggaggggaggcgacgcccctgacctctgtggcgccctccaccttcaagaccctggtggggcgggggcacgccgagttctccaccaaccatcagcaggacgctgaggagtacctgggctacctgttggatgcgctggagaaaacggagcgcgccgcaggaccagaccgccttgtgtgtggaggggagactccagctcccaaggagctcgtcacatttgagctggaagacaggatccagtgcactgtgtctggcaaggtgacctacaagcgctccaaggcgacgagccttgggctgaggattcctctggatgcagcaacgaaccgcgctgagcttgaagctcgcgaccagaagcggcagcgactggagaatgaggctcctgagggcagtgttgacaagagggtgggctgcggtggggatggcgcgatggtggtgacagcgctgggggaatga

SEQ ID NO: 5833 - DNA, 534 bp, Chlorella protothecoides
atgacacgtagcgaggcgcttctgatcttggtaggcaccgaccccacgatcacttccgcgctgaccttcgcggttctggagcaggaagggctgcatcctggatgcactcatccatggtccataagtacaaagtattacgatgccaacatcagcgtgcgcctcctggatgtgagcgatcccaccccttcccagccagatgcatgcatactggtggtggatgcggccgttggcgagagcctctccagggtgcagcgctggtgggagacgagagcgatcgatggtagctcggtgcgagtgctggcagcctatggcgccgacgaggaggacccccgcctggaagctgcacgggcttggtgcgcagaccagctggtggaactggtcgcggtgcccctccccggcgatggcgctgtcactcaccagcgagggcgtgacccgcatccacgaggcgctgcaggcccacgtgtggcctggactgcgtctgaagccctcccctcaacatgggagagcggcgatgtatgcggctggagagaatga

SEQ ID NO: 5834 - DNA, 471 bp, Chlorella protothecoides
atgaagatcacggagctgcgcctggccaagctggtgggggccgtgccgtcccccgccaacgtggctgcgcgccgaacaggtcagctccaggcccacctggacccaccaggggagagcctgcgttcccccatcaccacacatgtgctggacaccgccaggggcaagcccgcctccggcgtgagaatcgtgctggagagggccgccccgggttcgagcaacgcgtggcagcatgtgggggcgggcaagaccaacggtgacggccgcgtgccggatctgctgccccccgcagccagcgtcgcgcccggggtctaccgcatcacctttgacaccagcgagtacatgcggcggtgcagggacgaacacccggccttcttccctgccaagcccttttacccgcgcgtctccgtgttcttcgagatcctggagtctcaggtatgttggcggtggatgagctgggagccgggtgcttaa

SEQ ID NO: 5835 - DNA, 570 bp, Chlorella protothecoides
gctggcgtgagaacgacctggtgctgctggaggtgtccatcaatggggagcgggtggagccgctggccgccattgtgcaccgcgccacggcgtacaacattgggcgcgcgctggtgaagaagctgaaggaggtgatcccgcgccagcagttccgggtgcccatccaggccagcatcggcgcgcgggtgctggcctcagaggccatccccgcgctgcgcaaggacgtgctggccaagtgctacggcggcgacatctcgcgcaagaagaagctgctgcagaagcaggccaagggcaagaagcgcatgaaggcaaggggggcctgggcagggccaggcgccctgcggtcaagcaccgtgctggtgggcaggcctccaggcgctgtgcctccagagcatgacgccgtgcttccagcgtcgcacggtctcttcctgtcccgagcacggagcccgacgaactcagcgcaccccctttcccccttccaatcctccacgcagtcgctgggcaaggtggacgtgccgcaggacgccttcatggcggtcctgcgcatcaaccgcaccggcggggaggact

SEQ ID NO: 5836 - DNA, 189 bp, Chlorella protothecoides
atgccgccgccgctgcagtggtggcctgtggccgaggtgcccgggcggctggccttcgaccacaagctcatcctccgctgcgctttccagcacctggcacgccaggacgccacgcccgccgccctggccgccggcctgcgggacgccgccgcgcacctggagggcccctggcgccaggagccacgctga

SEQ ID NO: 5837 - DNA, 810 bp, Chlorella protothecoides
atgtctgggacccacacgtatcagtgcgctgggagctccgagatgcggatccatgtcatccgtcagtgcgcgccagtctgtccccgcaccccaccccagacccaccgtgtccgcctctgcaggtacccccggcccggtctcaccgtggatgccgtgatggtgactggggaggagaggccccaggtcctgctcatccgcaggaagaacgatcctttcgccgggagctgggccctcccaggtagggctggtgtgcatggggtgcctagccccaggcacacggcacagctgtgtggtgcctgggctcggcgcgtgctgggtgcgagccagccatcccaggagacacggcatgctcgctccctgccgcacaggcgggtttgtggacgaaggggaggacctgggcgccgccgccgcccgcgagctgaaggaagagacggggctgagcgcgcgagaggcagggctcacccaggcggatttgtggacgaaggggaggagctgggcgccgccgccgcccgcgagctggaggaagagacggggctgagcgcgcgcgaggcggggctcacacaggtcggggccttcggcgagcccgggcgggaccccaggggctggtgcgtcagcgtggcctacgccgcgctcctgcccgcccaagccgaggtgatgggggctgacgacgccgaggaggcccaggtggctgctcgcctcgcggtcagacgtgggcacacctgcgtgcacggagcgacagcccctggctctctgttctcccatcgtgcttgcaaccggtgcacccaggggttggcccctggcgggtcatga

SEQ ID NO: 5838 - DNA, 2223 bp, Chlorella protothecoides
atggcccctgcgggcacccgtcgcccaatctttcttccagcccttgaaaccgggtggtctcaagcgctcgcgtggagtgcacgtgaccaactgcgaggacctgctggtgaactttgtggtggcggaggtcaacgcggcgcgcggcaacgtctctgcctccatgctcaggccgcggcgccggctggacatcagcaagctgatgggccagggcgtgggcatcagccgggaccggggcagccaccaggcaaagcgggaggcctgcgtggagcgcttcgcccagcgcctggtgatgcccgtagagcaggaggttccggtctgggtggaccggccgccctgcttgtcctggctggggtgcgtgtacctgtagagattgcagagagaacccagaggcccctggaggtgcgcggggtggcccgtggagggcgtccgagtggggggggtgtgcagaggggaaggatgaccaggcaggctgcgatgagggcgcaggacccctcttttcaagccggatgccgggcgacgggcgctccgacagccaagcatatacatgtcccccacgggaattactgtacgatttttatttggaagcgcttgcagccgtcgcacggagtgcggaagcagagaaatccctgccttccgtgcggggcgctgtgttggacgtgcgagcccgaggcccctccagggccccagcagacggtccctgacgctgagattgacttgacacgatacctcacggctcgtgcatggagtttgctctgctctaagtccctgaagccggcccgatgttgggggagtccggaatgtccttcgggcgtggcctccccgcagggatgcagttcagctctggggcgaagtgccttcagtttcgacatgactgccagtacgttcctcatcggggcagggatgcgtccgagtgtgctgggcaggggtgcgggtgggaacgagggcaggtggcgtatgggctccgcgagctcccccgctgccgacccgggacccttcccactcattcctacccgcaggaacctgggctgctccaacctcaactgcccgctgtgcaagacttgccagcgtcggaggtgcgagcagaacttcgcctccaagtacctcgcaccctgcgacgtgctggaggccaagtgcggtgcccagatctacgttgtggtcgtggacgcgatgaccggccagctggtgcaccccgacatcgacgaccctcacctccagggcaggccggcagcccgccaccgtcgcacccgccgtgcctccccgccggtgcccctcgccctcctcgcctcctccaggcccctgtcatcaacgcatacgcacatgccccccctccccccccccggcacacacccagatctgcatcgtggacgggcgtcggttcgagcaggagggggagcgggaggaggcgctggaatcgtgcatgctgctggccatgctgcccgacctgaaggtcaccgactcaagcgaggcgctgctgctggggcgcgcgccgcccttccgcctgctggtgcgcctggcggaccggctggggcacccctgccccggggtcaagcacgcgctgtcggagccgttcgtagtggccaccgcgcgcgtcaagggcgcggccaaggccgacatcccgcacgtggacgaccacgtgagcaagatcgagtgcgtgggcgtgcagacgcagcgcaagctggaggacatcgccgcggcgggcgcggcggcgggggtggcggacctgcgcgtgcccgtgaactgcgtcacgcgcgtgggccagttccgggagctggtggagctggcggaggggaacaagccgctgcgcgagacgctgaagcaggtgctgcgcctgaccaagggctgggacgtggcgcgcgaccacgtgcggcgctgcgtggacaccgacgagcgcctgcgcgtcttcccccccgacggccgcaccgacgtggggctggccttccgctgcgccgcgcacaacgtggtggacctcaaccgcccgctgggcctgctgcgccggcgccagaacccggcccagcccaaccaggagatggtggacgtcatctggctgccccaggacgccgccgccttccccgaggcggtgcgccgcctgctgccccaggccttcagcgcctggtggcgcgaggggcacccgggctgggcgctgctgccgctgaccaccagcgcgcatgcgccgcgctgggacgaggcggggcgccccgccaccgccaccgcctccttcacctt

SEQ ID NO: 5839 - DNA, 1323 bp, Chlorella protothecoides
  modified_base (1204)..(1213): a, c, t, g, unknown or other
atgtggaggggtggggtaaggtgtttgtgtgccgtttcccctcttcccttcccccccccatcaccccccaccgtttgggctcccacccctccccctctgcagattgacctgtatcgcgacactcgggagtccatccagctggccgcccggtgcggcctggccctgaaggacatgcagcccgccgcccgcgagcgcgccttccagagggagatgaaggcggagaacaacctgcacccagccatgcacagcccgcaggggcactacctggtgggtgcgccgcgagcgctggatcgactcgttcgaggctctctgcaggggccatgggcgtttgcgtgggtcgacaggcatgcctttggggggggggggtctgcttcgggagaccaaggcccgaatgcggtccctgcagactcagcggcatggggtactgggctgcaggggggtactgggctgcagggggggggcttgggctgcagggaccccacaaaggctaagccgcccgtcacccccccaaaaatgaccaccgcagatgctgcgcgccgtctcccgtgggattgcgcgcctgctcctggaccccaaggacatccccacccgctgtcccagcttcaccgtgacctccgaactgctggcggcggtggtcctgcgcccgctcatgatgttctgccacccctaggtccagtggctgagtggttggggccaggctgcttggtgtcatggggcagagcccccaatcaatggtggaacccttcctcacttcctcccccatcaacccctccaccgccgccccaccggcagccacgtgaacaaggtgcgtgccaccgcccgtggaggcaccccggctttttgctggactggggtctctacgtcctgctgtccgccacgcagcccgggaagaagacggcgtccgccccgccccgcgacggccagacccccgtcctcaaggcggcactccctgcccgtgcatgtgccattcccttcaggcttgtgcggagtgcggcgtggacaggcaggggccagggggcaagagggatcgagtttcagggaaccacaagccttgatcgcagccacccccggcataccctttgcctcaccgctgccccatcgactgcatcaaacaggtcgagcgtggcgctggaggccagcgcggctcacagcgcggagggcagggagcgcggctcgtcggcaggcgccccgcgcgccgcgccgnnnnnnnnnnggcgctggaggccagcgcggctcacagcgcagagggcagggagcgcggcccgtcggcaggcgccccgcgcgccgcgccgtcggctcgcccccctcgcccgggctcgccgc

SEQ ID NO: 5840 - DNA, 858 bp, Chlorella protothecoides
  modified_base (553)..(562): a, c, t, g, unknown or other
atggcgaggagcagggttggcaccggtgtgggagggcagtcgtgggcgtggacgcccctgaagtcacggccactcattctgcagggccgcgtcccgccaccccgaggtactgagaccgctatgagggggggaagggggcgggggtggccggcccacacactcgaggcacagactgtagcaaccggggtcaaatttggaatccgagcaaaggatcagagcccgatcgctttcggctccagggcacccgatataacaccatgccgggcgagacctgtaccacatgccctcggaagcagaccagtaatctcccatcgctcaagtcttctggcattcatggtgaccgcgtgcatcactgctagcctaccggcagcctcccgctgtctgaggcgcccctcctcaggactcggagcgcgggctccgctcaccgtccgccccagggcgccgtccctgcgatgcaggcgagtcgtgcacctagggttggggtgtgcgccctgtactaaccctccccccgccattccttccttccccaccccatgcagagctgccagtgagnnnnnnnnnnccagcaggcctggttacaccctgtgtgctctgccctgtactaaccctccccccgcctttccttcctgccccatcccatgcagagctgccagtgatgggtcgcagcagcaagccatagcggcaggtgtcacagtcggacttggggcaatgatggcccaccccctggtggcagaggctgcggtcacgccctccctcaagaacctgctcaactcggtggtggccggtgggctgctcctcggagccattgtgggtgccatcaccctggtgtccaactttgaccccgtccgacgacagtga

SEQ ID NO: 5841 - DNA, 354 bp, Chlorella protothecoides
atgacgagtgttgagagcgtgggccgctgctgccggcaggggcgtgagcacagctcgcacctgtttccgggcgtctgggttgcagccgatgcagcccgggcgcggggccagctcgaccacccggccactctctgcaccccgcagatcggcatgttctccttcaccgggctgtccccgcagcaagtggaaaacatgaccaacaaggtgtggctgaaggggggggggcggatggcggtgtgtgccgggggatcaagcaccgcagaccagcggcctctggtcgtgggatgcctgccgacgacctggcagcctcggcctgagaggtgccccacaacccacccctcccttgccccctga

SEQ ID NO: 5842 - DNA, 1521 bp, Chlorella protothecoides
atgggggcagtcgactggacgccgtggagatggcccctcccgatccaagtgaagctcgtgttggggcatgacaggggaactgcacccgacgtggctgcatgcccgtggacacagcacctcggcccgtcctgcaaggctgtggtcgggtgtcggtgccccgtccaccatccccgtgccccctccccccccgcgcgcagtcctgggcgtgtcggaggcattcaagcgcgaaacctcaacagacaagctgaacctgggggtgcgtctgggctcccatggggcctactgcgcggcgccgccgcgcccccgcacgtgcacatcctggccactccacgtgcgggcgccggctgccaaccaccaccgcgccccctcgccctgcaggtgggcgcataccggaccgaggagctgcagccctatgtcctgagggtcgtcggcaaggtgagcacccccggacagccccgcccccaaccgaccggccgccgcggggctccacaccccacacttgctgcgggatggccccagatgcacacgctcgccggaacccccgcccgccgcgcaggccgagaagaggatgctggagcggggcgacaacaaggagtacctgagcatcgagggcctgcccgagtttcgggccgcgacggtggagctgctgctgggggccgactccgccgcggtgaaggaggtggggcgccggggggccgacgtggcaggcgctgcctcgggtgtcggaaaggggggaaatggggggccctgggcgggcggcggggcggaaggacccccgtccccaggctctccgcagcgggggccgacgtggcaggcgctgccatgggtgtaggaaaggggggaattggggggggcctgggcggccggcggggcggaaggacccccgtccacaggctctccgcaggaggcagcaacacattttcaagcaacccattacccacagcatccctccccacccccaccccccgccctctggacactcccatcctcctcccccacccggtcgcgcagggcagggtcgcgacgctgcaatccctctccggcaccggcagcctgcgcgtcgccgccgccttcctggccaagttcctgcctggggtggcggtgtacctgtcccgtcccacgtggggcaaccacaagaacatctttggggatgcgggggtggagtggagggagagagcagcggtgcaatgctgcatagcatgtcctgagccgctggagcgtgcgggaagctcgggcgggggtggcgctgcctcgcgcgacggacgggtcacgccgtgcatgctcccagggcagggggtctggcggctgggcggcgccgacccctccccggcaccctgcccagccccgacccccgccgccgcctcgccactcaccccgccctgccgctccccgccgcacgcaggctgtgcgcacaaccccacgggcatcgaccccacccgcgagcagtggtccaagatcgccgacgtgatcgaggagcgacaccacctggcctttttcgatgtcgcctaccaggtggggtga

SEQ ID NO: 5843 - DNA, 1764 bp, Chlorella protothecoides
atgtctagtgctgcctccacagagctggcccaggcccccgcccctgcctttcacgcctacctagacttcaaggccattcagcgggaccctacctccctggtggaaaactgccggcggcggggagcgagcgccgacccggagcgggtggcggcgctgtatggccagtttctcgagctgcagcaggcggccgaccgggtcagggcagagcgcaaccagaacagcgcccaaatgaaggccaagctgggcgcggaggagcgcgcggcactggtggccgtcggccgccggctgaagggggagctggagggcttgcagggacgactggtcagcctggaggccgcgctgcaggtggagggccaacgcctgcccaacgcgacgcaccccgcctcgccggtgggcggggagggcgccgagcggctgctgcgcagcgtcggcacgccgcccgcgtttgccttcccactgcgcgaccacgtggagctcgcggcccacctggacctggtggactttgcggccgggagcaccgtggcggggcccaaattctactacctcaagcacgaggcggcgctgctggagcaggcgctggtggcgcacgcgctgcgcgcgctggtggccgccggcttcgtgccgcacgcgacgccggatctggtgcgtgaacacgtgtttgagcgctgcggcttccagccgcgcgcggccaacacccaggtgtactcggtggagggcgcggggctgtgcctggcgggcaccgcggagatcccgctggccggcctgcacatggacgcggtgctggaggaggaccagctgcctctcaggctggcaggcgtcgggcactgcttccgcaccgaggccggcgcggcaggtgtgcagggggggtgcggcggggatcgggcggcggggatcgggcggcgggggtgtcgctgcgatccggtgaatgccctctcctctcctcatgtcaccccagcaccccggccctccgcccctctccgcccgtgcgccacccgctccccccgcctgcccacgccacccacccacccgacccacccaaccctgccaggcgctgcggggcggggcttgtaccgcgtgcaccagttcaccaaggtggaggcctttgtgctgtgcacgccggagcagagcgaggccctgcacgaggagctgctggagctggaggtgggcctgtttgcggggctgggcctgcacttcaaggtcctggacatgcccagcggcgacctgggcgcgccggcctaccgcaagtacgacgtggaggcctggatgccggggctggggcggtatggggagatctcctccgcctccaactgcaccgactaccaggcgcgccgcctgaacatacgatacaggtgggcatggggtggggggtgggaaggtggtatagccagcttcctgggcagcccccgcgagaggggctgcccaggaagctggcctggcacctgcgcggcatccgagcacttttgccggtcaggcaatgcgctgagcaggcccagtccccgcttgcatccacacacacgcaggccgcggctcgaggaggtgggggacctgggtaccagaagggcccagggcacccgcttcgtccacacgctgaatgcgacggggtgtgctgtgccgcgcatgctggtggccatcctggagaacttccagcaggaggacggcagcgttgtcatcccgcccgccctgcggcccttcatgatgggcctggaggtcatccgccccaggaaggaggcgctgcgggaggcggcgcgcgcgggggggccctga

SEQ ID NO: 5844 - DNA, 582 bp, Chlorella protothecoides
atgacgcattcgccccgcgcctcttcgtggagcggggcctggaggtcctggtggcgcaggcgcggcgcggggaccgtggagggcgccacgaggggccaggcgggggggcatggggggctccctgaacggcggcgcgggtgcctggaccgcgccgcggcgcccgccggcggcatcgacacgcacacacacacacacacacacacacacactcccccatctgtttcctgcccgtggctgggagctgcggaatgcaaggccgcccctcccctcctcctgatcgcacccctggccgacgcgccgccccgcccccaccgctggcccctgccagccttcccccaagccagcccttcccccgccctgtccgcgcagtcgtacagcaagaacctgggcctctatgctgagcgcatcggcgccctgaacatcgtgctggccagctcgcaggcggccgacagggtgctctcccagctcaaacgcatcgccaggtggggttcatgcagggcgccgcgctgcgggggaaagggttgcgaggggggaaaggtgcagggtagtctcccctcctggtggcgtgggtggggagagtga

SEQ ID NO: 5845 - DNA, 2214 bp, Chlorella protothecoides
  modified_base (680)..(689): a, c, t, g, unknown or other
  modified_base (1720)..(1729): a, c, t, g, unknown or other
atgacgccgagccagcacacaccactcgccctcgacatgacagcgccctggcacaggtgcgcagcagtattgtggtttcgttctaatggaccttggcactatgtttcttcggcgctgcgtgtggttttctcggagggcccggcacaagtgctctcctccccaagattttcctccgctggtggggcttccagactttgcggagtcccagacttctggccaacccgtcggccgtgctccccttccccaccgtgttattttttatgctttgtttccgattccgggggtggagcggagagccccatggcgatcgatgaggcaatatcttcgggaatgtggggggcaggtaacgtcatccccgaacacaccaccttccgcgtgtcgtgggacttttgtcctgcctccccttcccatccttctctcattccgatacgcttatgtattccttctacaaggaccgatgagcccaccttgacaggcgtgcgaccacacatgaagctcgtggaccggcctgccccggccctcttccagacgtcgacagagacgaacgaggatgatccaccagccaaaagatctagaagaccgtccaccctgcacactccaaagtatgtggccatggatgatggaggggacgacaccgacccagagttcagtgctgcccctctagcagcttctcacgtggnnnnnnnnnnaccgacccagagttcaggtacagaatggcgcctcctgcttgaaaggggaaatttctgtggtgggcgttcgcactgctgcccctctagcagcttctcacgtgattctgcccccccaaccacttgcagccctcgcaccacgccttcgtctgccccggcccgccgaccccgtcagggtcttggcgtacgtggaggaccttccaaatatcgcggcgtggtctggcacaagtccaattccaagtgggaggctcgcatctacgagggtggcaagcagaagtttctgggctactacaccagcgaggaagctgctgcccatgcgtacgacacatatgccggtatgttggaagggtatgggattgcggcaggccctgtgcactttgcctgcagtccagtggtctcatgcgtagggaggtgcagagatctggtgcttttctcttgctttcaagacaatggctgcccaggccctgtgcacattgcctgcagtccagtggtctcatgcgtagagaggtgcagagatttggtgcttttctcttgcttcatgacaatggctgcccagaagctcaacttcccggagctctacgcgtcaggggcagaggtctaccacgaccccggcacgccccccgtgcgccacaccgcccctggcccgcgcgcggcgagccccctggcccgccccccgccctccccgcgcaaggcgggcaagtcgcgggtgcagcccgtgaagggcacctcccgcttcaggggggtgagctggaactccaactgcgccaagtggcgggcgcaggtgtggaagggcagcgaagtgcaccacctgggatactttgagggcgaggaagacgctgcccgcgcctacgacgaggctgtcctgcgcatcaggtgtgtgctggcgctgttcgcgatatgtaaagctgagagcatgtgtgtgggaagctgtcggttgagttcgagattctatgcaatgatcaagactgcgccctcaccccatccccttctcaaccccgccccctcccccaccaccaggggtcccgacgcccccnnnnnnnnnntatgcaatgatcaagactgcgccctcacccttatccccttgccaaccccgccccctcccccacaactaccaggggtcccgacgcccctaccaacttcccgcgctcccagtacggcgccttccccgtcccgggcgaccacgacttccagggcggcgccgccatcggcgcctccggcttccgcggcgtcagctgctgctgggcagcttccgggacgaggcctcagccgcgcgccgctacgacgtggcctgcctggagctgaacggcgccgacgcgctgaccaacttcccgctgcagagctacgaggcggagctggccgcggtggcgctgcgcgccatggccgccgagccggggcccgtgtgcctgacctcgggcagcggctggactcgggaggagctggagggcgacgaggtgggggaggagagcagcagcctgccggccgccggcgcgccgcgcgccgcgccggtcgcgcccgtggcgatgcccgc

SEQ ID NO: 5846 - DNA, 1911 bp, Chlorella protothecoides
  modified_base (9)..(18): a, c, t, g, unknown or other
  modified_base (447)..(456): a, c, t, g, unknown or other
atgcggctnnnnnnnnnnctcgaggcggggaaagcaagcagagacaccatcccctggcgcagcaagtgtcttatgcttcttcttactggcaagttacaatggctccagataggccatgcggctgccgtgtttgcagcaccacagtgcaccctcccggcccggcacgtgcgctgcaggatcgccggactccaggatcgacggactccaggttcaaagcctgctgccctagtcagactgggcaccccgctcaccgcttttgacttgaaggaggaccactccatctttgcggctggcaccgcaggtttgttggtgggtccttgtgagtgtccttgggggaggcaatggcagtggacctcaatgcgttcccctgggcacgcatcgcgtggccaggcaggcgatgaggacataggtggcgcgggtgtgggcgctcccctgcccagcctcatnnnnnnnnnncggtgggtccttgtgagtgtcctcgggggaggcaacggcagtggacctcaatgcgttcccctggccacgcatcgcgcggccaggcaggcgatgaggacatgggtggcgtgggtgtgggcgctcccctgcccagcctcatgccctacctggcgccgtactccctctccgatgcactcgagactacccttcatccacgaaagtcctaccatctccgcactcacagaaggcatcgtgtatctgtatgacccccgcgcccctgctgggcccctggccgcgctttcctcgggctcacgccggcccatcaccggcctgcactggcagcactgctaccacagccctccctcccgggctggcaatgacgggagggctggccaggaaacccgctctgcccggcccagcgacatcgcatccagcggcaaagcgccgacaagtactgctggccagtctggcactgcccttggcccctcgtctcggagaccagacgcgctgcctggcctgccggctgacagcgttgccgctgccggggtctgtacgtcgcacagcacacttgccaacctcggtggggcggggcatgtgggaggacagccgacggggccctccgaccatgctgccacatctggcaccgaggccagcagagcgatggacgcggctcggtgtcgtgaggcggcgggggcccgggcggcaagcggggcggctgcggccgggctcgcccatccggaaagcctgaacgtgacgccctttgtggggttcaggcatggcgtgggcccagcaggcagcacggcgccgagcgcaggggcagctgcactcgaggacattcgcaggcggctgccgttggcgatcgggtcgcggtggggcaccgaggccggccaggaccgggcggctttcacgcctgcgccccaggtcacggcgagggagtggagcgaggggcccaggtgggaggcagccagggagggcggcgacgctgggtcggcgggcggcgcgcagggtccgcgcccgcacgcctccgagccgacgtcgagcacggccagcgcaaatgccaacccagcactgcagcgcgcgccctcaggcgcgcgcctgtcgtcccccgccaagtcatcgcccgggacggactctgggaagaagggggcggacatggcgcaggagggctggcggatacctgctgtggcccgcgactcgccgccgcgcagcttccgaccggggcgagaggcggccgagggcccgggctcgcccgacggcagcaacgagtcggtgcggcccatggaggaggactccctccttgggactgcaccggcacagggcgccgcagcagggtcgccgctgcgcaggcagccgcccccctcgctggccagcgtgtctcgggatgacctcctggccctgcacctcgacatgctcaaccagttccaggtggggtggacagctgggctaaagggggaggtgttcgaggcggtcccataa

SEQ ID NO: 5847 - DNA, 813 bp, Chlorella protothecoides
atgtccctgagcaaagggcatcggaatgggagatgtgggtcctccttgccggagagtttgcctgatctgggcatcaaaggggctgatgcatcctacggcctgctggcccccgaagacaatgacttcagctatgcccgcttctccgacgacgacccctcggtcgccggcggcgcagagctgggcctggaggcggggcagcagcagggcgggcatgctgtgcccgctgggcacggcgcctcccatggctccgaggagtttgactttggggaggtcatggtgcaccaggccatccacgccatcgagttcgtgctgggctccgtctccaacacggcatcctacctgcgcctgtgggcgctgtcgctggcgcactcccagctctccgccgtcttctacgaccgcgtgctcatggccgccatcaagagcggcaaccccattgccatcgtgattggtgcggggagttttcgttgcgttgtgggtgggaagtggggtgggtgggtgatttcaggaggtctaggatctgcattggtcagggcagcgcccggggcatgcgcagtcatcctttccagggatctggcaggaccgcaccctgatgatgcacgcacccattcccacagggttctatgtcttcttggtggccaccatctccgtgctgatgctgatggagtcgctgtccgccttcttgcatgcccttcgtctgcactgggtggagttccagagcaagcactactttgtctggggcccttttcccgccgcatggcatgcctcggtgcttggcatgcgagacatggagagatcatgacaagcatgttttag

SEQ ID NO: 5848 - DNA, 1752 bp, Chlorella protothecoides
  modified_base (1346)..(1355): a, c, t, g, unknown or other
atgaatcctctgacgcagatcaaaaatacccagaagatcagcaaggatgagattgagctgggtctcagcgacaagtcttcctggcactccaggttcaagcactctgcctacatctttgctggcgggctgcccctgaacctgacagagggggacctcctcgccatctttgcgcagtatggcgagatcgtcgacctgagtctcagccgggacaggaagacaggcaagttgttcattgtgggaacacgagtggacgtccagattcggtggcgcaccatttggtggcttcggcagggctggtgtttggccctgcaatcaagtcctcgtcctcctgcacggcagtcgctgaaagccaaagggctttgcctttctggcttacgaggatcagcggtccactgtagtagcggtcgacaacctctcgggcgccaaggtctctggtcgcacgctccgagtggaacatgtggacaactaccggaggaagcgcgccgaggtgagagtgtgtcagaggctgaggagacagctggagtgcggggaccagacatggaaggcgagcctgatcctgggagtggtgcggaggacaccgcgaggccagacccagtacggagtcggtcagaagctggggcccctgacgcccctgcacgacagccacctgtgccagcagacgagccctgggcagctggaagcagcgtgttcagtatgttgaacgctccgctgccgccaaacctactgcggccggctgcggtcagcggcgcgaacagcgacaagcccaagaaatccaaaaaggagaagaaggagaagaaggagaagaaggagaagcgacgggggctgtcgcctgcaccaccttcgccgctacccagagactcgcccgatgatgaggaaggggcgcagggccgagtcaccaccccggcggcgccggctccgcagccccttgccagacagggatgcccgccgtcccaggcggagtcgatcaagggaggcacggcggcgcagctactcgcctgcaccgcgcagggtccgggactcccgctcgcccgtgaggtatcggcgatgacagtgagtgcgtgtgtccgtgttgaggctcagcttttcgaagtgagggagccattggcacccacttgtcaccccgtgtactgtcctggctcacccaaggcatctcacccaaggcatgtcagtgccctacatgctgccctgtcaagaccagggcattgtaaaaggactgagaatccagtccagatggcagagggtctcagggggtgtggtgtaggcctgaatcatgagcgtgcgccccagcatcgactggcgcgacacgcttggtgcagctcaggtgtccctcctcaggtcatgccggnnnnnnnnnngacagcgtgcgccccagcatcgaccggcgcgacgcgcttggtgcggctcaggtgtccctcctcaggtcatgccggcggccacgctgcgcctcctcaggtcggcggcgctgcacaggaactggtgccccaggcggccgggctcccgaccgtgccagggcttctggttggtgaagtgcagtaccacgggagccacgccgcctaccgtgaggttgcccaccaggctctgcgccgtctgcgtgcgtcggagggtgaggtgatcgtacagggttgggttatggagaagggggtggataccacgggggcctcggtggcaggagggggggaggtcaggcgcggcagtggtcccaaacctcccttgaaatccctcggcgtgcaccaccgcttgtcccacagatga

SEQ ID NO: 5849 - DNA, 1911 bp, Chlorella protothecoides
  modified_base (789)..(798): a, c, t, g, unknown or other
  modified_base (1388)..(1397): a, c, t, g, unknown or other
atgcatgggaagaagcctgcctgccacacgatgtcatctccatctcggcgtccagccctgcccagccgttgcccacacgatccattccatgctttcttcgcagaccgtcgactccagccccatctccacggtggccaaggccgagctgcggggcgagctgcagacccagctcaaggcaagcatggcttgcctggggggtgggtgggtgtttggcatgcgaggcatgggcacgagtccaaccggtattgcctttcccaggatcccgctccctcgcctggggaccgcatctgcctccctgagcatacgcatacacgcgcatcaccctccctcgccccttgcacacaagtacagagggtgctggacgagcagaagcgcgaggcggcggcgaacaaggaccgtgccgtggcggcggccgtcacggccgccgacgccgcggcggcggtgggctcccgcttcctcgtcacgcggctggacgtgggcttggacgccaaggcggtgcaggaggcgtggaacgccatcgccaaggcccacccctccctccccgtcctcctggcctcggcgggggaggacaaggccctggtcttcgccggggtgcccaaggaactggcccccggctttcctgccggcgagtggctcaaggcggcgctgggcgccatcggcggcaagggcggaggcaagcccaccttcgcccagggcatgggcccggaggtgggcaagctggacgaggcactggcggtggcggggaagctggccaccctcaagctgcagccatggtttgggaagatgacnnnnnnnnnntgtccacggacccctgcatgcctctcatctactttcaaggccatggttggggaagatgagccacttatgtattgtaagatgcatggacaccagagagccggtggccccacgagacgaccgctcggtcacattgagagcgggtgccggtggcggatcagggcgcgagagcggggtcgggcgaaggagggtggaagcctgcgccatgcccacggaagccgtgtgcagcaagatcgcgcgttgcactgggacagccacggtatgtttctcctcgtcaccggcccagctcggtcaacaggtgtgtactgttttccctcccaccgtgatgtggtgttgagtccaccccatgcgtacatggtcgatgcgagccagcctcgcagtcgctcctgcgggggcccctggcggggcttgcccgcctgggctcgttgcgcgctccggggcaagcccatgggcagcgccgatgtagagctgcaggcagcccccttttcctggtgcgaaggcctttcctcatgcgtacctggtccatcggatgctggcgtagtcaagtctgctcttaccgctccttacaacccaaagtcaagccctaccccctnnnnnnnnnngcccccttttcctgtcaagccctacccccaccgccgtccccaggccccagaacccccgccgctccacctacagcgccttctggcgccgggccgcgcccttcgtcgccctctgcctcctggtgctggtggcctacaaccgcaggtccctcttgcgccatgcccaggacgcctttgccgcggtgtactacaagtccgacccggccatgatggggcgcagccacgccgccttcccctcccccgtctgctgcacgggccagagctgcgtgcccaagggcggcggtcgtgtggtggttctgagcacgctctcctcccccgcctacctgccgctcttcctgcagctggagtgcacgctacgcatgtccaacccgggcctggagctggcggtgctgctggagccgggcctactgcccaagtccagcgagcgcctgctgcgcaagctgggggtcaccctggtgaagacgtcccccctggagtaccccaacacctacgaacccaggttggttggtgggtgtga

SEQ ID NO: 5850 - DNA, 678 bp, Chlorella protothecoides
atggaccttttccgcagcgaagaggtccatttaatgcaggtgaaagatcgtggtaccaagagtatggctctgctggctcagtggagtgtcaccgagtatggtcgcgctggggatcgcctgtgccagcgagggcgacgacccctcccttccctccccccgcagctgatgataccctccgaagtcgcccatgacaccatcgtggccttgggtgaggtgggcatgctgcagttcaaagacctgaacccggagaagccagctttccagcggacctatgctggccagatcaagcgctgtgacgaaatggcccgccagattcgcttctttcagtccgagctggagaagcgggagatccccgtcgcgcggcgcggcgccgaccctcccacccccgacctggatgcgctggagtcgcagctggcggggctggagacggagctgacgcagctgaacgccaacacagatcgtctagaccgctcgtacaacgagctgcaggaactgcagctggtgctggagaccgcgggcaccttcttcgaggacgcgcactccaacgccctgcaagtccgcgatgagcatgccctgaccgcggaaggtgagtggttcaacagctgttgggagttccaggggagttgtttgggtgacaagctgtggcaaggacgggccagatgcttctccctggtatag

SEQ ID NO: 5851 - DNA, 948 bp, Chlorella protothecoides
atgggcacgggcgactacccggccgagctcctggccgggtgctccggcaccagcctgcatctatggagggtgaataatgtgaactccagccctcccgtgcccaacagtcaccctggtcagcagcccctggaggtcgtggcgtggaaccggaacaacaaggtggtcgcgggggcacgggccgatggcagcgtctccctgtcgtacagcaatggcgaggccatgagcgtgctgaaccgtcctgccggctccagtgcgatcgtcactcccaccgccctggcgtgggccagcgggtccaaacgactggcagtggcagacaggaacggcgccattggcgtgcacgacatgaccaacaaggtaggcgacaggatcgcctgtcattcgctcgtagatgcttgctgtggatggcacatcgggtggagcgtgggctgttggcgccgcacacccaccggtgctcactggggtgacgccgcgccagccgtgccttccaagacccggcccgtccccttcccaccaccctctgcaggtgagagatgggggtcggtcagcctggggaccaacgcgggggggttcagcctcctccgcctcctgcacaccccaacgcaagcctttgctgatacggaaacactccccgcctcgactctcgactcccagtggagcctcggccacgctgttggacagggacctgcggcctgttggacaactgaccccggaacctggcatggcgcccgccacatgcatgcacctggactccagctcggcttgcctgaccctgggccacgccgatggcagcctgaacgtgtgggacctgccctcccggcggactgttgccgcctcccaagcgctgggccgaggggggatctgcagcgtgtcctctccagccggcgacccgagctccgtgtacgctgccgccaaggatggcagcgtgtggtgcctggtgagcgtgggtga

SEQ ID NO: 5852 - DNA, 891 bp, Chlorella protothecoides
atgctcaacactcctcccaacgacccatccaccgactctttcaccgtcaggtacggcaagaacttcgtgaagctgaaggccttcaacctgacccagtacgacgcggtgctcatggtggacgccgacaccgtgatcgtgggcgacgtggcacccctctggtccctgcccaccccctttgccgcggtgtgggaccagtaccgctggctgggccggcaccgcaccggcctgcgcggcctcaacggcggcgtgctgctcctgcgcccctgccccgccgtcgccgcccacatggcgggcatcctggagagccaccccaagctgcgcttcacccaccgcgccgcggagcaggacttcctggactggtacttccggtacacagggaccgtactgcccctggagtacaatgtgcagggtgatgcccactcatcgcgaggatggctggggcgcggggtgttggtgtcagagcgggacggtgggtcgaccgcggcttcatctgtgggacaagcggcggtgcacgccgagggatttaatggaggtttgggaccactgccgcgactgaccttcccccctcctgccaccgagtcccccgtgggatttcaagggaggtttgggaccactgccgcgcctgacctccccccctcctgccaccgaggcccccgtggtatccacccccttctccataacccaaccctgtacgatcacctcaccctccgacgcacgcagacggcgcagagcctggtgggcaacctcacggtaggcggcgtggctcccgtggtactgcacttcaccaaccagaagccctggcacggtcgggagcccggccgcctggggcaccagttcctgtgcagcgccgccgacctgaggaggcgcagcgtggccgccggcatgacctga

SEQ ID NO: 5853 - DNA, 1722 bp, Chlorella protothecoides
  modified_base (929)..(938): a, c, t, g, unknown or other
  modified_base (1166)..(1175): a, c, t, g, unknown or other
gccgcggcggccgccgcggccgggcccctgaccaacaacatctcggcattctccttgcgcagcgtgccctggctaggctctcgtgctgtgaggccccaggggtctggtgacagcatggaaccccggtccggcccggggtccgccgtggtggccccagcgcagcgcgagatgccaccccagcatccccccccctccgcctcctcctccatggagtggtacgtggccgactgcgcgcgtacgggggtgcgctacgtcgtgctgcaggggtcggacaccctggaccactggcgcgtgaacctgacctttgaccccgtgcccttcgagggcgccgagctgggcacccaggtccaccgcggcgtctacgagctggcgtgcgcgctgtaccccgtcttcctacccctcgtgcgcgagcacgtgatggcagcggcgacagactcgcccggcgcgccgccacgccgcctcgccttcacggggcactcgctgggcggcagcgtgggcgtggtgctgtcgctgatgctggtggcgcgcggcgagctggcgccgcgccacctggcgccggtctacacctttggcgcacccgcggtgctgcacgacggcacgaacgacggcctgctgtgcgcgctgggcctggacgagggcgccgtgcgcggcgtcaccatgcaccgcgacatcgtgccccgtgcctttgcctgcgactacgcgcccctggccgaggtcctgcggcgcctctccgccgccttccggggccacgccgggctggcgccgggcgccggacgccaggtgagcgcgcctgggagggggccagaggggggtgggcgttgtggccctcatggggcaagagcatgtgggcgagagggtcggtcggcgggccgggcaaacggtgcacggggaggctcatcgacgcggcgcggcaactgctcaacaccgcnnnnnnnnnncgttggccctcgtggggcgagagcatgtgggcgagagcgtcgttcggcgggccgagcaatcggtgcactgggtggctcagcgacgcggcgcggcaactgctcaacaccgcccgccggcggcccacacgagcccaccgccgccgccgaggcccctcctctccacggcattgcctgccatgtaccgccacgtggggcgcctgtacgtgctgcagccgccggcggagctgnnnnnnnnnngcccaagcctgatccatctctgtgccccccacccccaccccacgccctcaatgacccccccccaaaacaatacactcaagcaggccatgtatcgccatgtgggccgactgtacgtgctgcagccgccggcggagctgcgcttcacggcgcgcgagggctaccacccgctcctgccggccgcgcccggcctcttccgcttcgtggcgcccggcggtggtacgcggggggcgaccgcccgtgctggccctgcaccctcgtccaccgcacccagcaccaagccctgcacccggccggactccctggcaaacgcggtgtgggccttcatgaacgacacccatccgctggacacgctggcggacccggcggcctacggtcacgccggcagcatctcccgcttccacaacccggacaactacacccgcgcctgcggcgcggtcctgcgcagcgccggcgccaggctcgagcgcgtgctcgggcgcagcgtgagggcggggcgcgggcaccgtgtcccccgggccgagccgcggcgccagggcgggccgggtga

SEQ ID NO: 5854 - DNA, 1977 bp, Chlorella protothecoides
  modified_base (215)..(224): a, c, t, g, unknown or other
  modified_base (1138)..(1147): a, c, t, g, unknown or other
  modified_base (1489)..(1498): a, c, t, g, unknown or other
atgaaccctgccatgactgtgccctttgtggcactccactctgcctgcacaggggaatggccgcgcaatgcttggggacaaccgcaaggcctgatttctggcagttggtggcagaggccgagcgtcgcacgcgcagcaccagcgctcgttgccttggagtcctctcctgggcatgcacagcgaggaggcgagcaagatgtgaccaatatttcagnnnnnnnnnngaattccaggggaatggccgcgcaatgcctggggacaaccgcaaggcctgattctggcagttggtgtcagggcccgagcgtcgcacgcgcagcaccagcgctcgttgccttggtgtcctctcctgggcatgcacagcggagaggcgagcaacgaggcgagcaagatgtgaccaatatttcagcatcgacaggggtgacagggagagacggtgcttcccaggagcgagctttaattctggcgagcggattcgcaccctacagcgaccaggcacaatggagttggccgcgaccaggaggaggccttgtcttgtcggagcacgcccatgggcagcactccggcaaggcgcatgggcccctcaagatcaccgatccagtggcgttccagaagatgcttgccgacatgaaggccaaggctgaagagcaaaggtgggtggtatgcctggggttgtcagcattagactgtgagtttattcgcttgctacgggtgtactccatgctacccgagctactcacaacaagtcccaaatccacgccgttgctggctgccaagagggaagcagagcgtgcaaaacgggaaggtgccaactacaaacctggcgcctcagaaagcattccagccagggctcttgttcagtgctgctcctcccatccccacactcaggctgctgatgaggtagaggcggtcgggaggaaggtcgatgcccagagagattactatgccacgctggggatcgaaagctgtgccgcagtggcggagatcaaggcggcttacaagaagctggccctgctgtaccacccagacaagcacaaggccgaggacgctgagcagcaggtggggcttggaaaggaaggtggcgctccttgcgctggccgcatagtggcggcgagtttgccgagtggggagggaaggcagnnnnnnnnnntctcatcgattcgaatgctggcacccaggtggcgctccttgcgctggccgcttagtggccgcgagtttgccgagtggggagggaaggcagtcagaccaatctcgacaccctgctttcacacacaggccgccattgccgacaagttccgggaggccgccgaggcattcgaggtgctttccgacgagcgctcgcgaggcctgtatgacaaagtcagggactaccaggtcggttttgttgggccgctgatggatgtctatggcgatgtgatcgaggtgtacctcctgagtccggccgatcgaagtagctgtttttgttcgtctcattctaaactcttctttacgnnnnnnnnnnagccgatcgaaggcgccaaccccgggcggggcctgcccctcctgagccgagaggaggctgccatgatggcctccggggccgctgagctggcgcgcttgcggcggctgggcaccaagcacatcaagcacgcgcccagcgcacgcagcgtggccctgcccctcgagcagctcaactccgggtgcatgaagacggtgaccttctctcgccggcgggtggacgaccacggcatcgagtacaactccacccggagcttctaccttgtcatcagccgagaacgcttggccaggctcccccccccccctccccatgaactcccccgctcaatctctttgccctgcgacaggaagggctcgcagcagggggacgtcctgacctttgagagcgagggcgacgagacggtggacacgcagcccggggacttgctggtcacactggcggcggagccccaccccaggttcaggcgctcaggtgaggggtga

SEQ ID NO: 5855 - DNA, 1203 bp, Chlorella protothecoides
atgaggtgctcccgttctgctggttgtgctgcaaaccctgaagccttccccatgccgcccaccccacacccaggccccaaggacctggagaccttttgcggcctgctccccgccgcccagtttttcgcagccgtagaggtccccaccccctctggcgcgccgcgcacgctatgcgcccgcatcctgccccagctgctcgcctcgggcggcgcggggggcacctgggtgggcaccgtccggggccagggcctgttcgaccacgacgacccctggggcgcgccgccaggcgacctgagggcctgcctgcgctacccggcgctgagactgagacccggcagcgtgcgcgtcgcggcgaggcccgggctgctgttgctttttggcagcgccagcgatcccatctccggcgccgcgttggggggccttctggccgcccagcttgcccacgaggcactgacccaggacctgcgggagggggagggcgagggggcatgcagtgcagatgttgccagacgccagaccttggtattctgggacctgggccgtggccggggcctgccagtcggcgcggccgccgcggcccaggccgtgcgggtcctgcggccgggggcacacctctgcattgtgcaaggcgtcgagctgctggatgaggaaatggcggcgctggagagcgcagacgctgtggtccttgtcgccgctgtgtcgggcgagggctcggagggcggcgcgggggcaatgggcgtgacgaccccgaagggcagagttccagctccagacctgtcagcctcgcccggcggtgcacgcgcctcaaccccctctacacctcccccacccctcctcctgcggaccctgctggcgccgctgctggccaggggcgcggcggtggccggcatgggcggagccctaccgctcctgcactccgccggagtactgccctggtactgcgcatgcgcgggcgaggccgacggcggctggcgcggcctgcaccgagaggcgcagcgctcggcggtgccctgcgtgggcgtggcggcgggggcgggataccgcgtcgatgcgctcacgggcgaagcgcacgcgatcgtggcccctggcaccgacgccctggtggcggcggccagctgggaggcgggaccgggggagccgcagggctttgaagcggacgaggaccgggggtttctcctcgccctggagccgggggcagcctga

SEQ ID NO: 5856 - DNA, 1251 bp, Chlorella protothecoides
atgtccttggccagaaagttgagagggatggacgcgccctccgggacgcaggcctccgtgcctcgcaagccccggcggaaacgcggtagtaataaaaacggtaagcaagcctcttaccgtgcaggcttgaacctacagcctcgaaatgcgcagtacaagcgaacgtctcaacagcctccgcaacagggctctcagcagctcggcttcttcgggagcgtgccctccctgcaagatctgcggcgtgagaaccgacgcaacacccgtcgacactaccgagcacatggtaggcagggggacagcaccgtgtggtggccctgttatgttccctttaccctggctcattccctcggttcggggacactcccaggcaactctcgaggccaggccctcctacccagcggaggaaatgctgttcccctgccagcacccctgagtgtgcccccggcgcccttcaactccacccgccaagctctagcatgccttgtggtgtggattattctgcagaatgagatggatcacatgtgggcttgcctgctgcctgcatgtgcttgtgatgatcagatatactgcacccttttgtcgtcacttatacctctcccatctctcccatttgtagcaactttgaatcccttggcaacacctgccctggagcccttcaaggggggcggccatggcaccatgttcgatgcctccggcgtgaatttttacggaagcaatgagggcctggtcctccccatggatgtcttccccaccagctctggctcctcttccgacgacagcgaggtggcaggtgctaggcatgactgcgtctccacccactctccgggtccttcgggccaacacagcattcacctgccaggtgcgggccacgaggcacctccgcctgagcgtgaggcatacatagatcgccttgaggacgagaatctaaggatgtctactttgtttgggggaatgcacccacagcaaggtttggaggcatgccttctgatcatggagctgaaggagcgattggagctgatggcccaggagctggaagagctgcaccgtgcggctggcggcggcaaatcagcgggcgattctatggcgagtcccagccagtctggggccagtcatgacaacgagagcgatgctggcgaggtgacagggcaatccaagtctgtcggtgttcccgtgtcggcaggaggcgcgccgacgtccaatgaagagggtgcaatcacggaaccgatttcaagtaacagcaaggatgattga

SEQ ID NO: 5857 - DNA, 996 bp, Chlorella protothecoides
  modified_base (471)..(480): a, c, t, g, unknown or other
  modified_base (619)..(704): a, c, t, g, unknown or other
atgtcgtcctcgagatccagcatgccctcacaaggggttccggctggacatgtgggacacactgacttccgccactcgacttcagggatcgcagatcagagcataggatgcagaaggaatttgattctccgggacgacccacccacgtggtcaggaccaaggcgaggccattggcatgacttccgggaactgccgtgtgcgccaaccgacccgcgtgaagttcccgggatgctgtcggaggaggagcctacccactctttcaagatactcctcgtgggcgacagcagtgtgggcaagtcctccttactggttcgtttcaccactggtggttttgaggagctcgtccccactattggtgagcatggtttcggacccaaggacatgggagcgatgcagcgtttggctgctctgcactggcatctcctccagggcgatgtcctgcatcggttggcaccagctccacccacctannnnnnnnnngcatctcctccagggcgatgtgtggacttcaaggcaaaggttgtggaattgaatggagagaagatcaagctgtccatctgggacacggccggccaagaacgtttcaggacgctgaccagctgtgcgtccttccttgccnnnnnnnnnnnnnnnnnnnnnnnnnnnnnnnnnnnnnnnnnnnnnnnnnnnnnnnnnnnnnnnnnnnnnnnnnnnnnnnnnnnnnnatccccatccccctcgtcccctgctgctgctgcagcatactacaggggcgcccagggaatcatcttggtgtacgatgtgactcgaagggagacatttgagagtctggaggaggtctggctgcgggaggtcgacatgtatgccacggtggaggatgcggtgaagatggtggtcgccaacaagacggacttggtgggttgttgggtggggaggcgggtgcttgtgtttttgaacgttggtccaggggctctgtgcggtgtgtcaggctgcttatgttgcacccagccccattga

SEQ ID NO: 5858 - DNA, 1041 bp, Chlorella protothecoides
  modified_base (743)..(752): a, c, t, g, unknown or other
atgatggagcggaggccgcgcgcgccgacgccgcggccggccgcctcgcgggccaacgccgcgatgcccgctggcgtgaccgcgaatcccgcgcccgaggcggccagcatcctgtcggaagcggccgacgaactcggggatgaggccgtagtggatgaggtcgcgctgctccacggcggccagcgcggcggcggccgccgccgactggcccccatgccggccggcgccgtgggcgccctcgcgcgcgcgcacgtgcgcgccgaagccgatggaggcggcggccaggcgctcgccgatctggcggtccaggcccacgaaggcgccgccgcagatgaacagcacgtcgctggtgtcgatttgcaccgtgtcgccgcgcgggttcttgcgcccgcccttctccgggacgttgaccacgctgccctccagcatgcggaggagggcctgctggacgccctccccgctcacgtcacgagtcacggtcacgccctccgcgcgccgcgtgatcttgtcgacctcgtcgatgtacacgatgccggtctgggcggcggccacatcgtaccccgacgcctggtacagcttgtgcaggatgctctccacgtcctcgcccacgtaccccgcctgcgtcagcgtcgtggcgtcggccatggcgaagggcacgtcgaccagccgcgccagcgtccgcgccagcagcgtcttgccgcagcccgagggccccaggatgagcacgttggacttgtccagcnnnnnnnnnntaccagccgcgccagcgtccgcgccagcaacgtcttgccgcaacccgaggggcccaggatgagcacgttggacttgtccagctccacgtggtcggcggggagcggcggcggtggggggggcgcgttgaacgcggcccccgccgccgccccgcccaggtggcccggctccaggccggacaggctgcgcaggagcgcggcgcgggtgggcgcaccggggggtgtcatgccgtgcgcggggggcccctccccgccggggccgccgccgtgctcaggacggcgcaggaggttg

SEQ ID NO: 5859 - DNA, 381 bp, Chlorella protothecoides
atggcggccatcgagatcaacaagcgcatgacgggcgcgcgagacgccggcgccatcctggacatcgtgcagaccgagtcggaccgcttcgacaccatctgcctggccacggccatgcacaagctggcaaacatgcgcggcgcccccaacctgcactcccagatcgtcacctcgccggccttccacaagctcaaggccctcatgcgtgcgaggggctgggaaggaaagggggaaaaaggccgcaggggttgggccgtgagatcgccggccgggcaggtcggggttggagtggaggcgtggcctggcatgtggctgacggtgctgacctacgaggttgagccctgcacactcgcgtcgcgcaatgaatgcacaccggggtga

SEQ ID NO: 5860 - DNA, 993 bp, Chlorella protothecoides
atgacaccccccggtgcgcccacccgcgccgcgctcctgcgcagcctgtccggcctggagccgggccacctgggcggggcggcggcgggggccgcgttcaacgcgccccccccaccgccgccgctccccgccgaccacgtggagctggacaagtccaacgtgctcatcctgggcccctcgggttgcggcaagacgttgctggcgcggacgctggcgcggctgacgctgctggcgcggacgctggcgcggctggtcgacgtgcccttcgccatggccgacgccacgacgctgacgcaggcggggtacgtgggcgaggacgtggagagcatcctgcacaagctgtaccaggcgtcggggtacgatgtggccgccgcccagaccggcatcgtgtacatcgacgaggtcgacaagatcacgcggcgcgcggagggcgtgaccgtgactcgtgacgtgagcggggagggcgtccagcaggccctcctccgcatgctggagggcagcgtggtcaacgtcccggagaagggcgggcgcaagaacccgcgcggcgacacggtgcaaatcgacaccagcgacgtgctgttcatctgcggcggcgccttcgtgggcctggaccgccagatcggcgagcgcctggccgccgcctccatcggcttcggcgcgcacgtgcgcgcgcgcgagggcgcccacggcgccggccggcatgggggccagtcggcggcggccgccgccgcgctggccgccgtggagcagcgcgacctcatccactacggcctcatccccgagttcgtcggccgcttccctgtcccggaggtggacggcgtcctcgtggacgccgacgccgaccaggccgtggtgcacgtctgccgcggcgcgggcgcccttgccgccgcgctggaggcgcggggccttcgcgcgggtgccggcggcgtggcgcagcccctgcgctccgagcacgagcgcgaccccgagcccagggccgtcttcgcctcgtga

SEQ ID NO: 5861 - DNA, 597 bp, Chlorella protothecoides
atgatattgctgcaggaggacctggggatagggtcgctgggccatcgccacgccatcctccgtgcccgggacgagctcagggaaggagccctggccgaagcccgccccgcctcacccatcggcggccctgtccagcccgcggcagcctccagcctgatgagggtgcatgcccagcgtgccaggctggccagggcgcttgagagggcggttgcccgacaggcgcaccgggccgccacggcacagcacgctcagcacagcgtcgaactggcaagcgacgaggtgcgccggctggaggcgcggatcgctgccctggactgccagctggcggctggctctgtggggctgagcaagcaaggatcggcactgggcctggccgtcctgggacctggcatggacctggcagtcccgccgactggggaggtgggtgggctgagtgggcgtgggtcaaaggggggcctcagtggtgctgaattggtattgggaggggaatctgggaggcaacgatgtgaggttggacgagttctggtagaagcacaccactttcaaagccattctgctggagtgagcacccggcacaattggactggtgacgtttga

SEQ ID NO: 5862 - DNA, 2019 bp, Chlorella protothecoides
atgaaccagctgctgagcaaggatgtgctgtatgagccgctggtggagatcggggcaaagtaccccgactggctggtggcgcacagggacgagctgccggcggaggagctggagcgatacgggaggcagtacgagcacatccagcgcctgctgaagcagtacgagacggatccagaggactttggggcgctgctcgacctcctccagcaggcacgcaagaagttggatgaggaatccgggcaaatgaaggtgccacggtatgtcgcttcgggggggggtgccactgagtggccgagcagcaactgggtgcctggacctgagatcggggacgcagcccatcagtccccttccctctccgcacacctgagtcgggccactgtgacagcatcccattcacacccctattcctcatcccatgatgcccagatgcaagcctgtggccagcctcccaaggagatcgtggacgagctggcgccgggaggggaagggttgggcgccgaagggttccctctctttggagggggggcagaagggagcccgcaaggtcctggagactgctgcgttgatgatgtcaagtgtgttggcagcactggcaggacagcgaatgttgtgggggtcccccttgaccgggccgtttccccactttccacctgttcccgctctgccccgagtccacgcctccttgcgacgcctatgaaacccgaccatcacactgcattcggggtctcgtctgtaacattcctacttcagaaatcctccagagattgtcttgaccccccaagaggaagagggcatgcttctgagagtaggacatgcagccatcctcaggcaacgttgggatctgcagttctttgtcgtagccggtcataccgctgcatctcctctgggaaggcagtcttgaaacgtgcatgcacggcggtccttagatcactgcagccaggcgggcatgggtgcttggcatacatttgcgctccccgcaatgatcagctccgagtatacggcacagaagagctccggctgcaaatccaggcatgtcaactcccccccaaccttctcaccgtacggcttccacctttcccttgcaagcctggttggcagccaaacttgagcgaaacacagcgctgggccgcggaactccaggcagcagcaaggtacaaggaattcacagacactgcctcacagctgtccaatgtacctcagcatctccactgcgacttcgatgggggcatggcgctcgaaaagtgtaagaggcacgcggctacttgcacagccccccaaagcgagggccaggcagagaggccgatgccttacagtttgctggggagcaggcccggctctccttgtgtcaacgtgccgcaccttgaggagtgtggcgtcgatggtcgccttcacctcccgagccatcccgcgctggtgttggtcacggcaccggcgtccgcatcctttggccccgcaacatgcgatactgtcgtgtccacgacgaaagggcgctcgatcccgctgggacccctgccccgagagcgctcctccacccgaggtaccagccgtcaaccgctcccgatgctccccacactccccctccctcccatgaacacgctcattcagggtgctcgcatagcttcccgtgccgctgagatgccccctgggtcccctccattcacgatgttacatggcggtcaccagcgatcacggtggcacgtcaccccaaggggctgcgccccgccggggcctcagagcggagcggggagcaggccctccggccccagcggggtgtccagcagcaggtgggtgtcggccgccagcgcggccacgctcccgtccctgcgcggcgtgccgcccagcccaaactcaaagtccggcgggaggcccatcgccacgccgggcgagggcgagggccccagcaggcccgcccccaacatccccgccacgggcgtgtccagcgccgccagcgggcccgccgcgcatgcccggtccgcgccgggcgcggccgccgccggcgccgcctggggcccagccagc

SEQ ID NO: 5863 - DNA, 855 bp, Chlorella protothecoides
atgctgtgggcgagcgcagggctgaaaggtccttcatgtggctcatgcaccttcatgacttccaccccaacttccacccccctctcctccaaccccacaccaggcatggtcatccccaggctgaatgggcacaccatcccctatgctgtgggcgccattggggccatcatcatgccccacaacctctacctccactctggcctcatgatgtccaggtggggggtggactctgcgggggtcaatggagacgatgatggggacgggagcataccgcgcctgctgagatcagccatgatgctgcttcaggggtggcggcaagtactgcctaccctgcagtgccatgctcctatccgaccctcccacccactcaccttcctcaaccactgcaggtctgactacatcgcggtggtgtcggtgcgccgcgcgctccgcttcgtcaagtgggcttgtagtgtagtgactgagcgtcgtgtgcatgggtgcaggcacctgcttgcttgcagggcggagatgtgcgagagcattttcgctcctcctgtacccattgcccccaccctccccctcctccggtcagtgttctctggcgcattctacaactccctggtcgcgccccaagtcgggctgggaaatgccgggttcgagctgggcaagatgtttgggaccgcgatcgtgagttgcagggatcccttggcattttggggggtggctaccggtgacgccttccagcgtcggctattgtgcaggtccatgttacttcacttacctccccacccaaccgctcacctctcattccgtctttctagaggattatctgggcggtgggcctgctggcggctgccaatgcctccacagtga

SEQ ID NO: 5864 - DNA, 621 bp, Chlorella protothecoides
atggaccccggcaaccttgccagtgacatcaaccagggtgccgtggtcggctactccatcacctgggtcaccggtcccgagcctctgtcgcgccaggcaagcctggccagggtgggtcctgcagtggcggccccgaaggaccgcgaactcgaccgcggaggcaacacaccctgctttacgcccttcccccgctccccaccaccaaccccgcagggcttcatcatgcagatggtcgccgcccggctgggcatgaccacccgccaggacctggcccagcacgtccgggccgagtacaacagcactacccgcaccctactctggatgtttgtggaggtgggcatcctcacctgcgacatggtggaggtgatcggcggggcctgcgccctcagcgccctcagcggcggtgccatccccatgtgggcgggggtgctcatcacgggggccaccgccttcatgtgcttggcgctggagagcgtgggcatgcgctacctggagttcttgctcatgctcctcattgcctgcatgagcggcaccttcctctacctcttcatcgacacccacgtcgactacatcgccacgctcaagggtgagtcggccgccgggcggcagtgttggggttga

SEQ ID NO: 5865 - DNA, 1278 bp, Chlorella protothecoides
  modified_base (611)..(620): a, c, t, g, unknown or other
  modified_base (1035)..(1044): a, c, t, g, unknown or other
atggggtctgggaagaccctgggggagggcgtgcactggacaaaggtcatgccgggtttgagggcaggacgcgcgtcctggccccctccaaaacctctcaaggacacccccctctgcgtgcagatgttgggggaggactcggagctcgtccaggagctggcgagccggggcctgatcgagacgcatggtctggccagcggggcgacgcgggaggagctggtcaagcgactcatcgtggcactgtcgggtgatcacttggggagcatcttcacccgtcgtacgacaggcaacacgcacaagcgccccgcggccagcctgtctggcgcgacggacgccgccaacggcacggggacggctgtggcggggggtgccggcggggcgggcacgaagtcaggggccttgctggtttaccgcgagctggccagcatggcggccgccctgtccgagccggagcttctggtgtgtgcccctgaattatatgtttttttggggggggggtatggaaagggagggagcgatgtggcagggcccagggcgccggcgaggtcggcggtgggattgcctgaagggtgtggggccaaaggcgttcaggacagcagaatcgcagggcnnnnnnnnnncatatggtttttggggggggatatggaaagggaggaagcgatgtggcagggcccagggcgctggcgaggtcggcggtgggattgcctgcagggtgtgaggccaaggcgttcaggacagcagaatcgcagggctgcatgccccgccgctctcactcgacggggcacgcccacggctgtttcccacctctcaccccccgccgcagtaccacttcatggagctggccctgcagaccagtgccacgacgagcggccccggcaggtgcggcggcttccacgcttgggtgcatgcctcacgggcggcttgcgcgccgctgatcccactcttcacagaccactggacacgcacggcgggcccggcccagtccgcagccgccccacgtggtgcccaccagcacaccggagcatgcacacgcannnnnnnnnnatccacgctgcgggtgcatgcctcacgggcggcttgcacgccgctgatcccactcctcacagaccactggacacgcgcggcgagcctggcccagtccgcagccgccccacgtggtacccaccagcacaccggagcatgcacacgcatacgcgcccatctccccgcccctcaccccgcctcgctccgtccaggacgccccatgctcacccccctgcaggcccacgccgacggtga

SEQ ID NO: 5866 - DNA, 693 bp, Chlorella protothecoides
  modified_base (98)..(107): a, c, t, g, unknown or other
atgcaagcatcgattgcagattctcagggtgggctgggtggtcgtaggcaggttgccgtcccggtgcctgtttcgtatggaggccaaaaacaacgtgnnnnnnnnnngttctcagggtgggctgggtggtcacaggcaagttgccgtcccggtgactgtttcgtatggaggccaaaaacaacgtggcagcgcagacggacggcgccgtccttagacctaccaaagagcacggttgagatctccagaccccctgcctgcctagggtgcccggggtgtcgcacttcttcccaagtggctcgactgaggggttgcacccatggcgtggaaaagcctgcttaccaagaacctgcaggagctaaggatccacttgtgccagacgtccaggaacagccaaggagcacggtacgaagggaatcgacgcaatttgtagacgaatggtattgtgattcatcctcgaagcagttcctgagtacccaagggaacgccaccatctgcagagacttcatctttgggagctacaaggacctgaagaaggccaatcccaacttccccatcctgatccgtgaggcttctggagtggaggccaagctcattgcacgatacgacctgggggtagagaagacggtgagcatcgacggtcttccagccgctgacatcagcaagcagctagaagcattggtgacaaaggcatag

SEQ ID NO: 5867 - DNA, 798 bp, Chlorella protothecoides
atgaacgagggtgaaaccttcatccggtgggcgtttggcggtcaggaggtccaaggagggtggaatcagaggatgacggcatactcaggggtacaaaccctgaggacatgttggctgtcaatgactgcgccagcccctgccctccacgcgcgaaccccaatctgtctcccgagtaatacaccttcgtctattctctctcctggcaggccgctgttcccctctgatcttgaacagctcaaggcgttgcacgaggcctgcttccccatccaatatgagaagcactacttccagaacgcggtgcatgggagggctggcatgcgctcctgggctgccatacatccctgcaggactagcggggatgcagaggaggcgcggtcccagaaccaggtggttggctttgtgatcgcgcgcgtcaacagtgcctgggatctcacgcccgaggagcacgtcgggcttggactcgcacccacagacggcacccacttgctttacatcctgacttttggcgtgcacgaggtaggcttggcgtgtttggtgccggctcttgccacgagtgggggctgtggttggggatggactcagcgacaaggctgccatgggctgcagggttgcagcggcaatgtgccattccggtggatggcttggctcagcgggcactggtcgaacagagcgtctcgctcccatcttgcagaagtggcgacggcggggtttgggcgaccagctggtgcaggctctggttggctattcccgcctcaatggcctgcgctgcatctatctgcacacactggaccagaatga

SEQ ID NO: 5868 - DNA, 591 bp, Chlorella protothecoides
atgtggcgcacctcctggccgacctcacccagaacaatggttcgagctgggagccctggcatgatggacattttgtgccagagcagcttgatgtggctctccatcttgtggcatgtgggtgcttgcccgcttgtgtgcagtccatgtggtacctctggaatccatttcaccctcccaccgcaccaccccaccccctcgttgcaaatcacaggtgccatcactatcattgggggcggcgactctgttgcagcagtggagaaggctggagtggcagacaaggtcagccacatttctacgggcggtggagcctccctggaactgctagagggcaaggtccttcctggtgcgtcgttgggagggggtggaggagggggggatcagctgggccggcatggtatccgccgaagatcggaacgtggaggaggtgcaaggagggtgatctcaccctggtgtgtctcttcatggagctcagatcttgaaaactgtgaggtgcttatccgatacctgcttcgtgcatggcttgtgcgatatgtacacgcatttgcagattggtgggagcagcagattggtgggagcagcatagagctttag

SEQ ID NO: 5869 - DNA, 762 bp, Chlorella protothecoides
  modified_base (75)..(84): a, c, t, g, unknown or other
atgtccgagacagatgtccacagtccttttagccatgcagggtgttccactcacccgaggatgagacggtcgacnnnnnnnnnnttaaacatccagatggtagcacgtgcaatgtcaaagcctaggaacccagagtctggatgcgcagcacgccaagcctgggtattccactcacccgaggatgagacggtcgaccttgcccagcaggctctcgatcacgccgatcttggacgagaccttggacccacccacgatggcgacaaaggggcgcttgggctcatcaatggcccctgccaggaagtcgagctccttctgcagcaagaagcccgccaccttggggctgaggtaggccgccacgcctgccgtggaggcatgcgcacgatgcgccgtgccgaaagcatcgttgacgaagatgtcgctgccggcagccagctgcttggcaaactccgggtcgttcttctcctcctccgcatgccagcgcacattctccagcagcagcacatccccgtccttgagcgcggcgatcttactctgcgccggctcgcccacgcagtcggaggccaggccgacgggagtgcccagcagctccgacagccgctccgccacgggggccaggctggtcttcttgtccgcgccctttgggcggcccaggtgcgaggtcgccaccaccctggcaccgttcttcaccaagtactggatggtggggaggctggcacggatgcgggtgtcatcggtgatcttctgggtctccttgtcctgtga

SEQ ID NO: 5870 - DNA, 2304 bp, Chlorella protothecoides
  modified_base (1166)..(1217): a, c, t, g, unknown or other
  modified_base (2099)..(2108): a, c, t, g, unknown or other
atgaaacgggctgaggattgccctgcattgtgggtagcggccaccataatgccgcaggacgcagcatgcactcacgctgcggttgcccatgcctctccttcgagcacacaggtcgacaacttgttcaagcgggatgacagcctctactgctccaatgtgtctgcaaatgccgattgtattgggctgcttctgacggctgccaagcacccacctgacacctctccttggacccctctgcgccctcaggatgggtttgtagacagggaggtatcctacagaggggtcaggaagtatctggagcggcgctgtggagcagctgccacggaaatggctcgccgcgatggacgaaacgatataccctccatggcagacctgtcggaccgagagcttgaggcgttcttcttgggcctgctccgcgccttggaagcagtgagtgctctgtgcgagggtgcgtcggggctgtttgccacatgcagcttgattgatgctcatgccgctggcacacgatgcccgcgcaagtggccagctcgcaccttacgagatcaccttgccttggcttcctcaccctgtccacatcccccgttgtcctggaagaacttggctgacggaaggctactgctgagcggtgtgaccctggagaaccagatggaggaggtacggcagatggtgcacgcagcgcacttcatttcccggcggccagcgctgatacgcgccgatctgtgcggggacgcggacaacaaggacgtcctctttgatgcctcgactctccccaagctggaatcacccctcgtccccaggaaactaggcaagtccctgaagagagggaccagggcgtggggcacccccgctgccgaacaagggctgtgcgggtctcaggatgggcgctggcaggattggaggtggaggtccccgggtgcggcggctgctgagtgggcacgcccgacacatccctggaccgcaggtatcgtggacaagctggagctcctgcgcatgggccccctcacctgccccgtgcgcaccctggcggtgctcatcgggacgatcgacctgcggctgctgagcggtaaggacaaggatgcggcgtggaaggcgctgcaggactctgtggccgaagccagcaggctctaccccctggacggagtcacggaggttgcccaactggaggnnnnnnnnnnnnnnnnnnnnnnnnnnnnnnnnnnnnnnnnnnnnnnnnnnnnggcccccctgccgccagtctccctggccactgtcgaggtggcgggggtggtgtaccagtttggcgctggagctccgccgggtgcggcccaggtcggggaggccagccagctcaccacgtggagaccggtgctgtgggctcagtttcacggtccccaggaggcgcaggcgttctacgacgccaacctggcgcccatcgaggcaagcggaaccgcacagatcatcagggtcaaggaaggcccgcacatggcgaccagcgcgcccccagccgaggggcacctggcgcacatcggccaggcgctgcgggacaggatgcagcagccttggcgcgaggcggggcttctggaggctgcgatcggggacgaggctgattctgtagctgctcagccaagcaggactgcgcagcctggaagccagcgcgatggagcggccgagcaggcaacccctcttgtgtcacggccgactcggcgaggggatggggcgccccacccagccgaggcacggacgccgggggtgcaggaggcaggcgatgggaacggccacatccggatgcggggatcgccactcgaccaatctgacgacgaaagcgactcaggtctggagtacgggatggatgcatggcagacagctcatggcagtgagggggagggcaccacagacggaccctccgactctgaggatctgggtgagagtgactcggaggacgaggaggtggatggaatggaggaggaagacgaaggcctggaaggtgcatttgtcatggagggtgtagaacaggacgacacggcgtatcgaaatagtgggttgatcaccgcggaggagctgtggcttactcgttctgatcaagggagcctctgcaccttaaccctgccaggatcgaaacnnnnnnnnnngtcccacaatgcttggatcgaaatcaaccttgtcagtcccgtggtgggcaacatcatcctcgtgaagctgattgaccaggaaaacatgatgagtcggtatgaggacgagcatgagtggcccaacatcgatatgacacatcttggagtttacggcaaatgtatcacacttccatcctggcttgcaccacaatattag

SEQ ID NO: 5871 - DNA, 1821 bp, Chlorella protothecoides
atgctgctggcactgtctgcctcgtacactgtcttagcaaattgcatcatgccggaatcatggagcttgtgcatctggacaagaatcaggatcgttgctgctatgaggatgtgggtgcgttctgatcgcactggctcccatcagaccgtttctattggacaagctgcccaccaagtccttggagtcacccaccttgagctccagtccgtaatcggcatgcaggcgctggagccagagtctcttactgttgtcgatgagatctttgagcatgcgacaagtctggcgcattcgcaatatgtcatccacggagcagcgcatgcacacttcctcgaaaaagtccaggctcagtcccgaggccagatggaggagtccccccggacgctcccgcacttccgccatctcagagccctgataaatcctcggtgggacgagttgtataggacccgctgtgcacctgccctcgctgttcatgatgggctcatcaggggtgcaatgcaccgtgccagagaggtccgggacggtatctcaacatttgacgctggagggtactacggagaagcgaacgcaatcgccctggctcacacagggctggaatggggtgattcgctgcacaccacgggaaggctgatggagagcgccgggaggtgcccagctccacccaatctgctccttagatttgcctttttgtttcaattcttcgaaagctatgagcgcgccgtcaggtccaagcgtcgatcatggtcgggagccttgcccggacaggtgggcggggtgacggtgacggccctacgaaaccttgatgcatgggcggagtgcagtgctccaactcttggcttttgtgcggctgtcgacataataattcccttgcaggcttacgatcgcctcccatacacatgtcgagtgcacccttgcaggattctggatgacgtgggtggcgcgtttggaatgggggccgtcggtggcgggttgtggcatttgttcaagggcatgaagaacagccccagcggtgctcgatttcgaggcggcattgatgtgagtccgttagcggtgggaattttcttgcctgggaggtctgtactgacgttagaggggccagtgtacatgtcccgttgcttctggcacgctggactgatcccaggaccggtattgtggtggtcgggctggattacagcaccaattctattcgcccagcaacagaatgtatgcatacgctgttgcaagaaagccactggcttccttccctacatatcctactcttcctgctgccaagcgcagtccattcggcgagaggcccctaaaattggcggcagctttgctgtgtggggcggtctcttcagcacatttgactgcacgctcctggccctgcgcaagaaggaggatccctggaacagcatcggtgcgggtgcgctcaccggtggcttcctgcagctacggacgggcctgcggtctgcagcacgatccgcggccttcggtggcgtgctgttgggcatgatcgagggtgttggcatcctgctgacccgtatgaccgccccgccaccggccccggtgcccatggtggagatgcctggaccggcccccatcacgggaaagggcatggctgcggctgtggaggccccggtgggactggcgcccagttcccctgccctggagatgcccgagcctgtgcctgaggctggcagcagctggttgccctcctggtttgggggagctaagaaggaagagaaccgagcaccgcaggctggtgctcaggtgcttccagacgaccgcttcgcccctcccgccatgccagatttcggcgcaagtgaagctcagtatcgctga

SEQ ID NO: 5872 - DNA, 5160 bp, Chlorella protothecoides
  modified_base (3025)..(3034): a, c, t, g, unknown or other
  modified_base (3311)..(3320): a, c, t, g, unknown or other
  modified_base (4528)..(4537): a, c, t, g, unknown or other
  modified_base (4736)..(4745): a, c, t, g, unknown or other
  modified_base (4949)..(4958): a, c, t, g, unknown or other
atgtcccctccacggcgcgcatgctgtgcatccgcggggtttgtcggagtgatgggatccctctccgtctctggaggctatggagcaatacatctgccagatgaggctgagacaataggaaacgaaagctggcttcggcacaagtgtgctggaagtcactgtggtgaagaggacctgaggatgtcttcagacgaccacattccggaggagaggcgatccccagccctcacctgggacataccagagatagacagcagcgaaacgctgcagaaaggagcccctatcacggcggagttgaacaagatcgcggttgaccatctgacaactctgcttggagtgcagttgagtgccgtgctccaaccagagcgcgtcgttgaatggctacccgtcatctggcgcctggctgatgctgcagcgagcagtctatctccttcggctgtgaccgcacatggggacctcaacccccggaactatgtagaggtaggcgtgctggttcccggggtgctcccacttcaaggggagtttgctccagaggacagcgaaatcgtggcgggcgtatgcctgcttaaaaatgttgcgcacaagcgtatgccaatttctgctcaacacccacgcataatgctgttgtctggggctctgcagtacaaggcagacactctgtctagccttgactctgtgctgcagcaggaggaagactatttgcagaagatcgtgcagcacatcgtatcattcaaacctacgatcctattggtggagaagaccgtgagtcgttctgcacaggacatgttcctcgagcatggaatagctcttgttctgaatgtctccttggcggccttggaacgactggcgatgtgcattggggcagaggtggctgaagatgtcaacactctgagcggaagaaatgttggattctgcaaggactttgccgtctccacatggatcgaaacaagcgacagcggcggagcagcagctacaccggcctcatatcagcctgggcaggcattggtccccatgggcaagcagcagagtctcatgagctttgacggctgcccccgaccacttggcgtaaccgtgcttctgcgcggcgccagtatagaggagcttaacaaagtgacgacaatcctcaaggactacatctttgcgtcttactggaatcgcctggaggtggcattcctcaccagtcaatttcttgctgcagtcgccgcggccccttcagatccacagtcgtcagtgggcgatcttgaggaggccgttacgcttgctgcaaaggcctgccgtgcccgccagcaggtgcagcatggagcctggtcaccatcacccttcatctccttctatgctccaccagacagcatgtatgacggtgcagctccagtatcggcagctgctgtctcaagtagggcgccaggagcaagacctcttgcgagctctcagcacaagtcctcctctgcggcaccagcgaccctagtggatgtgccgcaatctattctggtggacgtaggacttgatgcggagaacgagcagaggctgtcgcctgaggatgcaatcgccaccccagacaaatttacgtcaacagaaccagtcctgggtgccctgtctctgacgatcatgtgcaagaatccatccaagggcgtgatgtgtgaagctccgcatgcgatatccatgccattctacagagatgcggatgtaccacttggtgctttcatggcacatgctgcccccgttgggcaaagatgtccccaccctgagtgtggagagggagcatttgtccatctgagaaacttcatgcatggggacagcatggtgacgctctcgtgcatccgcctgggcgagggaaaacaacttccagatgatcgcctgtggatctggttgcgtcccctacagcaagcatctgacaccgacactcatcgcgtggctttggatgcggatgcggcctgcatatcttttgcacactttatgacgttgctgctggatgtccggcatcttgagcttggagggacagatttacagaccgactacgttcgatacatcggctccaggtctgtcatcttatgcttgcactacactcgagcaacgccgtacactatccagatgccctctttgccattagattggcagtcagacttggagctgcggtggctgcagcaagagctgaaagatttcacagaggtaggcgcacggtggcttgacttgtcggtttcgcttgacgttggttacaattatgacagtgtcagcactctcttgcagacggcggatgagcacctgagcaatctcgaggctgctgtggaagagttttggaggacgcttcagatcgataagcagggccatgcaacatggcaacaagccctgaagaagacaagaaggtgcctcctgagtctgggcaagaatgttcacagccacatcgtagctgtcaacacacagctcccatccgataccatcctctccccactgggcaagaatgttcacagccacatcgtagctctcaacacacagctcccttccgataccatcctttcccccctggtttgggaaatcaactatgctaagagggtgtcggagctttgccttaaggcatggtccgagcgacttgagcggctgcagcagaagactgcgcttgccaagactacgaaggagccacctgccgctgagatccctcagttgggcgccacgggtaaatctccaagctctgagaaccttggccggtccttggaaccatctaaagactcacctcctcggcaccaacgtgggcacagcgcgagcctggccgagcagttcgcccagatgtacgtcagatcgccggcaaacattgatgcaacttctaagttcgcgacacctttcctaaatagcgatgcagctctctcggaggcttctgaactgggagagcgcgacaacgtcatcattcccaccgggctggtggcaagatatgttgccaaatttcaagagtcttctcagcagcagtctccacatccgtccatcaactcggcagcgctggaggtccacagcaataccggggcaggtatgtttggannnnnnnnnnatcctctctgcagcagtctccgcatccgtccatcaactcggcagcgttggaggtgcacagcaataccggggcaggtatgtttggattccccaggtgatccagcgagggttcgagaacttgccagtcaagtgtcaaacgcatccttcaccagattccacaggagcgcatatgtcgcgccggaagtcaatgctcaccaatgtggaggggacatccctgattgtgcttattccagcaccttgactattcttttcgattgccacctaaataacagaggtannnnnnnnnncacttaggtactgggaaatgtgggagatgatccagttgagaccctcttggcagagattgaagcccttccagggccagctccaatctcggaatcccctgtggaggtaagcagggcaaggagtgagttaagaagggctcttcccgcttcagcaagcttgcttgattgcctcatcgatcgacccgcttccactcgaatgccacagtccgctgcatcgcccactgaagctgccagccatttcgagttgtgggctgatcttctacccgatgagaagaccacgagtgcggcaccgaaaccagcctctccaaatgacaagacgagcggtgcaacggaagatgctacattcaatcctgagccattctcgaggcttcccttaccacccagtaagactgggcgagtatctcaactccgactcaggcagggcttcaagacggaaggagtctcaacattggccgctgatgatgggcactacatcactgtgtatgaagatgaaccgacatcatgtgtggcgtatgcgttatcaacaagagcttacacacagtatgtccaagctgcaacgggggagatattggctgcgacgaccggcaatcttgaagatctagcttcgcccacatcagagggactcttgcaggagcactattcaccatctacagatatatcagtgctccagtgtgacgagcaactggactgcaagatttcagtggacactgctttgaacacatcgagcggaatggaggtactcgcatactttgcccctcagtttgcagctctccggtcactttgtgtgttcggaggcgagcaaagctttctgacttccatcagtagatgccagaaatgggaatcaaagggcgggaagtccaatgtatactttgcgaagaccaaagacgacaggttcattgtcaaggagctgtctcgtctggagaagcagtctttcctggaaagtggtcccacatttctacgttactggggaacagcccaggctacgggaacaagcacgagcttggccaagatcctgggagtgtaccaggttactcttaagagcgacaggcaggctacaatcggaaaatctgagaccattgacttcctcataatggagaacatcttctatggatgtgatatacataggatctacgatcttaaggggtcggagagggatcgctatgttgcacaaggagctagcacgcgagcaaccctctgcccgcgacatccgnnnnnnnnnntttcattggaccatatcactggcaatcaggacacggtcgcgcgcgtgtgcagcaaccctctgcccgcgacatccgcaggcactgttcttttggaccagaatctgaaggagatcagtctaaacaaccctttgtccataacgcccgcctcatttgagcatctgaagggagttcttcaggaagatacggggtacaagcagtnnnnnnnnnnagtgttacttgtctttgctggctatgactatgtacttcatgcagaattcttggcaaatcaagatgtgatggactatagtcttctcattggagtagacaagaatcgtcggcagctcgtcatcggagtcattgatttcattcgtcaggtgagtagaaggatcacggtagtaaggggatatctgtcaggactccattcttatgcgannnnnnnnnntgtcatcggagtgattgatttcattcgtcagtttacactggacaaggcgctcgagatgtatgtcaagaaatctggcttgcttggaggtggtggtaaagagccgacgatcatctctcccaagcagtatgcgaatagatttcggctggcgatggcgaagtggcttgtctctgtgccaacaggaacagaaagttgtacatcgtag

SEQ ID NO: 5873 - DNA, 891 bp, Chlorella protothecoides
  modified_base (147)..(156): a, c, t, g, unknown or other
atgttctgtcctttgcaggcgataagttctcgtctcgtcacggacaaaagggagtgctctcgagaaagctggatgatgtggatatgcccttctgcgagaggacaggcatccggtaagatatggttgacggtccttgccgcagtctannnnnnnnnnttctgcgagaggacaggcatccggcctgatctgattatcaatccgcacgcgttcccgtcgcgtatgacaattggaatgctgatcgagtccctcaccagtaaggctggagctgtttgcggtgagtttgtggacgccactcccttcaagagcagcgaaggagactcgtccagtgtttgggaggggtacggcaagaagctggaggctgcaggatttaccaagaacggaggagagacaatgatcagcggcatcaccgggcaagctttcgacgtggacatttacatcggcctggtctactaccaaagacttcgtcatatggtgtctgacaagttccaggtcagatccactggcccgatcaatcccttgaccaagcaacctatcaaggggagaaagttcggtggaggcatccgctttggtgaaatggagagagattcactgctggcgcatggagctgcatatctgctgcatgatcgcctccacagttgcagtgattactcagtctgcgacgtatgcaccaactgtggcttgaccttctcaaccatggccgttccgctggctgcctccgaggccagcggtgtgcgggcaaccgctgacatctccagaagctcggttacctgccgagtctgcgagaccagcaaattcatcgaacgtgtggccgttccctatgtctttagataccttatggctgaactatgctcgatgaacatcaagtgctctctcaatgttcagtgcctgtaa

SEQ ID NO: 5874 - DNA, 1218 bp, Chlorella protothecoides
atgcatgcagattctgggggaccagagcttcctcatgacgcctctggtcccacatccctggtcctctatacctgcccccactgcgagggccacttccctgctgagtcgttcgtcgagggtggcccagacgctcccatgtttagtgaccgctgccacacctgtcggtatgaggagcacgcccagatgcaggctctgcttgccgctcaggtcgtggatgctgacgcagccgcgcttgcagcaggatctggtccgcagatgctccagtatgttggagatggcggtggcgacggccctccggcggatgcggcatgcgccacaatgcgatgcgacaagtgcggcgtgaccagaggcgaaaatcctggccaggatgccagttccagtacatgcctgggttgtcttggaaaaggttgcggggtgccgctgattgccaccccagagcccaaagtcggaggcccaaaggagcaggacgctgctcctcttgccccacacccactttcggggtgcgacgcgcatcatgccgacaccaagacctgcatgcactgtggcacgaccaaggagctggctgctttcaggggaagcaagaacaagaccgaccgtctgcaaaatcggtgcaaggtgggaagaccctgtgatgggagacccaggcttcgcggcctgaagcggggccagcggatccatcggtggggcagccgtgcgcagtggaatttctggctgcatgagctgctacctctcagcttccgccactgtgtgcaggagtgcgaggtggcgctcggcaggggggccaagcgtgacaagaacgggccgctcgtcgtgcgcgtggagcagaagctgtgccgtcgctgctcagaggtcaaggcctccgatctgtttttccacagcaagctgagcctggatggcctgtgcacatactgcaaggcttgccagaaggaactcaacaagcaggcgcgggccaagcgtcccgacgtcttgaggcctcaggtgggaagtgtatgggctgtgcaggagcatgcgctgctgagtgctgtgcatgtggtgtcatccccagggcccagggccgtgcgggcgggcatgtgcggcttttcctcattgggatcagcgctgggggccagtcctgaagccctgcgcctcggccccttttgtccctcccacaaaaacacaggtgcaggagaaggagtgtcggcactgtggcctcgtcaagccagcagaccagtattttaa

SEQ ID NO: 5875 - DNA, 822 bp, Chlorella protothecoides
atgatccgcgctgcagccaagaaccacgcccatgtcttggtagttgtggagcccgccgactacccttctgtcctcgaggccctgcggaatgggaaggcggatgccgctctgcgtcgccacctggcatggaaggctttccagcacacggccacttatgatgccactgtcgccgaatggttctggggagagatagggtctgggccagcccccgagcgctgcgtgcccatgaagctgggcgccaccttgcgctacggcgagaacccccaccagaccgctgccttctacaccgacgtttccctgggcgaacacggccgaggcggcgtggccacctccctgcagcatcatggcaaggagctgagctacaacaactacctggatgccgacgcggcctacctggccgtgtgcgacatcgtcgacccggcatgcgtcatcgtcaagcacaccaatccctgtggcgtggctgcccgcgaggacctgctggaggcataccgcctggccgtacgcgccgaccccaccagcgcctttggtggcatcgtggccttcaaccgcaccgtggacgaggctctggcgcgggagatcagggagttccgaagccccgccgacaacgagacccgcatgttctatgagatcgtaattgcaccggggtacaccccagagggcctggctgtgctcaagggtaagagcaaggccctgcgaatcctggaggctgcacccagggccccctccggggactctttgcgccaggttgccgccgggtggctgcagcaggatgccgacagccttgtgcccagccaggtacgacgggttgcagcgccagcatga

SEQ ID NO: 5876 - DNA, 675 bp, Chlorella protothecoides
atgggccgcaagcgcaatgtttctgatctgaaggaggccgatcttaagggcaagacggtgttcctgcgcgcggacttgaacgtcccccaggacaaggagacccagaagatcaccgatgacacccgcatccgtgccagcctccccaccatccagtacttggtgaagaacggtgccagggtggtggcgacctcgcacctgggccgcccaaagggcgcggacaagaagaccagcctggcccccgtggcggagcggctgtcggagctgctgggcactcccgtcggcctggcctccgactgcgtgggcgagccggcgcagagtaagatcgccgcgctcaaggacggggatgtgctgctgctggagaatgtgcgctggcatgcggaggaggagaagaacgacccggagtttgccaagcagctggctgccggcagcgacatcttcgtcaacgatgctttcggcacggcgcatcgtgcgcatgcctccacggcaggcgtggcggcctacctcagccccaaggtggcgggcttcttgctgcagaaggagctcgacttcctggcaggggccattgatgagcccaagcgcccctttgtcgccatcgtgggtgggtccaaggtctcgtccaagatcggcgtgatcgagagcctgctgggcaaggtcgaccgtctcatcctcgggtga

SEQ ID NO: 5877 - DNA, 537 bp, Chlorella protothecoides
atgcagatcgacttcaaggtcgtgtcggaggcacagcccaccccgcagcagctggaggacatcaagtttgcctggcagtgcgtgaagcatgtgaagtcgaatgccatcacggtggccaaggacaggcgcctgctgggcatgggaagcggacagccaaaccgggtcaagtctgttcaaattgctctggagaaggcagcggaggaggtcaaggtaggcccccagggggtgatgcacgatggactcgtggaggcctggtgcctcatgctcagtggaactttgggcaagggctccagcaaaattctctcctcccaggcgctgccctcaaatggacgtctcccatctgcacagggatctgtgctcgcaagcgatgccttcttccctttcagctggaacgactcggtggagattgcgtgcaaggctggtgtcagcgctatagtgcacccaggtggcagcctccgggaccaggatgccatcgattgctgcaataagtacggcgtcgtgctcctgacgacgggtgtgcgtcacttcaagcactga

SEQ ID NO: 5878 - DNA, 909 bp, Chlorella protothecoides
tccctcagcccactggtctgctcggccgccttgggcccggcccagactggtgccccggtcaatccccaaaccctccaatccccgtccccaccccactcatgtccccgtttcttcccctctcacccccaatcagggcgaggaggccatgctggtaacggagttcatggagtttggcgacctgtggcgcgcggccacgctgcgctcaccacgcggcgaccgcatctttggctggtggggccggggccgcaaggtggccctggacatcgcgcgggggctgcacttcctgcactcccgctccatcgtgcacctggacctgaagagcactcctcgccgccgaaactcccctcctcaccccgctcaaaatacacgcacactctccctcgcagcgccaatgtcctgctgatgcgggacggcaccgccaagatcgcggatgtcggcttcgcgcgcgtcatgagcaagagctacatgctgtcctccacgggcggcctgggcacctttgcctggaggtgggaagtttgtggttgtgggggggagttggaaagtgggcttttggggggtggggaaaggcactgctgcatgaggcgtcgtgcggtgggcgtcttgacaccaggtggcagactgggcctggggtgggaacataagggatgcatgggggcgaccagctgtgtatctgcagcttggagactgcagggctgcatagggcacatcatcaggcctggcctggtggcagggactgcacgcgccatgctttgcactcgcccgacccaatccccaagggcgccgtcgctcaacgctaggaaccccccccccccccaactccatgcagcgcccccgagatgctctttggcgaccgctgcagcgccaagtccgacatctactccttcggcatcgtgctgtgggagatcgtga

SEQ ID NO: 5879 - DNA, 303 bp, Chlorella protothecoides
atgcgccccatgcgcgtgcccgaggagtgctcccagggcgtggtggacctgtttgacgcctgcctggcgcaggacccgtcggcacgcccggacacgcggtccctggtcacccgcatccaggagctactggacgagccagtgcagggcgcggcgcatggggcggagctcgatgcggcgggcgaccgggggggtggcagacctgctgcggcggcagctcaggggccccgcggctctgcggcaccggctcaagtgccggacgccgctcgggcgagggccgacgccccgcccgccgccgacgcctga

SEQ ID NO: 5880 - DNA, 1341 bp, Chlorella protothecoides
tcggccgccgccgccgccgccgcgcagcagcagcggcggcagcagggctcgggctcctcatcgctgcgcggctcgctcgacgctgccgcatccccgcccacgtcctcggacgcggggctggacgccgcggggcccggcgccgccgaccaggcctggcatctggcgccagaggaggtgaccatctgccggcggggggatggcaccttcctgcagatcggggcgggggcctttggcacggtgttcaagggcgtgtatcgcgaccgccacgtcgtggcggtgaaagttttgcaccgcgccgctgacgagcggcgcagccgcgagttcgtgcacgaggtcacgctgctcaagagcctgagccaccgacacgtggtccaggtgggctgggctgggttgtacttgtggcgagttgttgggctgtggggctgtggacccggcactgggggaagtgccctgggtcctttggaagcttcgcggagccgcccccctctcctcgtgcctgaacctgcgcctgcgcttcagggcccccaactagtcctgtcattcccccctccttccccccagttcctgggcgcatgcacctccggccccatggccatgctggttggaagggaaggaggggtggtgttcaaaggcagaagccctctggggcgcgggcgtggcgctggacgtggcgcaggggctggactacctccacgcccagaaggtggtccacctggacctgaagagcgccaacatcctgctatcgcgcatgggcacggccaagatcgccgacgtgggcttcgcgcgcgtgctccaaaagtcctacctctccgtcctgtcgggcctgggcacgctggcgtggaggtgcgggggatttatacagaagggttggggcgttggggttgttcaaggatgtgtggaactgggctgggcgcagtggggggagggcctcaccgccgctccccagcccacgcgagtgggggcggtgtccatgatattcctgggttgccatgcatgcgagacccccccgcacccaccactcccccttcccacccgcagcgcccccgaggtcctggctggccggcggtgcaccgagaaggccgacatctactcgtacggcgtgctgctgtgggagatcgtgacaggcgagggtcccgtgcggggccgcatgcgcagcccccgcacgcccgaggagtgccccgtggaggtggcggcgctcatcgccacctgctgcgcagaggacccctgcgcccgccccactgcgccgcagctcgtgcagctgctgtccgccatgcagggctgaggcctcccgcccgcccgccgcccttggaaccctctttcccgctccaaactgccccctga

SEQ ID NO: 5881 - DNA, 378 bp, Chlorella protothecoides
  modified_base (203)..(212): a, c, t, g, unknown or other
atgtttgacgatgtcgctgtccgcagggtcgctctcatcttgctcactggcttcaccgcccgcctcaagtactactttgtctggtctgtggcggaggcgggcctgatcatgtctggccagtgctactccgggctctcacagaaggtgaccgtcggctcgaggtggtctcgggagactttgtctttgggggttgaggaggggcnnnnnnnnnngtctggccagtgctactccgggctctcacaaaaggtgactgtcggctcgaggtggtctcgggagacttcgtctttggggggtgaggagggggcgtgggcacgtgtacagcaggccaccctgttctgggcggaaccgggcgaggccccgtcggtgcgagtgccttga

SEQ ID NO: 5882 - DNA, 5286 bp, Chlorella protothecoides
  modified_base (116)..(125): a, c, t, g, unknown or other
  modified_base (4254)..(4263): a, c, t, g, unknown or other
  modified_base (4339)..(4348): a, c, t, g, unknown or other
  modified_base (4424)..(4433): a, c, t, g, unknown or other
  modified_base (4625)..(4634): a, c, t, g, unknown or other
  modified_base (4724)..(4733): a, c, t, g, unknown or other
  modified_base (5182)..(5191): a, c, t, g, unknown or other
cgggcggcgcatccaagcgcgccctcctgcgcagtctgggcgcgcacgaggtcctcaactcccgtgacaccgcctttgtctcggaggtcgccgagctggggggcgtggacgtggtnnnnnnnnnnagcggccctgaatgccggcgggcgcttcgtggagattagcaagcgcgacatctggagcgccgggcgcgtcgcacaggagcgtcccgacgttgggtactcgctgctggcggtggacttcctccccgcccccatcatccagtccaccctggcccgcatctccagcgccctggcctccggcgcgctggccccgctgcgcagcatcgcccacggcctgggcgcgctggcgggcgccttccgtcagatggtgcaggccacgcacgtcggcaaggtggtggtcggcgccggcgaggcgggcgccctccccggccgcgccgcgggcggcggcatcgccgtcaccggcgggacggggggcctgggcctggccatggccgactgggcggcggccacgcacgctgcacgccacctggtgctgctcagcaggtctgggcgcaccggtgaggccgctccgattggcctgctggcctccccggccagcatgacgctcgcggccgtagacgcatcggtgcccgccgacctccagggcctggtgtgcggtggtgtgctggaagggctgcccatcacgacgctgctgcacgccgccggcatcctgcgcgactcgctgctggcccagcagaccgccgactcggtcaggcgtgtgctggcgcccaagctggggccgctgcacgccttgcgcgaggcgccggggcccctggccgccaccctgctcttctcctccgtggcctccctgctgggcgcggccgggcagggcaactacgccgcggccaacgcagccctggatgcctgggcgcacgcccagatggcctcgggcgcgaacgcgaccgccgtgcagtggggagcttgggcctcctcagaaaatcacctgccctttccagcctcctgccctccatgggcttctcctcttggcgcaccgtcaatcagcatacttgaacaaagacaccaatccatcccccccactcccccccatcacccaggcatggcatcccaggcggtgctgaagcggctggaccgcatcggccagggcgccatctcggcggagcagggcatgctggcgctgggcgcctccctgcgcgctgtgcacgctgtgccccagatcgcggttaatgccttcagctgggacacctacctggcgccctggacggggcccgagcaggcaagggggcccgtgccaaccatgtatgccgagttcgaggcgtcggcaccacctgccctggtcgcccccatcggcgccgctgcaggtgggcgcaggaagcgcggcgtggacgccaacaagggcggcgccggcacggccgcgccagacgccgccgcgctgcgcgcccaggtcgcggcgaccgtggccgcggccgccgcagaggtggtcggccccggggtcggggaggacgagcccctcatggccgccgggctggactctctgggctctgtggaatttgccaacatgctgagtcagcgcctgggcatgagcatgcccggcacgctcatcttcgactacccctccctgcgcgccgtcggcgattacctgtccaccgcgctgctgaagaagcagggcgcaggaggggatggcgcggcgcccatgcccgaggttgatgaggacggcgacgtcccctccgacagcgacggggaggccagcgacggcgaggctccatcgcgcgggctgcgcgcccggcccgctgcctcgcccgcggccaggccgatcgcgctggtggcgatggtcagccagggcctgcagggcgacatcctgcacgccagtccgggaacccaggccatagtggcgctgcaggacgcggttcacaaggattgtggtgttggaggttggggaggtgatgcaatgtttttgaggtcgcaagactccgctggccgaggcagatgcctgtcgtcgtccccccaatccaccccatccctcacccctcccaaccgctgtgcaaaccaccagtttggtgcgttcatgagcgagatcgaggtatttgacgccgcggcatacggcatgtctgtggcggaggccacgatcatggaccctcagcaccgcctggtgctctccttggccacccaggccctgctgggttcccagggccttcacggcgcccccctcccccgcaccggcgtcttcatgggcatttcctggaccgagtacggccagctggcgcaggccggcggccttcccatctcggcctacaccgcgcagggcgcggtgctgtccgtctgccccggccgcgtcgccttccaccacggcctcaagggccctgcggtggcggtggacaccgcctgctcctcctccctcgtggccgccaacgccgcgcaggaggggctgacgcgtggcgcggggggcgccatcgatgccgcgctggcgggcggcatcaacatgatgctggccccggccacctccgccatgttccgcaaggcgggcatgctggcgccggacgggcgttgcaaggccctagacgccgcgggggatggctacgtccgctcagaggggtggcacagcaagcatgggagctccatctcgatttgcgctcccatcgatgcctccgtgctcgccttcctggtgggcagcgccgtcaaccagggaggccgcgccagctccctcaccgcgcccaacggccccagccagcaggacgtgatccgagccgcgctggcggccgcgagcctgctgccggcggccgtctccaccgtgcagctgcacggcacggggacgcagctgggcgaccccatcgaactgggcgctgtgtcggagctgctgggcgcagggcgggccggcgccggtgccccgctgcgtctgctggcctccaagtcccagctgggccactcggagccagcctccggcatcatgggcgtcgcccagctgcaccaggcgatgacgcaggcgctggcgctcccggtgctgcacctgcgcacgcccaacgcgcacgtcgcggcggtggtgagcgagcccggggtctactccatgccgcgccagcccggcgcggcgcccatgcgtgcgccggcggccgccgccgtcaccgcgggggcctcggcctttgccttccagggcaccaacgcacacgtgctgctgcaggcgggagccggcgcagccctcgcacctgttctgccgcctgcgccagctttcgaggcccggcgcttctgggtcctggccgagccgcacgcgctcctgggcggggtgctggccctggacccccgcaccggcaccgtcacctttgccgccgacctgtcggcacccaagctcgccgccctgcgcgaccacgccgtcaacggccgccccatcctccccgcggccgccttcctggagtgcgccgccgcagctgcggcagccgctgccggcggcgcgcgagacggcgttcaggccgtgctgcaggtgaccatccccgccgccctggagctgctgcaggccggcgcacaaggtgcccgcgcgcaccagcacctgctctgctgctcggtggacgctgggtcggggcgtgtgcgcctgagcagcagccgcgcgggctcccgcctgcgcgaccatgcttacggcctgctggcttcaatccacctcggggacattggtgccggggtctcaacggcaccagcaaccccatctggcaccgtcactgccctgctccctctctctgtcgaggcagcgggctcgggcgggcccgtcggcaccatcacctgcctcaggccggatgggcgggtgggcggcgcagggctggacgccgccgcactggacaacgccttccacctgggcgcgctggacgccagcgccctgcgcatccccgccggcatcgccgcctaccgcgtggcggcggcgcccagcgtcgtgcccgcgcccgtcctggccgcgggctgcgcgccggtctcccagtccacgacctccgccctcaacgactactgggtggagagcgcggcggggaggtcggcgggcgtccagggcctggaggccagggagctgggcgccgctgcgcggcgcgcctccggtggttctccgcaggcagctgctgccagcacggcgctggagtaccacaccgtctgggagaccagcgtcgtggtggcgggggggctctcctctgcccgccccactgcctccgcatttgatctggcacagggggtctccacccagcacgccgcgatcatggctctggcaggcctgcaggcggcggcagcnnnnnnnnnngctggaggcccccgggccacgctacacggccgtcgacagcgacggcgcgcagcgtgcccagcgccccaccgcgctnnnnnnnnnnactggaagcccccgggccacgctacacgaccatcgacagcgacgacgcgcagcgtgcccagcgccccaccgcgctnnnnnnnnnncccgcatttgatctggcaccgggggcctccacccagcacgccgcgatcacggctctggcaggcctgcaggcggcggcagcctcgcagggccccccctcggtggctctggagtcgcgtgcccgccccggcgccgggcctttcaccggcaatgcaacgaccgcgctgctgcgcggcatgctcaaggccctggcnnnnnnnnnncgcgcacgctgcagacaccgggccttgccgtggggccgccctcggcggaatcaaagacccgtgtttctctggcatctgccgccccgcgcnnnnnnnnnncgacacccttgtttttgggggcgcggccgtcgatgacggcgtcgatgcgcacggcctggccctcagggggcgcacgcagcagacaccgggccttgccgccgggccgcccttggcggaatcaaagacacgtgtttctctggcatctgccgccccgcgcttcctcatcacgggaggcacgggcagcctgggccggctcatgaccgaggcgatcctcaccgggagcgcgggcggcgccaccacctgcaccctggttgggcgggctgggcggctgggcagcagcggtgacgccgcgccgctgctggcaggcctaccaaccgacgccaccgccgtctccagcctggtcgtgacctctggcgacgcggctgtggcggccgacgccgtgcacctactggccgcggaaggcgcagagcccctggccgtactgcacgcagctggcttcctggcggacnnnnnnnnnncgggcgggctgggcggctgggcggcagcagtgacgccgcgccgctgctggccgccctcccaaccgacgccaccgccgtctccagcctggtcgtga

SEQ ID NO: 5883 - DNA, 1644 bp, Chlorella protothecoides
  modified_base (441)..(450): a, c, t, g, unknown or other
  modified_base (1485)..(1552): a, c, t, g, unknown or other
atgcacctactggccgcggaaggcgcggagcccttggcagtactgcacgcagctggcttcctggcggacgccatcctgggcaaccagaccccctcggcgctgcgtcgcgtgtttggcgccaagacgtccagcgcggaggcgctgcgtgccggcctcgctttccttcccgcctcccagcaggtcctcttctcctccgtggcggcgctgctggggtcgccagggcaggtcacttactcggcagccaactcggtgctggatgcggctgccgagctggcgcaggcccagagagtgacccagctggggaaggacggctgcgcctggccaaggctgtgcttccacatccacattttctcaagcaccacggctccatcgctgccccacaccaacccccccaccaactccatcttccgacgcagggtttgccctccaccagcatccagnnnnnnnnnncctcaagcatcacagctccatcgctgccctacaccaacccccccaccaactccatcttccaacgcagggtttgccctccaccagcatccagtggggcgcctgggccggcagcggcatggcagcccaggaccgctccaccgccctgcgcgtcgagcgcatgggcatgggcatggtcgaccccggccaggggctgcgcaccctggtcagggccctggcctccacaccggccgtcttggtggccgtgcccttccacctgccgcgcctggcggcgctggcgcagcgcggagcgggcacccactccatctacgcccgcttgctggccgacgtgccagcggcggcaggagcagcctctcgccggcccgcgtcccgcgccggccaggcgagctccgcggcgccggccgcggcagcagcggtcagcacggccgccatcatgaccggcatccaggaggccctggcgggcgtgctgggccagaccctggagcccgacgcgccgctgatggcggccgggctggactcgctggcggctgtggagttccggaacacgctgcagtgccgcgcgcccagggcacccacggcgccagcagggcccaccgagggtctgccgcgccaccccgcgctgcgcctgccgtcgacatcatggtcatccgcgggagcgtggcgcaggtcgtgggcgaggtgctgggggccgaggtggagcctgacgcgcccctcatgtctgccggcctggactcgctgggcgcggtggagctgcgcaacagcctgcaggccgcgttcggtctggggttgccgggcaccctggtcttcgactaccccaccgtgaccgcgctggcaggccacatcgcaggcgaggtggcccgcgccggcggcgacgctccgggcgccgcgccgcgccccgcctcgcgtgccagcgccctgctagaccgcggttccgtgctttccacagtgtccgaggtcatcggcgaggtgctgggcggcggcgatgtggacgtggacgcgcccctcatgtctgtcggcctggactcgctggcggcggtnnnnnnnnnnnnnnnnnnnnnnnnnnnnnnnnnnnnnnnnnnnnnnnnnnnnnnnnnnnnnnnnnnnnggcgtcggcctgccggggacgctggtcttcgactaccccaccgcgcaggccctggccgggttcattgccgacacggtggagccggagggtag

SEQ ID NO: 5884 - DNA, 780 bp, Chlorella protothecoides
atgctgagcctggccgaggtcggcgcggtccgggcctcccaggacttccccctcgtctccctggcctcgcgcctgcccaagaagccacacttcaccttacaccgcattccccctcacctccccgccaccaccacacaggacatcctgaacctgagcctggccgaggcagacgggagtggggttgtgccgttggagcgctgggacctccaggagcaggcgcagaccctgggcactgcgccggcaaggtgggcagcggatgtgctgggtttggcaaagccagatgctgcagcgtgtggcaggcttttaggggcagttgccggcaatgcatgtgatgggtgtggtggatctcagatacatctcctgtgcatggtcaccgtcacatttccctccccttctcccctcacatctcgccccccaaaaatctccccccaccccaggttctcttccttcctggaggacattgatctgtttgacattgcggccttcaagttcaatgccaacgaggccatctccatggacccccagcagcgcctgcttctggagctcagcgcccaagtcctcgccgggcagtcggcacccaccgacacgggcgttttcatcggtgtctcctccacggagtacaggatgttggtgtccaaccaccttcccgccttcactccgtactctgccactggcactgtcagcctgtcggtgacggcggggcgtctgtcctaccactacggcttcacggggccgtctttccccatcgacaccgcctgctcatcgtccctggtcaggtga

SEQ ID NO: 5885 - DNA, 2505 bp, Chlorella protothecoides
atggtcgcgcaggcgggagcccgcgcggctgctgctcaggcgcacacgccccgacccagcgtccaccgagcagcagagcaggtgctggtgcgcgcgggcaccttgtgcgccggcctgcagcagctccagggcggcggggatggtcacctgcagcacggcctgaacgccgtctcgcgcgccgccggcagcggctgccgcagctgcggcggcgcactccaggaaggcggccgcggggaggatggggcggccgttgacggcgtggtcgcgcagggcggcgagcttgggtgccgacaggtcggcggcaaaggtgacggtgccggtgcgggggtccagggccagcaccccgcccaggagcgcgtgcggctcggccaggacccagaagcgccgggcctcgaaagctggcgcaggcggcagaacaggtgcgagggctgcgccggctcccgcctgcagcagcacgtgtgcgttggtgccctggaaggcaaaggccgaggcccccgcggtgacggcggcggccgccggcgcacgcatgggcgccgcgccgggctggcgcggcatggagtagaccccgggctcgctcaccaccgccgcgacgtgcgcgttgggcgtgcgcaggtgcagcaccgggagcgccagcgcctgcgtcatcgcctggtgcagctgggcgacgcccatgatgccggaggctggctccgagtggcccagctgggacttggaggccagcagacgcagcggggcaccggcgccggcccgccctgcgcccagcagctccgacacagcgcccagttcgatggggtcgcccagctgcgtccccgtgccgtgcagctgcacggtggagacggccgccggcagcaggctcgcggccgccagcgcggctcggatcacgtcctgctggctggggccgttgggcgcggtgagggagctggcgcggcctccctgggccttgcaacgcccgtccggcgccagcatgcccgccttgcggaacatggcggaggtggccggggccagcatcatgttgatgccgcccgccagcgcggcatcgatggcgccccccgcgccacgcgtcagcccctcctgcgcggcgttggcggccacgagggaggaggagcaggcggtgtccaccgccaccgcagggcccttgaggccgtggtggaaggcgacgcggccggggcagacggacagcaccgcgccctgcgcggtgtaggccgagatgggaaggccgccggcctgcgccagctggccgtactcggtccaggaaatgcccatgaagacgccggtgcgggggaggggggcgccgtgaaggccctgggaacccagcagggcctgggtggccaaggagagcaccaggcggtgctgagggtccatgatcgtggcctccgccacagacatgccgtatgccgcggcgtcaaatacctcgatctcgctcatgaacgcaccaaactggtggtttgcacagcggttgggaggggtgagggatggggtggattggggggacgacgacaggcatctgcctcggccagcggagtcttgcgacctcaaaaacattgcatcacctccccaacctccaacaccacaatcctgcacccacctgggctcggccctgtcgaggtcccagcgcgacagcggcaccttgtgaaccgcgtcctgcagcgccactatggcctgggttcccggactggcgtgcaggatgtcgccctgcaggccctggctgaccatcgccaccagcgcgatcggcctggccgcgggcgaggcagcgggccgggcgcgcagcccgcgcgatggagcctcgccgtcgctggcctccccgtcgctgtcggaggggacgtcgccgtcctcatcaacctcgggcatgggcgccgcgccatcccctcctgcgccctgcttcttcagcagcgcggtggacaggtaatcgccgacggcgcgcagggaggggtagtcgaagatgagcgtgccgggcatgctcatgcccaggcgctgactcagcatgttggcaaattccacagagcccagagagtccagcccggcggccatgaggggctcgtcctccccgaccccggggccgaccacctctgcggcggccgcggccacggtcgccgcgacctgggcgcgcagcgcggcggcgtctggcgcggccgtgccggcgccgcccttgttggcgtccacgccgcgcttcctgcgcccacctgcagcggcgccgatgggggcgaccagggcaggtggtgccgacgcctcgaactcggcatacatggttggcacgggcccccttgcctgctcgggccccgtccagggcgccaggtaggtgtcccagctgaaggcattaaccgcgatctggggcacagcgtgcacagcgcgcagggaggcgcccagcgccagcatgccctgctccgccgagatggcgccctggccgatgcggtccagccgcttcagcaccgcctgggatgccatgcctgggtgatgggggggagtgggggggatggattggtgtctttgttcaagtatgctgattga

SEQ ID NO: 5886 - DNA, 561 bp, Chlorella protothecoides
atggtgaccggggcggccttgactggcgggccttcgcccctgcggccccgcccagtggtgcggaggtccagggcgcaaggcccccggcaacgcaatcctcgcactcccacgcaatgtgcaaccggacccgacatcattgtcgtcggttccgggatcacgggcctggccatcagcctcgagctgctacgcactgccccgggcctcaccgtcacgtgcctggacggcctggcccagctcccggggggcgccaccggtgcggggcagggctacctctggctggcgcaccgcacacccggctcccctggctggaccctggcccagcgcagcaaggagatgtggcggggctggcccacgcccggtgtggacgtgggctggcgcggcgccggcagcaccctgctcgccgcggacgccgctggcggcgtgcagctggagcacacagcggccgcgctggccggcgccggggtggcggccagcgtgctcggcgcgcgtgagctcgccgccgtggagccagcgctggcccacgaccgcctcgccgcctggccggcgggcggcgccgccgcg

SEQ ID NO: 5887 - DNA, 522 bp, Chlorella protothecoides
  modified_base (104)..(113): a, c, t, g, unknown or other
atggtgcgcatggacgtcctgcaccgagtcatcggtcccacgctggatgaggcgtactgtggctggggtgagtcgcagcgcgggggggtcgaggctgggacagnnnnnnnnnncatcggtcccacgctggatgaggcgtactgcggctggggtgagtcgcagtgcggggggggccgaggctgggacatgcggcgggcgcacggccaggatggggagcccagagcgggaccgcgggcggtgcccgcctggaacgcacatggcttcaaactgagaggctcgtactgtcctgggtccagcctgcagcggcagatcgtactgcctggtgattcaggcctcgccatgccgtacagccttttcccccttatccgccgccaaaccacaggcctggacatcgtctggcccttcctgcttggctaccccaaggagaccgtggggatcatcgacagcgtctgcgctttccacccggctgcgcagctggacaaggtgtccacctacggcttccagaatcccatggccaggtga

SEQ ID NO: 5888 - DNA, 537 bp, Chlorella protothecoides
  modified_base (282)..(291): a, c, t, g, unknown or other
atgcgcgtgatcgcgacgggcatgccggccgaggagatcgcggggctcaaagccctcttcgaggccatcgaccgcgacaggagcgggaccatcaccgccgaggagctgcgagaggcgctgaagatgaagggcgctgtcctgcgcgccgccgacctggagacgctgatgtcgctgatagatgtggacgccagcgggaccatcgagtacgaggaggtgagtgattgggtggggttgcattttgttgttgtgggagagggttggaggagcgagggtggcacgatnnnnnnnnnnagcgggaccatcgagtacgaggaggtgagtcattgggtggggttgcatttttgttgtcgtgggagggggttggaggagcgagggtggcacgagtacaggagagtgggtgagtgggtggggacagggcggcggatggagtgcaacaggcagcgtgcccagtccagggaagcaactcggcgcgagtgttcgcaccctcacgccgtggttgcccctgccgaccccgctagttcttggcggccaccatga

SEQ ID NO: 5889 - DNA, 786 bp, Chlorella protothecoides
atgagcggcgcgagggtcctggcatgccaggccttcccaacccaccctgcccagggcccacagcgccccgccggacatgaccaccggatggcgaccaggagaacgctcctcgccacgactctgggcgcgggcctgctcccgacgatctccatgaggtcgcgggcgggagcgctgtacgacgagtatgccgaggagtacgacggcctggaatccggccgggcagcgcagctcctgggcctggcaggcctgcgcggccgcctggcgagcatggcccgtggcgatgtgctggagatcggggcggggacggggctgaacctgccctggctcctggcccggcccctggcctcctacaccgcgctggacctgtcgggcgccatgctggcgggggcgcgggcaaggctggcgcgtgcgccgccaccgcccttccccgtgcgcttcgtcgctggggacgcggcgcgcctgcccttccccgcccactccttcgactgcgtgctgagcagctacgcgctctgcgcaatggaccgaaccgacgccgcgctctccgaggcgctgcgcgtgctgcgccccgggggccggctgctgctgctggagcatgcgcgcagcgagctgtggcccctaagctggtaccaggaccgcacagcgcgcgccgtggcggccctcagcaagggctgccgctgggaccgggaggtgggggcgctggtgcgggccgcgggaggggaggtctgggccctggagcgccacctgctgggcaccgtggtgctgctggacgcggagccccgtgcttga

SEQ ID NO: 5890 - DNA, 900 bp, Chlorella protothecoides
atgaggctcctcgccctggccgcgctggcctgtgcgatggccggcaaggatgcccccaggcgcatggtccccgtcacctttactacaggaagtctgacctttgccaattcctcgggacggaacctgatcctcgcccccatcggcgccaactcggtgcgtgttcgaatccgggggcttcgacgcacgtggacagccggcaaccttgccggcccccaaccccaactgcccccaccaccccctcccagctggctggacgataccgactccaggacctttgacatcctgcccatctactacaccccccagccgccccacccatgccccgcctgcatcggcgcctaccacggccagggacccaagttccagctcctgcaccaggtcctccgcagccagcagtggcaggccatccacccgcgctacgacgtcgtcatgctggcggacgacgacatcatcatgtccacgcataccctgaacgaggccttccgcatcttcggcacgttcaacatgaccctggcgcagcccacgctgtgccggcacccccaggtcggcgtcagccatggcgtggtgctgcagaaccagtccaacttcatcaggtaccctgacccccaagtgggaaagggtgactattggaaaagggggggggtgcaggatggagggaggaggatcagcgtggctgattgtctgcggtgcggctggtggtctgcggtgcggctgatcgccagcgtgccggatcaggaccatcctgtggggtcgctctcacacagatgcaaacacaagccccttgcccgacaaccacaggtacacgccctttgtggagatcatgatgcccatcatgaccatggatgtcctgaacagcgtcgtcgggcccacattcgaggacgcctacactggctggggtga

SEQ ID NO: 5891 - DNA, 282 bp, Chlorella protothecoides
atgctgggcgcagtgacccacgcccatggagcctttcctttcccccccttgcccctcagaatacaggccgtcccgcccgccgtgctccgggactgtggcgcgctgcgcacgctgagtctgcacgacaaccccatcaccgtggaggagctgcgcaatacggagggctgggcggcgcacgacgcgcggcgccgccagaagcacgacaagcagctggggagcgaagttctgggcccaggcatggatgagggggccgacgcccaccccgtgcagaactggaaatga

SEQ ID NO: 5892 - DNA, 822 bp, Chlorella protothecoides
atgttcacgtccccaccccaacactcgcaggtgtgggcagcgctgggccaaagctggaagaccagacctccgccctggggaggaactgggcaccaggcggccggaggtgaaggacaaggagaggagtggttggtcggacgggcgccaccacaagtttgctcggccgagctactcccccaccaacagcgactcggagacgtctcgcggccggtcctcctccctcgccatcccgatcccgccatccgaggcaatcaaccccacgaccttcgaatccgcagaaacaactttttcatcagtgcccatgccccggaggtcccccccagcggggcttcccccagctcccccggccagtacgtgtcgttctgcttgcagaaggtctgccacgtccgcacccagtacatgctggtctgggtgcaggatgcccgccacgtcagcaccctggccgttgtgggtacggacgcacgatccagcggtcactacacatacaccaaggcccctgacttccccggcccacccctgacctgcaccaatagggccagggtgttgaactggctgggccagctgggcatccataaccaggtccaggaggggacctgcatcctccccagcctgtctcccgcagccctcctgcacctcgcagagggagcacgcaccgtgggctgcgcctgggtcgactgcttcaacctgtgccagcaactccatcaccatggcccccctcccagggaggaggccgttcacctgggcgggcacctcagccgccgtttcttcctcgtcaacgcctatggcggtcaggcgctggcagccaccagtaccaacgggtag

SEQ ID NO: 5893 - DNA, 189 bp, Chlorella protothecoides
atgtacgcccccacccctgtccggacccaccgcagggacctgaagcccgagaactttctgctggcttccccggcagaggacgcggccatcaagtgcaccgactttggcctctccgttttcttcaaggccggggagcgcttcaccgacgtggtggggtcggcctactacatcgcgccagaggtagtgtga

SEQ ID NO: 5894 - DNA, 696 bp, Chlorella protothecoides
atggaagtaagcgtaagattcggatctagtgcacacatcgtttcgttgccagcagagggaacgctcggcgacctgcgggctggtgtcgaggctgccacgggtgtgctggcgcgacagcaaaagctgctgtgccgaggcaaggtcctggccgaacctggggccggtagagacgatacaaggctcagctccatgggtctggttgcgggcacgaagcttatgctcttggccgcgaccgggccgggacccaggagggccgtgggcagacccgctgagcggccctctcaacgcgcggcccagatcagggtgtggaaggccaccggcatcgccagcctgggcgccgggccgggggccccgaccctggatggctggccgcccgcattgctgggggccgcccccggcctgcgggccgcccccggcctgcgggtgctgagctgtcacggtgcgctgtccccgctggccaaccccttctccgccccgctggcgcccttctgcgccctgcagcggctgagcctgacagggtgcgggctgccgagcgctgccctcgactggcgcgtgctgggcgcgctgcgggccctcgccaagctgtcgctgcgaggcaacgcgctgcacgcgctgccgtgcgccgtcggcgacctgcccgcactgcgggagttggacgtagcctgcaacctgcttggtgaggcgcgagggggctga

SEQ ID NO: 5895 - DNA, 507 bp, Chlorella protothecoides
atggtgtctgcggaggccatgcagtttgggcacgccacagcttggcaaccttctcagcactcctccccaccgttgccttcctactctcccgcatgcgcagtggaggcggcgggagtgaagctgagtgtggagatctggcagcgccgactggaatccgcggcactctactttggcgtgctcctgtacattgacgtctggctgctgctgctccccatcccccagagcagcttcctgcaggaactcagtgggctggactaccatcagatgatccgctggcacaggtgcatgctgtgcgtgtttagtcatcctgtctctgcggggggtccaaagttcccgaagatgctatgcaaggctactcacccacacgccatcccccacccacccaccctggcacctggcactcccgcacaggtggatgggccacatcaccatgattgttacctccgtgcacggcctcttgtactatttctactggggcgtcacccaccagtgagtcctcgagcctga

SEQ ID NO: 5896 - DNA, 801 bp, Chlorella protothecoides
  modified_base (118)..(127): a, c, t, g, unknown or other
atgccgggcgcaagctcaccacatctcccaccctgcctcccaccccctccctcacctccccctccctcacccaaaaacaggcacacgctggacgcgctgcacatcatcgggctggatnnnnnnnnnngtcactcggtagcctcgtcccctcacccttcaggattgtgtgcttgcatgccgggcgccagctcaccacatctcccaccctgcctccacccccctccctcacctccccctccctcatccaaaaacaggcacacgctggacgcgctgcgcatcatcgggctggacgccggggcggtgcgctccgtgctttcctgcgtggccgccgtgctgcacctgggcaacgtggcctttgccaccgaggacgactgcgacgacgcggtgctggccgacgtggcggcggaggacgcggtggagattgcggcgcgcctgctgggcgtggcacccgaggcactgctggccgcgctgacgcggcgggtgctggagacgcgcggcgagcgcatcgtcaaggcgctgggcgccgaggcggcggccgagtcgcgcgacgcgctggccaaagctttgtacgcgcgcctcttcgactggctggtggcggccgtgaaccgaaagatcggcagcctgggcgcgggcggcgcgggcgcgcgctccatcggcatcctggacatctacggtttcgagtccttcgacaccaactccttcgagcagctctgcatcaacctggccaacgagcgcctccagcagcacttcaatggccacgtcttcaaggtttgtcgggctggtattcaggggccggactga

SEQ ID NO: 5897 - DNA, 1251 bp, Chlorella protothecoides
  modified_base (327)..(336): a, c, t, g, unknown or other
atgcttctcctacctcccactgcatgcatgggttccctttggtttccctcccccaccggctcaccagatcacccactccgccctttgccgcacagcatcctgcacaccctgcacgttcggtacgggctggactccatctacacctactccggctccatcctgatcgccgtgaacccccacaagagggtccgcggcctctacggcccgcgcatgatggcgcagtaccgcggcgcggcgctcggcgagctgtcgccccacgtctacgccatcgcggagcaggccctgcacagatcccagggaacccgacctgctcgcctcgcccatcannnnnnnnnnctctcacaggccctgcacagatcccagggaccccgacctgctcgcctcgcccctcacccctcctcccaccccctccccgatccacaggcctacagcgccatgatggtggacgagcagcgccaggccatcctcatctccggcgagagtggcgcgggcaagaccgagagcgccaagctggtcatgcagtaccttgcgcaccgagccggcggcgggcgcgccgcaaacggcggcggcgaggcgggcgcggatgcgcgcggggcatcctccggcgccgcgcccgtggaggagcaggtgctggagtccaacccgctgctggaggcgtttggcaacgccaagacctcgcgcaacgacaactcttcccggttcgggaagttcgtgcagatagactttgatgcggtggggcgggtggtgggcgcctccatctccacctacctcctggagcggtacgttgttgatgggaagggagggggtggggcggggggttcgtgcatggtgctgggggaggggtggcagcatgtcgaatgtgggagcagggacctacatggggtcgtgtgtggaggagggtgtttggcagctgctggccaggcggcacagggattccgggccgcggcaccacatgcaatcaagaccctccccccctcctcctttacactgcaggtcccgggtggtcagcataaagtcccccgagcgcagctaccacatcttctaccagctggtggccggcgcctcgcgagagcagcgccgcgagtttggcctggagggtggcgtgtccagcttccggtacctggcgcagtccgacgcggtcctgctgcagcacgtggacgacgccgaggagtttgggtgaggccatccgtgtttcgggtcgactgctctggaggtggagagcatgcgccgcggcctcgcgtcactcggtag

SEQ ID NO: 5898 - DNA, 627 bp, Chlorella protothecoides
atgccctctctgggccgtaaagcttctatcccactggagcggggtctatcacaggcaggaaggggctcgggctgcctgagcgcccctgttgtctcgcgttccctccaccccgtcgtctttcccaatgggtggcgacggccagatccccaccccgcaggtctacccccaaggcacggcagtatgggccccacgagtcgaggttttgctgtccgctgcggcagacggcagcaggaagcgtgtcactcactggctggcaggcattgtgcagttgcacgacctggcaagcacgactgtgtcctctcctgtccactgagcgcctggtctcccaccacacccccaggccgccgagcggaaaggagatgccgtcgacctcaaggttcggctgaccagcggcgatgtcgtgcagatcacggccaccagcgtccaccttcaggcaagtctgagctgccgcgcgggagcagggctgtgcccggggccgtggagagggggtggtcgtgtcctgtgggtctcacctccgaacccgttcccccatccgcgcagaatgagagggatgacgtgatcgatgacctggtcaagtccgacttcctgcacgagccagggtgtgtgccggaaagtggagggagttga

SEQ ID NO: 5899 - DNA, 1398 bp, Chlorella protothecoides
  modified_base (326)..(335): a, c, t, g, unknown or other
  modified_base (613)..(622): a, c, t, g, unknown or other
  modified_base (779)..(788): a, c, t, g, unknown or other
atgactgcccacgtccctcccctctcacccgcccagctcaaggcctggatgcaggcggccggcatggacagctgggtggacgccatcgggaacgtgcacggccgcgtggagggctccctccccggccccgccaccttcaccggctcccactacgacacggtggtggatggcgggaagtacgacggcgcgctgggcatcatcgccggcattgcggccgtgaaggcccttgtgctggaggtttgtgtgtgtgtatgttgcgggtttgggggggggagcaggggagcgggcttcctcctgtgctgcctggttcggcaagctcagagtgnnnnnnnnnnttgtgtatgttgggggttgggggggtggagcaggggagcgggctttcttgtgtgctgcctggttcggcaagctcagagtgcatcacggcggctgctccccgctgatgcccctgggtcggaggcaccaggggactgcgtgggagggcagcgccggcgccttgcctggtccacccccctgaccaacaccccttcttcatgccccatccaggccgcggtggcgcggggcgcgctcacgcgggaagaagctgctcggttgcccgtggaccctgctctgggcnnnnnnnnnnaccaggccgcggtggcacggggcgcgctcacacgggaagaagccgctcggttgcccgtggaccctgctctgggcacgacggcgctgcctaccaccttaaatgccagcgcgcttctccgtcgcagcttgcgcgtcgtgggcttcgcggacgaggaggnnnnnnnnnngaatgccagcgcactcctccgtcgcagcgtgcgcgtcgtgggcttcgcggacgaggagggcgtgcgcttccagtccacctacctgggctcgcgcgcgctggcgggcagcctggcggcctcgggcgcgctggacgcgcgcgacggcgcgggtgtcacgctgcgggaggcgctggcggccgaaggcgcgggcgacgaggccgcgctgcgcgcgctgggcgtcgtgccgagcgccgctcgggcctacgtggaggtgcacatggagcaggggccggtgctggaggctgccaactcacgcctggcagccgtgtcgggcatcgcaggccaggcgcggctgggcgtgcgcctcgctggaagccagggtcacgcggggacggtgcccatggccctgcgccgcgacccgctcccgggcgcggccgaggtggtgctggcgctggagcgcctctgtgcgccgggggggggaggcggagccggcacgggcctggtgtgcacggtcggcacgctggcgctctggccgggagccagcaacgtcatcccggggcgagttttggaggggtgtgtgaagggggtgggaagagggcagaggaaggggtgtttgccagaggaggcttga

SEQ ID NO: 5900 - DNA, 195 bp, Chlorella protothecoides
atgatctccctgcgccccgccttccgaccgtacaatcccctgatgtgcagcgcctcgtccacgctggagtctgttgtggccaagctggtcaagaacgggctgcaccggctgtacgtgtgcgacaacgacctgaggccggtgggggtcatcacgctgaccgacatcctgcgcagggtgtgcctgtcgcgggcgtga

SEQ ID NO: 5901 - DNA, 3084 bp, Chlorella protothecoides
  modified_base (26)..(97): a, c, t, g, unknown or other
  modified_base (817)..(826): a, c, t, g, unknown or other
  modified_base (2053)..(2062): a, c, t, g, unknown or other
atgcgagcatcgatctccatcccccnnnnnnnnnnnnnnnnnnnnnnnnnnnnnnnnnnnnnnnnnnnnnnnnnnnnnnnnnnnnnnnnnnnnnnnnggagcgggagaggcttggcctccgcggcctgctgccgccctctgtcctgcctgtccaacgccaggtcagcacgtaatgttggtgtgtgcacccgcaggaagtgtctgaaggatgctgtgtatccctgccagctgcagtcctgctccccacggcatgccagccatgggtttccagcgcaggggcccctgccactgcctgcacctcgtcaagttctcccttccaccctcgcctgcagctgtcacggaccatggacagatactggcatggatctgacttcatcgacccttcccaggtctgttcctagtgtgagattcaccttcccttttggcccctgcttgcggggcaaggaggttgacgccccaacgcatgctgtggcaaggctggctgtggctcgtcggactgcagcccctgcttgcggggagaaggaggttgacgccccaacgcatgatgtggcaagggtggctgtggctcgtcgcactgcaggtcacagtccagaccaaggatcatccagtcaacacccccccacctgccaggtggactctgggggcgttacccacgagcacacccggaaatggctggtactgagtgatctccaggtgcgccccaggatgtgcagcatgcacgcagggcgagcttgggaggtactgggcatgctggcagccgtacatcggctcacctggatgctgattgttcctcccttccctcctgcaaccaggatcnnnnnnnnnntgtctcacctggatgccgatcgttcctcccttccctcctgcaaccaggatcgcaatgagacactcttctacaagtgcctgatggataactttgtcgagatggcaccggctcctgaggggcatgaaggagggcgtctgattgccatcacctcatcgccgcctcaaaaccctgcagattatttacacccccacggtcggctgggcctgcatgaactaccacaagctgtaccgccgcccacgaggcatgtacttctcggccgccgacaagggcatgatggtgcgttgcttcttggaggtgtgacgtgccctgggatgcaggtgcctggaagggcagcttgtgttgggggctcgggaggtgtgcagggatcagggccctcctccaccaacccctcactctctcgtctgcgcagtcaaccatggtccacaactggccccacgatcacgtggacgccatcgtggtcaccgatggctcccggatcctgggcctcggtgggtgatgtgacacagggagtggacgactgggaaaatactcccgaatggcgtgctgggagccaggcagggtcccaggccagccacgagtcggctctttttggtctcatgttctatctgaaggccttggcgagtgtattcaggttctgggttacccccacacctcagcaagtgtgggccatcgccccaaccaaatgtctcctgcacccccctccccccccccttctcttctctcacatgaaaccaacaggcgacctgggctgcaacgggctgggcattcccatcggcaagctggacctgtacgtcgcggcgggggggttccaccccagccgcgtgctgccctgcgtcatcgatgtgggcaccaacaacgaggccctgcgctgcgaccagtggtacatgggcctgaagcagccgcgcctggcgggcgacgcctactaccagctggtggacgagttcgtgcaggcggtgatggggcgctggccgcacgccgtgctccagttcgaggactttgcgctagagcacgccggcccactgctcaagcgctaccgcgaccaccacaccgtcttcaacgacgatatccaggcacgctgcggtcgtggggcccggggaggggccctccaccctctgaggcgctcacctgacccatccgattctggtcaaagctggacaaactccgcatcccaactctcctaccgccactaccccaaaccccacctaccagggcaccgcctgcgtcgcnnnnnnnnnnagggggggagggggggggagaagtcccccaagggcaggctggacaaactccgcagcccgactctcctatcgccactaccccacccccccacctaccagggcaccgcctgcgtcgcgctctccggcttgtacggcgcactgcgcgtgctgggcaagtcccacgccgacctcaccgcccagcgcatcctggtggtgggcgcaggcagcgcgggcatgggcgtggtgaccatgattgccaagggcatgcaggcgcacggcctgacgcccgaggcggccgccgccaacttccacgtcatcgacgaccggggtctgatcaccacggcgcgcgagtgcctgccgccgcacgtcgtgcgctttgcacgttctgacgagcagagcacgggtggggtgattgatggtggtgttgtatgtgtggggagtggcggagagggaacggaagaaggggggggtagtaagggggccaagcgccctgagggtgcttcatttcttgagggaggtgcaattcatgcctctgcagctcagcgtgagtcccgcagcaaccgaccaccaggaggcgtgctggcaccctgccgccctcgctagggtgagagcctggtggagtgcatcacgcgcgtccgcccgacggtactgatcgggctggccggcgcggggcggctgttcacgccgccggtgctccagacgctggccgcgtactgcgaccgccccatcatctttcccatgtccaaccccaccgcgcgcatggagtgcactcatgaggaggccatccgctacacaaacggccgcgccgtgtttgccgcagggtcgcccgagccgcccgtggtgtggcacggagtcaccaaggtcccctcccaggccaacaacatgtacatcttcccgggcgtcgccttgggcgcgctgctggcgcgggcgggcacggtcagcgacgccatgctcatggcggcagccgaggccctggccgccgagaccaggcccgaggagctggagctgggcatggtgttccccaacatggacaggataaggtga

SEQ ID NO: 5902 - DNA, 1821 bp, Chlorella protothecoides
  modified_base (559)..(568): a, c, t, g, unknown or other
atgcgacagcatttggcctatccttcgctgctgatcgggacaccgacaaaggaagtgcccctcccatccacaacccgtgagcttgacagtgctggtggcggtcacaggagtcaccctgtagggtctcccatgccaggtgcatgctatctccgtgcatgccgtctttctcggaggctgaagggcttgcaagcaccatcacaggaacgagaggctgagcctggcagagcagcgccgggcactgcctgtgcacgcccacctgaaggaaatcttgtacctgctggaaaaacatgcgacaacggtcgtggtgggggagacaggaagcgggggccattggatttggtatggaggtgtcgcgggaagccaatggcctcgacaggatgccacgcccttgctagtgttggtagaagccaatggcctcaacaggatgccacgcccttgctagtacatactcggctgcaatgcaatatcatctcaaggccctcgctgcctccaccaagcgtgtcactcccccaaccatccaggttggacggccgggggcaagatgattgcttgcacgcannnnnnnnnngctcgggtgagcgaggagatggggtgcagcctgggccgcgagggtgcagcatgatgagaggagcagggaatggagtcacaggcaatgttgctggaaagcagtgccgattgctcgtcgtgcatgatggcaatggactggagtgggggggggtagctggtcactctgcctgccacatggtttgtcctcagtcgagagaagactgtgcaggccccatcgctggtccctttatcggctatactgcgtcggcccaaccactgaaccctaaaccctcgtgcacacaccgcagggcagaacgtgcatcaagttctgcaccgatggtgtcctgctgcgtgcaaagctctgtgctttccatggaggttgggttggctggccatctgcgtgtcgtttgtacaagtagaagaggaacctttctggagttaaccccaccacccccgtgcttcctccgcatgtcatcatggtggatgaggcacatgagcgcagcctggcaacagaccttctgctcgggcttctcaaggtacccatcagaggagtgcttgatgcccattcctggccatgcccagaccttgtggtgttgtgctgggacacacaatcagcatgcacactcgtcatgggcagcgtcttctgagtggcactggattcctgggaccatgcccagagcaccactgctcgggagcgacgccgtggtttctcaccgtcacacatgcaggttcttcagggctcccactgctgccagcaagccacggggccaccccttgcagcactctgaggcaggcgccgatcagttctcggggaaccctgccctgctcagcgtggagggcagggcccaccatgtccagagtaccagagcctggacgtggggtgaagcatgggcaggaagccagaccccctgcttggccgtgtccccgcctgagaccctaccagctcgcacggcgttgctcttttcaaaccgcattccccccttgtgcaccctgccccaggtgcactacctggacgaaccctgctcagattacctggcagcggctgtggaggcggcgctgcaggtgcatcgccaggagctgccgggcgacatcctcatcttcctcacgggccaggacgagtgccaggcggcggtgcgcctgctcgaggaagaaagccagaaatcgggccacaggagcggccagctgaggttgcaggtgcgcgggcaagccctcggcgatgtgcgtggagagagggggcgcattcctgctgagtggggcgggatgcttgagccatga

SEQ ID NO: 5903 - DNA, 657 bp, Chlorella protothecoides
  modified_base (19)..(28): a, c, t, g, unknown or other
atgccgctgtatgccgggnnnnnnnnnncccggcagcctcggcgccatgcatgcatgcctgcaaacgtgattcactctcccacaccggccctgctggtccctcacattgagccgcgcgcccacaccccaccaggcgatgccgctgtatgccgggctgccggccgcccagcagctggaagccctgagcccagccccacgagggacagctgccctggccgcccgcacttcttgccagcctgcgcatggatgtccatcaagtgggcacctcacacccgcggccacgggcaagccccccccctcctacaggccatcgtggcgacaaacatcgcggagacgtcgctgacgctggagggggtggtgtacgtcatagactcctgcttcgccaagcagcgcgcctacaacccgctcacgggcctgcagagcgtcctcatcacgcccatcagccgcgcctcctccgcccagcgagccgggcgggcgggtcgggtcaggcccggccacgctttccggctgtgcaccgaggctgggtgggaggcgctgcccgcagccacggtgccggagatgcagcgctgcgacctggctggggctgtcctgcagctcaaggccctggtgggcaggggttgtgagatcctgggacaggagagggagggacctggatga

SEQ ID NO: 5904 - DNA, 1038 bp, Chlorella protothecoides
atgctgcccacgctgagctggagcggttgcgtggggcgagtcgctgcccttcgagcacaccgtggcccagctggcgggcatgctcttggacgccggcgtgggggcgcgccccacggtatttgtctgccactccatgggcggcgtgctggtcaaggagctcctggcgcaagcccaggccaaggagaacgggcacgcctggcacaagtaatgaggggggttgggggagtgtgtagtgtgtttcctgtgggggggtgcggcgggcgggaggagggggaagggcatgggggggatctgcgtggggtggacggcagtggtgcgccgcctagcggctgtggggtgactcgaggatgctacatcatgcgatccccaccccccactgagcagtggtgccagagagatggcaccacacaaggtgggctgccgcccgccggcctgcccagctgcagaccggaagtgcgccccaacctccattcccacaggtcccgctcaatgtcgccacgccccctgcccatcccccacccccagcatgacccagaactcctcaccctcccctcttcccttccctctttccaatcgctcaggctggcttgcaacacgctaggcctggtgagctacgctgtgccccactccggctcgcgcctggcggacctgggctggcagctgcggtacgtgggcggcttccccgcgggcgccgtggcgcatctgaagaccagcgagctgcacctggaggacgtgaacgctgcggtgcgtggaatgcaccgccgcggcggcctggccgtgctttcctttggcgagggcaagccgacgcgggtggcctacatcaagacgctggtggtgccgctggagagcgcctatccggggtacggcgaattcttcgtgctcccctcccacgaccacatctccgcctgcaagcccaccgaccgctccgatgccgcctacgccaaggcgctggacttcctggggcggtgcgcacggagcgccgcgcgccggcgcgcggaggcccacaccgcggacgatgtggaggcggcggccctgtga

SEQ ID NO: 5905 - DNA, 780 bp, Chlorella protothecoides
  modified_base (226)..(235): a, c, t, g, unknown or other
atgcacctgtttgtccccggcgccgagcaccacgccgtgctggcgcggtgcggccgggacgccacgggccctggtgagcccgggggcgtgtcttttgtgtactttggcgggggggcttgtgcggggtcattgacgactgcccctcccggtcaggggctcatcacatgtgctggggccgcacacactacctccccctccccctgcacgcaacacctgccagggaccnnnnnnnnnncctcccggtcaggggctcatcacatgtgcttggggtcgcgcaccctaccttccccctccctgcacgcaacacctgccagggacgccgctgatggacgtggtcttcgtccacggcatccggggcggcgcctttgccacgtggcgccaggagggctcaccgcgcccgggcaaggtgagcggggtgggagcggggtttcaccgggtccctgcaatcccctgcacactcgtactcgtcccccacgctccccgtctgtcatgaccctcccccctccctccccacctctgcagggcgccgcgtttgagcaccacgcctgctggcccgcggcctggctgtccgaggagctgccggaggcgcgcctgctgaccgtggagtatgctgctcctgccagtgggtgggaggtgaggggcccttggggggggggagggagggatcgcgatgctgcccacgctgagctggagcggcgcgtgggcgtcaggaccaccacctcccctggaccctgcgtcgctcgctccggcagcgtcagccacctcgacacatctccgtga

SEQ ID NO: 5906 - DNA, 582 bp, Chlorella protothecoides
atgttgccacgccattctatcctggctgcagccgacattcgtttccagctggagtcgcacctgaagagggcaggcctggactggaggtccacagccttgggtcctggggcacagggcgacgcagcgtcagggctgctgactgttcgcaaggcctgtgctgctgggctgttcatgcaggcggcccgactcacagaggaactcgtccttgataaagcaggtgggatttgtgctttgttgtgcgtcgtgctttgtctcctctggggaaaaggtgtgtgtattcatgtatccggacgagaagagagtgggccagacgatgtgccgcctgtgcccatccggcctgattgcgacaagcgtgcacagtgtcaagtatcagccctctcacctcgaccagatgctcgagatgcgggtgccagcgtgtaccgcctggtccgatctggcgggggcgaggcggctgccgcgaagctgcgcatacatcattccagcgtcctgttccgttgtcggccatcctgggtctgcttctacggcgcagagcagaataacactgggtggtgcgcagagggagaaaggggggtgggggggtaa

SEQ ID NO: 5907 - DNA, 432 bp, Chlorella protothecoides
atgctggtcatggccccagaggccaccaccaaggccgcgcagtgcctgctcaagttcaggcgcggcgcgtttgccagcgggcacccggtctgccccatcctcctggcctacccgcaccgcgccttcaacccggcctggggcattgtgccctccaccccactccatgtctaccgcctgctggcccagcccctgaaccgggccaccatccaggtcctgcccacctacttccccagccagaaggagagggcggacccggctgcgtacgccgcgggcgtgaggcaggccatggccgctgccctgagggcgccgctcgtggagcaggccatggccgccgccctgagggcgccgctcgtggagcaggtggggggtggggttggcgagcaggcgcgaggcgagcgcaagaggttcagacatgcgtgcctaggctcttga

SEQ ID NO: 5908 - DNA, 249 bp, Chlorella protothecoides
atgtggcaacatctgccagctcccaagcgcgtcctgttggggcagctgggcatcgtctcctcccgcgccatgctggcgcagtggaagtacgtcgtggtgggcgccaccgtggccgcggccgtgctcacgccctccacggaccccttcacccagacgctactcgccgtgcccctggtggggctgtacatggccggcgcaggggcggtgaggctgattgagaacaggaaggcggccgcggggccggcctag

SEQ ID NO: 5909 - DNA, 381 bp, Chlorella protothecoides
atgcccacggtgctgtacgagatcatcgcttatgtaatccccggcctcacccgctccgagcgctccttcctggcccccgtcgtcttcggctcctctgccctcttctacctgggcctcttcttctcctacgaggtcctggcccccgccgccctatccttcttcgtgtcctacgccgacggcgcggtggagtccctctggtccatcgaccagtacttctccttcgtcctcgtgctcatgctcagcacggggctcgccttccaggtgcggcgcgcagtgcgtgaggctccagggcctgatgcgaccctgtccagggtgcggcgcgcggtgcgtgaggctccagggcctgatgcgcccctgtccagggttttttgtggctcgtag

SEQ ID NO: 5910 - DNA, 1782 bp, Chlorella protothecoides
  modified_base (437)..(446): a, c, t, g, unknown or other
  modified_base (956)..(965): a, c, t, g, unknown or other
  modified_base (1210)..(1219): a, c, t, g, unknown or other
gctggtcgcagagcggcgtcaccgcgcgcgcgccgccggcctgcgccgcgccgcgctgcaggccaggctcaccgccgcgcggtcccgcctggcggcgctggagggcggcagggtggtggtcacggagggcacggtctgcgcgcgcagcggcgcccgcatcgggacacgggtgttcaccgtgcgagccgagccgccggagggcgggccggggctgcggcccgtcagcctgaaccacgccgattagaccttgaacacgcaggccgctcagagccgccaaggggtgtgatgcactgtccctggagggatcttatcgaagacggatgtctttgggacgaagcatctctgcttcggcatcaccgcaagcaggctaggtgggagtcaggtggaagggcgcttgtgacatgcagttgcaacatcggggaacccaaacagcacgnnnnnnnnnnagctgggtgggagtcaggtacaagggcgcttttgacatgctgttgcaacatcggggaacccaaacagcacgctttccagccgggaaaatttgagcgcacccagaacacggctggtcacccagccgctggtgacgcataccagggcaaggcccatacgagactagggcacccgcgccccggcagaccgctcagaagccgtagccatggcgtcaaggaagcgcacccttctcaaagtcattattctgggggacagcgggtgagtggcgtggacggtcggcactgcagaggcgcacaattcaatggcgtcagcgactggccggcaccctctcccagtgtcccctccccctccctccctctgctgcgacacagggtgggaaagaccagcctcatgaaccagagggcatccctcaagctacttgaggccccaccctcacctcgtctcactatcaccgcagtacgtcaacaagaagttctccagtcagtacaaggccacgatcggcgcggacttcnnnnnnnnnncagctgcatgaggcctcaccctcatctcgtctcactatcaccgcagtatgtgaacaagaagttctccagccagtacaaggccacgatcggcgcggacttcctcacaaaggaggtgcaagtggatgacagactggtcaccatgcaggtccgtgcatgggagcgccaggggagtggatggggtcatggggtcctccacatggttgtacgagtgcacccggggaggcttcatcatgttccagatgtannnnnnnnnntgtgcatgggagcgccaggggagtgggtggggtcatggggtcctccacgtggttgtatgagtgcaccggggaggcttcatcatgttccagatgtatggaagacgctcccgtgctgtcctccgaggctgtggcgatgtaacagcaccccacgctcggcaccgtcgcatcccctctcccctcttcagatctgggacacggcaggccaggagcgtttccagtccctgggcgtcgctttctaccgcggcgccgactgctgcgtgctggttcacgacgtcacctcctccaagtcctttgacaacctggagaattggagggatgagttcctgatccaggcctcccccgccgacccggagaccttcccctttgtggtgctgggcaacaagatcgacgccgacggcggcaaggcccgccaggtcagcgagaagcgggccaagcagtgggccgccgccaaggggggcatcccctactttgagaccagcgccaaggaggatgtgaatgtggacaccgcctttgccaccatcgcgcggaacgcgctcaagaacgagactgaggaggagatgtga

SEQ ID NO: 5911 - DNA, 510 bp, Chlorella protothecoides
atggcccagcaacccttggccatcagcgacacagcgcatggcgcagagattggttggaggaggggtcaggacctcatcacggcgcttccctatgtagatgccctgactgccgaaagtcgcgccgctgtcgagaggctggtccaggaggaggtgtctcgctcggagcgacaagacccccgcagactacttggcagagctgccccggctcctggcctccaggctagatgtaagctccacacctctggcggcattcacaccagtgcacggctggcaggcatggcgctgaatcatcctccacccttctatgcacccacgcaggagggctccctcgtcgcccaggagctggaaagggtggctcgcggcgagcagatggctgaaatggacaccgtgaggtacaacctggaccccccctcccccagctcacgagagagtgtggatgcctggcaacaggcccttgacaattcccacagccagctggagcatcagtatacgaggtgggtcttggggtga

SEQ ID NO: 5912 - DNA, 678 bp, Chlorella protothecoides
atgttgtcgtcttttccagatgctagcgaccacctcaatgtcaacatttccatctcaaccccaaaagtgcaggtactgttggatactgtcattttctccccgctccacattctgggctactttggcgtcatgaacgtgggcgagcgaggcagctgggccgacttcagcaggaaggtggaggtggacttcgtgcccaccctagccgctgagctggcggtctggcccgccatccaggcggcaaacttcaagttcatccgcgtggactaccagctgctggccgtgaacctgctcacaatatttggtgagccgtgcatgccgtgttgggggcgcatgatgcgaaggagtccaaacccaagggacattcttgtttggagttctgccccagggagacagtgcattcatgtcttggtgtcgagccaccgaggactggatgtccgttctcttcccggggctgaagagtccagcaccagctcgccccgtggtggccggcttggggcagagcagcagcgtcgtggatgggccgcagaaataaagagttcagaagcagcgccatgggtgagtgcacgattggcgggggttcacacagtcgcccttgccagtgtggctcgccctaaggagtttccacgcacctcccttcgcagcctccaaagaaggcaaccagattttcatcactgttag

SEQ ID NO: 5913 - DNA, 1449 bp, Chlorella protothecoides
  modified_base (696)..(705): a, c, t, g, unknown or other
atggcacacacatggtgtgggtccttcgcccgcatcctacgcagctccactcgtgacccactaagaccacaaacccatgcatcggtacatttactcaatcacctcaatgcaagctgtattggacgggaggctgtgtgggcttcgtctccctgcctcagcccgcgccggtttcgggcggtgagccccatcatgatgggcagacggtccgccaaaatcgccctcaaaaaggggaaggccgacggcaacaaggccaagctctacggaaaggtgcttggtgtagagggtatagttggggagccgttgattcacggcagcgcttggtcatgggcttgccatgatgggtgcaacggcgtgcaacgccacgcttggtcatggcttgccatgatgggtgccacggcgtgcaacgccagcaaccccttccccaaacccctcctccctcagcttggcaaactcatcgcccaggcggcacgggccgggggcccagacccagtcaccaacatgcggctgcgggaggtcttgcaccaggccaagctcgcctccctcccaaacgacatcgtcacgcgaaacctggagaaggcaacagacaagtccgccgcgaacttttcggaggtgtgctggactgacgagggaagggtgggtggggatccggccagccgtcgctgttgccatgctgtcaatactgcttcctcatgtatnnnnnnnnnnccgcgaacttttcggaggtgtgctggactggcgagggaagggtgggtagggatccagccagccgtcgctgttgccgtgctgtcaatactgcttcctcatgtatccctcacccacccacctcatgccctctggcaggtggtgtatgagtgctatggtcctggcggcacggggtacgtcatcgagtccctcaccgacaacaccaaccgctccgcttccaccgtccgggcggcggtgaccaaggcgggcggcaagatggcggaccccggctccgtgctcttcgcgtttgcccgccagggagtcatcctcgtggggggccgggaggatgacatcctggaagctgccttggaggccggtgcccaggatgtgctgcctggcgaggaggatggggagttcaagtggtggagggtggctgggtgcaaggcacatgcagccaacgccatgctgctctggggcccccacaatgccatggtgcccggtcctctcaactgtctgttcattgggattgctgtgccgcctgccatcccctgccagccagcccatgcccagctctcgtcttcatgctgcacagatcctcaccgcgcctgcggactttgcagcggtgtgctcccgcctggcggaggcggggatcgaggtggatggcgaggacgcgagcctggcctacctcccatccgcccccgtcgatgtgggcgcagaggcccaggcagcaaacgaggtcctgatggagcgactgctcgccgtggatga

SEQ ID NO: 5914 - DNA, 360 bp, Chlorella protothecoides
atgacccaagcgaactcatcatgcatcatcgctcaccccaccccaccccacacacaggtggataatctgctcgaagtgctggagactcgaggcagtgcggccctggaaacctaccgcgtgccgctgctgtcgtgggaggaggtcaaggcgctcaagggccccggcaccgtcggtctggctctggggtcctctgccgacgctccgcccacgccccccaagctccatggcagggccgccgcccagcccctggccgttgaggcgggggaggggggcgctgccctggcctcagagatgccgggggacgagtggagcccccctgccgtgggcactggcgcccctttctttgaggagctggactga

SEQ ID NO: 5915 - DNA, 336 bp, Chlorella protothecoides
atgtttgacccgtgcaactgccggacctcgagtaccctcacccgccccttttcccccggccaccccgccctcaggatcaagtatgagcagaccatccgcgacctgagggaggctgccgccgcctccttcggcctctccctggacctgctgcagctgttctggaggggcagggagctcacctccgccaccgatgggctcaccctcctggaggccaacctccacaccggcttctccctgcagggctacgacctgagcgaggcaccagactactggccagccgtggtccagaccccggagggactggcctttgagactgtggctgcggctgcatcttga

SEQ ID NO: 5916 - DNA, 393 bp, Chlorella protothecoides
atggcgctgtcaggcctccctgctgcccagcgtccactctgcgaccatgttgccctgcctcggcgccgcaggctcatcaacctggagctgctgctcaagtttggaccggatgcttggcgcgtgcggaacgacaccctcacggtccagtgcgaggctctgaaacggcggctggcggccgtcaagaaggagacggaggacctgaaccgcagcaggaagctgtcccagctggaagccgggcggcagctgtcctccctgcaggccgagtacacgcagctggttgccaagaacgccgagatcgaggcggcgtgcctcacgctggagagccaggccgcggcgttgggtgacaaagtgggtggcgactcggatgcctcgatggtggaggccactgcctga

SEQ ID NO: 5917 - DNA, 303 bp, Chlorella protothecoides
atggacgacgagacggtgcactggatgatggaggagatggcggagaaccggatcaaggccgtagcccaccgcaagcactactaccacccggacctggtggccctggcgcgggacccgcagggcgccggggtcgtggcggccgaggcccggcggcgggccgcctccgccggcaggcaccacgactgcctgggcacgcccgccttcctggccagcatggcggggcacccggagcgtgtttctgcctccaccctctgcatcaccacggtgttcctccaggggtggcagacactgcagcgtcgctga

SEQ ID NO: 5918 - DNA, 687 bp, Chlorella protothecoides
atgaatggtggggtcaagcgtgctgcagtcctgacagcagcactgcctcaagctcgccacagcaatccctccctccatcctcccgcgaaggaagcaggtcaccgcgtcaatcgtgtcctcccttggcgacgccatcacacccaccccaccccacactcacatctcctcctcagtctcgttcttgagcgcgttccgcgcgatggtggcaaaggcggtgtccacattcacatcctccttggcgctggtctcaaagtaggggatgccccccttggcggcggcccactgcttggcccgcttctcgctgacctggcgggccttgccgccgtcggcgtcgatcttgttgcccagcaccacaaaggggaaggtctccgggtcggcgggggaggcctggatcaggaactcatccctccaattctccaggttgtcaaaggacttggaggaggtgacgtcgtgaaccagcacgcagcagtcggcgccgcggtagaaagcgacgcccagggactggaaacgctcctggcctgccgtgtcccagatctgaagaggggagaggggatgcgacggtgccgagcgtggggtgctgttacatcgccacagcctcggaggacagcacgggagcgtcttccatacatctggaacatgatgaagcctccccggtgcactcatacaaccacgtggaggaccccatga

SEQ ID NO: 5919 - DNA, 1146 bp, Chlorella protothecoides
atgctcacccaaatcgttgtcctccaggcccctccacccgcaccagggtacctcagctgctcggccctttgcctgcccccacctgcctgcctcccacaagcccatcctctgcctgggctgcctcagctgctcggccctttgcctgcccccacctgcccgcctcccacaagcccatcctctgcctgggtgcacatcgaggcagcacagcaccaccacaagccacacctccaccgccatcttccctttgcaggccgcaagcagcccgggcgggcggagctgtcgtacctgcgcggcgccgcctacctcgaggccggcgacgccggccaggccctgcgagacgcacgctgtgccatcgtgttcggcccccgcgccggcccggccgccgaggagcggaccccggaggccgacgccggggacgcgggggaggaggggtggggcgcggcgtcgccctggctcaccgccgcgcgttcctccctctggccggcggcgctgggcctgctgggcgccgcctacgaggcgacgggcgacaacgtccgggcactgctgctggcctgcctggccgcggagggggcgggcggccacgagcgcgaggggagcgacgagggggcggggggggcttgccccgaggtgcccgccgtcggcggcagctcggcagggcgggccgtgtgcggcggccctgaggagggccaggacggcgggggcctggaatcagggcagcaagaagaaagcgtgcacgaggcggcacggcgccgcctcctgcgccgcgtccccgaggagtgcgtggccgccgtgcgggcgcgcgggagcgccggcctgctggcgctgctgtccgcggcgcacacgcaggccaagccagaggtgctgcgcaggcgccccaagtactactactactacgagtggatgaagaagcgcatccttgagcaggcaaggccccttgggtggcgtcgtggagagggctcccgtgtttggctgggtgacggaggcagcctcccacaacaaccatggaccctgccccgcccatccccggcgcagtaccccgcactgcctgagccggtcatggacaagctgctgacgttggatgcgaatgagctggacctggtgctgcagtacccccaggccacgcggcagatggtggggtgggggtga

SEQ ID NO: 5920 - DNA, 387 bp, Chlorella protothecoides
atggtgcttgagacgctggaacgtcgtcatggcctccccacagttgcatcccactcctctcagattgagcggctggcgctgacggagcctgtggaggtcgagttcccggagacggccggctggctggcccgccagggctccaacctgctgcggggcctgctgagctcggggctggaggtcagcgaacgcgtgtctgacaaggcggagcgcgcacagcaggccagcaccgccagacctgacaggaaggagctggccgagaagtctgcggaggcgcgggcggagctgcgatactttgacaggaaggcacaggacgcagaatcgagaaagcggcccgtgcccgaatccctgcgccgcgccaaggacaggagcgatcctcgacccaagtga

SEQ ID NO: 5921 - DNA, 1107 bp, Chlorella protothecoides
  modified_base (847)..(956): a, c, t, g, unknown or other
atggttttgtgggaggagggtgatgtgcgtctcaaggggctgcagcgttgcagggaccgtcgcatcgtgcgagggggtttggaggagggtgaggggtcggcaggaggaccgccaagaggggcaggcaggggtacacatgtccaagcttgcggctgcttgacctctgctgccctgccgcccaatggtgaggccaccttgcgagagcagcttcccgatgcaagccgccccaccctcatcccactgcactctgccgcccgccaggcttcaaggggtgacgacaaggcggcgccggcatccccccccacaaccctgctcgccagcgggggcgccgacgggagcctgcgcctgtggtgccccgcgacgggggcctgcctgggtaaaacccccgcggcccacgccgggcgcgtgatctcgctggcgcacgatgcgagtgccggcctgctcgcctcctgctcccaggacggtagcctggcggtctggcgcctggatagcagcgctggcgcgccacgcccggcgctggccctggcggcgcggctgactgtccccggcgctgcaccggcgcccgtccccgtacgcgcctgcttccttcacgacaccgggcagctggccggcagctggtcggacggcgcggtgcgcgtgtggcgcgacctagccgcgccgccgcgcctgaacctgcccggcccgggcccaggcgcgcccgccggcctgactgcctcccccgacggcgctctgctcgccgccgtgggcgaggcgcggtgccgggtgtgggaggccgagtccggcgtgctgcgcgccgatgtcgcgcctgagtctgggcaggccacgctgtgcgcgttcttgtcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgcagaccctggtgacggggcactggaacggggagcggcgggaggggcggctcatggcctgggacgtggcgcgcggcggcgccgggtgggtgggcggcgcgctgacggggcccctggccacgcgcgacgacctggccgccgcgcccgt

SEQ ID NO: 5922 - DNA, 789 bp, Chlorella protothecoides
atgtttcagctactcacgccccaagcaaccccgcaggttcggggtgctgggcgacgtttcggcgctggccagccagctggaggaccgcgagatacggcaggtggtgtacctgctgcacacccggctggaaagcgtgcatgctgccgtggcgcacgtggcccagtgccggcggtgaggggtggaatcaccctgagcaggagcttgctcctgtctcccatgcgcacctgtgatatcgtctacctccacctgactccctctgcctcacctgttttcaacaggctgtgctcctcccccctggagtttgcgtggctggtgatgccgcgggtggtgagcctcgtcccccgcatgctggagcgggcagggctgctggccgacgtcaccctgctccccacgccactctcctggatcccgctggatgaggacctgatctccctggagctaccagacgtcttccgggtgagttttgggagggggccgaccttcctccccaccggctgccactggctgcgccgcacgctcattttccggggtgccctgccactgaggactgtgcatgctgcttcccccgaggccttgccctcaacctcccccaaccccttcccaagccccaggagtggaccgcagacggcgaccccagctccctgcacgagctggcctccgccctttcctccctacagcagcgattcggcgccgtcgcccgcatcaaggccaagggcacggctgcggtggaggtggcggggctgctggggcgcatacggcgggagcagggctccgagggacccgctgtag

SEQ ID NO: 5923 - DNA, 720 bp, Chlorella protothecoides
  modified_base (40)..(49): a, c, t, g, unknown or other
  modified_base (127)..(136): a, c, t, g, unknown or other
atgggttgttgggggtgggaggtagccctgtatttcagannnnnnnnnnggcagaccagttctgggacttgggatctggaatgccctttgccaggcatgtgcgggcccaggagcatgccaccaggcnnnnnnnnnngtgtgtgggacgacaagagtgcaggcggtcaggaggtgggttatttgagatatgtgctgtcaggagcaggccggttctgggacttggagctggaatgccctttgccaggaatgtgcgggcccaggagcatgccaccaggccccctggtgtcaaacttctcctgcagccagtcgtctcatgagaaccctgggaaccagccctgtgcatggcgagagtggagcatcattccgacaccgcccctcacaggccagtctggcatagacggcatgatcctgatggatcggtcggtggatatcgtctcccccgcctgcacccagctcacgtatgagggcctgctggaggagaccatgggcatccgctgtggccaggtcgtccttgaatcggaaggtgggcgaggccgatgtggccggtctggagattgggaagggggacagggcggagacaatgctgttactgctgggctgtctcgcttttacacctccatgccatgctgggccgcgacacagtgtactccccaggaagtgccgggcggcgaagctgcacctctttccaatgcacgaggctggctgcatgccctgagctga

SEQ ID NO: 5924 - DNA, 1446 bp, Chlorella protothecoides
  modified_base (261)..(270): a, c, t, g, unknown or other
atgcgagtggcgctgcagaatgaggacgggacgctgcccggttttatgcgtgtctatgactgcgtcgtcgtggaggccaatgaccgagtcaccttcaccggcatgaccatggagaagctgcagggtaggcagggactgcgcactgttatggctgggcactaccctgttgatcgtgtgttgcgggcctttgcctgcttcaatgccgtgctgtcggccgggtgctcctcacagcaccttgccactcagtgccatttgcgtgannnnnnnnnngtatggctgggcactactctgctgggaggtgcacaagcgtctcttggagcccgatttccacaacatacactatgtccgggaaatgctgtaccagatcacacggttcctcagagcctgccgcctctccctccaatgtcctctccctcctttcccccgcctcccagtccttctctgcactggctgcggcgcagcgcaagctgggcttccaccacgctgacctgggcatgcggaacatcatggagtgttaccctcgctggggcttggggtgcctggccctcttgcgggcatcatcccttcttctcatcatgcttccctgctcgctcattcacaccggcgaccttccacagggtgttcacggatgtagcagaggagcagacggcgaagagcctcgagtcgctgcggcaggcggagagcagcgggagcgaccccgccccgggctcccccaccagctccgcgggcgagcctgcgggcggcacctcggcggcggccaagctcaacgccgcggacgccgacctgccggagcgccactcccaccgcagggtgaagcctgtgcgtggtttcacctgcagcgcctcgggcgagatgctgcccctgggcccccaggtggagttcaagatcatcgactacggcgtggcgatcttcgacgagcggctggcggagtccacgggcggcactgagtacaagggcgtgctccagcgtatcaagcacgtggtggcggccaaggaggtggtgttcccctcgcgggagggcacccaccccgggatcaaccgcacggtgcccctgcagacgagcacgggcgcggtggggcgtgccagccacgcctggcacctgctgcccacgaagctgaagaacaagttccgggtgaagcagacgcctgtgggcgctttccccgtggtgtcggacgagtccttcacggatgcgccggcgggcgtggcgctgggcgccagcaagcgcatcccgcgcctgaacaacgccacgcgccgcctgatgaaggagtctggctttggtgagggggtggtgtggatgggttggttgggggtggggctacccacttggtccaggcaagggagggtgtggcgccttgctccagagggatttgcaaggttcgtggcctggaattgccagggaacacagcgtgcagcatgccatgcctctgctggcatcacttgcaactga

SEQ ID NO: 5925 - DNA, 972 bp, Chlorella protothecoides
atggctgctttcactgccgctcgaccggtgtcagtgacgggcagcaggtccactcagcaatcccaaactagcttattcctgaaaccgagtggattccacacagtagcacagcggaggaacggctcccaaggagtaacagggcccaggctacaagacacaagtcgtgggcgatgcctctgtctcggcgtcagggcggagaccgcgggcggggtgtcgaccgccccaggcagcgcacgggggtcagtcgtggtggtcgacaactacgacagcttcacctacaacctgtgtcaggtggatgaattggatagaccggccggccagtacctgggcgacctggggtgtgactacatcgtcctacccaacgatgcagtcagcgtagagaccctggcggccatgcagccgctgggcgtcctggtgtcccccggcccaggtgccaaagtaggggtattgactggttggctcatgcacaaggccatcctcttcaacctgccctgctcacgacccatccctcagtctcgcccgccctcccaactcacaggccggccagaggacagtggcatcagcctggacacggtggcctcactgggccgagcgggtgtccccgtcttcggcgtctgcatgggccaccagtgcatcggccaggtttttggcggcagcgtggtgcgcgcccccaccggggtcatgcacggcaagacctcgctggtgcaccaccgcggggagggcctgttccggggcctgcccaaccccttccgcgccgcgcgctaccactcgctggtggtggacgccgcctcgctgccgccagagctggaggtcaccgcctggtgtgaggacgggacggtgatggggctgaagcaccgggcactgccgggcgtgcagggcgtccagttccacccggagagcgtcatcaccgacaacggcctgaccatcgtccggaacttcctggactcgctgccggctggtgtcagggcctga

SEQ ID NO: 5926 - DNA, 696 bp, Chlorella protothecoides
atgctggccgggaagctgggccccagagtactctccagcagtcggctgggagcatttagcacactcctctcgccgccaacctcttgcctttgcacgactcttgtgcagggggtgacgctgcagctgacccagggcgtggtgaagaacatcatccccgccatcgcctccaccaatgccatcgtggcggccagctgcgcgctggagaccctgaagctggtcaccctggcatccacggggctggacaactacctcatgtactctggcgtggatggcgtctacacgctgaccacgcagtacgagcgggaccccgcctgcccggtctgcagcgcgggcgtgcccatgaccgcgcccccgacatgcacgctgcgcgatctgctgggcctgctgaccctgcaccccgcgctgggccgcctgctgcgcgagccaagcctcagcgtgggcagcgtgcccctctacgcgcgcggcgtgtttgaggaggagacccggcccaacctggaccgccagctgcgggagctggtgacaggtcccctggtggagctcaccgtgaacgacaagggcctggtagccccgctcaaggtgaatgaaagggaaaggagatgggaaggtgtggtgcgtggatggaggagagcgaggcagacgagctgcttggggggaaaagagggaggggcgggaggtgcctgtgcgttcggggtctaa

SEQ ID NO: 5927 - DNA, 672 bp, Chlorella protothecoides
atgtacaccggcgagggcgcggctgccgtgctgcgcctgctgtgcctctactgcgcggtgcacggcggcatccctcgcaaggcgtacgacggcctgcgtcgcgatttcctcaacacctacggccacgagcacctgctcaccctggcggcactccagcgcgcaggttggggagggtggggacggcgacgctcggcattcccgttggtgcgtgaagccttcgggctgctggcccaggaggacggggccggcgccgacacgaccccggacatccacttcacatacgccgggtacgcgccgctcagcgtgcgcgtcgtgcaggccgcgctgagcgggagcgggtggggcggcgtggaggccgcgctgggcgcgctgcccggcccgaccgccgagctggcgcagggcgtggggcccgaaggccagccgaccacgcgcacagaccggggcccgctgctgggcggcggcggggcggcccccgccggcgtcgacctggggacgggcgcccgccgccccctcgtcctggtggtctacgtcggcggcgtgacggcggccgaggtggcggcacttcgctggctggccgcgcagcggcgcgtcccctgcgacttcctggtggctaccacgggcgtggtgtcggggcggagcctggtgcaggagttcatgccgccggggggctga

SEQ ID NO: 5928 - DNA, 366 bp, Chlorella protothecoides
atgccgtctcttccatccttctccatcgacaggcgaaaacttcaacccaggaacactcctatcggtgatggggatgtagcggagctcaacgacgccatggataagagcttggagcctggggcggtgctgctgcctgcagggatgaccattcgcgagggccaagagttgtgggaaggggtcaagttcgggcgccttctgggggcaggagtccaggcacgagtcttcgagctggtgcgctccgatggcacgccctctgggaaagtgatcaaggtggcccacgccgatcttggacacaagatcctcaacagtccagtcgtctggatcggcggggaacgagaatgggagatcggcattcaggtttgctga

SEQ ID NO: 5929 - DNA, 900 bp, Chlorella protothecoides
  modified_base (786)..(795): a, c, t, g, unknown or other
atgaggtcagactccatcgccggccctcacgtcgcccatccccccccgcccctccaagatctggtccaactgccgggcttacaacctgcccaccgcgcccgtggtgggcgaggcggcggcggccgaggccgcgctcgacgcactgtggcaggaggcggacctgcccaagacactgaatcccgccgcggcgacggaggctggcagcacggatgcccctgctccggccaagcccgggcccgccctgaactggcggaagccggccctcaaggatctggattgccgtcactgccttgcggggaggctgcacggatggcagcacatggcagcgacacgtcagatttccttgatcaccgacccgccacatccagcagtcccccactccctcccacccccggcccgacgcaggtgctgaagaagctgcaggcgctgtccgtcagctaccctttctgggcgccggtgcgcgccgaggacgcccccgactacggcgcggtggtgaaacagcccatggacctgggcaccatctccgacaggctcaagggggaggactacgccacgcccgcccaggtgcgggccgacgtggagttggtgtggcgcaacgcgggggcgtacaatggcaggggccaccccatcaccgtcgccgcggcggcatgctccaccgcgttcaagaaagcatggcgagatgtgggcctgggtcattgtgagaccgcgcagcttgagcataagatctgtcgatgggaagggatcaacgggcaggatggcagcagtaaaagagaagtgcagggcacnnnnnnnnnngagatctgtcgatgggaagtgatcagcgtgcagggtggcagcagtaaaagagaagtgcagggcacaacatgtgtgcataactgtttttacagggaaaactactga

SEQ ID NO: 5930 - DNA, 816 bp, Chlorella protothecoides
  modified_base (496)..(505): a, c, t, g, unknown or other
atggaggcacctgcaccaattgcctctcaacccgccccaaaccagtgcctagacaccggcttcctcacccctgaatccctcataacgacggacatggccgcattgcgagcctgtggtctatcccagaggaaggccgaataccttacgggccttgcccgcctcttctcagatggggtgctcactaatgagggcatccaaggtcaggggggttggtttttccaaggagagtgtggggtcggtgttgggggcatggacgacgcaacgctcactatggagctgacgaaagttcgaggactgggtcagtggtcggtccacatgtttggtgtcgagatggaaatggcagaccgacgtgctcttgcccccgtcgtgctcctgcagctcgacgtgacattattgaccgcggcgcaacccccttgtgcagccatgttccacctgggccaccctgacatcttgccagtgggggacctgggggtgcggaagggcatgcagtggctgnnnnnnnnnnctcaaggtgagtggatgtggagggtgcaggtgtcggagcgggctgcaattttctcaggaatgcgaattccaacacaggactttctcccatcccatccaaggccgcaatacacctcacaggacttgcccgaccctgagacgatggagggggtggcggcggcctggaagccgtatcgtagcgtgggcagccactacatgtggagcgccgccgcctcggcgccgcgctcacccaacaagaagaaagcgcagtctcccgcaaaaaggaaaaaggcagccgctgctggagaacttgatggcgagaagccgacctga

SEQ ID NO: 5931 - DNA, 615 bp, Chlorella protothecoides
atggtcgtggccaacggttttgtgctgggcccaaatgccatcggcttggtgctgggcctgctctacatcttcgcctgtgccggcctggccccgcagcgcaccctggacgcgatgggcgccgtcaccgtcctcttcaccgtcgtgctggtcagcgcgggggcggtggggaccttccgccacctggaccacgcagcgcttcgcttgctctggggctacaccagcaacgccatcctgctctgctactatgccgcgcccatgagcacgctgtaccacgtgctgcgtgagcgctgcgccgacagcctgtccctgcccctctgcgccatgaatgcgctcaacggcgcgctatggctggcctacggcctggccatccacgaccccttcctctgggtgcccaacggggtgggcatgatcatcgccctggtcctcctcgccgccatcctggtgttctggaggaaccggggcgttgccacgcccacactagagcccgacatgtgtgctggggaggatgggggaggggtgtgtctgtttgagaagggggaggggggatatgggtgttttcgaccttgcagcttggcagctcggcaggtatgggcatcctcgcctgcaggcagttga

SEQ ID NO: 5932 - DNA, 822 bp, Chlorella protothecoides
  modified_base (557)..(566): a, c, t, g, unknown or other
atgtgggggtgcatcgcgtttttccactgcccatactctagtctctgtccaatgggaggaaccctttcatactggggacacagttcagcaggattttacacaccacaggacccagacacagagggcatgggttgtcagagggggaaggcgagtcatctagatgtgggcatctgtacgaggtggcgcgccagcgccacagcgacccaaactcaggcaccgatctgcgcggagatgaggtccgcggcctcctggacggtggagatcttctcggcaccctcctcatccagctgcagctcgaacttctcctcaagggccatcatgatctccacggtgtccagggagtcggcgcccaggtcggagaacttggcgtcggcggccacctgcgaggcaaggatggtggtggaggaaggttgctgggttggcggtccacaacatgagatgggtggtggtaaagtttggcagtgttggtgtgccgctctccatgagatgattggagagcggacttacggtagaagtaaagtgtgtgtctgggagatgtttgtaaagaaaacacgcgnnnnnnnnnngggtggtgaagtttggcagtgttggtgcgccgccctccatgagatgtttggagagcgaacttacggtagaaataaagggtgtatctgggagatgtttgtaaagaaaacacgcgagtgggctcatgtgttttggcgaggcgctcggcaacaggcaaacacaggagttaagcccttgcatgatgagacttggaatcacttgcaggccgatttggtaacaaacatagagggcaagcaatcaaacctatctcatctttaa

SEQ ID NO: 5933 - DNA, 954 bp, Chlorella protothecoides
atgtcaccatcaagatcctttctccgggcagcccacctgttgggaaccccccctcttctattcccgtccgtcacccgtcaggccgagggctttgaggctgctgcggccgccgccgcggccctcaccctggaggcggagcgcctgccgctgggcgtgcctggcgaggcggaggacctggcggagcgcggcaagctgtactgcctgtgccgcgcgccgtacgacgagcagcgccccatgctgggctgcgatcactgctccgactggtaccactacgagtgcgtgggcctgcccggcccggcaggcgaggagggcgccggcgccgaggcggtgccggaggacttccgctgcccctcctgcgccctgcgcgcgggggtgacctaccccgccttccacggcctgcccccgcgctccgtggaggccctgcgccttgcagcgcttggcctgggcgggggtcaaggtaagggagacggccaaggtgctgctgcagcggcggagggggatgtagccgccgcctggcaggctgccatggcggctgcgctcgcgggcggtggcgaggcggacgctgcgctgggcccgggcatgcgcgagatgctggccgcctgcccgccggggctggcgggcgccatgttcggcggctgctggccgggcagtgtggccgcggcgggcggcgaggtcgacgcagcggagccggccgccaagcggccgcgctcggactctggggtgcaggcggatctcggcgccctcgggcccagcagcgacgcaggcgggccctcggccacggtggagctgagtgccggcacgcaggaccctgaactggcagatgggtgtgcccagaacgccgagcagggaagcatgagcgccatccctctgcaggaagcggggccggccggcaccaacacccaggatacaaccagcatgcctgtccccgtcccagaagcgcctcgcaagctgtga

SEQ ID NO: 5934 - DNA, 1812 bp, Chlorella protothecoides
atggcccaggtcgttgggctccacatgaaaacgctgctggccacatataccgggcccgcaacacgcacggcatttgccaccgctccgtcatgtccttttagatatctggccttacatagatctggcacaatgaggcgagctagggcgtcggtgcggcccatgtcgagtactggcatcgcggaagtcgatgtgaaggcggcaggcctcgctgcgacgtgtccacgggatgccctgatggcccggttagccagcttggagcggtccttcggcgccccacgtttgagcgttgccaaacgcagcagcggaaaggtgccaagatctgcttccgggcgcgcattgtccacttcccccggctggacgccatccaccaaaccctttggtcgtcgacagccgcagcggctcgcgaggagccgcccatcgcgctcgtccggaggctcccacttcacatccaacctgcagctctccaccccaggcgatggaaaggagcacctcccacgactcagcttggaggaggagcgacaactaggcgaatgcatccaggcagcaaggcatctcctggatggctccttggacggccaagaggatgccagcccgcacggtgcgctgctgcgtgaagcacagctggcagagcaggtcctggtcacacggaatgttcggctgatatacctggtggccaagcgtttgaggcattacagtgtgcacgctgaggtgagcaagggtgtgcggtggggcagagcagcgtgctatgtgtgctacaccccatcatgttatctggcatatgctccgcaatctgctcgcaccaggtgcacgccagtctcctttttgtcaagattgttacgatcttctcccgtgtatctgcaggatttgtatgctgagggcatggtggcgctccacagggctgcccgaggattcgacccagagaagggtcatgcctttgcaacctttgccatccccgtgctgcatcgccacctggaaagggccgcgcagtccttgtctcgctccatctacctgccatctagccgcctgatccagataaaaaagctgcggtcgatgagctgggcgctggagaggcagctgggtcggccccccaccgtggccgaggtggcagaggtcatgcagttgccagagcagagcatcgttgagctccgagctgacgcccaggcggcggcctccctggagcaggcggggcagggcgaggaggactcctgggtcagggaagaggtgcatgcccagggcctggaccccagctcccaggctgtcagggagctgcagggcatctccctgcgcagccagctggcgcacctgccccccgctgagtgtgcggtggtgctggcgcgacacggcatgctcgaggagggtgggcccggcatgacctggcaggagctggggcggtggatgggcgtgtcggccaatcgcacccaccagctccacacagcagccatcgaaaagctgcgcagaaacatgctcgaccctccaacatctttcactgagtactcttgtgatgctgctctcgtcgagaagacagacagacttgatcccgtgtatttattcctccccgcaggcagatgcactgatgtaaacatttcattcccagtgaacacgcgtcagagtgagatggtgataccagcgtcagtgtatgatggctgtctggctggggattggctcatgaaagggagcttaaagtgctgtgcagacatctccatgatcaccctgcacaggctcaggccgcgaataacaagcactgcactctgggcagcgctgaccggcaagactgggacagagcggacgaatccgttgtcaaactggcggtga

SEQ ID NO: 5935 - DNA, 1299 bp, Chlorella protothecoides
atgtcgctgtgtcgtactgcaccgcagcccggcggtgtatgtgtcggagccaggcgctctgcccagaacggctgctccccagcagggccacacagcgcgtcgtacggagcgcccaagcctgtatggagcaatatgtctcgagagatgtgtgtacctagagggtctgcaggccggcaaggtgcctggcatgtacaagcccatgcagccccacaggccggcccacaaggcctagccagtccggtacagagcagctactgtccttctctcaggcggcccagacttgcttcatcatcacaaacccggcactccgcaccacttagcctgctcccacctctgacaccccttcccactcaaacccctattcccccccaaccctcaaggcgtgtgatgctgaagatcagcggggaggcgctgcagggccctgccggctacggcgtggacccggccatcctctccggcatcgcgcgcgatgtggcggcggccgttgcggccggcgtgcaggtggcggtggtcgtcggcggcggcaacttcttccgtggcgtggggcgctggcccgggctggaccgcgccagcgccgactacgtgggcatgctggccacggtgatgaacgcggtgtgcctgcagagcgcgctggaggcggagggcgtgcccacccgcgtgcagacggccatcgagatgcgggagattgcagagccctacatccggcgtcgggcaatgcgccacctggagcgtggccgcgtggtcatcttcggtgcgggaacggggaaccccttcttcaccaccgacaccgcggctgcgctgcgcgccgcggagatcggcgcgggcgcgttccttaaagccacgaaagtggacggcgtgtacgaccgcgatccggcgcaccacgcgggcgccacgttgcaccgcagcctcaccttccaggaggtgctgcatgcctcgctggcggtgatggatggcacggccatcacgttgtgcaaggagaacgacatcccaggtagggtgggaaggggtgagggtagagaggctccaagtccgtgtttcccgtcgattctcccccccacccctctcccaactccaccaccgttcccctgctgcagtggtggtcttcaacctaaccacaccggggacgatgctccaagccctgctgggggactggagcgtgggcacggtcatctcgagcagcaggcaggagcaggcccagccggcacccaccgcatgaggggcgggacacagtgcgcagcgggggaactagggcacggggttgccaaagtcttggcaccagctcatcaagatttcccgtga

SEQ ID NO: 5936 - DNA, 561 bp, Chlorella protothecoides
atggggcaattgtctgacaggggggtggggtcccccctcccccctgcccctgtcttccaccccagtcctgaggagtggacggacccggcagcctacatcgcctctgttgtccgccctttgacggaggggctggtgggcctggccaagatccggcctccggcgtgctggccacgggctccgcccatcgaccctgccagccttcaactgtgctcccagctgcaggctgtggcccgcctccagcacaagaccactgaaggtgttgcccggatttggagggacagctacgccgacttctgtttggccaggggccagaggccagggcgcaaccctgtggtggcggggcacgaggtggacctccatgacctcttcacgcgagtgactgctgccggcggttggaactctgtggagcaagactgccgctggggcgagatagcagcttgtttagaggtgcgggagggggtgagggatgccccgacggacgccatcgtcggggcgcacacctgcccgccacgacctctcgaccctcccgatgaccccatggtggcattcctgataccatag

SEQ ID NO: 5937 - DNA, 282 bp, Chlorella protothecoides
atggcctcgcccgtggtggtggacttgggcagccacgccatcaaggccgggcggtctgtggggtaccccagcgacaccgagcccagcgtggtacgagggcatccatgcatgagatgggtcctgccctgcacggtccaggacgcacgtgtgacggtcgttgaaaagctggtgcaccccatgcacgctggggtggtgactgactgggagggcctggagaccctgctccattacaccctgtttgaggaggtgagtggggcggaggagcagccccgcagggggtag

SEQ ID NO: 5938 - DNA, 384 bp, Chlorella protothecoides
atgcccgcgcccgacgatagcgccccgcccatcctgtctcctccaatcgccgctcatcgctgcctccaccctgggaatccaaaccaatccatcccctccccacacccaaagggcgtgctgggctcgctgttcgtggccggcggcgcggcgggtgtggcgggactaggagcggcgctggcgcgcgaggtgcacgccgcgctccccgccgcgcaggcggtggccgcgctggagccgccggaccacatgccgcgtggcgcggcgcgcagcgcggcctgggccggcggcgccgtgctggccaaggtagtggccgcgcaggagcagtgggtcacgcgcggagagtacgacgaggcgggccccggcgccgtgcacatgcgctgcctctga

SEQ ID NO: 5939 - DNA, 1335 bp, Chlorella protothecoides
atgcgtctgtgggccatcgttacaaaacacgcacgtacccccccccaaaaaaacaaaatccatcagtgggcggaggaccccgcactgcccgccggcgcctgcccctggctggcgcgggagctgcgccgctgcattgacgacgatctggccacgcggttggcggtgtgggcggcaggcacgaccgactcgcgccgcgcggagggcgaggcggcccgctgcgcgctgtgcggcgcgcactgcacgctgagcgcgctggagtgcccgcgctgcgcacccggacgccaggtctgcgccgcgcacgtcgccgcgctgtgcgagtgcgagccggcgcggctgcggctggccttccgccacacgacgcgcgagctggagggggtggtggggcgcgtcgccggacgcgcagcgggcgaggcggggttcgcgggcgccgacgcggcacagagcggcgaggacactgccgcgcaggaggagggcgagggggaggaggacgacctggtcggcctggcgggtttcatgaccgagctggccggggcagcgggcggcggacgggagggggggtgcccagaccctgcatctgcgtcgactgccagtacccctgctcccccgcccacgatacccacgccctcgctggcgccccccggcgcggccgcggcgctgcaggagcgcctcgcccggctgggcgaggcgcacgcgctttggcgcgagcgctgcgaggcgacgctggcccggggaggacggctggccgctgatctggatgagctgctggaggaggggaagcagtacgcctggggcgcagtggacgacgaggacggcgtggaggccacgttcgtgcacctccgagaagcggcggcgtacctggccagggtcgaggccgcgctggcctcccgcccggcggcggaggagctggagggcatcctggggctggacccgccacccctggccgccgcgcctggcctggagcggctgcaggagctgggggagcgggcgcgagagtggcgtgcgcgcgcgcaggttgggggtggggtggagggccgggcggtgaggtgcgcggtgctgtcgtcgcttcgcgaaagcaaaagtgtgcattggcgctggggtcatgagccagtaatccccgctgcccatgtcgtttcgtgctcaccccaacctctcatccctcgggcggccatggctgctcgcggcagcatggagatgaaggacatggaggcgctcatctccgatggcgccgccatttcaggttgggaaaggtggatggcggggtgggagggctgggcaggcccggcttggagcgctgcagcaatgccggctacctgcaacgcactgcacgagggttaa

SEQ ID NO: 5940 - DNA, 372 bp, Chlorella protothecoides
atgtgcgactcgtgtggggagtggttccacatgcgctgcgtcggcatctcccagacccaggccaaggtgaccaagaagtacacctgccccgtctgcgccgccgtgcgggtgagtgagggggcctctggtctggaaaagtcgccctgtgtggagcgcggctgcatgtttgcaggtcgtgctacaagatccagcgccagcaataatggctggggcacatgggaagttgtttctttacatcatgagctcctgaggcgcatcaccctgcagtacaacggcgagcccctgcaagccgccctggccaagctgaagaagacgcggcggccgacccgagccgggctgggcgcttttcttgaacaggcaagtggtggctga

SEQ ID NO: 5941 - DNA, 501 bp, Chlorella protothecoides
atgcccgaggtgcgcctgctgcgggagcgcctggctgctgcccggaagctgggcgagtccatccgcaccgctctgccggggctggcgggcggcccccgccgccgcaagggcgaggcagagacgacgctggaggggctgcaggcgctgcgcgccgccgcggtgaccttgcgctgtgacgtccccttctaccccgtgctctgcttcgccctggaccggctggaggcgtgggcggggcgggtgaagcagctgctgggcatgcgggcgccgctggcggacctgcgagcactgattgaggagagcagggagctcccggccgccatgcccgaggtggagaccgtcgagtcgctcatcgccaagggcctggcctggcagtcgagcatgcgtgccctggtggccgcgcgcgcgcccctgaagaggatgcgggacgccctgcacgccgggctgcgcctcccggtggagctgccggaggtggaggagctgcgcggcatcatccgcaggtga

SEQ ID NO: 5942 - DNA, 543 bp, Chlorella protothecoides
atgggaatcgcagatgatgctcatgctggtcacggagggcattccgggcgtggctgggtcgggagtcaccacggccttgacgatggctcggatgcagaggacgcgcatggcgtagagaacgacggtggcggtgagatcgatgccacagcagcagcagaggtactgggtgccctgcttggaaccacgccggcgagtggagcgaaggctgtcggcaccaagaagcttatcagcgcggggggcgaggctgtgccatcgaccctcatccccgctcgaggttcacaggaggcggtggaggagccctcgcctagtccatcgctctcggctgacacatcgggagggaaggtcccgcagaacatcttcaccatggtttgtgaggcttgcagagggggccatgcggaggatcgcattatcctctgcgaccgatgcgacaagggctggcatctgcagtgcctcgagcccccactctccagtgtcccggtgggtgactggatatgccccagttgcatcctcgaaggtgacgttgggtttttgagaataacttaa

SEQ ID NO: 5943 - DNA, 603 bp, Chlorella protothecoides
  modified_base (265)..(274): a, c, t, g, unknown or other
  modified_base (536)..(545): a, c, t, g, unknown or other
atgccctgcagggcctggggctggaccgggaggaggtggccatgcaccgcctgtggggagggggagccatcggcagcaggtgcagtgctcgtctgtggggcctcgatctgccgcacagcgtcccatgcagcttgtaccggctgccggcagggagaccttctcttgtccctctgtccatgcctcaccacaccctatgccccaccacatcttccccccaatacacactctctccctcaccgcaggccggaaaccacatggaggcgcnnnnnnnnnntcacccgcatcctccccccaatacacactctctcccccaccgcaggccggaaaccacatggaggcgctgcgccttctgtgcgtccggctgcgcgatgtgcccgccgcggcggcctacgcgcggcgccacctcccgcgcgaccttcaccccgacctgctgggcgtggtcctggccggcggcgcgcccacgcgccaccgcgacgcggcgcgcctcgtggccgcgctgggcctagacccgctgggcctggtggccgcgctgccgnnnnnnnnnngctgtgcgtccggctgcgcgatgtgcccggcgcggcggcctacgcgcggcgccacctc

SEQ ID NO: 5944 - DNA, 633 bp, Chlorella protothecoides
atgcgcgcatgcctccccacttcacatgcccgcccatccactcccgcccaccccaacacacctggccagacaccacgcccgacgacgtgcccatctgcgaggcgtacctcgccttcctcgagtccggcggcgaccagggtgagctggtgtggcgagggtggcatggagtttaccatacgaatctcaggacggtgcagggctggcgacgttcctggcacgcgcccctggcgccagcagcatgtcaacacccgtcacatgacggagcgatcaggttctgacatgacacccaccctcccactgtcaaaccaccctccaggcacctactggcgcgtgctggcggacgccggggtcacgcgccagcgcctggagtcctttgatcgccccatcaccgtcgacccgcagttcttcggcgaccggcgcgacgcgctgctggccgacttccgcgcctatctcaaggtcctcaaggcggtgcactccggtgcggacttgcaggccagcgccagcgcggccgcgcgcatcgtgcccgccgcggccaaggcgccgctgggctacgcgctggcgcacgccggcaccggaggctcggccctggccttggtggaggcggcggtggaggcgcgcaccgagctgggggcg

SEQ ID NO: 5945 - DNA, 585 bp, Chlorella protothecoides
gctcagcatggacggcgaagagctgccgctgcagcgcgcgcgcgtgcccgtccccgtcgacgccgaccttgcggcgctggccttcgtcctgcgctcccgcgatggcagccgctggtggcgcgacggcggcggcgacttccgcgtgcccctgcccacgggagacggcggcggcgcgggagagggcgccccggacgccgcctcggggaatccgctgttgcaggactcggtggcccgcgccatagtggaggcggaggccacgcccgcctggaccctgatgcaccgcttcaaccgcgcctcagacctgctggagcaggtcgcggccggcggggtcgaggacgtggaggggagcctggcccgcatctacgtctggctgcgctactcctccatccgccagctgacctggcagcgcaactacaatacccagccccgcatcctcggcgccgcgcaggagaggctgacccacaccatcgccaaggtgatggagaggggtggagtgttttgtgtgcaagtgggagaaagggggaggggctggtgtggggttggggttcgcagccggtgagagggtcaagagggtctgcagtgtga

SEQ ID NO: 5946 - DNA, 1524 bp, Chlorella protothecoides
  modified_base (548)..(557): a, c, t, g, unknown or other
  modified_base (1048)..(1057): a, c, t, g, unknown or other
  modified_base (1166)..(1175): a, c, t, g, unknown or other
gacgcccgacgccaccccgcccccgacgcccgccaaggcggcacgggcggggtgggggctgggcgccgcgctggcgcgggtggcggcctcgctgcgcgcgctgtactcgcccgagttccggcgcaccacgctgctgctggacggcatctggttcaccaacgccatcacgtgagggaaaggggtgtgggatggggaatgcatgggagtgggatcgcgcgggaggaacgtggctggaggacggggcgcaggaagtcgtgcgcgcaaatccaggacagcagcagctgtgggtcatctacaccgcgactccctcacgccagacggccccccgcgccacattgtctcacacataacaggtactatgggctggtgctgctcagcacggagctgcagacggcacacaaggaggagcagtgcacgccagatgggcagcccaacctcgtgggccgcgactttttggtgggcgcaagtgcaggaatgaggggggttcatcgcaccggccaccccgccgggactcgagcccgcagtgatcgctgcccagggttgctgannnnnnnnnngtcatcgcaccggccaccccgccgggactggaggtcgagtgccatcacgggcttgctgagctggctgccttcccatccccaccccactccctccccgcctgcagaacatcgtgatcaccagcgctgcagaggccccgggcctgctggccatcgccttcctggtggatggccgaggcaggaagtggagcctgcgggccggcctcctgctcaccggcctgtccatcctcctcctgctggcggcggggccggggggtggggcccagctcttcatgctcttcctgtcacgggcggggatcatgggggcctactcagtgctgtacatctacaccccggagatctacccgacaaaggtgggcagcgtgtctggtggcgagtgtggggtccggatggacccgtggtccgcgagcaccactggggagtcgagagacccccagtgatgccttcccaagtattcatgcctttcccagtaccatcgcccctccccacctccnnnnnnnnnnaagagacccccagtgatgccttcccaagtgttcatgcaattcccagccgtgcgcctccccggaccggagcccgaggacgaggccctggatggcacgccggtcggcgccnnnnnnnnnncaaagaaaaaaccttccccacccaacagctgcgatcctttgggctggccctctgcaacgccatgagccgggtgggcggctttgcggcgccctacgccaccgtgtccctggtggagtcggggcgccagaccgccgcgctgtgcctgctggggggcatgtgcctcctggcctgcgccgccgccttcttcctggagcacgagacgcgggggcgcgacctgcaggccgtgcgcctctccggaccggaggccgaggatgaggccctggatggcacgccggtcggcgccagcccggcgatgtcggccgagctggtgcacacgccccgcccgccctccggggcccaggcctcgtga

SEQ ID NO: 5947 - DNA, 1197 bp, Chlorella protothecoides
  modified_base (531)..(540): a, c, t, g, unknown or other
  modified_base (809)..(818): a, c, t, g, unknown or other
atgggtcaatcggagaggcagggatcgcctggggggtcccgacgccggtcctcggtgggtgtaccctcgcgcctgggccctgcagctcaggccaggcgtacccagggccttccgatcaaaggatggaaacgtcatggtaatgtgggaatagagttgcaggctctccttccaccagatcgcacccatgcagatatggacctccagcccatcccacccccttcccaggctcgatcatcgctgccgtgctcgccattgggctggccctgggacaccgattcctctggcatgaaagaccagtctcgaaatggtagtcctgggatattgcagtcggtgagcgccctcttcatctcgtccctgcagggcccaacctggtgccctttccgagccccaagctgctggatctgcaacagttcaagggtagccacgcagaaaagtacctctggggaacctaccgtccagggtattacctcggtgaggatggcgagggggtgtagctggttgggtgctctgcatgaggccccgccacccaannnnnnnnnngttcaatgtgctggcattgactatcgctctcttcacctgcaatccttctgtttgagcctaaagcatacatcctcaccccctctcgccaaccacacaggcatgaggccccgccacccaacgagcttggttaccggactgatgtgggtcgacttcacgaggtccgactggttcacctccattcgccacgaagccctgcagtcagatggtgggtgggttttggggagggagccgcccagccgtgcgagaagaatgtgtagactgagacatgnnnnnnnnnntgaagccctgcagtcggatgctttcatcaggcttacggctgctcctgcgcttcggcacccaccgcacctcgctggcagggccatactccaccctagtaccgacctgggcttctatggctggcttgaacacgatggggaaaactatggcatccagcagctggaggaccggcgtttcaacatgaccacctccttggtatgctggactcgggtggtcggtgtagctgcggaatcaagtgatagcgacgacccatcaacggggggcgacgcgagtggtgcatactctgtaggcagctccgtcatcctctggtctatggctagctttcacggcaaacgaggagcctatcacgcccctcaaggctcgccagcgactgctctgtag

SEQ ID NO: 5948 - DNA, 480 bp, Chlorella protothecoides
atgcatggacgagtccgaatgtacagccaccactgcccctgctgccagggccatgcatgccaggaccctcacctggtgtttggtgttcgaaggcacaggcctctgcaccccaccgccactgccaacaaccgtgtccctgtttccccccctccaccaccctgcagggcggcaatgctggagaggctcaactccggcaccacgctgatagtggaccggtatgctcactccggcgtcgccttcacggccgccaaggggctgccggggctggacacggcctggtgccgggcacccgacgtgggcctccccgcccccgacaccgtcttcttcctggacctgagcccggagcaggcagccgagaggggggggtatggccaggagcggtacgagaccacagatttgcagaagaaggtgcacactgtggaagaggagtggggcggcccggggtcaaggggaggggtgggggcatgtacattgcaatga

SEQ ID NO: 5949 - DNA, 1752 bp, Chlorella protothecoides
  modified_base (949)..(958): a, c, t, g, unknown or other
  modified_base (1100)..(1109): a, c, t, g, unknown or other
  modified_base (1310)..(1319): a, c, t, g, unknown or other
atggagccatgcagggaccgacgcggcatcgtgtcccatccctgcaatctcactttgatgcaagctgtcacgctcatccccggctgtcgcgctgtgcctgagccgtgcctcagccagcgccgacaggcgggacccctggcattcacggctgggccatcacctgtcgaacgacgtcatcgcctggtctgtaagtctgcagccatttcacactctgcggcccccccaaacctgccctcacgcccaggtaactaccaatggcaagtcccaagccctggaactgagcgacctgaccgccattgggcccctggacgggcgctacggcagcaaggtcctccccctgcgtgccatcttctccgagtatggcctcatccgcttcagggtgctcgtggagtgccagtggctgaaaaccctcagcaggctggagggtgttcccgaggtcccgccccgccgagtcatggccggttctgcctgccgtttgactctcacggggctggcttgccatccccccagactcttcctgtatctcctccctgtcttcatccaattccatgcaaccccgctcacgccccctccccaccccccaggtttagcagcgaggccgaggcgctgctggacgagctgtcctccaacttcagcgtggaggatgccgcggaggtcaaggaggtggagcgcaccaccaaccacgacgtcaaggcggtggagtatgtcatcaagcggaggctggggaggaacgcggagcttgccaaggtgctggagttcacccactttgcgtgcaccagcgaggacatcaacaatctggcgcacgccctcatgttcaaggaggcgctcgccggcgagctgagcgcattttgttgtcattggagatgtcctggtggcgcgacaccgcctgggcctgccttaggaccttggctcctctcaagcatctcctggtctgcactccagttgaccnnnnnnnnnnagcgattgcagggtgggcagtttaaggctgtagaggctggcatggccgtggtggatgggatgcatgacgacctcgcggggactcaccaaacactgcgctatgatgcctcagggcagctttgctgccctaaacttaaatatannnnnnnnnncgcgattgcagggtgggctgtttcagactgtagaggctggcatggtcgtgctggatggtgtgcatgtgttttagatgcttcggtgcatggcatgctttggggtgcccatcgccttgcaggtcgggcctcgcgggactctcctatccaaactctgcgctgtgatgcctcacggcagctttgctgccctaaacttaaatatannnnnnnnnncgttgtcattggacatgtcccggtggcgaggcaccgccttaggaccttggcacctctcgagcatctcctggtctgcactccagttgacctgtaccctcccatcccactcccgcactttccttcaggctggccaccgagcacgctggtgtgcccatgctggcgcggacccatggtcaaacggcatcgcccaccaccatgggcaaggagatggcggtgtttgcctaccgcctggcgcgccagcggcaccaggtgggaggaggtgctggtgctgaactccgcggtctcgcatggggccgcacaggagcatgttgcctgggttcggattaagaaaggggggctccatgtcatggatatgtctggaccggcctttgtggcatgcccatggatatcccaggggggcacgaatgagtggctgagtggctcttcggggtga

SEQ ID NO: 5950 - DNA, 711 bp, Chlorella protothecoides
  modified_base (549)..(558): a, c, t, g, unknown or other
atgtttacttccccagacacaagaagaccctcaagcgccgccctttctgcttcgtcacgtttgcaaccatcgaggtacgaggtgtctgtacgttcactcattttcctcggcatatgcgcattttgggaggcccaggatcctggggagtgggctgggactggtgggctgccgctcataatcctccgccgcctcccccaccccgccgaacacttccaccccaccgaacacccctggagtgcctggcatgggagccggcactgggtcatggttgcaggtcattttcctgcggctttcagcccatcaaccgcccctcctccactttctgctgagcagggcctcagggctgccctgaccgggtcccccctgaacatctgcgggcaccccataaaatcgctgacggccgtggaggatcgcaatgcctactaccgtgagaagcacgccagcgcgccttgctgccagctcgagcgtgggggcggggcccctcccatgtcccgccagccccactacggcgtctcagacaggctgtttggcagtgcacacgtttccgcnnnnnnnnnntgggggcggggcccctcccatgtcccgccacccccactacggcgtctcagacgggctgtttggcagtgcacacgctcccgtgccggcggggaacctgctggagatacagcagctggctcaactgctcgcaatgacgtcgaccatggtgcgtga

SEQ ID NO: 5951 - DNA, 606 bp, Chlorella protothecoides
atgaccgtggcggccccctcggctgtgccctctggctccatatggatattcggctttggcagcctcgtccacagccccggcttcgaattcaagggcagggtggaggggttcatccgggggtaccgtagggtgttctggcagggctccacagaccacaggggccatcctggagccccaggccgcgtggcaaccctgcatgaggacccagaagccgtcacctcatctccaccccgctccccctgcactgcacagtggggcgtggcctacgagctggcgggcagccacgaggagcaggagcgcaccctgcactacctggagtggcgggagaagcagtacgacatccggcgccacgtatccgtctgggccgcccccggggacgcccgaccggcggtggaggacgcgctggtgtacatcgcgggccccgacccggggtcaaaccccgactacctgggcccggcgccgctggccacgctggcgcacaccgtggccactgcggaaggcccctccggccccaaccacgtgtacctcttccgcctggccaacgggctgcgcatggtggggtttgaaggaggggcgggaacttcccttgtgggctgcagggggtag

SEQ ID NO: 5952 - DNA, 270 bp, Chlorella protothecoides
atgacgctgtcggcgcgcaccatggtgcagatcggcacggctctggggctgggccgcggcggcgccctcgcttccttgcaggcggacgcggccaggctgtctgacttcggggagctgaccgccctgcactacgacgccgcggccggccggtttgcggactggggcctgcactctgaagatgtggccctggcgctcgatccggcgagtgggaagctggtgcggcagacggcctccccgccccgcctgcagtgggtgccccaccacgggtga

SEQ ID NO: 5953 - DNA, 303 bp, Chlorella protothecoides
atgacacgcagtccggctcgaggggcactgatcgtgttcgagggcgtcgatcgcgccgggaaatccactcagtgcgagcttctctcacagcacctaggacacctaggggcgtgcaggcccgtccccgatgacctccaacactgccaacctccccacccgcagtacaatgtggagctgtggaggttccctgatcgtagcactgccatcggcagcatgatcaactcgtacctgacaaaacagtcagaggctgatgatgccgccatgcacctcctcttctccgccaatcgatgggagaaacggtga

SEQ ID NO: 5954 - DNA, 783 bp, Chlorella protothecoides
atggtcttccctcccgcctggttgccgcctgagttttggatccctatctcgaccacccttccaaatgccgctccgcaggggggcaaggaggcggcccactccaacgccatcctccacaggctgatcagcgaggtgttggacgccagggcccccagcgtgggctccggcctcgtctccctggtcacctcccgcgacgacattgatgccctgctgaagttggatgacgtgattgatctcgtcatcccccgcggcgggaacgccctggtgaggctcaagcttgagatttggtgggggctgggatgggaggggcaagccagtggcctttcgtggcccttgcttggggcccggggacaaggggagcgcgtccccggcggggggagagtgtcccacatccagcgctccacccgcatcccagtgctgggccatgctgacggcatctgccacgtgtacgtcgacgccgaggccgacccggccaaggcgctggccatcgccgtggactccaaggccgactaccccgccgcctgcaatgcggccgagaccatcctggtgcatgcatcgctggccgacggcctggcgcgggagctgctggaggcgctgaagggcgctggcgtggccgtgcacgccgggccgcgggccgccgagcggtacgggctggaaagggcggcgtcgctgcgccacgaatactcctcgctggacgtcgggtttgagctggtggacgacctggccgccgcgatcgaccacattcacgcccacggcagctcccacaccgagagttggggttga

SEQ ID NO: 5955 - DNA, 267 bp, Chlorella protothecoides
atgaccctcccaaccgcaccgccctttcgcccccacctcgtctcgcaggcgctgcgattctacgcgcggactcccggtccctactcacagcacgccggcacagctgccgcgcagctgcgtgccgccgtgttggacgccggcgtgggccagttccgggagacgggcttcttctgggagcagtacaacgacaccagctcggcgggacggggtgcccaccccttcaccggctggacggcgctgctcaccctcatcgccgccgaggcgtga

SEQ ID NO: 5956 - DNA, 552 bp, Chlorella protothecoides
atgatcctgaacctccgcaggacgggccacctggacgtggaaaaggcgctggcgctgggcgtggcccgcggcccaggcttcggcgagctcaaggcggggcgtgcggtgcgcacggcggctggcacgacggtcacacctgaccaggtgctgggcgccagcctgagagggcgcagggtcttgatcctggacgacgctgcgctcgaaggccccggccgtggcctgctcccggtgctgcgtgggagcgcgggggaggaggaccccccggagccctgcgacgtgatggtggccagcctccgggggctgggcgcggggggccgggcgctgcaggacgccgcgcgggccgtggcggccacggcgcggctggcgcgcgcggaggaggtcatcgtgtggccgcgcgacgccggcaccacggccgccctggtcggcggggagggcgggcgcgccgtcctcaggttagccgccggtgtgcccagggccgcccgcgtgcactgcgatttgtggcgaagatgcctcctttcacctgcatgcgcggcattcctgcagtctgcctga

SEQ ID NO: 5957 - DNA, 894 bp, Chlorella protothecoides
atgctctgcttgcccacggtgttcccgcgccttctcatacggctccggcacgccgtggcgccgcatcacggtctggatgggctccgccagcacctcccaggcggcgtccaggtcggccgccagcttggcagcgtccagctgcagcttgccgatgccgcgcagggcagaggagtaggccagcagcgagtggcccacgccgacccccaggttgcgcagcgccgtggagtctgtgagggggtgcgcgcgggacttcgcgcggtggatttgtcggtggtggcagcggggggtccggagctgtgcggggaggggaatttgcagacaccaggagcgcctggcggcaccggcaatcgagccgggaccgccgactcgagcagggcagggcaccccacgagtgctcggcttggtttactgcagccacgatcctgccgtccctgctttcacacggctggtcatcccctcagcaagcaccccccccatgttccccatccaacgacactccacccacccaccagtcaggtcgcgctgccagcggctgaccggcagcttagcggcgagatgcgccagggtggcgttggcgatgcccaggttgccctcgctgttctcaaagtcgatggggttgaccttgtggggcatggtagaggatcccacctcccccgctatcgtgcgctgccgaaagtagcccagggagatgtagccccacacgtcgcggtcaaagtccagcaagatggtgttgaagcgcgccatggcgtcaaagacctctggttgggtgggggggggcggggggggccgaatagacagacatggaggggttgcagacaggacggcaggagtttgggactggtaggaacccaggcggggtgcaagcagccaccatccggcatgcagcgcccgtga

SEQ ID NO: 5958 - DNA, 594 bp, Chlorella protothecoides
atggcatccaacggcgcagcgaacgcacgggtgagcttgggccctgcgcacgtgctctgcccatatccccgctggaagactgctggcagcggtgacacccctccccctcccccaaaatttccgcaggaggctgcaataaaggctaggtcggcctccaggcagctccaggccctgaagtcggaggaccgggtggccttgctggacgccattgccgacaccctggtggcgcacacggacgacatcctcgcggccaatgcccaggacgtcgagtccgccaccggaaagattaccgactccctgctgcagcgcctcatcctgaagcccgcgaagatctcgcagctggcagcactcacaacgtgcatattcaacacccctccagacggcattcgatccatcgggcgccaggacgagccgttgggccgcgtcatcagcgccacccagatcgccgaggacctggagctgcgcaagatctcggtccccatcggcgtcctgctcatcatatttgaggcccgccctgacgcacttccccagatcgtgtccctggccatccggtccggcaatggcctcctcctcaaggcgagtggaggcgaatga

SEQ ID NO: 5959 - DNA, 678 bp, Chlorella protothecoides
atggaaccaaggcaaggagccactcccctcccctccctccaccaggcactcgacaaggggcgcgagctgtacgagaagaacgacaggatgggcgcgctgcgcgcctgggaggccggcatggcgtccaagggtgcttcctctgaggagaggggggtgatggcctacaatgcggcatgcgtgcacgcctacttcggcgacgtggagccggcgcaggtggcgatgcgaggtgcgcatgctgtttggggcaatgtctggaggtggtggggtgcggggaggagtcggcccccgcctgcctggtccatgcacgccgctgcttgcgtgccccagcagccctttgcgcaggtgatgccagtgcacatccacaaactccccgttcctccaattcccagaggcggtgggccaaggcctggacctgctggcggcgctggagtccggggacaaaaggctggtgcagctccaggcctcgccccaggtgcagcgccagttggagaagttcatcctggcgaccctggagggccagaagaagaaggcggcggccacctcgccacccaagtttgggagcgcgagcggggaggcgggcgggaaatcgggcgggagctggtgaggcaggggtccgtgcctgcaggcgctgccctccgtgctgggtacagcgtatgcatggacaggtgccctgactga

SEQ ID NO: 5960 - DNA, 2892 bp, Chlorella protothecoides
  modified_base (966)..(1035): a, c, t, g, unknown or other
  modified_base (1456)..(1528): a, c, t, g, unknown or other
  modified_base (2044)..(2126): a, c, t, g, unknown or other
  modified_base (2253)..(2385): a, c, t, g, unknown or other
ggggtcggcggccgacggcgcgcgcgaggcggagcgctggcgccgcgctttcctgcgcgccgccgcgctcaccgcgcccgtcttcgccgtggccatggtcctgccccacctggcctgcatggcctggctgtatcaaactcaactggcgggcttccccgcggaccaggtgctcaagtgggcgctggccacgccggtgcagtttggctgcggcgcgcggttccacgtgggagccctgcgcgcactggcgcgtcgcgccgccaacatggacgtgctggtgtcgctgggcaccaacgcggcctacttctactccctgctctccatcctgcaccaccacgccgcctcccaccaccagaccctggcctacaagcccaccgactttttcgagaccgccgccatgctcatcaccctggtgctctttggcaagtacctggaggcgggggccaaggcgcagacgggcgcggccctggccgcgctgtgcgcgctggcccccgccactgccatcctgatcgaggggggcggcgacgagggcgagcagcatgcagacggggggccggcgacgagggcgaggagcatgcagacgggtgggtcgcccccgacggcccgggcacgcgccccgagcccgccgacgccgacccctccccctccacgacggagcgtgagatagactgcgccctggtgcacgtcggcgacctgctcaaggtgctgcccggcgcccgcgtgcccgccgacggcgtggtggcgagcggggccgggcacgtggacgagagcctgctgacgggcgaggcggcgcccgtggccaaatcccccggcgacgccgtggtgggcggcagcctgaacctgcgcggaacgctgcgcgtgcgcgcgacgcgcgtgggcgccgactccgcgctctcccagatcgtgcgcctggtggagggtgcgcagctggccaaggcgcccatccaggccctggccgaccgcgtgtcnnnnnnnnnnnnnnnnnnnnnnnnnnnnnnnnnnnnnnnnnnnnnnnnnnnnnnnnnnnnnnnnnnnnnngcctcgatcacgttcggcgtctggtatgcggccgggcgcggcggctggtacccggccgcctggctgccggaggggcacacgcccctgctcttcgccctccttttcggcatcgccgtcctggtcatcgcctgcccctgcgcgctgggactggccacgcccaccgcggtcatggtcggcacgggcgtcggcgcggcgcacgggatcctgatcaaggggggcgacgcgctggagcgcgccgcgggcgtcacccacgtcgcctttgacaagacggggacgctgaccgcggggcggccacgcgccgtggacgtcgccgtcttcgcgtcgggcgtggccgcctcggacgccgccctgctggccgccgcgctggagcaggagagcgagcacccgctggcgggcgcggtgctggcgctggccgccggcnnnnnnnnnnnnnnnnnnnnnnnnnnnnnnnnnnnnnnnnnnnnnnnnnnnnnnnnnnnnnnnnnnnnnnnnntggccgcggagaagggcggcgggggagcgggggcggaggatcgcgacggggcgaagccaatcgcgctggcctgccccgcgccgcccgccgccgccgccgccgccggtgcgggcctgccccaccagcgcatgcagggcctggcggggcgcgtgcccgtcgtgcacgattttcgtgctttccctggcgagggcgtcagcggccgcgtgccgctgtaccgggacgctggtggtgcgcagggcgacgccgccggctgcaccaggccctggacgacggcgcgcggcggcggcaacgcgctgcgcctcacgtcacagcacaggtcctggttcgccgcgcccgaccgcctgcgctctgccgcgggcgcctcgggagcaagcgagctggaggtcgcggtgggcagcgcacgcttccttgagcagcgcggcgtggaggtcgcgggggacggcgcggcggacgcctatgtccgcgccgcgcaggcgcgcggctgcaccgtcatcctggtgtccgcgggcgccgcgnnnnnnnnnnnnnnnnnnnnnnnnnnnnnnnnnnnnnnnnnnnnnnnnnnnnnnnnnnnnnnnnnnnnnnnnnnnnnnnnnnngctggcggccgtggcggtggccgacccggtgaggcccgaggcgcacggcgtggtggcggcgttgcgcgccgccggcgtcggctgcacgctgctgaccggggacaactggcgcaccgcgcgcgccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggtgctgccagcggggaaggtggccgcgctgcgcgcgctgcaggccgcccccggcgcggtggtggccatggtcggcgacggcgtgaacgacgcgcctgcgctggccgccgccgacgtgggcgtcgcggtgggctccggcgccgacgtcgccgtggaggcggccgacctcgtgctcgtgcgcagcgacctggaggacgtgctgggcgcgctgggcctcgcgcgcgccacgctgcgccgcatccgctggaactacgccttcgcgctggggtacaacgcgctggccatccccgccgccgcgggcgcgctctacccgttcttccgcgtccagctgccgccctgggtggcgggggcctgcatggccctctcctccgtctccgtcgtctgctccagcctcatgctgcggcgacacgtgccgcggcgccgcgtcctgcgcgacgtcctcgtcgtcaaggggcgggaggaggcggcctgagcgtgcgcctcggtgtcgccccccctcgatga

SEQ ID NO: 5961 - DNA, 2640 bp, Chlorella protothecoides
  modified_base (63)..(72): a, c, t, g, unknown or other
  modified_base (493)..(502): a, c, t, g, unknown or other
  modified_base (1505)..(1514): a, c, t, g, unknown or other
  modified_base (1732)..(1741): a, c, t, g, unknown or other
  modified_base (2007)..(2016): a, c, t, g, unknown or other
atggtctggaggcgcggctacctccgtgccgatcgccccctcggcctgcacgcgagcccctgnnnnnnnnnncagaggcatgcagcgacgctgctgctggtggggtggggtggactggaccggtgcggcgaggcgccgacccaatggtctggaggcgcggccccctccgtgccaatcgccccctcagcctgcacgcgagcccctccgcgacgtcacgcgcctccaaacctccgcacgatgcagaccctggcgatggagcgcggggtgtcatgcgcctgcacgcggtgcgtgtcgcccctggccacctccagcgaccgcttcctggaggtgcgttgcgtgttggctgcaggggctgactgcacagctttgcaaaacgaggggactctgctcgtcgaccgaggccaggaggtggtggccctcgccaggagccgtgcgtgcaggcagtgcgcgccctgcgatcgacctccgctgcggaagcccgtgtgcagacctnnnnnnnnnntgttggctgcaggggctgactgcacagcttaccaaaacgaggggactgtgctcgtcaaccgaggccaggaggtgggtgtgtggtgcctggcctgccgccgcgatgtgctggtcgaggcggccaaccaggaaagcgcggcggcggagtacgaggcccaggcgtgcgagcgcgagcggcgagcggcggggccgcacgcagcccgcatggggcggggggccggcaagcacaagggcaggaaggcgacgggcggcggcgccgccgccgccggcgccgcgccaggggccagcgccgcgggagcgggccacgtggaggaggaagggatgcctgcgggcgaggagacccccgttgcgggccacgagtctgtgcccagcacccctccgcctggcgcggccgactccccgcctgcagccgaggcggaggcggcagaccacagccagtgctgcggcgggcacggcgaccactcccaccaccaccacgccccaccgcccctgaccttcccgggaaagtggtggaagtgctgcggctgtggcagcgtggcccccggggtcgcggagcagggcctggggccccagcagctggtgcagcgcgccgacctcctctggcagcaggggctcatgctgcacaacatgaaggtggattggggggggaaaggctcagggatgcagagggaactcaaagtgcatcataggccttgggccctgctgcctcactgccagtggaccccggcgctcaattcctttggtcactctcaagtgacagcaagaactcaatcctgggaccactccttcgcatgcgcaggcctactcgcagtcggagcagatcctgcgggtcctgtgcgctgggctggcggggaggctgcaccccctccacgccagggcacatggctccagaggttctacccctcaaacccctgcagatccagcggggggagactgtcacggtgttcaacctcgccctccagctctgggaggccgagcgttcggatgcctgcatgggatgctgnnnnnnnnnngaggaaagggggaagggaccttttcgcgaggtgcttgactcccaatcgctgctactcgccggaggatgcctacatgggatgcttcacctgcactggggctagcatcaaccaggctctgtttctctcctctcagatcgtggaccggcccaccctcacgcaactcacatacctgggtgctctggttgaggcagcccaccacaagattgatggagccaccnnnnnnnnnngaggcagcccaccacaaggtgaagtatgggagggagcggggggtgagcactgtcagacaggccttctcaaggcagtcgatgcatgcctgctactcacccaggttgatggagccacagtctcattgcgaactggtcttcctccgcaagatgatgctggggcccgaggagtgagcgctggcgtgtgcgagagcggatgctgtggcgaggagcgtggatcgctggggctgccgcccagatctccccaggttactgcctggcaaagaatnnnnnnnnnnagcgtggatcgctggggctgccgcccagatgtcctcaggctactgcctggcaaagaaatttgcccaactgctgcaggttcccctttgagaacgtacgacacggaagcagcaggagcgtctgtgaagcccatgccctctgccatccatcatcctaccaccgtcgctgcagagtggctgggcgtggacgtcataacagatgctgcagcgaaaatgaattcctcctctcccactggtataccaaaatgctatcccaagaaattgcaaggcaccaatcgaccccaatcagtcctccatactcaaaagctatgtcagtggaagacatcctacatgtcacgtggaaggctgggcacctgcagggttttgtcacgcggcgtctgcctggacgaagcagaagcggagattgccaggtccgttgatgcgggcggcgctgacgaggccggtggggtcgtccattgcaccgagctggaccgcctcgacgctctgtcgaagcagctgcatgtggttgcacagaaagggggggagtctgcgtttggcactgacttcctgagacagccattcttgtatcacggagagatgccattgtgcctggcggttcccagccgggctgccctgggcagccagtaa

SEQ ID NO: 5962 - DNA, 258 bp, Chlorella protothecoides
cgccccgcgccctggcgtggggccctgggccccgcgctgcgggcggtgcacgccgagctggcggcgctggcggctggcgggaagctggcgggctacgccgcgcccggcacgctgccggagctgcaggcccgggcggccatgctggcgaccaaccttgtgggcacggggccctctaccgaggccgggctggccctgttcccgggcctggcctccttctcccactcctgcatgccaaactgcatctggatagcggcaggt

SEQ ID NO: 5963 - DNA, 1677 bp, Chlorella protothecoides
atgacggcgtccgccgcgccgtcccccgcgacctccacgccgcgctgctcaaggaagcgtgcgctgcccaccgcgacctccagctcgcttgctcccgaggcgcccgcggcagagcgcaggcggtcgggcgcggcgaaccaggacctgtgctgtgaccgcgttgccgccgccgcgcgccgtcgtccagggcctggtgcagccggcggcgtcgccctgcgcaccaccagcgtcccggtacagcggcacgcggccgctgacgccctcgccagggaaagcacgaaaatcgtgcacgacgggcacgcgccccgccaggccctgcatgcgctggtggggcaggcccgcaccggcggcggcggcggcggcgggcggcgcggggcaggccagcgcgattggcttcgcccccaccgcgcccgccagcgggtgctcgctctcctgctccagcgcggcggccagcagggcggcgtccgaggcggccacgcccgacgcgaagacggcgacgtccacggcgcgtggccgccccgcggtcagcgtccccgtcttgtcaaaggcgacgtgggtgacgcccgcggcgcgctccagcgcgtcgccccccttgatcaggatcccgtgcgccgcgccgacgcccgtgccgaccatgaccgcggtgggcgtggccagtcccagcgcgcaggggcaggcgatgaccaggacggcgatgccgaaaaggagggcgaagagcaggggcgtgtgcccctccggcagccaggcggccggggcctggatgggcgccttggccagctgcgcaccctccaccaggcgcacgatctgggagagcgcggagtcggcgcccacgcgcgtcgcgcgcacgcgcagcgttccgcgcaggttcaggctgccgcccaccacggcgtcgccgggggatttggccacgggcgccgcctcgcccgtcagcaggctctcgtccacgtgcccggccccgctcgccaccacgccgtcggcgggcacgcgggcgccgggcagcaccttgagcaggtcgccgacgtgcaccagggcgcagtctatctcacgctccgtcgtggagggggaggggtcggcgtcggcgggctcggggcgcgggtcggcggcggcgggctcggggcgcgtgcccggggcgtcgggggcaacccacccgtctgcatgctgctcgccctcgtcgccgcccccctcgatcaggatggcagtggcgggggccagcgcgcacagcgcggccagggccgcgcccgtctgcgccttggcccccgcctccaggtacttgccaaagagcaccagggtgatgagcatggcggcggtctcgaaaaagtcggtgggcttgtaggccagggtctggtggtgggaggcggcgtggtggtgcaggatggagagcagggagtagaagtaggccgcgttggtgcccagcgacaccagcacgtccatgttggcggcgcgacgcgccagtgcgcgcagggctcccacgtggaaccgcgcgccgcagccaaactgcaccggcgtggccagcgcccacttgagcacctggtccgcggggaagcccgccagttgagtttgatacagccaggccatgcaggccaggtggggcaggaccatggccacggcgaagacgggcgcggtgagcgcggcggcgcgcaggaaagcgcggcgccagcgctccgcctcgcgcgcgcc

SEQ ID NO: 5964 - DNA, 546 bp, Chlorella protothecoides
atgacctctcacgtatcggagggaggggtcttgcaggtgatgaaatctgcgatgcgttctcccctgggcgcgaaaactcgtgatgggttggggcctccccgatttataaccaacgcaaccacgacaggttcttacttgccagcggaggacacagcttggggccaagctctcgggtcaccagcgactgagagggacgaactcaatactcacgatgctgcagtcaaagacgtttgtcaaaaagacgaaaaggggcaaaatcctgaaggtgggtcggaggagaaattgcaagcttgccatgcagacgtgggaggaggtccagaataccacaacagctctgctcccaggctgggagagccccagctggagcactacctgcgagaggacatatactccggttcgcccctggatcctgagtgcgaccctgcttccttcaaactcagccctgatgcacagagatacatcgtgctcgatacaaatgtggcccttcaccaggtctgtgagggtgtcagcaatgggcagtggtcgggggtggatgtctcagattga

SEQ ID NO: 5965 - DNA, 1923 bp, Chlorella protothecoides
atgtgctgcagggacacctatgtcaagcaggatccgggcgagagccccaacgaccgcaacgaccgcgccatccgccgcgcggcagagtggtattcacagcgcctgcccggcaagcccatcctgctgctgacggatgacgccggcaaccgcaccaaggccatcgaggcgggggtggaggccatgagctgcgcggtgagaggggcatgcaggggggagcaatggggcttggcatggcattatgaggaccgtgtgaggtgtctgttgcactgggtcgtggggtgtgggccatcttatacccgggctgcatggtttgtttgcacactcggacggcgtggcattcgagcgccggggcccgccaccacttccagcatgtcacccttcatcctcatccacaaccaggcctacgctcggctgcgtgaagatgtgcccgagctgtctgacctggtcagcgccggcctggccacccaggctgagcagagagaagcccatggcttgggcttcgggccatcgtcagtattgcttgcctttccacaccacccccccaccattccaccctttctgcgcacagtcgggggcggggccgggcccaagaagaagcggcgagtgtttgaggatcacaagccgctgtcggaggtcaccgccgggatcaaggcggggcggtaccaccagggcacgctgcgcgtcagccgcttcaacccctgggaggggtacatcgcctgccagagcgtggagcaggagattctgctctctgggcgcggcgcgctgaatcgggccatggacggcgatgtggtggctggtgaggtggcgctctggggtggggtttcatacccctcctcccttcctatggggcctccttgcacgacctctacacgggattcccgccccgatcacatcccccattcaacacaacaacacacaaaactcccatcccccgcagtggagctgctgccggaggagcagtggcgcggcccctctgcccacctgcccacccaggccgagctggacgccgccgatgccagcgagggggaggaggaggtgctgggagaggacggcggcgcacacatcgcccaggtcgaccccggcgagcactaccccggcgtcgccggagctgcgggcggggacgacacctcggccgcccgccagccgacgggccgggtggtgggcatcatcaagcgcagctggcgcacgcgggggtactgcggctcgctgcagccgccgcgcgtaccgggggcctcacacgggccggggacggcctcggtgctggtgtgccccgtggagcggcgctacccctttgtgcgcatcaccacccgccaggtgggaggtgtgaacaccaaattgggtgggggtgaggccacaggtcttgggtggggagcgtgggcgcttgatcatgcggacggctgtggaaaatggtggtctgcagaggcgtggacgcacactggggtcagacgcagtgagggccctggaccctccatcccctcgcacccaggagtggcacacacaacccaccaggcggccacgctatccgacaaacgcatcgtggtggccatcgacgcctgggacaccgactccctgtaccccacgggccactacgtgcgtaccctgggcgccatcggtgacaaggagacggagacggaggtgctgctgctggagaacgacatcaacaccgcgcccttcacgccggcggtgcacgcctgcgtcccgcccctgccctgggcgctgggcgaagccgaggcggccgacccggcccgcgccgacctgcgccacctccccgtctgctccgtagacccgccggggtgcaaggacatcgacgacgcgctgcacgtgcggcggctggcgggcggcaacctggagctgggggtgcacatcgccgacgtcacccacttcctcaagcccgacaccgccatggacgaggaggcgggcagg

SEQ ID NO: 5966 - DNA, 219 bp, Chlorella protothecoides
atgagcaagcatcccaccttcccccctccccttcctccaaccccttccaaccaccagatggacttcctggagcacgctgcggtgactgatgttgtcgtgccggccatcgtcctcgaggaggtgagggcccggaaccagtctgtgttccagaggctcaaggcactcaccgccagcgacttcaagcgcttctacgtcttcgccaacgagaaccacaagtga

SEQ ID NO: 5967 - DNA, 825 bp, Chlorella protothecoides
atgggggacaccatcacctccctcagtctggtggagctgcgcgccttgctcctcgaagcggtgcgccaggcacacgatggactccacgcggtggctggagcactgccaggattggaggacagcgagaggtgcgcgatggggctggttgtcagcagtcatgttgcgaaggttgagggatggaatgcacctggatcgccggcgcacggcgtctccatgatgaatgtgcatgccgaccgacccacccgcggtcgaactcttggcaatctggagcctgtgtcgggcgcgggagcgctgcccctagccacaagacctctccccctctgcgatcatgccctccatgctgccaggaagcgcgccctcacgtcccagctgcatgcctcccgccagcagctccagcgcctgggggtggtggtggcctggtccgccaaggcccgggcggtggccgagtgccgcagagtcatgcaggcggccgctgtgcacgctgcggcgctgcaggacgcggcagaccagctggcctacctgcactccgagctcacggccacggcagcccccgcctacgacatcgccacggccgtgcagaaaccacactccgcaaccacctcccacgcctgcacagggtcgtacaacctgctgcccagcagcatcgaggagcacgccggggtcagtccagccaggcccccacgctccaccgtgcgcgcggccctggcgcagctagacttcctcatccgcgccaagctcctccaggtgctgttttgtggcgtggctgtgaggggagtgcgccgggagggtattgggttcgggggcgcggtcttcgggttgagctga

SEQ ID NO: 5968 - DNA, 1308 bp, Chlorella protothecoides
atggctcgcaggaaacagggcgccccacgtcgacagagcccgggcaggacaggggatcgccaggatgtgtcgctgcaagggtcaggatccatgcaggagccctccgatggccgggtcactgattcagatgatgtagaagacgcatcgaaggtggcagatggacgtgccttggcttccgtcagcaacagcgtgcgagctgtggtggccgtcagccctaaaccccagccgtgggtgctgggacccctcgtcctccaggaggcgcctgtcgccagcctcgcggctggaagctccatctcactctctgcactggacgattgcattgttgcggaggtccttgcagaggatcccgagccatgcccagcatggaaggcaaggggtagggtttggggggactggtggacacccgcagggcctctggatccaccagcactcgaatcacccctctccctgcctccttcacaggaatgcatccccctgccattagttggcgcggcccatgccatcgtctccctgctcaagtctggccatgccggcctgtgcctggctggaacccagccgggcctcctcctctgcctggccccaaaggccctcgaggacccagcgctgaaccccctggacgcctcgagcaggccgtggcagtcctccctgctcctggccctgcgcagcttcggcctgggaccatgggccgcccaggtccccgccgccgaacctcaggaagccgaggccggcgacggctccgaggtcgctcgcatctacgcccgcatcctgccctccaagaccgcgccagagttcgagggccccctgccgccagccctgcgccccacgctgcccggctaccagcgccgggcgctgcgctggatgctgcagcgcgagggtgccgctgcgacggcggccaaagaacacggcgccccgccctgcaagaggccccgcgccgacgacctgcacccgctctgggcacgggtggccaccgcggacggggggtccctgtttgtgaacaggtgcaccggcagactcagcacagccagcttcccgacacctagcccgcggcaggtctgtcccgagagcgggtggagtgcggtgaggctggggattttgggggatgtgggggatgttcgattgaggcgttcctctgatgcaggcgggccgaggttaaatattctgaacacaacccctccaatgcaggtgtctggcggcatcctggctgatgagatgggcctgggcaagaccgtggaggtgctggcctgcatcctggcgcacccctacggcggtccggcgcccgacctggaagcgcaacggggcatgcggtga

SEQ ID NO: 5969 - DNA, 1386 bp, Chlorella protothecoides
  modified_base (162)..(171): a, c, t, g, unknown or other
  modified_base (1034)..(1043): a, c, t, g, unknown or other
atggcacttcagagaactggttctcatcgattgcacggcggacactcaggctgggtgggccagtcagaggggaatgtaggtgctgcagtcttccccccccgcaccctcaaccccatgactcaccgcaggtgggcaccggtggcatgcgcagcctggccctgnnnnnnnnnnttgggaagggggggtctggaatgtctgaacggaggggtccgagagcaatgctcaaaggtcatggtacttcagagaactggtaatcatcgattgcacggcggacactcaggcagggtaggcaccggtggcatgcgcagcctggccctgcaccgggtccccatgtccatgcacgacgtcctggacgtcatgatctgtgagctccagagggtggcggggcgatgtgcgtttgcactggggacgtgggggcatcggttcagggtcgcagcgcatactccacggccacgagctttcctcgttctgggcagccagctttcgaggggcccttcccaacgtccccctccccctgcactcagccaagcaaagaatagaggcggaggacgcgcagcgcctgctcctggcggcgctcaacggcctggcggggctgcagctgctggcggggcggccggaggaggcggcggccacctaccgcggcgtgctggcggccgccgaggccaacgcgcgcctgggcgtgcgcgccgacggcctgcagcgcctgcacgcactgcacaatctgcaggacgcgctgcgtgccgcgcgagacggcgtgccgcgcacgctgcgcgacgacgtgctgacgaggcaggcggaggagctgcgggacgcgtacgcggccgagtcggtggcggggctgacggcggcgcgcgtcgcgcaaggagcagcggcgcgcgaggcggaggcgggcgcgggcgaggggctgggggatctgaggcccgaagaagcgcgtgccctggaggcggcctggcacgtcgaggcagtgcggctgatagagggcgcaggccaggcggaggtcgcgctggccgcgctggcccgcctggaccgcgccnnnnnnnnnnctcgaacgtccgcttcgactctctgaacggcctggccctggtgctgggccgcgagttgagggagttgaaagacgcgcgggaggccgccctggctgagctggcccgcctggaccgcgcctgtgaccgccccggaccggacctcgtgcggctggcgggcagctgcgcgcggtgccgcgccgagacggccgtgtccggcgccacctgcgcgcactgtcgcctggacgagcgcttcctgcggtgggaggtgcgggccttcagcctgtcggtggccggcgcggcgggcgtgggcggcgagcaggcggcgctgctggcgcagcgcgccgcgctccagcgcgtcgggcgg

SEQ ID NO: 5970 - DNA, 207 bp, Chlorella protothecoides
atgtccaaggaggaggtggagaagtcgccgtttgtggagacgctggtggcgcgcgggtacgaggtggtctacctctccgacccgctggacgagtacatgatggggcacctgaacgagtacgacggccacgactttgtcaacgtggccaaggacgacctgcgcctgccggaggacgccgacgcaaaggaggcggagaagaaggtcaag

SEQ ID NO: 5971 - DNA, 1764 bp, Chlorella protothecoides
atgatgggacgaatgaacttgatcattgccaccccgcaagtcccgccatgccctgccgagcgatgttggtttccagtgcccagtctggttgacactcccttccgtgcccgcccagcacgctgtcgcgagagacggaaagaccgcgtgcccttccccctctcttgtcatgctggggcaagcccgatggccagaggaaacgagccagccgaagggcttttggctgccgcgcgcctcggcttgactgataaactaaagctagccctcgatcaggcctcctgcgatgtggtgaacgccaaagatgagacaggtgggcatgctgtgcagggggcccctcccggctcgcggtggtccgagtgccgcggtcggagcgtcgtcagccgttcaccccatcattgttattcgaggacgggactcgcggcttcaggagggaaccgagaacccgctcgccctcgcgaccccaccccccccacccaaacccaccgctccctccctcccggtccaggtcgcaccgccctacaccacgccgcctcctgcggctacgaggactgcgtggagctcctgctggagcgtggagcggatggcagcatccaggacgaggccggggacacccccctgcacctcgccgcccaggtggggtgcgatgcggtgttgggctcagggggggaactcgtgccctgctgctggggcgcgggtctccgtcgtcaggctttctaccaaaccagtgcgctcagaggcccgcagggcacacccctctccaccctgaccaccccacatcagatctaccaggtgtgctccaagtttccggccgcatgcttggcccccgacgcgtcgggccggacgcccgtggacctggcggtggccagttctcgcggcgaggtcctgaacgccatgctcctggcctgctccgggtcggggtcggaggcggcgctggcctccatgcgggcgctgctggcgcgcggcgcggtctgcgacacctgggccccctccggctcctccgccctcatgctcgtcgcctccgccgactcccgccccggggtcgagctcctcctggcccacggcgccaccatggagctgcaggacgcgctgggccgcaccgcgctcatgttcgcggcgggcaacggcgcgcgtggcgcgctgggcgcgctgctggccgccggcgccagcctctctgtccgcgaccggcgcgggcgcaacgtgttggactacgccggcgcgggcacgcccgtgcgcgcggcgcttgaggaacgcctgcgggagctggagaccaagtcggccgcgctgcaggaggcgctgctggccgaggtgctgggcgagggcgtgcgggcgggaggtgtccaggcggcggcgcctggcgcgggaaagaaggccaagaagaaagccaagaagaagggcaagggaggggtcccgggggcaaaggctgccgccgctgggcccgcggtggacggcgatgccgaagaggcagaggaggcggtggtggaggcctgcgcggcacgggagggcccggcggagaccggcgctgcaggggacagcggcgcggcgggggacgcaggcacagcaggagagcaggcgggggcgccggcgggggaacccctcgtgacatgcgagcccgcgccgccgattctcgcttgccctcgctcgcctcgctcgcctcgctcgcgcagccctggctggtgcacggtgaccaaggccgcggggcccaaggcggcgcagcatgcccagcagggctccggcgcggcggtcgggggccacgcgggcgcgcggcgc

SEQ ID NO: 5972 - DNA, 222 bp, Chlorella protothecoides
atgggaaacccagtggtggagcacagccccccgccaccaccccagctcaccgccgaggagtatcgggagtggaggcagacgagggacgctgagagggcagcgcgtgtggcacagcatgcggtggatcgggaggccggcatcctgtctgggagcatcccccccgaacagctcacggggagggagttggccaggcactacccagagctctttgacggctactga

SEQ ID NO: 5973 - DNA, 2313 bp, Chlorella protothecoides
atgctgccagcaccttccacccgcgttgtgtactctgccccaggctcccttcccacgtttcacctccccaccccaccccccaccctcccgcagacgcaccagtcggcgtcgctgacgccgcccccgctgtccccgctgcgccacctcccgcgcccgctcccgcgccccgccttcggctcctcacccaacctccaggccctggtgctggaggcggaggagcggatggaggcgcaggcctccagcaacgtgcacgccagcctgtcggccgccgccgtcttctacgaggtgaccatcgcctccatcgaccagcccaaactgctcagccggctcagcgagtgcctgggcgacatcgggctgaacatatgcgaggcgcacgccttcaacacgcgcgaccactactccctggacgtcttcgtggtgaacggctggttcggcggcggcagcgaggagtttgaggagactctgagtcagcgcctgcaggagctgccgcccccgctggtggctggcgcccgcggcggcgccgcaggcgcgcgggatgccccagcgcagcgcggcgcgcaggagcacagcaagccgctgagcccgctgtcggagcagcgggtgaaccccgaggacctcctgggcctgcagcgggtgagggttcggaggtggaggggtggaagggtgttcggcgagatccttgtgtggcactcgggtggtggcgcgcacgtcgccggggggttgaggagggccgcatgcgcactgtacacccctcttgaaacacacgcatcgtatgcgtgtgagataccctttatacactcactcaccaatcgacacgcacaggaggcatctggcgcggccgcgggctcctccctggacagcgactgggagctggaccccagcgacgtcatgttccatgagaagatcgcgtccggcgcgtttggcgacctgtaccgcgggtcgtactgcgggcaggacgtggcgatcaagatcctgcgcgcggtgcagggcactgcggcccagttctccgaattcctgcaggagatcgccatcatgcgcaaggtgcgccacaagaacgtggtccagttcatcggcgcctgcaccaagaagcccaacctgtgcattgtattcgagtacatgcagcgcggctcggtctacgaatacatccgcaagggcgagtatcgcagcgtgcatgtggtctcaaaggtcggatgccagcaccaggacgggcccgctgcgcgtatcccaggtgctcaagtttgcgctggaggtgtgccgcggcatggactacctgcacaagcggcgcatcgtgcaccgcgacctgaaggccgccaacctgctgctggacgagacgggggtggtgaagatcgcggactttggcgtggcccgcgtgctggaccacacgggcgtcatgaccgcggagacggggacgtaccgctggatggcgccggaggtgatcgagcaccagccctacggcgtggaggccgatgtcttctcctttggcatcgtgctctgggaactgctgacggggcgcgtgccctacgccgacatgaccccgctccaggccgcggtgggggtggtgcagaagggcctgcgcccgccgctgccgctcaactgcccccccgcgctggcggagaccatgcgcgcctgctgggtgcgcgaccccgccgcgcggcccaccttcgagcaactcaaggcgcgcatggaggagctgtacaacacgtaccggaaccaggaccgccccgaggcgctggttggcgttgccgcgcccgcgccacccagcgccggcccctcgcccgcggccactccgcgggccggctccagcgccgcgtccaacgcctccaccggcgcgggggcagtggcgccctcgcagcgcccgggcgccggccagccggcggtgccacgccagaagtcgcagctgacaggcgggctgctggcccggctgcgcagcaactccaactcctccaagtgatggggggggagggggagaaagcgcggccgccacaccggcgtgtgcacggtccgaggttgggaggcctggaggacggcggcgtgcgccgcctttggaccgtgcctgggatgccgcggccgcccagccgggcccagcacgcatgctgggccccctgccccaccccctggggaacccccacccacacacctcgcccctcctccagggcggcgggtgtgttctgtctgtgtgcaactacgagagctgagagcccatgtgtctcgagagtcctcttttttcgatgcatggcgtcggccccttcatcgccccctcccatgggggggatcacgcatgcactctgcattgcctcaccccaagcagattaa

SEQ ID NO: 5974 - DNA, 528 bp, Chlorella protothecoides
atggccacccttgtgaccataggccactcaagcagtccctccagcttcggaagtcttgttcatcctgcagcatgccgaggaatgagccctgataccaacgacacgcccaaatgggcgcagggcgagtcgttcaggaggcgggggggtcctggagcacttcgacagcctgccgtcgaggtaagatggggtctaaatgatgtcggtggaggcggctacgagtccgcggggcgtttgcgagtccaccatccccacggttgccacaggtatgccttcgacgtcaacatcgagtccctggatgtgctcaaccacaagcggctgctggacagtgcacgcgctgaacccagcgcggtgagcttccaggtccggcccgtcgacgtgataacgggaaccggcatcgcaggccgagtgccgtccaacagcttcctgaccgagggctccttagaggtgcgctgcggccgaggtgtggttctaggggatgagcggttctttcggaaaaccatggctggctccccatcccgctctgcatga

SEQ ID NO: 5975 - DNA, 1950 bp, Chlorella protothecoides
atgcgtgctgggcccggctgggcggccgcggcatcccaggcacggtccaaaggcggcgcacgccgccgtcctccaggcctcccaacctcggaccgtgcacacgccggtgtggcggccgcgctttctccccctccccccccatcacttggaggagttggagttgctgcgcagccgggccagcagcccgcctgtcagctgcgacttctggcgtggcaccgccggctggccggcgcccgggcgctgcgagggcgccactgcccccgcgccggtggaggcgttggacgcggcgctggagccggcccgcggagtggccgcgggcgaggggccggcgctgggtggcgcgggcgcggcaacgccaaccagcgcctcggggcggtcctggttccggtacgtgttgtacagctcctccatgcgcgccttgagttgctcgaaggtgggccgcgcggcggggtcgcgcacccagcaggcgcgcatggtctccgccagcgcgggggggcagttgagcggcagcggcgggcgcaggcccttctgcaccacccccaccgcggcctggagcggggtcatgtcggcgtagggcacgcgccccgtcagcagttcccagagcacgatgccaaaggagaagacatcggcctccacgccgtagggctggtgctcgatcacctccggcgccatccagcggtacgtccccgtctccgcggtcatgacgcccgtgtggtccagcacgcgggccacgccaaagtccgcgatcttcaccacccccgtctcgtccagcagcaggttggcggccttcaggtcgcggtgcacgatgcgccgcttgtgcaggtagtccatgccgcggcacacctccagcgcaaacttgagcacctgggatacgcgcagcgggcccgtctgcacggagttggcggtgatgaggcaggggaccctggtgctggcatccgacctttgagaccacatgcacgctgcgatactcgccctggatgcaccagccccaaagcgccaccccctccccctcctcccctcacttccccacaatccacccccccacacacgcaccttgcggatgtattcgtagaccgagccgcgctgcatgtactcgaatacaatgcacaggttgggcttcttggtgcaggcgccgatgaactggaccacgttcttgtggcgcaccttgcgcatgatggcgatctcctgcaggaattcggagaactgggccgcagtgccctgcaccgcgcgcaggatcttgatcgccacgtcctgcccgcagtacgacccgcggtacaggtcgccaaacgcgccggacgcgatcttctcatggaacatgacgtcgctggggtccagctcccagtcgctgtccagggaggagcccgcggccgcgccagatgcctcctgtgctgcgcatgcggccctcctcaaccccccggcgacgtgcgcgccaccacccgagtgccacacaaggatctcgccgaacacccttccacccctccacctccgaaccctcacccgctgcaggcccaggaggtcctcggggttcacccgctgctccgacagcgggctcagcggcttgctgtgctcctgcgcgccgcgctgcgctggggcatcccgcgcgcctgcggcgccgccgcgggcgccagccaccagcgggggcggcagctcctgcaggcgctgactcagagtctcctcaaactcctcgctgccgccgccgaaccagccgttcaccacgaagacgtccagggagtagtggtcgcgcgtgttgaaggcgtgcgcctcgcatatgttcagcccgatgtcgcccaggcactcgctgagccggctgagcagtttgggctggtcgatggaggcgatggtcacctcgtagaagacggcggcggccgacaggctggcgtgcacgttgctggaggcctgcgcctccatccgctcctccgcctccagcaccagggcctggaggttgggtga

SEQ ID NO: 5976 - DNA, 1011 bp, Chlorella protothecoides
atgcgccttctcaacgcgcacggcctgaacccgcaggctgccctgggggagggcgggtggggcaccgatctcttcaagacggaagtggtgggagccatcacgcgcgccgcctacggccaaaccagcctgcagttgaacgcgctgtctggtgctgcggcgctcctggcagtcacagatcccgggggtttcagcatcgagggcggcttccccggcctggcgtcggcgctgctggactccgccaatgccagcctgcatctgggcgccgaggtgcggagcatcgcacggagccccggctcggaccggctgcagctcgcctgggcggacgcggcggccggcgggggcgctgccatcgccgcccagagcggcgacttcgatggcatcatcctggctgcccccctggagggcagccagctggacctggcgggcgtgcccgacctcgcgccgcgctttcctcgctcctttgtccccaccgtaaccaccctggtcagggggagggtgcgtgcgtcctactttggacagccggtagccgcgcagctgcagtacggtgcgcgctcggggggtgcagaggctctgggacacaccctggaaaatgatgggatgagcatgggggcctttccactgcgcccgaggcatggtgcactgagatccaagcctctaggcgctcgcactcgacaccttttgagtggcaagcacgagctggccgcccccgagatccctgggtctcatgccgcccattccaactcggcaggccgtgtgctggtgacggcagactcccccgtccccttttcgtccctggccaaggtccagctggccccaggccagcccagcctgtggcggctgacgagcccgaaaaccctctcccacgcctggctcagcatcgtgtttgaggctgggtggcaagtggccgatgccacgacctgggcagcctaccccaggtggggcgcaccgggggcatacgggatggaggggattgcacctgctgcgggtgttccgatggaccgccacacatga

SEQ ID NO: 5977 - DNA, 354 bp, Chlorella protothecoides
atgggtcccgctggtgccacgcagcatctcggcctcctcgcactcctcatcggcctgcagtgcatggtatgtgcgtcatctggaccacacatcggtgtcgtgggcgcagggatcggaggggcagcatcagcgcactggattaggagcctgctgggcgatcaagttcagatcactgtgtttgagaggagcaccagcgtgggagggcggacttccaccacaccgatcgggaatgcgtcggtggacaccgcattcgatcaggtcgcacaccacaggcaagccggcgtgtcgctctgcgaaattctgcattggaatgtggaagggcttaccctggggctccacttggatgtcggctag

SEQ ID NO: 5978 - DNA, 213 bp, Chlorella protothecoides
atgccatggaaccggcgcaagccgtcctccaccgccgccctgtgcaggagcgatccgccggaggacttcagtcccttcctgctggctcggggcctgtggtataataatgcgctggaaagtgtggcaggcagtctcgaggccgctgcaatgtccgcgctcaacacggccctgctcgtgaagcgagatgtgaaggcccgtttggatgggacctga

SEQ ID NO: 5979 - DNA, 1350 bp, Chlorella protothecoides
  modified_base (285)..(294): a, c, t, g, unknown or other
atgattctgaatgcaatgggtagtgggggcggcgaggcggcctcaggggccggaggtgacctggcctttgagggagggatggaccttgtcttggggggtgggggcgaattcttcatctttggcggcggagacctggctatgggcggaggggacgacctcttcctgggtggtggaggggaccgcttcttgaggggcggggggggagaacgctttttggatggtggaggagtagaagaaagatttatagtgtccccggtgaccagatcagctggggtgcagggtcgnnnnnnnnnnagtggaagaaagatttatggtgtccctggtgaccagatcagctggggtgcagggtcgcgaggcgccagccaggccattgcagatgttggcattgcccttgttattagtgccaatgttgaggcttccttgattcttaggtgtgaacatgacacccccaggttgggagtgtgcggccctggctcctccaagagccccttcccagctctcaaaacaggatgcggcagggcataccccatatcagagcaccctcaagtgccagccatttgcatggctgcagcagcgcaccacggacctatgtttttgtctccactgtttgcggtcccaaagttgtgccacccgatgttgccattgccagtgtttcccagccgatcaggcgtgcaggccggctggcctttaggcaggcattccacagccatcagcgcttggcaggcaggggatgcgcatgtcttccctctgacaaggctgactgctgagacgttgatgtttgtagacttgagacttgctgacaataggtatttctggtccgaggtgttaaacatcccggcagcactacccggccgcggtgacctatgggctccggtgatcatagtaacgccagcatcggatgcaggggagctgcatgctgacatatctcccagtacccctcactcacctcgcagatggaagagcgaagaagcagtgtggcgaaacccagtaggaggagcagcgacaaacccatctttggtcgtgcactgcctgccatcctcagagagagatgctattttccccgtcgaattccagttctctttgtccgactcttcggagtggttcgagctgaagactgcttcgtacgatgatgtcacggatccgacaaggctccggaccccggcagcaaaccagacgtacgggtccctgccgcaccccagcaattcttttcagcttctcccttgcaagctatggggaccattcattgccgatgaccttaaaaagccacccgaatgggcctgcagcgatctgcccctctctcctgcagtcccgacatcgtcagttccacggatgctggaatcagcatcgtga

SEQ ID NO: 5980 - DNA, 3204 bp, Chlorella protothecoides
  modified_base (189)..(198): a, c, t, g, unknown or other
  modified_base (707)..(716): a, c, t, g, unknown or other
  modified_base (1736)..(1745): a, c, t, g, unknown or other
  modified_base (1869)..(1878): a, c, t, g, unknown or other
atgaaatcggctgcccgaggcgggagggccttgaggggaggccgacattgccaaggcagcattgccctgttccgtgtcgccccgccagtcgtccaacccctcacgaccatgcagtgtaccccataccctcactgccccccccttccttccccccccccccaaaaaataaccgaaaacccatcaacactnnnnnnnnnngagggccttgaggggaggccgacattgccaggcagcattgccctgttccgcgtcaccccgccagtcgtcccaacccctcacgaccatgcagtgtaccctataccctcactgcccccccccttcctcccttccccccacataaccgaaaacccatcaacacgtaccctgtgtccgcaggccacagcgatgacaggggacgatatgtggaaggacagcgaggcgatgggcttgccgaactggaacatggccaggcactcgccagagtgcgcattccagagccggacctggtggtcgagggagccggacgccaccaggtgcggcaggcgcgggtggaagcgcaccacccagggggtgcggctgtggccggccagcgagcgcagcaccaggttggtgcggcagcagctgatcttcaccgtgtggtcgccgctgggaagaggagggggtttgagggggctgagacccacgggagccgagggagctggccctgtagtccccccacccttacaatnnnnnnnnnnagctgatcttcaccgtgtggtcgccgctggagagaggaggggggttgagggggctgaggctcacgggagccaagggagttggccctgtagtccccccacccttacaaaaggcccatccagaccgcaggatgccaaacgggcctggggccgtggcaggggtgccgtccgcgttgtaggccacggcgatggtggagcgtggtgcagggctgaaggcgcaatactgggccgagcagtgattcacgaagtcgtcctccttccatgtcgagaactcttcatccaggggctgacaaggctgcgggaggcgacctgggacggctgcctggccactctcacgctgcacaagcaggtggacaaggttgcgctgagccatcccgcgctatggggaggagcgggcgcgagccaaggacggcgctctaaggagcccgaaaccctcaaggacgtgtgtggaccattctgggaagggcttccgccggaacgcccacacgtcaagggtcacaggccagggactcggtcacaaagtcgcgtacatctccagcacactgatgctcaggagcggggaagggagaccaacatggtgaaatcctacatcaacgggctggggtgtcgaggggggaagaaagaacctgcctcgattcgcaacaacaacgaaacgaaaagctcccgcccggacgacgctgcatcgccgtcacatcctattctcattgcactatcccaccgacaccccagaacaggtgacttgggaagaggagacccacacccggtccctttcacgacatctcatcgggcagttgcacagcatattcctggggaatcaagggtcttcctagacctaacccaggcgtggcttgtaacgcggcgtccggatgttggactacttctgcatcttcaccaagagtggagccttgctgtgggccctgtccctcacaaccgtcaagggcgagcccgtgaacgctctcattcgagaatgcctgctggaggagcgcacgggggacaccacgttctcctacacttccccttcannnnnnnnnncctgctggaggagcgcacgggggacaccaccttctcctacacttccccttcgggggccgcctacaacctgaagtgggcgctcaacaatgtgaggtcatattggcaggaatcaagtcttgaggcnnnnnnnnnnactacctcattcctcgccccacatcatcctctcacgctccaggccctgggcattgtatttgtcgccgtctaccagaaggcactgaagcttgcatatgttgatgagctgctggggaaggtgaacgcctccttctctccacggttccagcctgccaagttcagcctgccaagttcaggtgcgaggggagatacaggagctggtgaggaatgtcatatttttctcgatgcggatggtaacagcagagggtgggtgagcccgatcagattggcgcatggcgccatgttgacaagcattgcagggaagtggttgaggccggctttgctttcagcgatcacaggaaggaaacgcctcaccggtgtactgtcctgctccattgccgcagctatgcggactttgagcccacattcaagcgcctgctgcgggagagcgaggagcgtgccgatcagagggcgaggagtggggcgggggcccctggggcactccaccattcccatccgacacctgggcatgcagtgcgcacgggggcgtgggaaggagttgcgagggtgctcggtgtgtagcttgaagtgttggcaaggtctcctctgggcctcgccggcgccgctggaaggtccgatcaaggtgactcatgtggtgagcggtcggtgcaagccattcatacggcgatgtgaggctgcaaggtccggccctgcctgcaggccgcatcgcagtcggagaggacggatggcgacgaggatgaggcagactccaagatcagggcctcagacatggccacctcccagacagatgccacagacctcaccgggcagagtgaggaggccgccgtgtcccaacgcgaggcctctcgccccgcaggacccccacacgcagtcggagggccacctctcgaacggcttcgacgctgccctgctctccaagcggctggcaaagcggggcggccccggcgcaaaggctgccaagcgcgcggagctcagggacgcccccaagcccaaggggaaagcggcggccaagcccaaggtcgcccgcacctggaacgatccctcaggtgggctgacgcagggagaaggctcactccgtgcccggatcggaccaccaccccgcgatgtactggcatcgcgcgagccacgtgtggatgccgccgccctggacttcaccgaggacaagcccagcgacgtggaaagcgagacggtggcggacttcagcaagctgagcttgatcgacgtggccgaggaagtggtgtttgatgacgtggaggaagaggtgagaagagcacgcaagaggcgtcggcctgtttcactggcttgggtcgttgtcggcggtgtgtga

SEQ ID NO: 5981 - DNA, 291 bp, Chlorella protothecoides
atgatcgcggcctgcgacaccttccgctctggggcggtggagcagctgaagacccactgcgcgcgcctgggtgtccccctgttcgagcgcgggtacgagaaggaccccgccaaggtggccgccgaggccgccaaggccgcggcgcgcgccggcaccgacgtgctgctggtggacacggcggggcgcatgcaggacaatgagcccctcatgcgcgcgctttccaacctgatcagcctcaatgcgcccgacctggtgctcttcgtgggggaggccctggtgggcaacgacgca

SEQ ID NO: 5982 - DNA, 3207 bp, Chlorella protothecoides
  modified_base (244)..(253): a, c, t, g, unknown or other
  modified_base (2102)..(2111): a, c, t, g, unknown or other
  modified_base (2895)..(2935): a, c, t, g, unknown or other
  modified_base (2999)..(3008): a, c, t, g, unknown or other
  modified_base (3093)..(3102): a, c, t, g, unknown or other
atgctggaagatcgccagtcctcacaccatgtgacttcatcgcagaggaggacagggagtcctggaaccgctcctcccgcctgtcctacctgtcagatggcatgcctgatggagctgaaaggtctgttgtgggcgtgccgtgaagagccttgtggcaagctcaggaacagctcaacaaacccatctccactgcctgcttgctggtttgaacaaccaaccacctccagcctccctttcctgatcnnnnnnnnnnctgtcctacctgtcagatggcaagcatgcctcatggagctgaatggtctgttgtgggcgtgccgcgaagagccctgtggcaagctcaggaacagctcaacaaacccaactccactgcctgcttgccagtttgaacaaccaaccccctccagcctccctttcctgaatccccctcagttacaagcagtacctgcgggacctgtctgtgcagctcaagggcatccgggagaggggcggggaggccggccccggggtcaaggaccccgccggcatccagtttgtgaacctcagccccgcctggagggaccccgacgtctactcctacttcaacaactctggcgagtgcagcacagatgctgggggcccccccttcaccctcccccaactcatcgcagtcatggagttcccgctcaacatctgggagcggccccctgggctgggtctgtgccccctgcacatcctggtgaccatctgcagccagatgcaccagtggctcagcctctcgcccgacaacctcgtcgtgctccacgctcggacctgcaccggtacggagcggcacctggccaccttcctggccgcctgccacctcatcttctccgccgggctggacaatgtccgtctggcactcgactccctgcccccgctgggggggcggcccaggtccgaggcttcagggttgtgggggagcatggggagggggagtgcggagacggttggtgggatgatgttgttcatcttcaacttgcagggcgtgtgtggctgctcagcctctgtcgactctgtgatgggaggcgaagcgctgcaaacatcaggcgccgctcggctcctccagcccgttcagcagggttggacccgactcgctccacctcacgccacacactcgccaccccaccccccaatctcaccacatgcactcacgagcctgcctcattcatgacgctcaccatccagggcctcaaagagcctgttcgacggcaatcaagaggacggcttcaggacagctgccgccctgaacgccctgctcccctcccagcagcgctttggcggctacctggcggccctcctgcatgctccccacacccttcccccccactccgcccggcccctcctgctgaagggcatcctggcctcgcgcctgggctgcctggaccccgcgggcgtggcaggggcctcgccgcgcaaggcccctgcagggcgcgcccccgccccgacccacggcccggcgcccgaggggggcgcgcgcgcgcgcgcgctgcccgatgcctcccgcggctcgggccgcgtgctggccacgctgtaccaggggggcagggcggtgtggacccagggcgcctcgctagacgtgctgtccggccaggacgacacgctctccttcgatgtcggcctggtggtgcagggcgacgtgaccctggccctctggtttgccgaccacgtgggcgagtgggagccgcccgcagccgcctactccttccacaccgcctttgtcgaggcgggggtggtgcgcgtcacggggctcaagctggacctgccgggcgtggggccaggtgggtgggcgtgttgtgggtcgcagggggggggcctgggaagggtgagggagaggccagagagcccggcacaagcctcgaccacccaagtgtagggcccgccacccgggtctgcgcagctcccagactatccccccttgctcaccaccgacgaccaggcgctgcggcgctggcggaggccgagggcttcttcatggacatcatgctggacgacgacatcggcggggatcatgcgtggaactgtggagcacgccattctcaccctgggaccccacctcatggcaccctccccaccctgccacctgnnnnnnnnnnatcttggttgttgggtgaggcaaagggcggtgatcatgcgtggaactgtggagcacgccactttcatcctgggaccccaccacatggcaccctccccaccccgacacctctcaggggggaggcgggcgacctgcacaccgacgtggagcggctgcgcggcagctgggaggcgctgatcgaccagaccgacggcttcctgggcttccgccccgtgcccgagtcgggcatggacgacgtcatgtcccagatccgggcggtgcagtcggcgcgcctgcgcccctcccagatcccacgcactctcttccgcgaggcgggcgccgtgtcggccgcctccagcgcctcctcctcgcccaccgccgcgcgtttgcgccgggtgggccagtccctgctgggaccggcggcctccagcagcgccgccagcctggccgggtccgaggagggcggggttgccggcggggaggcgccgccaggcaggggcgctgcgatccaggttggagttgagaaagttgcggcaggggaggttgacatgagtgaggctggacttgaggaaccccacgcggtagaggctgagctgagcctggctaaaatggaaccagcacgagaggctggcggggccggcggagcgagctcgtcgtcgccggggcatgaccttccagacccgaggactgatcagcagagggctgcggaggggacgggtgcggcgcacgcgaccacctctgctgtgccatgcgacgcgcaggtgactgctttggatgcgaatgtgactgcctcaaccattgaggtnnnnnnnnnnnnnnnnnnnnnnnnnnnnnnnnnnnnnnnnncccaagaagcccgtcctctggaatcgcagcgcagaaccccatctctggaggcgcagcgcagagnnnnnnnnnnggcgcacgcgaccacctctgctgtgccatgtgacgcgcaggtgactgccttggatgcgaatgcgactgcctcggccatagaggcnnnnnnnnnncccaagaagcccgtcctctggaatcgcagcaaagagccccgtctctggaggcgcagcgcagagcccatcccccagggacagcaccacgccgccgccgccaccgcc

SEQ ID NO: 5983 - DNA, 516 bp, Chlorella protothecoides
atggaaggagggggttcccgccagcccgggatgggcatggccgcgtgcagatgggtctccctgctcgcagaccaccccttggaaccagcccctgctctgcatgctttggcacttgggatcagtctggcccgttttggacctgcaccgcggcggctttgcgtgggcgcggctggccagccagctccgcctgggcctgcgccccaccaccatcaccacacacgcccacacccacccacaccccaggtggactggcgtgaccgcgccaactggaactgcaacaacaacgtgcaccccagccggcacggcacctacgacggcgtttccatgcacccctttgagaccgtgtttgtcaaggcgtcctggcacgtgggcggccccttcgtggacaagtacgccgagtggatgacggcgcaggtgggcaggggctctgaggggtgcggcggggggggacgagcagggtggtgcgcatcgcagcgtccgccctccgccggacgcctggctcacgctgcttcctga

SEQ ID NO: 5984 - DNA, 1530 bp, Chlorella protothecoides
  modified_base (265)..(274): a, c, t, g, unknown or other
  modified_base (1007)..(1016): a, c, t, g, unknown or other
  modified_base (1430)..(1439): a, c, t, g, unknown or other
atggcccgcctgccgcggcgctcaggactgcgaggattgaatctacgtgtaattatggcgatcataggggtcgccctgctctggtggagcctaatgagcgtgtccgacggctacactcccatacgcggcaacaaagggaaagtgctcgtctcctactcctatttcgagaaggatgacattcagggcgacgaacgagatggtaaacccaggtattcccatgatcactgcacaaagaagagctacatatctccactacatccttctnnnnnnnnnnagaaagatgacattcaggtgagcgtgctgcgtcgcactgagtgcttaaaaatgtttacacatgggatcgaggttcctcgttgttaccctgccatgcgatcggaggccctcacaccttccctctgcaagacccgcaacttcgacttcttcatcacgactgccatgggcgtcgacaacgtgctagataagccacataacatcgacttcgtggtggtgcagagcggagacgcctgcgagccctgcaaacggctgcttcaatccatgaagtgcgtccattcttgggtgatgggagaggcctgggcggctggggctctgcgccaccggctgccagtgtacgaatccgtgtctggccccggccgagtgaccctcctccagcgcaaggagaacgagggcatggactttgcggcgcacaacatcactttggagtacctgctggctcagggcaggctgaagcagtacaagtatgtgatcctgctcaacagctccgtccgtggcccctttgtcccatcctacatgcccgagggctggcagtggccgcaggcctacaccagccgcctggtgggggacgtgcatgtcgtctcctcctccctggtgtgcctgccagaggtcgacctgggtgaggcgtggggttgcgtgtgcaggctgggtttgctgggagcggggcatgccggactcgaggggaaggtgctgaacaactccctgtcttgctttgtctccacctggcgtggtggcannnnnnnnnngccagaggtcgacctgggtgaggcgtggggctgcgtgtgcagggtgggtttgctgggagcgggccatgccgtactcgagggggagggtgctccccgctactccaccaagtgcctgagcgctaggaaatcgtgcccccccccccgctgcaaggtggctacggccccaagctcgagtcctgggcagctgccgtcgaccaggagggactccgcgtgctcatggacgagggcgtctttgcgatcaggacctgcaaactctgcaagtgtgtgtgctgtggcgggggtgccttgcgcgtggggttttcctgtgagtgaatgtcaaggccgaccgctgactcagcgcaggcgtcggcaggcatgcctgcgcctcaccccccccctcctacaccctccccagggacggcatcgtggtgaagnnnnnnnnnngccgaccgctgactcagcgcaggcgtcggcgggcatgcctgcgcctcaaccccccactcccaaaccctccccagggacggcatcgtggtga

SEQ ID NO: 5985 - DNA, 1155 bp, Chlorella protothecoides
  modified_base (622)..(631): a, c, t, g, unknown or other
atgggagtacctgggtttaccatctcgttcgtcggcctgccaaccaactccgctgcagagcgcgccaaaggaaaaaccttatcgccaatgctgaacgctcgagacgctgggggggggggaggacgtcgtgtgcacggtgcgattccttccttgcaagactcactattgtccaacatctgttctgtgtttgtcgacgaggttgccgacaagcaggcggtcggatccctgacggccacccactgtgcgacaatgatagccgcacaggcacccaccgcgcacgcgtgccgtgcacaggcatgcttcggtggaccgtactcttcggcgggatctagcatgggaagtctacagtacaggatgccccggcaggaatgcttcaccgctcgcagggtgtgtccccgccagcgcctgacgccactcgccgctggggagggtgagctgggaaccgaagggcgggatgctggggtgcccccaagaccctgtctcacacacaaacacctccacagtcaacccctgcctcccacccaatcctcttgcccagtcatcggcatcatcaagctggccttgcctgcgggcaaggccaatcctgctccccccgtcggccccgcgctcgggcagaagcagnnnnnnnnnncgcactcgccatgtctctcgtgggattgcgctctgagcagtgcccccaagcccctgcctaacacacaaccacctccacagtcaacccctgcctcccacccaatcctcctgcccagttatcggcatcatcaagctggccttgccagcgggcaaggccaatcctgctccacccgtcggccccgcgctcgggcagaagcaggtgaacatcatgcagttctgcaaggagtacaatgcggccacccaggacaagatgggctccatcatccccgtcgagatcaccgtgtacaagccagaggggatcaggacccatcgccgactcctgaatccctcaacctaacacctgcgcaggacaagaccttcacctttgtgttgaagacaccccccgcctcgacgctgctcaccaaggctgccggcgtggccaagggctctggcacccccaacggcccgccagtcggatcggtaactgccgaacagatcaaggtgcggagcagccgaacgggcgaggcagccggacgtccaacgtag

SEQ ID NO: 5986 - DNA, 2079 bp, Chlorella protothecoides
  modified_base (1680)..(1689): a, c, t, g, unknown or other
atggcatgcctgactgggtgggccgcaggagtcccaatcacaggacgacggactccagcatggccccagacctatgccgtggcggccggggctgagctggcgcagggcgccctgcccctgaccccgggctccaccctggtgtgggcggggttcacccccgaggggcagctggccgcgcaggacagcgccggcgaggtccgggtggcgggcctgcgctggggcgcatgggcacccctcttctccgccgaggccggtgcggcggcgggagtgtgcgtcgttgatgcgagcagggagggggggggtcacggggtgtcacgcggcacgtgtgcgccccctcgcgcccgacccatggaggcactgggggtgcagcccatgctggtcgcgcctggccccttgcgcccgtgcagggcgccagcgccccggccgagcgcccttcccttcttcctggggccatccctggcagccatgccagccacaccagctgctgttttcccagcgatgcacacgatgaacacacacatgcacacactccctcgcacgcacgcacagctcggcaaggcggcgagcacttctggctggtggagtgcggactgcgcgaggtgcagtgcgtggtgctggcgggggccgaggagcccggggtcagcgtgggcaccgccccccggcccaccctctcctccctgcccacccgcccgggcctgctggccgggggcagcggggctgcgcaggaggaggaacgcttccgctgcctctgggagcgagaggccgcgcaggaccaagcggcgctggacgccgcgcgccgcgccgaggaccaggccaggcgaggggaggggggagctgagggggagtgaaggggtggaagaggagcgggtcagccgacgatgcagggatgaggctgtggcagatgtcatgagcctgggccaggcccggggctgccacgcaacccccgcgccatcggccccagctggaaaccacccgccgccgccgccaccctgcgcagcctgcgcctgctggccgagctggccaaggcggatcggtgcgcgcggtgccttgagctggcgcagcagatgcacaccgtcgccgccgtggagggcgccgtccgcctggccacccacttcaagtgagcgcgcggggacggcaaagtgggaggggtccgggaagacgcccactctttcctcaaaaggcctcaatgacccctctgtggaaagttcctcgcctcgcaagtcctccccgttctgctcccgccacagggcgattgccctggccgacaggctgtcgctggtcctggaggaaaggatggacacaggcgcagagtcccaggagcccgcaccactcctcgctgaggtgcatggctgcatggaggcagcgctgccggtgcgctgctcatttggatgcctctcactctcccgacgccgagaccacgccaccccttgtgcaggaaccccagccctcacccatcgggggcggcgcgctgctgccgaggagtcaggctcaaggcccggccaccctaaagaggaagggagcggctgcgggcgaggacgccgctcccaaccccttctcacgcaggcccaagcctgcgcaggcatgacccctgatcaccggcttgagtgcgtcaggccttgggcagaaggagacacgcactccagggaagggttgcacacatggctcgcgcctgcaaaaccnnnnnnnnnncccctgatcaccggtcctgagggactcgtactgcttgtgaccacgcggtggcagcctgcactacaatcatctttgagaggtgcagcaggcatgcctcaggctcgagtgcgtcaggccttgggcagaaggagacacgcactcgagggaagggctgcacacatggccctcgcctgcaaaactatggacgctgtaagtgccaagagggcctgctcagtccttgatggcgatgcccatgttgcgcgccgtgcccgacaccgtcctgatggcagactccaggctgctgcagttgaggtcggggagcttgatggtcgcgatctcctggggggtggcaaggaaggagaggtggcagaggtgggattatgggaggggggcctggtgtggcgcatctga

SEQ ID NO: 5987 - DNA, 2043 bp, Chlorella protothecoides
  modified_base (1460)..(1469): a, c, t, g, unknown or other
  modified_base (1981)..(1990): a, c, t, g, unknown or other
atgagcggcatcacctcgacactcaaagtaccttcaggagaggagtacgagggaggcggggagtctgcggaagactcgggcgcatgcagtgctccttcgcagacagccgtagagcttatgcgagtggcgctgatgtccaaggattgtaacgctaatatgaaatgtgccgatggccttctgcctgtccaagtcggccatcatccgacatggctggatgcaggcgtcacggggcgcgcgtggtggcgcgctcatcccgattcatatctcgaggggcacgcgtcgggcactgttcgagcacggggtaccgatcgactcattccgctgtgggtgaacactgcgcctggcgtatcacacgcgcgagatgggcatggaacggcgcaccggcatgctttggccaagatgatgggggtgcccacgggctgcacccccgccactcgcccggtggtcccattgcggcccagactcctcggttccggcgggaggcgagcgcgcccggggacttgtctgcacgccgagtacagatggagcgcagcagacggaggccccggccgacggcggaaacgggagtccatcttcgacaactttgacccccaggaagatgtgcctggcagggagcgtcccctggagagggagccagcgtgggagacccagcccagcgagacgaacgaggcatcggggcgagcgaatccgtcgcgcccttcgccgccgcgcccctccgccggcgccgcggtcgagttggaggagggctggggcgcgggagcctggtgggatccaccccccagccggcgggtccggggcctgtacgatgagagcggggcgggggtggacgatgagacggaggagggtgccccgtccgcggatgaacccggccgccgccccgcgtccgacggccccctcgacgtcgtcccgctgagcgacgcggagctggaccgcgtgctgcccgtcttcccgctggcctcccaggccgcatacttctccggcggcaccgccggcgccgtccaacgctggggcgccagcctggcggccaccgtggtcctgtccaaggccgccctgctggccgctgcctcgctgacctggcccgtctggtggccctgggccctggccgcgcggcgcaactgggcgctgcgccgcggccgccgccacgcgggcctatggcgcacgcgcgtcctggacgtagacccgggatcgcgggggggcgtgcccgccccgcgcctggccgtcgcgcgcttcgccttcggggagcgcggagggccgtgcacgcggctggacctgcccgcggacggcaggttccagagggtgcggcctggggacccggcggagctgctcgtcctctcctcctcacccgagtttgacgagttccaggcgcgggaagatgggggaagtgcgcggtgtggggtgtctcatgcacccactcacaccctccaaacgcccaggacaggccgctcatcctttccacccgnnnnnnnnnngggaggaggggggccgagggaagagatggcagcattgctgttgagatgtggctggcctggtgctggtctcatgcacccactcacatactccaaacgcccaggacaggctgctcatcctttccatccccttgatcccacaggcggtgaaggacgtctaccttcccaacagcggcctgtggctctcgtcctacccgttcctcgaccgctcagatgcgctggcacgtcgtacagcgagcgatggggcagctatgtgagtggatcagggatggtggtatttgaggagctcctggattgggcacgtcttctccttcaggtaggtggagaaagtggaaaaatgtggcaagcagatgccagcgtgggcgcttggctgaggggagcggatcctccagggctgcaaggaaggggtgaacgtgagcagttgagtggtccatgcacggcggcatggcccaggccccagtgctcagaatcagatcagtcccttgctccaacccccggctcctcctcacctacgnnnnnnnnnnccgggtcgtacagcgcaaggaaggactatagattgaaggacctgaggctttga

SEQ ID NO: 5988 - DNA, 810 bp, Chlorella protothecoides
atgcttgcgggctctgtatgccgagacatgagcccacaccacgcagcaccatctcctgagctccatcagctgacgagcataaggttgagcagaccctggcgtcatgctgcatgcacaaaagtcctccccattctcaacctccctgacacccacccagcagatccagccattctcccaccatacaatccccaccttccctcatcacacgcgcagttcttcctcatggccggcagagggtcgcgtggcgacgccactcccaagaaccctgtgtacggcgtgacgaaacaggcactcgtccagctcagcgcttcgctggctgcctcagtgcagggaagtccagtgagcgtgcacctggtgtcccccggcatggtggccaccgatctcctcttacccctggccgacaccgccaagtcgggtggggaaagggggggagatggggttggtgggcggggtggagtgagtttgattttcatgcgcgaggatctggacggcccagtacggggtcttggtgagggaggcagtcaccatgtgtgcattcagctgtctgcaagagaacgtctatgtctccgctgcatcccacctcatgctttcccctgtgcagcccgcctcatcaacatcctggctgaggagcctgagactgttgccggctggctggttccacgcctgaggggtgccacaggcaacggaggatacctgcagtacctcacgattccaggtgcattgtttcggtttgccacagccggacggcgcaggaatcggttcgtctcggagagccagagccgggtgggagctgggtttacccggatttga

SEQ ID NO: 5989 - DNA, 522 bp, Chlorella protothecoides
atgtccgagcatggcagagtagccctccggttgtatcgggagtttttgtccctgaacaagaggctacctgcacaacaggctcaagcaaacatagcacaagctcggtcaaaatttcgcgaggctgctgcgatgacagacgggggtgatcaggcggaagccctgaaggagctcgtcgccaagatcagcttcctgaggatcatggccccccggcttccccaggaccgttccatcacagccgccaaattcatattcagagatggagaggttgtggaaggcgaggccgagactcctggcctccggtgggtgctggcttgtgcaaatgggtgcacgtctgatgggtggccgggattgggggttttggccaacaacagcacccctcactggaccccatggactgcgccctcatgcagagtggcctccagccagtgctccatgccggagtttcgacagaagcatgctgagctgctgaagcgtcagtattttggacaggaaccgccgccctacgacccctccacattctag

SEQ ID NO: 5990 - DNA, 1533 bp, Chlorella protothecoides
  modified_base (564)..(573): a, c, t, g, unknown or other
  modified_base (696)..(877): a, c, t, g, unknown or other
cccagtggggcgacgcgcgctgcgtcgcatgtacgacgccctggtccaggactcgccgctgctgccgccgggggtgcggctggaggcggtgctggcgcggacgccgggcgcgcagcgcgccgcaatcctggggcccgccgcggccgacgcgccgtgcatgtccgcggcccagctcgtcgacgccgtgctgcggctgcacggccacctgcgcggcgccgtggggctcatgggcatcggcctgtctgcgccgcggggcgacaccgtggccgaggccaacgctgggatcgcgggcggcaaggaccagggggacgtcaggcgcttcctgaacaggatgctgtgcctgcatgtggcacagcagaacctgctgttcgactacttccaggccaccctggcagccgagatccgcagcgccaaggccgaaggtgctggggtgggatgagggaggggtgggctaggggcttgtggcacctgagaacaggctgcctcaactcgatctttacaaagctgatcagcgccaagctcgtcacctgcatccactcctctgtggtgtgtgccctcaaagannnnnnnnnngtgctggggtgggatgagggaggggtgggccaggggcttgtgggacctgagaacaggctgcctcaagtcgatgtggacaaagctgctcagcgcccagctcttcacatgcgtccactcctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtcgacccgctgagcacgctgagcacgatgcagcacgacctcagcgtggaccgaggcctcccctttgccgcggcgactgcccagctggcgcgggcgaccgacggcgcctctggcttcatggtctccaagcgaccctccttcggccgcacctcctacatcctggcgctgcagaaagcccgcacccctggcaccttttccatagcccggccaaacacgggtatgccttggagtgggggatgagagtggggagtgacatggatgctctccagatgagggtccatgccctgcccgagcctacacaatgcgccctggtgaagggttctagagggccaatggcaatttcgtgcccagtcgtcacgagtcaggggctggagggccctggcattcttcatgtgtgcccccttggatcttcatcccttccacccaaatgcgctccaggtgcctccttctttgacatggatctggacgaggtgcgggccaagtacctgccatgcgcacccgaggcggcagaggcggggggggagcagtggtaccaccagtcgctggaggtgtgcacacacggcccgacctgcaagcagggtgccgcatgcacggtgagcaaggaggacgagacgcgtcaaagggattttgttttgcttgggatgtcgtcttga

SEQ ID NO: 5991 - DNA, 252 bp, Chlorella protothecoides
atgtccctccatggcatcgccgcggtgcaggccttcaccctgcccgacctgtcctcgccccgcctgctggccggcggcgtgctccccctgcgcgccctggcgctgagcccctccggcgccacgctggcggtggcgggggacgaccccggcatccgcctgctggccgtcgggagcagcgccggaggaggcctgcatggaaacactgctggtctggcgtcagacggcttcgaggccccacaccctagaagctaa

SEQ ID NO: 5992 - DNA, 402 bp, Chlorella protothecoides
atgtcctcgagcttgtcgcccagcagccacgatcggcaggctagacccagtgcacagcacccagcttgcacaatcgccacggcccacagtgctccccttgatagccctccgcatccctctccccacctctccctgaccttcaccaaggctctgcccgatggggaggaggccctgtgcgtcgcctcgggcgacaccttcttcgcggcggccaccagcgcccgcctgctccgcattttctccctttccgggctgcagctgtgcgtgctctgcctggcggggccggcggtgaccctgacggccggcggcgacagcctggccgtcgtgtggcacgcccagcgcccagacgcagacggcacgcagcacctgcgatactcggtgcggcgcggacctgccctgcgatga

SEQ ID NO: 5993 - DNA, 501 bp, Chlorella protothecoides
atgcagggggagcctgcgcaggacgccgcgcccgtttccctccctgccttctactccaacgacacccccgcctcggccaacgagatgtggcagcgcttgcacgccgacccgctcttcgccatcaagcaccaggagcagagcgcccgacgctcgatcctggccaacccggtccagatgcaggccatcaaagcgcaggtggagacaggggtccaagcggggttgtgcctggatgtgcatgaacactctttcggccgagaactccatgcaccaagcatgacaagctgtgctcccatgtttgcgctccaccactcaggtcaggcagctgaagcccgagcacggcaaggacaagaagaaggagaagaaggagaagaagaagaagaagcacaagcggaatcgggagtcggaggacgaggccgaggagcggcgggaggtcgaggacgccaggcacccggcccaatctcccggggcgcctcagccgtggcgcggcgagggagtccctga

SEQ ID NO: 5994 - DNA, 270 bp, Chlorella protothecoides
atgtccggcattggcggcatgctcgtttcaggcatggccatggggacaggctctgccctcggtcatcgcgctgtggatgccgtactcggctcccggcacccggagcccgctgcggcgacagaggccgcccagcagctcgtggcagagaaggctccctgctccgagcaagccaaggcctttgcagactgcatgagctgggccagcggcgacatgggggcttgccagcagtattttgatgccatgcagcagtgccgcctgaatgttgcttga

SEQ ID NO: 5995 - DNA, 453 bp, Chlorella protothecoides
atgcgccctctagcacccatgcatgagccaccctccctaccccctcctccacagattgggcggcggaggactccggtgacggtgctgacggggtccattgtccgcatctgggactgcctggaaagggtgctgacgcggcacgaggctgagctgtcgcgcagcgaccgggtgatgaggatcgtcagggtggacctgggggacggctccctccccatcattgcgcagggagggcttggcgccgggtccttcctgctgggccaggccgggtacggcgtggaggttggtatcggctccaggcgtccgctaccccggcttcctcctgccagaggtggtcatgttgctggcggtggagcagcagatgggagcagcggggaggggcagggcggtcagttctctcacgacacagcgccgagtggaggccgtggacccagtcgtgccacggctgctcagtaa

SEQ ID NO: 5996 - DNA, 900 bp, Chlorella protothecoides
atgaggagcgcaggtgcgcgggagggtggggttggggttggggctgggggcgcttgcattgtcgatgcatgcaggaagccgggaacagctgttgccccatggctgccagatggatgtgaggaggcgggccagatggggcatgccgggctaccccatgcacaccgctcccacgcccgggctcccccgcgcagtgcccgggccgaggcgacgcagcgccacctggcggaggcggcgaggcggcgggaggaggaggagcgcgcggctgccgccacgcgtggccagcgcgcgacgtaccggccgggccggctgagtgccgaggagcaggcggcgcggctgtcggccatggcgcatgcggcagaggcccacgaggacgagcgggtggtgcgcgtgcgatcccagaccgtgcgggaggcagcggaaggtgaggttacgagcgggcaggaaatgggcgcgaggcgggactctgatcgatcagctgcgaccctctcgagggtgctcgggactgagatcagcatagagtgggttgctgacttcagggtgcatcctcatgtcacgcaccagcccatcactttcctcacagcaattcccaaccacccccgagaacctgcagagagggaggcgggcctgagggctgcggggacgacagcgagcttcgtcgagtctgcgcagaagggagtttacggcgccgaggggggtttgggcgcgtccgggaatgggtcgttggctgaggccgtgaaccgccggaagcacttcaaccagcgaggatcggcggccggcggcgcggcattcaggaggggaagactgcacggggtctcggagcggagtgcacacccacgcggcttcagagaaatggatgtccatccgtgtgcgggaacccaatgttgcgccgagccaggctga

SEQ ID NO: 5997 - DNA, 276 bp, Chlorella protothecoides
atggcgttcctgaacaagaagacctggcacccgggccgggtgcagaacatggaggaggtctggaaacgggagcaggtggcttccaaggaggagcagaaagtgagggacctgcagaaacagatcgcggaggagagggcccgggaggagctgcactccatggcacaggcagctggggtgaaagcgaaacgatcgactggactggatgtaccagggcggcgtcatggccaagaaagaggccgactcgcgggtcgcgactcagggagttggcccgggtga

SEQ ID NO: 5998 - DNA, 501 bp, Chlorella protothecoides
atgcatgagccggggcccagtgctcccttcacggctcgcacacgcgcacatcgtgacctcccttcacacacctcacacttcctgcaccagggtatgctgcagcgcctcctgcgccagcgccagcgcccgtgccagcagcgccgccagcagccggcgccttctcctttgccggcggggacccctcaggcagaagccggtccctcctcatcgtcagaggaggaggaagagcaggtgctgcacatctccggcacccctgcggccgccccagccccagctgcagcagagaccagcagcagcagcgaggaggagtcgtcctcttcgtcatctgacgaggaggaggccacgcctgtcacgtccgcggcagcaggcggggcgcaggatggggagtacgtgcctcggcgcgtctacgtcggcggcatgccctaccgcttcacggaggcagaggtgcgagaggtgttgcttgttgagggttggaggatgcgtcagagacatgtagagtga

SEQ ID NO: 5999 - DNA, 585 bp, Chlorella protothecoides
atggccatcatcctattgcaggaggaggcataccaggcagccttgggctacgacggcgaggactgcgagggccagcgggtcaaggtccagcggtgcaaggcgccgacctccgtgcgccgccaggccgcgccggcaattgccgcgccgaccgccgcggcgcctgcggccgcgatcccacccacccaggccggggcctcccctgcgccgccggccgccgatgccaggggctccgcgccaaagacccctggctaccacgtggcgtacgtgggcaacgtggcctacgatgctgacgaggcgacgctgcagaagctgttcgagcccttcaacgtcacgctggtgcgcctgcacaccgacaaggagaccgggcggcccaagggctttgcccacgtgcacttcaggcgaggcgggcatgggggagtaccgtggcagggacgtcgagatggttctgtgactagggaggtttggatggaaggggacgaggcctcgctggatggggcactccagctgaacggcacgcagctcatgggccgggccatcaaggtcggctatgcccaggccaagaagaaccacaacggtggcgcttga

SEQ ID NO: 6000 - DNA, 591 bp, Chlorella protothecoides
atggcgccgcactttgacctgccgtcctttggtgtcggcatccttgcgcagacggccctgctcctggtgggcagagccatcctgtccagtctcaagacgtcggcaagatttcgagcggacaatacgccccacccatctggcctcaaggtggtgatcacaggcggcacgcgaggtcttggcctggccctggcccgccagttcctggcgctgggggatgacgtggtcatctgcagccggcatgccgaggccgtggagcgcacggtctcggccctgcgagacgccttcccgggcgccgtcgtggcgggggtcgcctgcgacgtgtcggtgccagaggacgtggaccgcctgggggctgaggcgcaggagaccctgggtggcatagacatctgggtcgccaacgccgcactgcgcggcctggcgagggcagacctggtgcacaccagccccggggacatccaggccatcgccatcgtgggggccaacctgactggcagcctcctctgcgcacgcaccgctctcaagatcatgagcgagtctgggtgcaaaggaaaagtgtgtgccggctggctggctaggacgggctctgagtga

SEQ ID NO: 6001 - DNA, 1146 bp, Chlorella protothecoides
  modified_base (307)..(316): a, c, t, g, unknown or other
  modified_base (758)..(767): a, c, t, g, unknown or other
  modified_base (1033)..(1042): a, c, t, g, unknown or other
atggtgctcaccccgaaatttacccccccttcccccccctttcttgttgcgcagaaggtgtacagagacccggcctccgtggacgacgagctggtccagatgctgtacgccccctcctgccagccaggggcgctggaggcctttgtgtccatcatgagcgggccgccggggccccagcccaagcaccttgtcccggacattgggtgcggcggggaaagggggggtgttgaggagatcaaggactgtcgggtgacactgcaccgcgtcgatctttcctcgtcgcaaggcacgaaggatttgcgccgcnnnnnnnnnnaaacggggggggggggagggggggtaggagatcaaggactgttgggtgacactgcaccgcgtcgatccttcctcgtcgcaaggcacgaagattttgccccttgccctctcgcctcaccacctggctcccccccatgccctcagctgccccttgctggtgttctggggcacagcagaccctttcaccccgctggcggggccggtgggcaggtacttccaggccctcccctcgctgcgaccgggcacgcgcttcgtgggcgtgccgggcgcaggacattgcccccacgacgagacgccgcaggccgtgctggcggagctgctgccctggctggaaatcgtgaaggccacgacccaggctgtggcctgaggaaggtcaagtctgattgtcaggcagcctggcaggccatccagcctggtagtgggcagctgggacctagggggcnnnnnnnnnntgaaggccacgacccaggctgtggcctgagcaagttcgagtcttattgtcagccagcctggcaggccatccagcatggtagtgggcagctgggacctaggggggaaggccttcttgacccagacccctggggtccttccttgacactccaaccactctcactgtgcatcgtcgtggaaaagctcgcagaaatggtacaaggccagcacaaggaggttgaggatgggagagcggcacaggagccccacgcatgcctccttgccaacnnnnnnnnnngacccagacccctggggtccttccttgacattccaaccactcacactgtgcatcgtcctggaaaagctcgcagaaatggtacaaggtcagcacaaggatgttga

SEQ ID NO: 6002 - DNA, 492 bp, Chlorella protothecoides
  modified_base (323)..(332): a, c, t, g, unknown or other
atgatgccgggcggcatgatgccgggcgccatgctgccgggccagggcggcatgatgccgggcgccatgctgccgggccagggcggcatgatgcctggcgcaatgatgccgggccagggcggcatgatgcccgggcatcccatgatgatgggagggtttggccctggacccatgatgtccacggcgggaggtgaggaggggagttttctgtgcatcgccgctcatgcaacgtgccagaggaggatgccctggatccataccatggagctgttccccacactgaatgaacggagactcaggggttccttccttccgactcagcnnnnnnnnnnttgccagaggaggatgccctggatccatgccatggagctgttccccacactgactgaacagggactcaggggttccttccttccgactcagcaggcacggaagcggcaaaccccggcggctcggggcgcggggccggcgaggcctccccggcggcactga

SEQ ID NO: 6003 - DNA, 1380 bp, Chlorella protothecoides
  modified_base (1306)..(1315): a, c, t, g, unknown or other
atggctaattctcaggggagaggagctgtgcagccggctgtactgcttctctcatgtccaaccccgcctctcgtgcatcttgggaatggtgaggttcttgtgccagcggccgtgccgttcaaccctcctcgttctcatttgggacatcttccctccacctgcgcagtggttttacaggttccacctggtctgcttcctgggcttcatggtgttggcctgcatgcactactccggatcgtggcgctacttcacccctggtctgcttgcggaattgctccccaagtgggaggacacattcacagccccctccctccccacataggcctcctcctctggggcgtggacctgctgcagcgcgcctcgaccagctccgccaatgtcgccatccactccgttcacctggatgaggagaaggacgtgaccactctggtcctccaacacgcacgggtgggtctcacctggtggagaggggcggttgctggaaagggcggccttttctcttgggaggcgcatcctggctgccccctgggcgacatccacctcctcgtccccgccatctcccgctgggcctggcacccattcaccatcgccgcctcgaccccggcccagccctccgcgccagggactctcaccctgcacgtgaagaatgaggggacatggaccaaggatggaagcagcgccggatcgcgcctgccttgggaggtcaccgggtctaccaagcgcggtcaagcttctaccagcctggattccgcaagtcctcaccagctccctgccgccctgacatccccatccccacccacttctattcacaaccaaccatgtcatcccgcagaggctggcggacctgctgctggcccggccggacgccgccatccgcgccaccctgccccagcaggtgttccctcctcacgagccctggaccggggacgaagccgtggctgtggtggtgggcggcatcggggtcacggccgtcatgctctccctgcgccggatggtagagaggagggcggcgggggcgctggccacccgccgcgtcgctgtcctctgggctgcccgccacgcctcggagttcctgaccctggacgccgcggtcgccgctgctgcaacgtgggtgccgaggaaggacggcggggaatgggttccaggtcggctgagggcagtcgtggaggccctggccaccggtgcagcctcacatctgctgcatggggctcgggacccgcacccctgcacgctgcccgcggccgggtatcaagggagccagccgggctccacgttgcgctcttcccattcctggccccagtcaatnnnnnnnnnnagtcgccgctgctgcaatgtgggtgccgaggaaggacggcggggaacgggttccaagtcggctga

SEQ ID NO: 6004 - DNA, 717 bp, Chlorella protothecoides
atgcaggccggcctctgcaccctgcagggaggcctgcccggccccactgcacgaggagggtcgctacacatgctgcgtcctcctcagctgacggcgatggcccccctccgcagccgccctcgaccatcttgcgcagcttgcaaggtctggctgggaggggaggtgccctctgcgcccgggccccctccctccaatccccttcccctcctcgcccttccaggcctcctgcaccagcccgtgccagggttcccaggggcctcgctggcggcgctgctggaccgagtgctggccctggcggcccgcgtcgccagggcctgcactctggccctggccctactggccgccgcctgcctccccgcgcagctctgggcgcggcccgcactgcaggcgcgcctgctccccgtggccggccaggccgccacgcggctgctggggcgggattgtgaccccggcgccctgcaggccctgctgcccacggggttggtgggcctggggccgctggcgcgcctggggccactcaggctggggccgggggccacggaggggagcagcgcggcgatcgagagcctggacgtgcacctggacgcgctacgcacgctgcgcgagcggcgccccgtcctggggctgcgactgagaggggcgcaggtgaggtggattggctgggggtggcgcttgttcatactcttgtcagagggggtgggggccgtgggcgggtga

SEQ ID NO: 6005 - DNA, 903 bp, Chlorella protothecoides
atggacgaggcgtcgacctctgccgaggagcaggagcggcactccagcatctccagcctgaccaccgaggagtggaggaagaggtgcggtcggtgtcaggccggtgcccagcgacccgacagcagcgtccctatcaggaatgagcggaatggctatgtggacctctgggtggaggacgagttcaactctgggtcccgcctcgtgtgtcgatgtccacccgtttcctcccttactacccccacctccctcccctcgcgcgccgctcagggtggccgcgcggcgcatctgggcctgccggcgggactgggttctggggagggcccctctgtcagcaaggcgccccgccactctgtcaagatccacaaccactacgccgatcaggaggtggaagtggaggtgccggaggacaggtgcggcggcggccaggggcgcatgaggggaaggccagcgtgcgatgctagcggcaggctgcatcgttcagaccccactgctgtgctccacgttccctcccccgcccccaacagatacatcctgtacgaggccgagagtcaggggctggagctgccctacgcatgccgcatgggctgctgcaccgcgtgtgcggtcaaggtggagagcggggagctgtaccagccccagtcgctgggcatcagccagggcctgaaggaccaggcgaggccgggtggtggcggggcgcctgtgcactctgggcttgcaggcgttggctacgcgctcatgtgtgtgggctacccgcgctccgacctggtgctcagcaccgtgcccgaggacgaggtgtacgacctgcagtttggccgcgctttccaggagcaagccaccgacctggactcgggcagcatcctgcgcgacgactttgccatcgagctggccctgggcgacgagtga

SEQ ID NO: 6006 - DNA, 462 bp, Chlorella protothecoides
atgccggggcccaaccagctgcacgtggcccgccaggacgtggtggccgaccccgccgccctcctggccgtgccctcggggccccgcacgctggccacgctgcgcaacaacgtcgaggtcagcattcgctacctggccgcctggctgggcggcaacggctgcgtccccatccacgacctgatggaggacgccgcgaccgcggagatcagccgcgcccaggtctggcagtggctgcggtggggggccacgctggagaacggcgcgccgctgaccgccgccgacgtgcgcgaggcggtggacgaggagtttgccgcgctggaggcgcggctggggcgccacgccgtggccgcgggggagtacctggacgccgccttcctcaccaagatgatgacctgcggtcgcgagctgcacgacttcctgaccctgccggcccaggacatcctgctggccatgggcaactag

SEQ ID NO: 6007 - DNA, 387 bp, Chlorella protothecoides
atggactggtgcatagaattacatggcaagatgaacaaggacaagatactgaagctcgcaaagggcttccgcggcaggagcaagaactgtatacgggtagctagggagcgtgtggagaagagcctgcagtatgccttccgggacaggaaggccaagaagagggacatgcgcgctctctggatccagcaaataaacgctggtgcccgacaatatggggtcaagtattcctcgctcatcagcgggctggctgctcagaacgtgggcctgaaccgcaagatgctgtccgagcttgccaggacggagcccttctccttcaaggccctggtggaccaggtggctcacatgcggggcctgtctgcccctcatgccggcgccgcacttaagtga

SEQ ID NO: 6008 - DNA, 528 bp, Chlorella protothecoides
atgggttccgtcgagcatctgcagcgggcccaccctccaaacccatccatctccctgcacaggaatgtggtgtcgtatgccgatggcccgaggggcaactcgacagggcgcctgctgttctatctcaccaccctggatgcaacagcatatgacgcgcaagccaacgcttcggccatgctgacggtgtccgaggcgcagctgccgggcagctgccgtgggctggatgcggaggaccccccttgcgccaagatctccatcttgggggagcttcaccgtgtacctgcgtccgaggagggagctgcacggctttgcctgtgtggcgctcccctggactatttgaagaaggaatggtatccccaaaacctgtgccgcaggaccttctctttcccaggcacccagccatgcaggattggcctgctggccacgaatttcacatgtgagtgcgatgtatggcagaccggccatgcaatgtgcgcagcctgcgacatgtgcggaggcccgtccgctccttcaatcctgggtagctga

SEQ ID NO: 6009 - DNA, 1338 bp, Chlorella protothecoides
  modified_base (218)..(227): a, c, t, g, unknown or other
atggctgcatgcttcaccatttaccagagcacatcaattctcaaggtaaagctccgatccagctcgctacgggaatcgcatctcgagcatactgccgtaaggtgtcctgaagagcctaacacgacactgagcttctcccagaacgtaaaatgggcggaggcactaccgccctgcgcgagggagaagcgcctacagcacccgccaccaatgacggcaannnnnnnnnngcagggaggcactaccgccctgcgcgagggggaagcgccaacagcacacgccaccaatgacggcagcacccagagaacacccccaaacgggttttcctcgagtcaagaacctcgccgacgatccgcggccgagggcggtgcggccagccactccaatttcccatctcggtcggatgtgctgtcggccgtggcatccacaacacttgtgctcgcactgacgggccaagccttgcgcatggtcgctcccattgcctctcccgccgtgtggctgggtcatgcggatgcgctccagcactacctgagccaaggtgcagcaggagagagagggggggggggggatctttcgagtccacatgtgtctggtcatgtgctgaggatggagcaggaatggcactgctgcatggggaaatccgccagcattctgcaggcgcctaatgagcagctccactccatcgccagctcaggcgtcagctccccctcccttgctctggatgccggtgtggtggcgggtgtgagtgccgccagatggtgcctgatggccctcgtttccggcttcaaggcctcttccaatgccagtaagcatgctcaagtggatgcacttggtcgcttgcgcaaacgggcagtgaccgttgacgacacagaaacaaggtgcccctcagtggatatcgcgacacgtcgaccacccaatctcctcccacccacaaaggcgctgagtgcctgctcccccctggacgtcgtttgggttggggccattcccggcgctgcagaggagtggtgcttcaggggaggcctactgcccgccatatccccggattggtgcgaggggggatgcactggtacatggggccagtgtcagcttcagtggacctgccagctcggccagcgaggcgcagccgtcactgccatcgtgtttgggctgctgcatcttctggatcgcaggcggacccccgtgtcggccgcctgggcgacgggcgtgggtgccgcgtacggcgcgctctacctccacaccgggaacgtggcggatgccgcgctcgcgcacgcgctgtccaatgtcgtgtctggcctgggctacaagttggggggcacccaggccccggatacaccgtcgtaa

SEQ ID NO: 6010 - DNA, 1596 bp, Chlorella protothecoides
  modified_base (56)..(65): a, c, t, g, unknown or other
  modified_base (713)..(722): a, c, t, g, unknown or other
  modified_base (1161)..(1170): a, c, t, g, unknown or other
atggaggagcgtaggatcgcctccctcgaagtgcaggagggccgtggatacgtctnnnnnnnnnntggtcggtggggtagcaggaggctcgacctaaacggcagagcaaggctggacaatgttgcgtgcatgcctcccgctggccctctccaacatgctttcctgcacccattctacccagggttcaagcagcagaacgctgtgcatgggcttcccctggagctaagtcctgaggaggtgaccctcgcacttgagaaagagtgggtgcggctgcagccggtgctcaggaccagtgctgcggcagcggacgccgccagcgccgcacttgcgaggaagcgggcgcatgagagcgagagtgacggcagcgacgaagaggccgggccacgggctgtggagggcagcagcgaggcgcctgcctggagggaggcactggcccgcggatcgcacttttgcattcccacccgcgcagcggcgcgtgaccccggtgaggccatgcccgtcctgcccgcttggaccttcccagcgacgccaggggagcggcagcggtatgcggtattcaaagacctgctgtcgcggggggacgatggaaagcttgtaccttccaggcgcaagaccagcctgtctccccaggccagagctcaggggcacaaccagcctgtctccccaggccagagctcagggccagggctgggaactgattgcggtaggtgttnnnnnnnnnngcatccaaaccccgctcccccttgcagcttccgtgtgacggggggttccaagtttggagcagactacctgctgcgtgccgtgcctcccaccaggcccgaaagcacctgctcgtcgcgtcgctgctggacggcgggaaggtcagctacaccacctttggacccgtggacggttttggctgagaggcaggcacatacaggacaagacctcattgtggggacccctggtaacactgtcttggtgaatggccaacatggccagcttgttacattgaaacaagggcatgaggtcacatggcattccaccccgccagttcaacggctcccagcgcgagtctcggagttttgcaagggggcagtggccgctagggggcacgtgcatggtcaggggagtgaagccgcaacttcattcgagtctgctcggccacgtgtgaccaagaannnnnnnnnnctacctcaaggcaccggggccctgcagcccagccccgtcggccctcaggggtattgcaagaagtccgcagcaggtcgtgcgggtgcacgccttctcggaatagcggaatgggtgatgggggtcgacgaaatcagactggggccacatcatgggcgggagcacaggcccttactcgccatggtgccgccggcgcttagagtcgtcgcggtgacgccgctcccgtgcttcccggctgcggctccttcgccgctccctgctctccctccgctcccgcgcgtgcccgccgtccggctgtgcgcggtcgcttccctccgcctgcgggtacaggcgagggaattggtcgatgtgcaggcaccatggagtagagcaggggtggaacgcgtccctttccagagcacaggggggtgctcgcgccaccaaagttga

SEQ ID NO: 6011 - DNA, 1560 bp, Chlorella protothecoides
  modified_base (51)..(60): a, c, t, g, unknown or other
  modified_base (456)..(465): a, c, t, g, unknown or other
  modified_base (563)..(572): a, c, t, g, unknown or other
  modified_base (621)..(630): a, c, t, g, unknown or other
  modified_base (832)..(841): a, c, t, g, unknown or other
atgctccccacgcccgcccatgtccagctctcacctccccgccggggagcnnnnnnnnnnaggggattgtgttggagagtggcgaggaggatcagggcacgcaggtccgaagccggggcaagcgtgtgtgccgtcgtgccacccaggtggaaacgtacggcgggccgcccatcaccccgcattcacccctccccaggtttggaaaggcttgccgacgccgtcggccatgctccccacgcccgcccctgtccagctctcacctccccgccggggagcggtcctcgcgccgcgctggcaggggcgagcgtgcgcgccgcgccggggccgggctgcggctgcggctgtaccgcggcgaggcgcggccccggcggccagcgctgcgtgagcgggagcgcgagcgcgagcggggacgtggccggcggtcgcgggacgggtccctgcccctcctgtcctcgnnnnnnnnnnccggccccggcggccagcgctgtgcgagcgggagcgcgagcgggagcgggggcctggccggcggtcacgggacgggtccctgcccctcctgtcctcgnnnnnnnnnncgacggcgggcgcgtcccagcctcgcatcccacccaagatcagtggacnnnnnnnnnnccgtacggcgccctgtcgcgagagtcgcgccccctgcatcaggcgtgggcaggtggtgcggccaggtgcggcgtgcatcgcaagcggggagtgaggcacgacatccaggctgatcaacatgctgaggaagaagcggaatcaccagacagacggccagccccgactcacccagccggggagaaggagcggcctgcgctcgagnnnnnnnnnntgcccaccctccccacccctcgcgacaggcgggaatggggccgcatgcgccgcaggctgagggccgagttctccaagaccgacgtcaacgtgaaggtcagggaggagcggcggagggaggctgcgatccccaacaccacgctcttcgtggcgggcttcgatccccgcaccatccgcacacgggacctggagcgtgcctttgagccctttggcagggtgaaggtgaagctgagaggctgcagggctgctttgccggctgcctgtgcagggggggcctggtggcagcgccctccgcgcctggaggggaacagtctggggtcgatgtgccacccacctcactcccttgcctgccctccccccgctccacctccagcgctgccaaataaagaagagcttctgctttgtgggcttgcgatgtcgatcctggtgcaagggttgcagaaccttagctcagctgtgatgcggtgtcaacacttgcgccccctttccacccagccgaacatcgatccccacttctcccttgctagaatccaagcatgcagcctcattcactcccatgtgcagtggagttctgcgtcaaggactcgagcgcaggccgctccttctccccggccgggtgagtcggggctggccgtctgcctggtggttccgcttcttcctcagcatgtcgaccggcctggatgtcgtgccccactccccgcttgcgatgcacgccgcacc

SEQ ID NO: 6012 - DNA, 858 bp, Chlorella protothecoides
atgtcccccaactcacctgtctccctccctccctcctcaccccggccccaggtgacctccatcgccgccttctggctggccgccaagctggaggaggtggtggagatcgatcgcccggaccgcctgcgcctgcgcgatgtgctcaccaccttccaccgcctgctggcacgcgccgccggctctcccgtccccgccccgctggacccccactccgcgcgctacgcggagctcaaggcggcggtagtgcgcgacgagcgccacctgctgcgcgcgctgggcttcgtcatcggcgccgagcaaccgcaccgcttcgtgctgaactacggcgcgctggtgctgggcgcagggacgcgcgtgcagcaggaggcctggaacctggccaacgactcgctgcacaccacgctgtgcctcacgctgcgccccgaggtcgtggcctgcggcatcctcttcctggccgcgcgccggctgggcatcccgctgccggaggcgccgccctggtggcagccactgggcgccaccacgcagcaggtgcacgcggtggccgccgcactgtgccagctctacgccaagcccccggcccagtatacagacgtcagggcgcgggggagcggggggcctgcaaggggtgcggcggcgggtggcgcggacgcggaggagggtctggagacggacgctggcgtcgggaagggcgccggcgtggaggcggcggctgccgccatcgacgccgtgaccctggagcaggggcccgggagcgcgtcacgggacgcgcgtacagacacggccagacgccgacaggtgtgctggggtgggtgccgcatgctcccacactgcaccaccctgagctgtgatgaccaatga

SEQ ID NO: 6013 - DNA, 477 bp, Chlorella protothecoides
atgggtagggaaggtgcctgccccatcctcacctccccctccctcccctccaacccacctcgcagggacacggcggggcaggagcggtaccactccctggcgcccatgtactaccgcggcgccgcctcggcggtagtggtcttcgacaccacgctggccagctccttcgaacgcgccaagaagtgggtacacgagctgcgccagaacgtagccaaccccgacctcatcatcgcgctggtggggaacaaggtggacctggtggacgcgcgcgctgtggccgaggccgacgcgcgcaactacgctgctgagaccagcctgctctactacgagtccagcgccaagaccaatgtgaacgtggtggaggtgtttgaggacattgcggaccgcctgccgcgcgccgccgcagccgccgcgcccgctggcatccagctggacgagcagccggccgtggcgcccaggagagcgggctgttgctga

SEQ ID NO: 6014 - DNA, 567 bp, Chlorella protothecoides
atggcacgcctggtgcgcgccctggtgctcagcaccctgctttcactggcggcagctgcaaacccggctccctactacatctcggccgaggtcgtcctctttgactcaggcagctccgacatctgtggcacatcgcacggcgcctcggagaccttcaccacggcggccgtgggcagctcgtattacatgggcctgtacaagggctatactgacgagaccttcacggaggagctgcagaggccggcagctgaggctcacttgggcatgctggggctgttgcgtgcggccatgcaacctgggcactccagccactggccatccccgctcccctccacaggccccatcatcagcgcgcgcgtgggagacaatgtcaccatcgtgttccggaacaccctggacttcgacgttaacctcgtgcccaccggcttctcgcccatcgtcggggatgattccgacttcctggaccccgtaccgtccaacaccaccgtcaccctcaccttcaccatcccccaagaagctggtcccaccgcctacgagccggacacaaagctctggctgtacaagtga

SEQ ID NO: 6015 - DNA, 1911 bp, Chlorella protothecoides
atgcggggccggacggcggagtcctttgggctgagccccaccgagctgctggagacccagacccaccactccatcaacggcctgctgtactgcgcggtgaagaacgtgagcatggtgcagggcgagacggtgcgctggcacgcggcggccatcggctccgacctggacctgcacaacgtgcactggcacggcaacaccatcacggtgcacggccagcgcgccgacatcatcaagatgatccccggctccacctactccctggccatggaggctcgctcccccggcacctggatgttccactgccacatcaatgaccacttcaacggcggcatgatcgtgctgtacgaggtggcgcccaacgcgacgacccaggcgctgctgaccgcgcagctggacggggcgacgcgcgagtactacgtgcaggcggagcaggacatctgggactacgcgccgcacggcgcctacatgtgcggcgggtcggcggagaatttcaccgccgaccagctgacgtacgtgggcaacttcagcgaccgcatcgggagccggtacgtcaagggcctgtaccgcctgtacaccgacgacacctacacgcagcgcgtgccgcgcgccgcggccgacgagtacctgggcctgctggggcccatcatgaaggcggaggtgggggacatcctgcgcgtgcacttcaagaacacgctgcccttcccggtgtccatgcacccgcacggcgtgtggtacgacaagtccaacgaggggacgccctacaacgacgggacgagcgccgaggagaagcgggacgacgcggtggagaccggccagaccttcacctacacctggaacgtgcccgacatcgcgggccccggccccgccgacctctccaccaaggcctggctctaccactcgcacaccgtggaggacgccgacacctacgcgggcctggtgggcgcgctgatcatcggcgagcgcggcgcctttggccccgacatggtcccgctggacgtggacgcggaggtggtgctctacttcagcgtcatgaacgagcagggcagcctgttcctggacgccaacatgcagctgttcctggccgacgccgactggaccgtgctgctgaacgacacccaggtgacggagcaggcggagggcggcgagtcctcccccgccggcgcgtttgccgagtccaacctcatgcactccatcaacggcttcatgtactgcaacggcccgcacattcccatcgcgcgcgacggcgtcacccgcgtccacatcatctccatcggcaccgagcccgacgtgcacgcgcccaacttccagcgccagaacctgctggccgacggccgcgccgcgccctccgtcaccgccatgcccggcaccatgcagtccctggacgtggtcgcgcacggctccggctccagcctgctcacctgccgcaccgtggaccacatcaacgccggcatgatggcgctgtacgacgtggtgggggacgtcgccgacccccccgccgccgaggccgccaagacctactacgtccaggccgagaccctggtctggaactacgtgcccctgggcctcgacggctgcacgggcgaggcgttcgacgagaacgccaagcagtacgtggcgcacaccaacgtgtccatcgggcccgaggccatcaaggccgtctaccgccagtacacggggccggactttgccacgcgcgtggaagcccccgccaccgccggcctgctggggcccacgctgttcgcagaggtgggccagacctttgccgtcgtcttccgcaacgccctggacatggatgtcaacctggccttcgacgccggcctgatcccgctgtccaacgccagcgaccccgcctccacccccgtcgcgcccaatgccacccacctatacaccttcctcgtgccttccacgtga

SEQ ID NO: 6016 - DNA, 246 bp, Chlorella protothecoides
atgatttacacctctctggacaacttctacctcacccccgaggaggtcgaggcgtccccttcccgtgccgatggcgtggatgcggctacggaggatcagctgcgccgcttcgggtgcggcatgctgcagcgggccgtggtcctgctgggcctgccccaaggcgtggcggttacagcccaggtgctcctccaccgcttctactgccgacgctcgctgaagaagtttgacgtcaaggttggtttctaa

SEQ ID NO: 6017 - DNA, 1569 bp, Chlorella protothecoides
  modified_base (345)..(354): a, c, t, g, unknown or other
  modified_base (431)..(440): a, c, t, g, unknown or other
  modified_base (527)..(536): a, c, t, g, unknown or other
atgctgctggaggcgcatcccaagcacactgccctgctcgagcaggaggccaccgcgcagagcctcatcaatcaatatgacgacctagacctggtgtctcccgacacaatccaagcgctcaaagcatccatagatgccgtcatgtcgcagagcaggcaggccatgcgtgatctcgagctcgtcagcgaggaaggcagcgggcagagggtgcgtggtgcaaggtcgatgaacacacttcctagccaggagtcgggtcacagcgccaggggcatgtcatccatgcggttttcggcaagcacactcgcttcctgcagggtatgggtgtgcactggtccaccagacgtnnnnnnnnnngcaagcacactcgcttcctgcagggtatggtcgtgcactgttccaccagacactcttcaccccttcacctggaactnnnnnnnnnngcacaaggccacccacgaggccctgcagaacgcgctgaccgccgccgcgcagcgccgacgagcggccctggcggcgtccggcgcctnnnnnnnnnngccctccacctgccgcatccccactcccagggaggccgaggcccagagcaatgctggcctcatcacccggcacaaggccacccacgaggccctgcagaatgcgctgaccgccgccgcgcagcgccgtcgagcggctctggcggcgtccggcgccgcccagcgacgcgagctgctgggcgcggcctcggcccagggactctcggctgccgccgcggcgcagcgggccgcggcggcctccccccgtctggccacctcccagaacgtgacccaggggctgaagcgggctcgccaggtgctggcggaggagctgcagcacacgtctgccacgttggccgccctggactccagccacggccagctgcgcggggcgagagacgagtacgtcggccaggcgcccctgctcaagagatcgcggcgcctgctgcgcaccatcaactggcagagcaacctggtgcgggacattctgctcacatggagggggacgggatcctgcgacaaccggaggaaaggcgctacccatgatgctgcccatgtacgcgccttccagcagtgcaagcccccatcccaacaaacctcccatcaggacaacatcctcctgtggaccggcgtcatcatttttggtgccgtggccttatacatcgtccagaagcgtgtgtcctactttgtccccgggtcgctgaagccaggaaacgtcctcgcgctgctgaggcacagggccggtgctggtagaccagggccgggggcacaacccctcactcaggcgagactggcggaggaccctggtcctgggatgccgaccggcctcactgacgtgaacagcatagggagaccggcccagcaggtaatcttctcagacggatcggcccctctggtcaagcaggcgcgggagcaaatccaggagcctgggcttccggctgcctccccagctgtagccagggaggaggtcaggagggccacccaggttggcccagctgtccaaaacccctctcttgaccgtcaggcacctacatggcaagagcatgccgagctatag

SEQ ID NO: 6018 - DNA, 528 bp, Chlorella protothecoides
  modified_base (34)..(43): a, c, t, g, unknown or other
atgccctcccttcacaggtcacctaccatggccnnnnnnnnnngggtcacctaccatggcctgcagaccatcttccagcacctccacctgacccgtggcctgccggctgccgatgccgcggccccggccggcgcggccgggggttacggtgccgcggcaggacccctgcccggcgcaaacgcagtggctgggctgaccccggtcctgaacgacgtcctgggcctcttccatgccgtaggcgggcagaacgagaacggcgccagcatctcagatgtgagcattggggtggcgagggggtatgatgccaggttggggctgattgaggagtttcctccaaacggcacgctcttgatcttcgctgccacaagcgcgttctggtcccatttgtctttcatccaggtggtggcgcggagtggcgggcgctacaccgtgcagcagatccaagacgcggtggaagccctgcagaacgacgggcagctgtactccaccaaagatgaccagcactacaagccctgcaacgccctctga

SEQ ID NO: 6019 - DNA, 747 bp, Chlorella protothecoides
  modified_base (558)..(567): a, c, t, g, unknown or other
atgaaggttggcttctcggggggtctggtggtggacttcccgcacagtacacgtgccaagaagtacttcctggtcctgctggtaggtcaagtgcctggtgcagaggcattctgtagatgccagttggttctaatgccgacttggggtggcacatcccgtcgccaatgtccatattccccccttgtcccatctcatgtgcaggtggggggccacgctgcgctccctgcgtcccgtgggatggacggtgaggatccgagcgacgaggaggaggcctacggcgcggtccaggttggccagcggcggaccaagcggcgcaagggcgggaaggcggggaagggcgtggagtggatcgtgaagaagaaggcgcagcagcgggggcggggccacgagaacatcaagccggacacaaagtacaccgggcggaagcgcaaggcttgtgcaaaccgctgtgcatggcctctgggggccatcccatctctactcctatgccagctcctgggacctgatcttgccatcactgtcatgctctcatgcaaactggcctgttgttatccagtnnnnnnnnnngcttgtgcaaaccgctgtgcatggcctctgttggccatcccatctctactcctatgccagcttttgggacctgatcttgccatcactatcatgctctcatgcaaactggcctattgttatccagtcacgcctcagaggcagcatccaatggagggtgtctgtactctcgtgacggtgtga

SEQ ID NO: 6020 - DNA, 438 bp, Chlorella protothecoides
atgtctcgtctggctaggtcaatctccagactgttggtccctcccctgtcatggagggaccgtgcttggtgtcccactttgcttctaggggctctccacagcaaggcagcctttcacctgcatgaatgcaccttctcctttcttcatacacagggtatggacatcagcccttcaatgctggggattgcacgggaaagggaagtggagggggacatctgcctccaggatctcggccacggactgcctctaaggcccggcatgtttgacggcgccatcagcatctctgccgtgcagtggctctgcaatgcgaggcgaaaatgggcatccctcccctgcacaattgagcatccatgcctcctaggagctgcctgttcagcacacccctccccttcgtcccctcacaggatcgcagctcccatgaccctcgcaagcggatga

SEQ ID NO: 6021 - DNA, 273 bp, Chlorella protothecoides
atgggtcgctccgaccggcccgagctcacggcaccgccggacgtgttctacaatgaggaggaggccaggaagtacacagacaatactcgcatggtcaacattcaaacacagctgacgcaaagagccctggaattgctggcgctgcccgatgatggcaggcccaagtacctcctggatctgggttgcggctcgggactgagtggggagacgctgaccgatgccggccatgtctggctggtgagagggtgctggagtaccagcctctggatttga

SEQ ID NO: 6022 - DNA, 378 bp, Chlorella protothecoides
atgacgacattctacggagcagggaacggtggattcgatgcctccgcctcgcagtttgcgggcggtggcttcatgcccaggtggggctgtgagctgggcttgcgcttggatttgaatgccgggcgctcgacgtacgacagcaagaaccagacgctgcgcgccttcaccatcaagcagctgtacgacgcagcctccgccaccgccgacgaccagctgtcggtggatggccgggatgtgaccaacgtcaccctggtgggcaagatcacggccgtggaggagcagaacctggtcagcatctacacactggacgatggtacggggaccatgctgactaagtactggatcccagaacaagacgacgccctggtgaggttttga

SEQ ID NO: 6023 - DNA, 771 bp, Chlorella protothecoides
atgacttggcacgccatcacagcctctggataccagcagactttgcctctctactctgcgacccacgcactcgcagggctgggccagccgggagctcctgccccgggacgccatgccacccccgggagggatggggcccctgctggacgccctcatcgagcacgtcccccccccttggaccgctccgccgagcccttcagctttttggtggtgctcaccgagcgtgactccttcctgggccgggtgtccaccggcaggatagccacgggcagcgtggccgtgggcgacgccatcaaagtgatcaagcacaccggtgggcagggtgtgatggaccagtgggcgcggggagaaggcgaggagcacatggggttcaaggtgaccaaactgttcaagcgctcggggcagaggacgctggagctgcagcgggcggtggcgggcgacatcgtgagcatcgcgggcgcgcccatcgcgggcgtggccgacaccattggagatgtgggtctggccgacgcgctaccgcccggccaggtggacccccccaccctctccatgatcatctccccaaacacctccccgctggcggggcgggagggtacgcagctgacgggctccaagatcggcgagcggctgcgccaggaggccgagaccaatgtgtccctgaggtgggaagggcagggggtgggagggcagagggagcggtctgaggttgtccaacctgggcaggcgggtttcagggttccaagggctcgaggatgtgtgtgtgcagggtga

SEQ ID NO: 6024 - DNA, 891 bp, Chlorella protothecoides
atggtgtacaaccatgtcgagtcagcaaggcataccatgatctgcttaccttcactccctgcagattcagtaagagactactgctctggaggggagccgactgcacggcatgcaccgcatgtttgggcgtgtaactcgaaaattacgcatgcggtcgtgcttcagcagtcggctcagtttgcagattttaaagttcagattaacatattacatgtagactatacacgcaatgggcatgcggagggctctgcagcaactgtggcgtgcagtaaccccgcacacggccccgctgacaggcttgcggacggagctccactcagttcgaggatgcgcaccctgccaagatcatcccatgtggaccatgggaagacaaccctggtcgacaagctcctcacctctgggggggggaccctcagctctgaacgtgccatggactccaacgacctcgagaaggagagggggatcaccatctcttcaaaatacacgtccttccagcacaagggttacacgctgaatgttgtggacacccctggccacgccgatttcggtggtgaagtcgaacgatggggggcatggctttctcttgatgtgcctgcggtgtcaccaagcggtggctgcccaccatctcatcacataaaataccagcatcgtccatgccaccctccactcacacagtgtgctaggcatggtcgacggagcggtgctgctcgtggatgccacggagggacccctgagccagaccaagttcgtggtcgagaaggccctccagcggggtctgcgccccctggtggtcctgaacaaggtggatcgcccggcggcgacgccagagcggtgtggagaggtggagtcggccgcgttcgatacctttgccctgctgggcgccgacgatga

SEQ ID NO: 6025 - DNA, 306 bp, Chlorella protothecoides
atgctcaccgtcatccccgccaacatgtgctacttcagcggctacgagctgggcaagcgcatcacacccccaggcctgggggtgctctctgacgtggccacggcagccattgcacagggcgtggcgggcatcgtgtactgccccatcgacatcgtgaagcagcgcgtgcagaccgccgcggtcatggaggcgggggccacccaccgtcagtttggggtgctggacgcggcccgccagatatgggctggccagggcgtcaagggtatggcgcagggattgggttggcgattggtgtgggaagagtga

SEQ ID NO: 6026 - DNA, 720 bp, Chlorella protothecoides
atgccggtgtacaacttcaagagcatgggcgtggtgcccactgcgaaagacctagtggatatcgtgctttcaaagacacagcgccagaccccgactgtcgtgcacaatggtagggacggcggggtggcggtagtgccacgaggtgcaggctgggccatccagagaatccggcagttctacatgaggaaggtgaaacacacacagaccacctggcacgagaagttatcgaccatcctcgaagatttcccaaaggtggacgatatacaccccttctactccgacctcctcaacgtcctctacgacaaggtgactttttcgttagcgactgcgtacgtcctcagagctgagggttcaagcacccattttcagagctcgtcccctcccaaccactgcgatcactacaaattggccctcggccagctcaatgcggcacggggaatgatcgacaaggtttcccaggtccgcagcagcagaggcaatgtgttctggggcggcttactcaggactccctcgccacatgaggaggccctgtcatacaagcttgggcacgactcacaagtcttgtccccactccctcctttcccggcaggactacgtgcgcctcttgaagtacggcgactccctctatcggtgcaaggcgctgaagcgtgctgcgctggtgcgagagcatgttgcggctcatgcacgctgagtgccagaccctttagtgcaaggccttga

SEQ ID NO: 6027 - DNA, 363 bp, Chlorella protothecoides
atgcgtttctttgagtactacgatgatccatcccgtgctgtcaaaaagaggaacttttccacgctccattgcaggggagctgacggtccagtggtcgagctagatctggcgtgcgggctctttgacctgaacaatcaggcagcagagcaggcagctgagcgttcgctcacgcatggccaggctacacccaactcagaggatgattccagtgatgatgatgaggaggagagcagctccgacgaggagggtggcgcacccgagcggcaggaggctgaacatgcagctgcggctggcaggagtgatggcgcaaggaggcgaaagacggtgcaaagaccaaaggctggcatcgaggaactgtcttga

SEQ ID NO: 6028 - DNA, 504 bp, Chlorella protothecoides
atggcgtccaaggagtgggatggccagcgcaggcgcggggctgtccacacatcgtcgcttcagaaacaggtgccggctgcgcagcgcaaccagctggaagacagcgctcccttcaggacgcttgaggaggtcacgcctcggcggcaggggcagactgggatgcccgaactgggcctggcgccgctgatggaggagtggcgggagggacagtactccatcgacatcgccatccccaccgagctgattgcggtggaggtggacgggcccacccacttcccctgggcgtcacggcgcgtgctgggcaagaccgcgctgaagcggcgcctgctcacggccatgggctggagggtgctccccgtccccttctacgactggccggaggcagggctcgaggcgcaggcagcctacatgcggagcaggctggcgggcctcggcctcccgggcgcctgcgtggccggcgcaggcccccatcccgccggccggccggcggggcgcgaggactga

SEQ ID NO: 6029 - DNA, 264 bp, Chlorella protothecoides
atgccgcctgactcaggccctcccttccctccccagggtcgcatgtgcaccatcatgaagcggcagggtccctctttggcatacctggagcaggtccgccaacacatgggccgcttgccctccatcgaccccaacacacgctccctcctggtctgcggctaccccaacgtgggcaagtcctccttcatgaacaagggtgagctggcgctgggctttggggacacacccggtccactcgagcggggtacacctgccgaggggtag

SEQ ID NO: 6030 - DNA, 867 bp, Chlorella protothecoides
atggtcctggcgagccaccccccctcgcccgacgacggcccggcgtgggccatgtccgcccgcgacgcggcgtgcctgctgcgctccctgtccctgcaccacgcggccgtggcggggccgggggcggcctgccacacgcacctgcagcgtgctctggacgcgctcctgctgcacctgtcccggctggtgccgggtgcgggcacgcacgaggtcaccaccgtggcctgggccctggccacgctgcagcaccgccggcccaatgtgctgacgaccatcacggaccgggcctgccagctggtgcaggagggcgactgggacgtgcaagcggtgagcaagctgtgctgggcctgcgcccggctatcctttgatgcccccgccttcttcgacgccgtcgccaggctcgcgccaagccggctattcagccgccggcagccggaggcacgcaccctcgcgctcctcctgggggcgtacgccacactgggcaggtgctccggcgagcgcgagcaggagctcttccgtttggctgtccctgcctgcacagcggagtatgctcatgcgagctcctcaccctaccagctgcatgcacacggtcatcccgccctgccctaccaacctctctcacacatacaggcggtgcatgggatgacctgcgagcacctgatcaacctggcctggagctactgtgtggcgggactgtacccccccgagttcttcagcgcctggaggttggctctggctctgcaggcccatcgcctctcgcaccaggacctgcagaagctcttcctggtggaggcagccctccagctggaagctgcctcagcgtcaggtatgctcctggcatgtcgtatggaggaagtggacgtgtag

SEQ ID NO: 6031 - DNA, 732 bp, Chlorella protothecoides
atgcggcgagaagggtttgagctgtcggtgtccccaccccgcgtggtgttccgggaggaggcgggcaggcgcctggagcccatcgaggaggtcggctgcgaggtcgcggacgagcacgcaggggaggtcatcgaggccatgtccaaccggaagggagaggtgaggcgcggggctggcggtgtgtttggcccattggggagcccaccccgacacatgcgaggttcgaagtcaccgcccgctactctgaccgactcccctccctattcccccccccaacagatgacggagatggtccccctggaggtggacggcaagcagcgcctcacctttgatgtgccctcccgcggtctgatcgggttcaggtccgccttcgcgaccatcacccgcggctcgggcctcctgcaccgagccttcagccggtatgacgagtaccggggtcccctggaccgggtgcgcaagggcgtgctggtgtccaccgccaccgggcgcaccacgctgtatgcgctgggcatgctggaggcgaggggtgacctcttcgtcggggatggcggagacgtctatgagggcatgatcatcggggagagcagcaggtgggcttgggtgggggagagaggcggcttggcagggctgatggcagggatgttggctcttcaaaacactgcacgctgggcaggtacatgggagtggtctgagacagcatggcacacaggtgcctgctggcaatgggagtag

SEQ ID NO: 6032 - DNA, 483 bp, Chlorella protothecoides
atggacatcagcaagtacaactatgagctaagcaaggcggccaaggatgcgaagaagaagcagcgtgaaaacattacggagacaaaggaactcaagttccggcctggcacggacgtgcatgattaccagaccaagctgcgagccgcgcagaggtttgtgtccaagtccaacaaggtcaaggtgtcgctgcagttccgcgggcgcgagatggacctaatagaccagggccacgagatgtgcaaggactggcacagcgaacagccaggagggattggggtggtgcatcctgtgcctctggcataccacaactactctgccggagtgctcagggtgccactccagatcctttaccacgtgctctcgacacccatacctatgcagcgcatcatcgaggacctggggtcggccatcgtcgtggaatcgcccccgagcatgcagggccgcaccatgaacatgatcctgggtccccgcaaggatgtctga

SEQ ID NO: 6033 - DNA, 666 bp, Chlorella protothecoides
gatcgccgctcgcccgcggccgagcggcggtcggcccgggctgccaagcgcgcgcgccacgcggcggtgtaccaggcctcggccctggcggccacctttggcatcgtggcgctggcggtgggtgccaccgcgctgcgcatcacgcgccacctggacgccggcgacccgctccccctgggtgagctggccggcacgctggtcctcatggcaggctccgcggtggccatggagatgtacgcgcgctgggcgcaccgtgtgctttggcacgacgcggcctggggctgggcgctacacgccagccaccacgcgccgcgcgagggcgccttcgaggccaacgacctcttcgcgctggccaacgcgctgccggccatgggcctctgcctttacggctttctccggcccgacgccctgggtggcgccctcttcggtgcgggcctgggcgtcaccctctttggcatctcctacatgtttgtgcacgatggccttgtccaccgccgcttccccgttgggcccatcgccgacgtgccggtgctgcgccgcatcgctgcggcgcacaagctgcaccactctgacaaatacgggggggtgcccttcggcatgttcctagggccgcaggtgagcatgcgtgggtgtttcaggacagagggagagggaagggggatttga

SEQ ID NO: 6034 - DNA, 183 bp, Chlorella protothecoides
atgagtcagcgggcgtataatgtgtggactgccaaggaggtggaggcgctaaaacggggagtggaagcgcatggagtgggtttttgggaacaaattcgcagcgatccgcagttcgaggtcctgagcatgggtgccatcaccgttccgttcgtcggtgcaggggccggacgggtgtgcagctga

SEQ ID NO: 6035 - DNA, 645 bp, Chlorella protothecoides
atgaggtgcgctgtgggcggcggggccactcgctgtgaggctcggtgtcccaccggatgcccatgcccccacacgatgggtgtggggggtcagcccatgcatgaaacgtccctgcccataccccctccgcaggccatcgaggccatgtacgcccgccagtcccgctggcagagggagcgcgccgccgccttcttctccagcgagctgggtgggatcgtgaccgacccagcgctcatgctcctgcatgcggacgagcacggtttccaccgggggcacgccgtctacgagacactgcgcctggaggacggccacatctacctgctcaagcggcacctgcagaggataaagagcgacgagtcatgcccaagccccccctctaccaatcctcgtccccctctccgccaccccaggctcttcctctccatggtcaaggcagacatacccctggcaccagacttgggcgttgatcagatggcacgaacggtgctggagacggcggccgcctccaccaagctgagcggtgaggagcctctgcatgcctgggccatggcatgccctgggtcatgggtggcgcatgctggagaggtttggggcatcgggtcctggtccatcgcgcatgagcacccacgatcgcccgtgcgctga

SEQ ID NO: 6036 - DNA, 375 bp, Chlorella protothecoides
gggtttccctgcatggtgtgcagggtgccttgcccgcagatcacccaagcgtccagattccacgtcatccctccctctcctctccctgcccctcagctcaagtcggtgctgatggccatctactttggaggtgacaacattgtgtgggcctcccaggcgggcatcctgcagaacaagaccctcatcctgcgggcacagaaggcctccctgtatggctgggcaggcgggtccatcatcggcgtcatcactgagctccatgagctgcagggtaggcctgatgctttggatggcatccccgtgatggctgccagggactggcaggaccgtattgtccaaggtgttagtgttgaatatctgactgacgggatgcactga

SEQ ID NO: 6037 - DNA, 843 bp, Chlorella protothecoides
  modified_base (739)..(748): a, c, t, g, unknown or other
  modified_base (822)..(831): a, c, t, g, unknown or other
atgtcgagcgtctcagcatcgtcgccgttccaaatgaaacactggccgttggcatcgtccatctgtcgtcgtcttcgtgggcttcccgtacttcattcgtgtcgcgcgcgacaccacccgatcagccacggcagcacgcatcggcctgactgccgcccgggccatgaagaccacatggtgctgaggattgagagcggcgacagcgatgtgtgcagcgagtgctgggacaaggccgtgctgtttgccgcgggcacggacccctatgtgctcatggaggaggcggtgatcgtagccgcggagtgcagcgggaccgccaagcctctgcgcgccaagaccctgcccccaaccctcgactcctttggctggtgcagctgggactcgttctactccacggtctccgcgcagggtggggaacctggtggtggcagggagcgcatccagtgcatgtgtgttgtaggctgctggctcagcagcagcaccagtccgtgtacgtgctcccaaagacttccagctttcaagcaaccattcccttgccctattccctcgcaggcctcgacgatgctgtccgaggcctgcgggctcagggcacgccaccacgctgggtggtcattgatgacggctggcagtgcacacaggtggacgccgcctaccgcgacgacccgctcaaggccttccgacgaggcaacggggaagagtattgggaggagtatggtctccattggcgacaaggctctatccnnnnnnnnnntgtgctcccaaagacttccagcttccaagcaagcattcccttaccctattccctcgcaggcctcgacgatgctnnnnnnnnnntgttacgagtga

SEQ ID NO: 6038 - DNA, 504 bp, Chlorella protothecoides
atgagcttcctgtggggtcggcccaaggccgcagcccagcctgccaccccttccgggactgagccacaagctgccaagcagagtggtaaggcacagagcctggaactcgtcaagtacgatgcgcagaccggcaaattcgagagcggcaaggcacagagcctggaactcgtcaagtaccatgcgcagaccggcaaattcgaggtcgggacagaggccctccggatcctgcgcgccaccgcggggcccgtgggcgtcgtatccgtgtgcgggagggcgcgtcagggcaagagctacatcctgaaccagctgctggggcgggcgggcgggttcacggtgggccccacccaccggccctgcaccaagggcctgtgggtgtggtcggcccccgtgccccgcacggcagcggatggctccccataccacctcgtgctgctggacacggagggcatcgatgcctacgaccaggtgcgtgcctgggacagggcaggttcagtatgggtatga

SEQ ID NO: 6039 - DNA, 1482 bp, Chlorella protothecoides
atggcgcgctacgcgccgcgcctggtctacggcgcccccacccccggcgtggccgaggtggagccctcggccgcctggaacccggccgtgctgggcggcgtgggctgggtgggggacatgggcgcgctgttcgaggacatgcacgcctacctggcggcggcgggggtggccggggtcaaggtcgacgcccaggccggcgtcggcttcgtggggcacgccagcggcggcggcgcggcggccgccgccagggcgcacgccgcgctggaggccagcatcgccgtgcacttccccgccaacctggcggtgaactgcatgtgccacagcacggagaacatctacgcctgggagggcaccgcgctggcccgcgtgtccgacgacttctacccgaccgacgcctccacgcaccgcccccacgtcgcggcctgcgccttcaactccctcttcttctcgggcgtcgctcacccagactgggacatgttccagtccgagcaccgcgccgccgcgctccatgccgccgcgcgcacgcacatctggcgcccccctgattccctcatcgggcgtcgttggacacaatctggggggccgcagtcctccacttctctgccctcgaccctggaccccactcccgacccctcattcgaccgcccaaccccctcaaagccacccgcaaacccacgccgcagcgccgtgagcggcggtccggtgtacgtgtcagacagccccgggcgccactgcgtcccgctgctcaagcgcctggtgctgcccgacggcggcgtgctgcgcgcgctgcgccccggccgccccacgcgcgactcgctgttcctggacgtctgctgcgacgcccgctcctgcctcaaggtctggaacgtgaacccgcgcggcggcgtgctggcggccttcaacctccagggctcggcctgggactgggggcggcggcggtaccgcacgcacgaggccgcgccgccgccgctgcccgcgcgtgccgcggtacgggacgtggagccgtaccgcggcgcgcccagcggcgaccgctttgccatgcacgtggatggggccgagggcgtgctggtcgtggacgccgacggcggcgtggacctgcaggtccccagtgagtcggtggatctgtttgttggttcagtttttcaaggagggggccagaggggaagtgacggtgcgagggccgagggcgccggggatgggcagcacaaggtggccggcagtggccaccaccagggcgcgcaggagagcgtcacgcgctgctgctccaggggaagtgatggtgcgagggccgagggcgccggggatgggcagcaaaagggggctggcaatggccaccaccagggcgcgcatgagagcgtcacgccctgctgcaccgtgctttctttcccctcgactcttttccaccacctctctcgctgcacacatttgagtccccatctgccttcccatcccctccttcaccgacaggcggcggcgccgtga

SEQ ID NO: 6040 - DNA, 2445 bp, Chlorella protothecoides
  modified_base (136)..(153): a, c, t, g, unknown or other
  modified_base (1085)..(1094): a, c, t, g, unknown or other
  modified_base (2411)..(2420): a, c, t, g, unknown or other
atgcacactcgatgctcgatggtgcgtctgccagcccccccactctgcctcacaacaattcattggtgcgccatgcagcaagggcaggaaggggctggagttcagcctgccagacgacggctccaggatcctggcnnnnnnnnnnnnnnnnnnatgtgggggaaggtgcctgcaggaaggactgttgaagaagccattgccccgtttctgctcatccagagggagacagcggggctctggtgcatctgcacgcacatgactcactggtgctcttacgaaggctcctgtctgagctcagggagggtcccgttgactactccagggcccgaacagcaccagcatgccatcaccgatgtagcacccccatccctgtacccacctgcgcaggccggggtgggtgaccccgactttgatgcggcctacagcgcctacgtgcagagcaccatgcagacgagctccaggcggcggagccgggggaccaaggagtggggcgagaacgcggacgtgtgcctctacggcctgcgggtgcccggtgccgtgcagggcccggcggaggaccggcccctggccggcctgtggatggcggagggatacgggccccacatgtgggccatcacctaccgagaccacgccagggtgctccgcctggaggaggtggtgcgctgcgatgaggagctgtcccacctcccacgtgtgcacgagtaccgggtgacgccggggcccgccctggccgacgccggcgcggggcacgaggcggatgtggagcacttcctgcggcacggcctggtgccggagggcgtgctcccggccctgggctcccagggctggctgaggctggtggcggaggatcacatgaggcaggtggtcccaaactatgtcccggggaggctgtaccgcctgcccatggaggcctgcggcatgcgcgtccgaatgaacccggcacggcgtgcatgcccgcctgggcaaatgtcgaacccttgttgcttcacgtccttgtggacatgtacatctacaaccgtccgatctgatgtgtcgcgcgcgcgccccgagaatacgaaacgagcaagtcccgatggtgcgactcnnnnnnnnnngtgtcgcgcgcgcgccccgagaatacgaaatgagcaagtcccggtgcaatgtgatctgattagccatcacttggatggtgcgactgaaggccttcgcggccatcaacagcgccagcctcgggccccatgggcggggtgccgagacggccgaggcgctggagatgcggatcctgggcgccttcgaatccgccctaaaccatgcaaggctgggcaagctcgatcaggccgagaacgcatcatccaacctgatcccgcctcgtaccacccttctacattccccctgacccatcaaacatcccagaccctgctgcggggcatcctgcgcgagccggcggtgcagagggggggtgtggagcagctgtcccgcctgcgtgtgctggcgctgaggcagctggcggccctgctggccggcagggacggcggcggccccgcggccctagactgcctgtgccaggcttgcgacctgggcccccccgacgcggtcctgctgagccgcctgaccaccctggcggggcgggaggggcgctggccgctggcacgctgggctgccgaggccgggctggagctggacccggcccaccccaccctggccgccaaggcggcggccatcgccagccacgtgggcgacggcgcctgggccgaggagttgggccgctctgtcgggggcaggcgctgggacgcggcggcgcccacggccttccgcgccgcgctgccggcggcctaccaggcggagcgccccctgccagagcccagcgtgcgcagcgtggctttgccccgcgactggacccccgtgctgctcgaggtggccgccttcctgggcgccggctctgcgctgtgcgaggagggccccgaccgattgatattgctggagcgggagagaacggaggggcatacggcgggggagcagagcccgcgcggcatgggggcgccgggtgcagtgcctggcgagccagggcaggagggtgatgcggaggtcgacgcaggcggcggcgacgcgacccagccggcgggggagggcggcacagaggccgcgcctgccaagctgaccaggtccagggcgcggggcctgggcgacgaccccacccagtcgcagccgggtggcgacgagggcgccgaggacgagggccgagcgaggttgggggcgctttggtgccttttccctggccccacacgtgttgatgcgctgagggacgatggtgaggcggcaacggcgagggatggagccctggaagaagatgagcgtgccgccgggcctggcgcgccccctgcaccaatgccagcatccacacagggtctcgaggggctgctatggccctnnnnnnnnnngggatggagccctggaagaagatga

SEQ ID NO: 6041 - DNA, 2283 bp, Chlorella protothecoides
  modified_base (517)..(526): a, c, t, g, unknown or other
  modified_base (690)..(699): a, c, t, g, unknown or other
  modified_base (813)..(889): a, c, t, g, unknown or other
atgccaaacgcctcactcttacatgcagggagagttccaggcgctcgatccctgttcgcagggacaggatcagcttcagggcttgtgtgtgcgtgttctgcaggtctgccatcgcaggcaggagaaggtccaggcaggctggggagagacgctcccgacgttacacccaattacacattcttcaagctaacagtatgtcaacaacaacaccagatcgcgacgtcaatctcatgcaagccatctatggtggcgatcatcaacctccttcgctgtcatataagcaacctcaaggcaatagaacgccaccatgacgactgtggaggaagcgaagcacctcatatgcgacctgtgcggggtcatgtatgccgggggccatgtgagcggcaccggtggtggcatcagcatcaaggcgggggacgccctggtcatggcgccctctggtgtgcagaaggagcgcatgcggccggaggacatgttcgtgctggacctgaaggagatggctgggggtggtgctccnnnnnnnnnncccctcttccagtcggtaagggtgaggttgactctttgagtgtacagattgagtcacatgtggttgtagagatggctgggggtggtgctctcgctgggttcaggagtgtcattcgcctttcggtcatggtgtgcatggcgtgtccgctctgtaagcgatcctgnnnnnnnnnntcattcgcctttcggtcatggtgtgcatggtgtgtcggctctgcaagcaatcctggctccctaccctccccaacccaggcgtacgacctggcaggagcgggggcggtgctgcannnnnnnnnnnnnnnnnnnnnnnnnnnnnnnnnnnnnnnnnnnnnnnnnnnnnnnnnnnnnnnnnnnnnnnnnnnnntgtgtgcgtgtgcgtcccttggggtaagcaccttgacatcagctcacagccacacggggagcgctgcttgccgcaaacatctgatccttgcagtgtctcgttcagacccctctggtctcatgcctcagagagcaggcattgagggccacggcttcttcgacaccctggtggtgcccatcatagagaacacggcgcgggagtgcgagctgacggagcggctgcaggccgccatccgcgcctacccccgcacccgcgcagtgctggtccgccgccacggcgtctacgtctggggtcgcgactggatccaggccaagacgcaggccgagtgctacgagtacctgttcgaggccgccgtgcgcctgcgccagctgggcctcgacgccagccggcctgccgtgggggtcgaagatgcggggcgtcccggtgccgcgccgctcgatgtgtccgcgccggggccaaagcgtgcagcgcgtggcgtgccccgcgctgtggtgctggacatcgagggcaccgtggcgcccatctcctatgtcaccgccaccctgttcccctatgcgcgtgtgcggctgaggagccatctggaggccagctggggcacgcccgcgactgaggccgtggtgcagcagctgcggcagcaggtgcgtttggctgtgtgggatgtattatttggagggcctggcttgagggttccagctcatgtcctgctgggcatggcaggcggtagcgcctgtggccacgcaggctcgtgggtggttgagcggggtcggcgatccacctgccgcaacagcctaggcaatgtatcaccggggcctccctccccacctgcccaggtcaacgggtcggccatccccggcctggcgcccgccgcccgggagggcgacgcggccgaggaggtcgcggcggtggcggcgtgggcggccgcggagatggatgcggaccggaagacgccggcgctcaagaccctgcaaggccacatctggaccgaggggtttgcgacgggggagctgacgtgcccgctcttcccagacgtcgcaccggccctccgccgctgggcgggcgccgggatcaagctctacatctactcctcgggctccaggtgggttcagggtggtgaggatggtcccagtgcgggtgggtggcggcttcaagagggcgacaggcttccagaggacacttgctgtcgatgtggcatgtgtcggaagggagcctggaggagggagcaggcctgcatcagccgcttcacccaatctttccccttgccaggcaagcccagcgagacttgttcgggcacaccgctgatggtgacctgcgccccctcctctccggcttcttcgacacctccagcggcgccaaggtggggaggtgctgggcccgggtctggctcgtgtgggtaa

SEQ ID NO: 6042 - DNA, 2859 bp, Chlorella protothecoides
  modified_base (1136)..(1145): a, c, t, g, unknown or other
  modified_base (2218)..(2227): a, c, t, g, unknown or other
atgaccccttctacaccacgtgacatagcgccctttccctggagctcagtccacccgcctgtgcatacacagcgcctggcgcaggacctggagtcgcagtggcgcatgcagggtctgcgcgatccccctgcgcggcgcgaggtctggaagcgcaaggtggaggcggtggtggacgaggcggcttccttgggcctcgccctccgccgctgctgcgaggccagccaggcaaggcaggccgaggcgacgcagcgcgccgagctcttccagggcgcctcctcctcggggcaggtgctggctgacatggacaccgcggcgcggcgccacctggcaagcagcaagcgtgtgctggaagaggcctacgccacgggggcgggggtgctgggctccatgtccagccagcgcgaaactctcaagccccagcgctgcgcctgggtccagtactacaggaatcgattcccttccccaccctggacccccttcccacatctagacggcccagcgccggctcctggacgtcatcaacagcgtgggcctgtccgattcactgctccgaatggcagaccggcggcaccgcatggacaagctgctggcctacggcggcatggcggccacgctactgatggtggtcctgctctactggtacctgaagatgtagaggatctcgccagcgggaaggtgcagggatgtgcggcggtgatgcgccatacctggcgtctccagcccggtgccggagttggcacgctgcggccccctgcggacacaggtcgggtttgctcggctgtgtccgactccttgacatcctcccgctgcgctgtcgccaatgaccatctgggatgcacccaatgtccctgttcagtggaggcgtcagtcgcactccccacccttcctcgcaggggtgctcccggtgtgaggcggccatgctgttgtcgttgcagcgatgtcctgggcttccccctggcgccagcatttccaccccctccaacatcccttgaatgcacctacccacttgctcccagctgcgctgtcgtactcctattcttgcaaacggacgaccgggctgcagaccggcagggggtgcacaggggcaggcgccacatactgcgtcggggcgagggacttcctggtcactgcaggtnnnnnnnnnntgcctcatacaacttggtccaggggctgcgggccggcaggggttgcacgggggcgggcgccacatactgcgtgggggcgagggacttcctggtcactgcaggtctccctgtcgcggcggcttctcgcccggccctcccttctgcggcctcatccagctcggcctgccggctggcatccacggcccggaccccgacgatgacggaggacgacacctggctgccgtcccgcagcagggcccgctgtgcgccttgcggcgtctgcgaggggaaaggtggggtgaaggctcatgctgtggccccagatacaggacagaggtgggacgcacagcccattcccattgccatcgatcccgccgtccacaacccagcacctcaccgcgaacttcatgtggagccagttcacgccctgcccgtcgccgtaggtgccccagtgcagcaggtccccgcaccgccccagctctcggagcacgtcagggcgccggcgtcggcgtctgcccggccgggcgagcaggtgtccatgggagctgggccggtccctgcctcaccgccgccggggctctcgtccatcaggctgctggtggggggtgggggcggggtttcccgtgccaggccgctgctggaaggggttagggagcgccggcgtgtttgggcgggggtagcgtcccaccgggggccccggctggcctgctgcccaaacagggaccccgacgctcgaggtgagcgcaggccgccacgtagatcgggggtcctggatccatcccctgttttcagagaggttggggtgaacagcaggctcacagggccggtggggccgctgtgcgccccagccatcccgtgctggtgtcggcctcctcttcgatgcgctcgatcgatggcacctggatctcttgaaaggcgcagggtctggcctgtacggagattcctcaaatgttatagtactgtggcagacaagctgtgcagggccgcacggactcctttgagtggatgctatcaacccccatacatgcaccacttcgacatcccatcacactccgtccgcgaggcacaagtcagcctactaccactgctgcacnnnnnnnnnnagacgcacttcaccgatctcgtccatctccacctctggtacaccaggcgatacggtataatttacaaaagctatcaccctcatacatgcaccactacgacatcccatcacactccgtccgcgaagcacaagtcagcctactaccactgctgcacgcacccccacccaccttccgcgatggcggggtatggcatggggggttatgtaggcaacacccatgacaaggcccgcatcacacggcaggagaaggaaagggaggaggccaagcagaagttcgaggaggccaagcgcaaggcagaggagggtgccggtctgaggaagtttggggcagggaccacagaggcatgctgccgcctgcgaacccttacaccgtcccaccctccacagacactggagacagcattcaagaacgagacggtgggactgttcacacgacaagagtttgtcgagaagagagctacaattggagatcgactgcaggaagagaagaaaaggcaacgagctgcagaggaggaggctgagtggcaggtctgttggagggatcatgtgctgtgcttgctgcatggacaggaggtttccaaaacgtcgagcatgaactggaggctcagacctgaagctcaccaccaaaaataa

SEQ ID NO: 6043 - DNA, 1653 bp, Chlorella protothecoides
atgtttggtcattcctcgaccgtgccccccagcagccgtcaggaacccccgccgtcaccctggccccagcagaaagagaacgagctgatcctgtttggtggggagtggtacgacagcgagaaggacaagacccatgtgtacgccgacctcttcgtgctggatgtggaaaaggtggcctggcgtcgcatcgtgtcgcccaagggcccccttcctcgcagctcccaccagagcgtgatgaccaagtaccacatgtacgtgtttggcggggagttcaccagcctcaaccaagagaagttccgccactacaagtgggtgcactggggaggatggcgggatttgggaggggggagggtcatggtggggttcattgagcttagcagctggggtgtgcttggggtcagtgccagacacacagctctgccagctgttgagggcattgtattttgggctctcaacctagcttgtaactccgtatacagtagccaatgtttcatgcctcatcgcacagccaccgacccaccccctaccacctgcctgccacgatcgcagcgatctctggcgcctcaacctggccgactggtcctgggagcagctgcccggcaggggcggccccagcccccggagcgggcaccgcatggtgctgcagcggaaccgcctgctgctctttggcgggttctgggacgcggggaaggagcccaagtattacaacgacctctgggccttccacctcaccgacctgcagtgggagtgcctgggtcccaccacgcagaccggctccagctggcccagcccgcgcgggggctgccagctggcagtccacggcgagctccttttcgtcttcggcggctactcggtgcgtatgagcatcactcaacgactctgctgtcccaggattgctctgtgtctggtgctgctccaacacctgcactccaacctccgcgtggctgtgacgcaaacaaggaccccgccgccaaggccgccaagcgcaagtcggccggtgacgacgacgacgagggtggaaagggcgtcgtgcatgacgacgtgtggtgctacgacaccaagtccggcgcctgggagcgcgtgaggaaggcgggcatggcgcccagtgcccgcaccggcttcggcatggcgcggcacggccgccgcgccgtctacttcggcggagtggtggaccaggccggcggccgcgaccgcgtctactccgagctcttcaatgaggcctaccagtttgatctggagacgcggcgctggttccccctggccgtccgcgcgccgcgcgggaagagggcgggcgcggctgccggcggcgccgacggcgcgcccgccctcgcggacgggagcgctctccaggtcacgccggcgcagcgggcgcggttggaggcggcggccacgtgcatccaggccagcttccgcggatatgcagtgcgcaaggcctacaccgcctacaagctgggcggcgcggtgtcggagctgctctactcccccgcgctctatggcgtggacgttggcgcgtcggccgacacggtgaagccgcgcgcgcgggccgcccccctcatggccgtggctcgcaacacgctctggctcctgggcggcatggtggaggtcagggcgcaaccctgggcagggggggatgggggagccgcgcctatgtag

SEQ ID NO: 6044 - DNA, 222 bp, Chlorella protothecoides
atgcaggttgaggcggcgtcgtacgagaacatcgccctgagcctgggggtggactcggcggacgaggtgctctttgccaccgacagcctggcagaggcacgcgcggcgggcgctgctgggtggagggtggcgctgacgctgcggcccggcaacgcccctgtcagcaaggaggacagcgcctgcctcctgcgcatcgcctctctcgcagacctcgaattttga

SEQ ID NO: 6045 - DNA, 456 bp, Chlorella protothecoides
atggaggcggcgcgagaggggcgggccccctcccgcaatgccgggggccaccgggatcagagcgccaactcccgcgcgctgcactccgtcttctctggcggcgtgctctacgtgcacctggaccatggcactgacctggcctccgaggggctggagggctacaccaagaacatgcgctgccggttgacggtgggttcccacagccgcgagacggagtgcagccggagcaagctgctcaaccggcgcaaccccgtgttcgaccagaagctggagctgatcctggacggcgacgaggcggcggagcaggatgcggtggtccggggccacgtcgccgtgccgctgcaagaggtcgtgagccgccggcgggtgaccggcacgtggccgctgcagggggtctccagcggacagctgagcatgaacctcacctgggtcaacaccctggagcagggaccctga

SEQ ID NO: 6046 - DNA, 270 bp, Chlorella protothecoides
atgtacgtcaaggaggacatcatcctccctcacaccacctccttctacgatctcatcttgaacaaggtgcgcggcaagtccggccccctcttccagttcgacctggtggagcacgcggtggcggcctttgaccccagggtcaagtcccaggactcccatgcgggcaaggtggtggaccggcactggtacaccaagaacaagcacatcttccccgcctcgcgctgggaggtgtttgacctcgacaagctcacgcaggagcgggatacgtga

SEQ ID NO: 6047 - DNA, 1191 bp, Chlorella protothecoides
atggacatacaagtgctgccggagaatgcccggctgcccatcatcgggcagctggccgccttcatcacccgccgctccatcgtcagggaccttgtggtgtctgggactctgaggacccagctgcgccccttgctgaacgagatcccggtggtgggggcggccaaggtctccttcctgggcacccccgttttcagctacaagggtcagcgcacctcctcctccgcccaagaccccggtgtctcattgtcatccccccctgacgaccaccaagtccacactcactcacaggtgtccagctacggcgtgaacccactcttcatccccggcctggagcacttcatcaacggcttcgtctccggcaccgtcctgcagcccttcacctaccccgacggctttgtggtgaagctggaccccggcgccgacgacagcgtggcggagctgcccgagggtctgctgacggtggtgatcaaggaggccacgggcgtgccgcgcatggacctcatcggcggcgccgaccccttcgtcaagctgtgggtggcagagggcaccaagctgaacacgagcgtgaaggcgcgcacgcgccacccgcgctggaacgagaccttccgcatgacggtgcacgatgtggcgcaccagtcgctgcgcctcatcctgctggacgccgacgcgctgcgcgccgacgacgaggtgggccgcgtggagctggcgctggcggacctggacctgtcccagccccgggacctggtggtcaccgcgcgcgtcgccgcgaccccgggcgtgggcggggagtcgggcagggggctggacctggacggccatgccacgcgcaccggcccggcggggcctgcgcgcccggcagatgaaggaaggggggagagtgaggggagtaatggagaccggggggaggaggcccgcgaggaagagggcaagaaggcgggcgcggtgcggcacgatgccgccgaggccggcgagggcgtgccgctgtggcgagaggaggagccggagaccgcgccggggcagaccagcgcgcggcagcgggtggggcgcctggccgagcagtcgctggagatcttcaacctgcgcaaggcctgcgagctgcacatcagggcgtaccggccaaacccagtgcggctgggttttgagggagggagcctcgctgcggccctcggcgagcgtgcaagccgctgctga

SEQ ID NO: 6048 - DNA, 759 bp, Chlorella protothecoides
atggctggggcgcacagcggccccaccggccctgtgagcctgctgttcaccccaacctctctgaaaacaggggatggatccaggacccccgatctacgtggcggcctgcgctcacctcgagcgtcggggtccctgtttgggcagcaggccagccggggcccccggtgggacgctacccccgcccaaacacgccggcgctccctaaccccttccagcagcggcctggcacgggaaaccccgcccccaccccccaccagcagcctgatggacgagagccccggcggcggtgaggcagggaccggcccagctcccatggacacctgctcgcccggccgggcagacgccgacgccggcgccctgcgccccgcccctcagcctgccccctacgccggctgctgggtcacaaccttcgggtttgggcctgaggacctacctgacgtgctccgagagctggggcggtgcggggacctgctgcactggggcacctacggcgacgggcagggcgtgaactggctccacatgaagttcgcggtgaggtgctgggttgtggacggcgggatcgatggcaatgggaatgggctgtgcgtcccacctctgtcctgtatctggggccacagcatgagccttcaccccacctttcccctcgcagacgccgcaaggcgcacagcgggccctgctgcgggacggcagccaggtgtcgtcctccgtcatcgtcggggtccgggccgtggatgccagccggcaggccgagctggatga

SEQ ID NO: 6049 - DNA, 2169 bp, Chlorella protothecoides
  modified_base (171)..(180): a, c, t, g, unknown or other
  modified_base (2055)..(2064): a, c, t, g, unknown or other
atgctccagcacagagtgctggagaaggtcaagcaagctgtcgagcaggcggcagagagtgagtggccggggcctggaacactcggtgtgagggtgggttgggagtatcgatcgtgggggttgggtggggccgtggacgatgtgcagcagtgtgcacatcataccttgtgnnnnnnnnnngagcaggcggcagagagtgagtggccgggggctggaacactcggtgtgaggcatgatacattcctcgtgacagctcggacgcacaggcttgaggcgggggatgaagtcatggccagtgtctcactcttgccctgggtgggcttgcccagcttggagaggcctagcgatcgaccccgggagcttgtcgctccgctagaacgtgctcaagggctgggcgggggaagcgccaggaagcccttgccgaggaccggcagccctgcacctccctccccataccccgaaaggccggtctgtggcgcgaaggaagcccggcagcggagcggcccccgctcgccctatcaaactcccctcgcttccgggaagtcgcccctccggaggtcgcaggtgggggcaacatttgattacgcccctggctttggggtactgaaaaaggcagtgtgcccgttggcactgggatttcgcgtgcatggagaacgttgccggtcccttttgcatcatgactcttgtacaaaccagattcaagcaatgtggatgtcgaaaggctcactggtatccacgcaaccctccctctcgtccatggtcagcggctgccgcgcaggatggatgccaccgagccgcactcccccgtgctcaagggcgaggcgggcctgcgcccggccggcttcaccagcccctcgccatccgtctacgccatgcacgcctccagcagtagcgaggagggggcggtgcattccggggacctgggaccgagcgaggccggccccgggctggatgccgcgtacgagcggtacgctttctaccccggcgccgcgatgttcgacgatgaggacgaggaagacgagggggcggaggactacgacgcgcctcgccactgcgtcaactgcaccgcccccctctgggacgacgtctgcctggtgggtgggtgggtggaggaccagctgcgtgtgtctgtatgcaggagccaaggaaccctgggtggaaggggccgtcggcgtggatactaccacgggccgggcggcgttcaatcagcaggcattgcccttctcatgcgcccgcccttccttcttcctgggtcatccacaggactgtgggcacgacgacgctcacacgccctccctgtttgacccgacgcccctctcgcgacgcgcgacgaattcagcgggcccgtgccttgcgaacagcgtcgacacgtgtctgcccaatgtttccgccgttgcttacactgcggccgacgcacggccacggccccgccgccgcgacgcagtgacggtggtggcctacgacgacgccatgctgctgcaccaggagagcgaggcgtgccccagctcgggcggcggggcacacccggagcgccccgaccgcctgcgtgccgtgtgggcccgcctgcaggccgcggagcttgctgggcagcgtggggtcggtggacggcgatctggcggtcacggccttctggcgagcccgttcacccctcgttccccagcctttcttcaaacccacgcgcctgcacgacccaacacagagcgctgcgtgcggctgccgtcccgccccgccaccgacgccgagctggaggcggtgcacagccggcgtttggtgcgtggcctggaggcgctgtctgagggcatccgccgggccgaggagtgcgaggaggagggggaggagacggcgggctttgctgacgcccatcagctcagcgccgtgggtcctcgggggtttcctgcgccgcccccgacgctgggcgcctcgtgtgacggaggcccggcgtcaggcgtcgtccccgagcccctgctcggtgtgccgccagccctcaccccaccccccctgcgcctgccgcccgacacctacgcctgcgcggcgacggccgcggcggcgcggctnnnnnnnnnnggaggagggggaggagacggcgggctttgccgacgcccagcagctcggcgccgtgggtcctggggggtttcctgcaccgcccccgacgctgggcgcctcgtttga

SEQ ID NO: 6050 - DNA, 2763 bp, Chlorella protothecoides
  modified_base (136)..(145): a, c, t, g, unknown or other
  modified_base (389)..(398): a, c, t, g, unknown or other
  modified_base (873)..(882): a, c, t, g, unknown or other
  modified_base (2285)..(2294): a, c, t, g, unknown or other
  modified_base (2709)..(2718): a, c, t, g, unknown or other
atgctggctggcgctgtccttctccaccccctcaggggacgggctgcatgctcatcacacgggccttccgttggagttgattacggaacctggatagcggtgtgggctttccgatggaaggacgtcctgaacatgnnnnnnnnnncatcacacgggccttccgttggaggtgattacggaacctggatagcggcgtgggctttccgatggaacgacgtcctgaacatacgtctctcgccgcgcacggcgtcatacacgcgctccgtaggaatggttgcctgcgtcacgggccattcataggcgcgggcgcgcgcttggctgacacccaatgcatacgacgtggatggcagatcatcatggcttgttttgacaagtcgcgcaaatatggnnnnnnnnnngcgcgcttggctgacacccaatgcatacgatgtggatggtagaccatcatggcttgttttgacaagtcgcgcaaatatgtcagccaccggcagcacccccgacctgcggcaatggatcacgtgtaatggaggcgatgttcacgccgacatcgatctctttggaactacagaaggaggatataggggcatcatcgcgaccagagagatcgccgagggggagctgctcctccgcatacccaccccgctatgcatgcacgtgcccagcagtcccagcgagcccatcgcgtggtctctccctgctgttcggccgccccatcactctcccgtcatgcaacacgcactgtgcccaggcacctgccatgcgagcactgcagtcccaacccaactcctttctggcatccacgatgctgctcctggcggaaagcgcaaaggcaatcgtggttttggcgtggctgtgtgtgtggggagaaatttnnnnnnnnnngcgcaaaggcaatcgtggttttggcgtggcggtgtgtgtgggggggaattctctttggaccctgggcatgtcgcgggcacagcagaccgaaggcactgccggcatgtacccttttcgcacacagtctcctgcccaacacccagcgatgacatgcccctacgcctcatcacagggagctgcatcgccgttccatgcccacattacaagcatgccatccagccacgactgcccctttgcctggagtgctcatctaccagtatgcatccgcatcaagggccttggtggctggcgagctttgcgccacttggcatgccatacatccccccctcctcacttaccccttttcctgctgcagacattgaccccgggctgcgagaggctgggctcgagttgtatgaggaagccgcacgggagctggcgtcccggtacccccaggcctggccagagttcacgtatgagcgctttgcctgggcggccggcatggtgcagtcccgtaccttccacctccaggccaccaactgggtgacgggtggcaccagcgacgatctccccgagcctgctcgctttttgagccgtcgcagcacagcgttgacagcctggggatgcgctggtcaaccaaggctcgctcaagaggggtgcactccacccggcctcagcatgctcgccatctttttccacacaggctgtgagctgtacctgttgcccggcatagacatggtcaaccactccagccaggcagagcagagatccactgagctccgatttacgccagacaggacggcgggtggcgagcgcatcccgggggagttcaccatgctcgcctctgcagtctgcagcccatcggcatggaggagacagcccctccccgtcgccccctgcaatcccctcccagccctgtctctttcctccgcaatcatgtgtcctcctccttacaccataatagctctctacacccgtttgccgacctcttccccgaccacccatcatcctcactcccttgcaacccacctcgactcagcccgcgccatcagccccggcgaggagatcctcttcacctacggggacctgtctgacacggagctgctgcacacttatggcttcgtggaggggctggatgtgccgcgcagccagggccaggcctgcgttcagctggcagacgtgttaattgggtgcggcggcgcccgcgcgcagcgcggcgcgtcggggtcagatcggtgtgcgtgcgaggctatccgtgcctacctggcgcccgccgacgccttccaggggttggctggcgacatcctgcatgcctgggcaatcacatgtgctggggtggcaccgaggcacccaggccctcctttcagaaaggggcagcagtcacctgtccaactcataagccacgtcggccgcaccccatcgtnnnnnnnnnnaaaggggcagcagtcacctgtccaactcatcagccatgtcggcagcaccccaccgcagatgctgctgggtggaaagaaggacctacagaccatctgcgaccgcttcgaggcctgggatccgcaaggtgcacaagtggcagtgcgtggtttcttgctcagcagaccgccggtggtcctggcacctgctggcatgcaacaatgctggctatcattgcaagagcctgcatctgaggcctctgaccgctccctcaacacttcttcagacgccgacaccgagcagcccaagcccctggcggtaaagaaagagcacctggctgccgtcggggcggcccttgagagcgcttgcgcccgtgtgtcggccgccatcaaggggttgcagcccgacgccgctccgcgagccagggcggcgtggatnnnnnnnnnnggcggtaaagaaagagcacctggctgccgttggggcggcccttga

SEQ ID NO: 6051 - DNA, 465 bp, Chlorella protothecoides
atgatggatatgcacacttttgtgcccgacatgacttcaacatatgcctccagcaaccggctccctgccgcaggaacatgcggctcgtcgggtcaggcatccgacgactctgatcaggactctaaacagggtgaaagcggctccaggcaggcgacagagcctcctgagttcttcgaccccgaggcagatgacaagtcggaggcatgggtgtcaaagctacgaggaggacgccgctcggatgccatcctgagctgccctcagtgctttacaacactgtgcctggagtgccaacagcacgcataccagcacaaccagttccgagccatgtttgtcatgaactgcaggtgctcacaaccagttccgagccatgtttgtcatgaactgcaggtgctcgcaacccctgtggtcagtggccatgccgctgagcagggcagacgagattgctggcgctgcgtgcactcctga

SEQ ID NO: 6052 - DNA, 939 bp, Chlorella protothecoides
atgcccggcccgacgagctgcatgttcctgcggcagggagccggtcgctggaggcatatgttgaagtcatgtagggcatttaagtgtgcaaattcatcctcgcactccaagtattgtcacaccttcgtgatcagagtctcgtgcatcgtcttctatgattgtgtcgtccatgtacacggccgcctggcaatcgtggactccgcaatggactatcgagatcaacaatccccgacacctcgtcgatccgagacccttcgtctgctccagtggaacattgaacgggggtataagctgcctggaatcattgaggagctcaaacaaatagatgcggatgtgattgcgctgcaagaagttgatataggatgcgagaggagcgggtctttggatacaggtaatctttgggtgtggagagggtgtgtgctcggactcccttgccagggtggattggtatccaaatttcccatcaaccttcacccgaaaacagggaatgaaattgccaaggctctgggtctgaactatgccttcttctggtggattgttatccaattttccatcaaccttcacctgaaaacaggggatgaaattgccaaggctctgggcctaaactatgccttcttctgtgagtttgaggagctcaggtctccgctgcggacgccagagctccaggtattggtgagggtgcgtgttggaaaggacgagcttgtgtgcactggaagcagtctcaggagtggcatacccagtgccatcctctctcaatgcctctcacaggtgaggagctgggaggatgctgggtgctcagaggggcatgtagtgagtttccttggctgggttcctggtcattcatctgccatggaggctcaacgtgagtcttctcttacgatcctcaccatctattggcagtgtgcacctggtggactggaacaatgccgagaaacctag

SEQ ID NO: 6053 - DNA, 528 bp, Chlorella protothecoides
atggagtggcccgcctgtcgccatcctactgctgcgatcgcatgcggttcaggtctgtggagcgatccttgctggcacgtgttctgccttgcactgctgggagtgtgcacgacaggatgtagcactactggcaacgggaaactcatgatcacacctccaccaagcaccaggttcctgggcagcacagagggagaggtgtggcaggacaagatcctcagcgtgcctgatccacggtattctgagccctatgccgctgacgccttggcaccaaacccacacatactggcgtggggcctcccgccgcaagtggctcttggcgccctgaacccgggcttctcagacccctttgatgccaggaatacagtcacattagataatcccaagtatcgctggggcccctggtcgctcatggctgggaagctggactggatgatgctacgccagctgacggtgcacagcaccagcctggggaatcaggggtacgggctctccgatcatgcatggctgtgtgctgacgtgtcggtctag

SEQ ID NO: 6054 - DNA, 1338 bp, Chlorella protothecoides
atgtctcacttcgtcaaggtcaatcccgtaactcatcgccttgagctcaacggccaacctttcaggattatgggggcaaactgctatcatgtacagcgcttctttacctgtcctttgagtttagcttcgttcgtctgcaccttgccgcagtcacatggagcagactctccgcaaggattggaggaaaggagaaagaatccggacagcggttttcccactgattgtggccgagctaacattcaaaggctgattaaatccgctgccgcgaagcacataaatgtcctccgtatatgggcgcacaacgatggcaatggctggcaagaaatccaaaagaatggagcaaaagaagttcctggcagctcaccagaggcaccctggtatgagccggtcatcgaagaaggtggagcggatggacttgactgggtggtggaccaagctgcgaagagtaagatcaagctgatcatgagcctcaccaatttctggccagcgtatggaggtctcacacaatacgccgagtgggctggcgtaggtgggggagatccatggaagggggaacctcaaaacagattcttcaatagtggcccggctcagtcacgctttaaggcatacatacagaaactcctcaacaggactaaccaataccgcaaccttcagtataagaatgatcccaccatcctggcctggtccattgcaaatgagcccagggtcaaaggcgagaaagacagcaataccctcgacagatggatcagagatacgtccgactttgtcaggtcacaagatagcaatcaccttatcacagtagacactgagggcttctttactagtgatatttctggattccgtgttggtgatcttaaccctggcctcctcatggagggctgcaacttcctgacgaacgccgcccatcccaacatcgattttgcatgctgccatatctaccatgatttgtggaatattgaatctcagaataagaagggtctgaacccgtggacaaccatgtggctcgatgctcatctaaaggcttgtcaggacgtcttgagaaaacccctcgtgttgtctgagttcagccatacggaggttggaacgggggatgagaagtatgacgcgcgccggcagtaccttcaacatgtgtacggctggctggagaaacacatgaagaatgacaactgggttgctgggtcatgcgtctggatgatatgtgagaagtactaccgtgaacgctatgattctgaaaaacgcttcattgccattgatggcgacggcaaggacgggctgcaggagataataagtcatgttcaggcattcaatgacagtcgcagcctgcatgcagagcagtaa

SEQ ID NO: 6055 - DNA, 1422 bp, Chlorella protothecoides
  modified_base (58)..(67): a, c, t, g, unknown or other
  modified_base (366)..(375): a, c, t, g, unknown or other
atgcagactcatcaacttgtcggagggcagcactcgggcatcatcgttacatccatcnnnnnnnnnncggaaatcaccatgaccttgtggggcctcgaaacccgcctccttgatcctggaactatactgaaccgtatgcagggaacgatttcgagtcagaggctttgccagggagtctgcctgttggccaaaacaaccctcgggtgcgccaaaggtccgacatgccgaaacgggcagatctggctgttccagagcgtgatcagggtatgtcaattcccccccttgttgcaggaagctccctatggactctacgccgagcagctgtctggcacagccttcactgcgccccgcacagcccctgccctnnnnnnnnnngtcacccacgagccattccatcccctaaacttccctgtggagactctgtctgccaactttacaacagggacgatcacccccaaccaactcagagcccctgcccctgtagatggcggcccttccccattcctgaggatccggtggactttgtgcgaggcctctttacagtgtgtggtgccggaagaattgacgattaccgctgccttcccaatcctctcattgtcccaactaaatagtgcggctgcaaaggatgggtatgccatccacatgtacgctgcctctgcagacatgggcgactcctgccttgccaatgctgatggagacttcctcatcgtcccccagctaggcaccctctgcatcaccaccgaatttggaaagctacgggtggcacccggagagatcactgtaattcagcgaggcatgcgcttctctgtggatgtggaaggtggcagggcacgcggatacgttctggaggtctttgcagggcactttgtgctgcctgacctgggtcctattggtgccaatggtctggccaatccccgcgacttccagacgccggtggcttggttcgaggacaggcaatgccactacactgtgatcacaaagtttgagggtcagctgttctcaggtgggcgagggagggcactgtgccaatgggctggccaatccccgcgacttccagacgccggtggcttggttcgaggacaggcaatgccactacactgtgatcacaaagttcgagggccagctgttctcaggtgggcaagggagggcactgtgtggtggtgcacgtgggaagacaatggcccagaacatcgtcttgatccaggggcctacatgtactttcttgaggctctggatgatggggaggttgcacttgcctgctctgtcgtcgtgttgcggcatgtttccatcacaagtttgaacattctctccacttcctgcagccgatcagaacttctcaccctacaatgtcgtcgcctggcatgggaactatgcgccctacaaggtggcagagggcaggagggggttgtgtcttgggtctga

SEQ ID NO: 6056 - DNA, 702 bp, Chlorella protothecoides
  modified_base (22)..(31): a, c, t, g, unknown or other
atgcaggacgtggccctggtgnnnnnnnnnngattgaatctaggccgatctttatcttgtggtcgagacaatggccaccgagcgttccaattccgagccctgtgtcggaaaggcacatgtccaatgcagcgaggagagcgtgaaggcctcccgacctctctcatgcaggacgtggccctggtggtgctggacgaggtgcactacctgggcgacccctggcgcggcagcgtgtgggaggaggttctgatcaacctgccgccccacatcctggtcctgggcatgagcgccactgtgaagaaccctggtgacctggcgggctggatcagacaggtggatggggagggtggggtggtgggtccacggcgagtgcagcgtggtgagcagcacgtaccgtcccgtcccgctgacctggcactactgccacgcggacgccgagctggcgcgcgcgcggctcaagcccctgctggcgcgcggcgggcgccggctgcacccctccctcgttcaccccagcgcgcgaggaaagcagggcgaggccggcgcggcggccgcgggcgggcagcgcggccgccgcgtgctggacgagctggtgtcggtggtggaaaggacggaggaggacgactggctgagcgtgccccgggcacgacgtgtgccctccatggcccaaggcaggtttatgatggtcgtgggtgggtcgacagatga

SEQ ID NO: 6057 - DNA, 696 bp, Chlorella protothecoides
  modified_base (580)..(634): a, c, t, g, unknown or other
atggcgctgagcctgctggccacgcgctccctgcccgacgcccgcgctttcctccacaaatcgttcctgcggtacatgggcggcgcagccacgcgccagcgcctggcggaggtggccgccctggaaagggcggcggaggacctgcgacgcgagctgggcgcggcggacggcgtcgggtcggagcccgagctctggcagcgcttccgcgcggcgcaggaggccgcgcgctccgccaaggcggcgggcaggaggctgcgcgccgcggtacggaccgcgcacggcggtgcgatggcggagcgggtcgcggaggcgcggcgcgagacgccctgccccgccgtggcgctggacctggaggggcggctactggaccctggggccgggcccgattcgctcgctctgctccccgcctggctgctgggccccagcgaggtggacggcaaggatgacggctgggaggctgcggcagacgcagcgccgggccccccccgctacgtctgcctcggcgccgacaaccggctgtacgacgtgccggcgcacgcgttggcgggcgtgcacccctccgtccccggcgggcccccgnnnnnnnnnnnnnnnnnnnnnnnnnnnnnnnnnnnnnnnnnnnnnnnnnnnnnnngctggcgcgggggagcagcgtcgccggcgcggggtggacggcggccgggccgcaggccccct

SEQ ID NO: 6058 - DNA, 252 bp, Chlorella protothecoides
atgtcgagactgttgtgcatcggggaccgccctctccctgcacacagggtggaggtggtggggctgcagaccggggacgccagcgtgaacatcgccgcgccgctggtcatcatgaccaccgagatcctgaggaaccagctgtaccgcagcaggacgattgcgccggatggggtggagggcgctgaggcagcgacggatgccgccggtgatgatgacttcgaggtgggtggggatcgtggggtggacaattga

SEQ ID NO: 6059 - DNA, 279 bp, Chlorella protothecoides
atgtgcatgacaccccatggcccagacacgatttcctatgaaaaggccatcctgccggttgcagaggagccagcccacctgcccagggacacgctggccttcatgtttgagacgtactacacaccgcgtctgacggcgcaagcgctgggctcgtcctccatggagagggggtactaccagtgctggtcggggctcaagagccacttcacagggtccaagagccccgcgcccagccaggctgaggaggctagacccctggccgagtctgccgctgcctga

SEQ ID NO: 6060 - DNA, 1050 bp, Chlorella protothecoides
  modified_base (478)..(487): a, c, t, g, unknown or other
  modified_base (603)..(612): a, c, t, g, unknown or other
  modified_base (842)..(851): a, c, t, g, unknown or other
atgcagggcgtgaccttcagaatcctgttccgatcagcatttgttgtcctccttggagtcctgggcatgtgccttcccttctttggagacatcgtcgggctcgtaggcgccatcggtacgcagagaggccggaataatctgttcagcagcgtaaaatcatggtttgtagagctgagggtctcggaccaggtcaacaccctggctgacttgcctaattatccctcctcacctccttcggccccagggttttggccagcaactgtatactaccccatcgagtgctggatacgggtgtacaaaccctcagagagacgcaaattctggctgcgggtgggtggcggtgggtcctctccgggcagggaggtgggagcctgccctcacatggatatacctctcaccatgtcccagagaaaccctttccaccaccatcctttgtcacaggtgcttaatatcgcctgctttgttgtcaccctggcgnnnnnnnnnnctcccagagaaaccccttcccaccaccatcctttatcacaggaggctccagtgccgcgtgacgcccgaaagccgacgccgaccgaggggcgccacggttccagtccccgagtcccnnnnnnnnnngtccagtaccgggtgacgcccgaaagccgacgccgaccggggggcgccacggttccagtccccgagtccccgagttccagcaccgaccgggggccactgcgaagtctctacacccacgtcgtcttgggcggcaaacccgcatccgacagatataatcggactactccccccaaaatagcctcactgcgcagctcgcgtagatgtctcgcaccccagtaccaggtccaggnnnnnnnnnnttcccccccaaataacctcactgcgcagctcgcgcggatgtctcgcaccccagtaccaggtccaggggggaacccacttgggagtgcaggccgagtaccggcggactttcgagccgactccttcgagggcgatgatgcggctttcaaagaggggattgacgaaattgaggacacggatggcgtcgaacgaacagggtag

SEQ ID NO: 6061 - DNA, 1938 bp, Chlorella protothecoides
  modified_base (1251)..(1260): a, c, t, g, unknown or other
  modified_base (1529)..(1538): a, c, t, g, unknown or other
atgcttgtcatccacatggtgccagttccatggctgccgcaccgggcactggcatcccaggaaggcaccctgctcgcagcatgccctgcactcaccgacagacacgcccttggtggagttcagcttggacaccaggttgtcggcggggtgggacaccacggcgcagagcacgcccgcgatgtagcctgcggcaaaggacacgcccagctgctcgcccttgctgcattcctcgcgcggcttgggcaccacgtacttgtacaggccctggaccacattctcgaaggccgcgaacttcatgatggtgtaggggatctgcctgccccagagggggaccacgcccttccacagcccgcccacgccgccctcggccacgaacttgggcaggccgtcgccgaagccgcgcgcccagccgggcacggtctgcaccttgaccttgacggcctcaaaggggcacagcgcgatgtcggcgatgaactcggccgaggcggagcccgccacgtagatcaggttctggtagcgcgccgcgtactcggggccggccaggtcggagtagtacttcttgaagaactcgtagaagccgaacttgcaggcgccctgcgcggagtagccgagggcggtgggaacccagcccttgaacaggccgcgggcgccctgctcggtgacgatggtgcggaagccctggaagatgcccgtgtacttggtgggggcggtctgcatgttgcacttcaccacgtccaggggggtgaccgcagtgtgcgtgaggccgcaggccaggatgccgcccacgccgcaggccaggtagtagtcctgcgcggggataggaatgggaaaaggaatgattatttgtcagtcccatgcaggggggcccgtcgggcgcccgggttctcctcggcgagggggccagcaggggttgggcgcgccagggcgtacccgggagtagagggcgatcttcttctccgtgggggcatgtgccacgaagccggacacgctgcgggcaagcagattgtcctggggggccgcagaccgctgcagggactgctccttctgaacggaggcagccatggccgcgttcagggccgtggggagtggcactgccggcaaggatgcgcgcaactgtttagtcaaatgctgctaacgtcgatcgaccccggagcgcgctcttccataatcagcccctactcccagaattcactctgcattggcatcgcaagagccgtaaaacaagcacactgcaagatctcagcagaactnnnnnnnnnntgcgcgaagcgtacgccacatttgagccttcacatactcccaaacccggcgtgggttttctactttgaactcctcggtgatgtggagtgtcacacacctgagtgtgagtgctccagagccgtaagacaagcacactgcaagatctcagcagaactggctccaaaatcactgcattacgccccttcgcttcatcctgattcccataaaagcgagattgtcggcataccatctccaaaggctcgctcaggagggctcacactcgtcgcttnnnnnnnnnnacctgattcccataaaggcgagatcgtcggcataccatctcaaaagtctcgctcaggagggctcacactcgtcgcttggccatcaggtggggatgcccaccgaggagtgcgatgtggaagggtgccatgcgagtacactccagtcacggagaacccgcatcgcactgagctgggatgccggccgacagcaaggggcctgcaagctctggctcgtctgggagcaggagcggaacgagccggtcatccaggagtagtaggtcctccggctcctccttctccagccggtcgaggtcgagctctcgatcccgctcgccccctcccaggaagcagtccaggcctgacagcaaggaaagaaagcctgcatccttggacgttcccaaggtggaggacgattttgtga

SEQ ID NO: 6062 - DNA, 603 bp, Chlorella protothecoides
atgccgaccccccgccgtcatccctcccctgcgctctcaccaaaccttctcctcccccctccaacctcaccgcacagcaccgcctaccagctggtggtggacaagtttgggcaccggctgtacgccgccgtgcgcgaggcggaggccgagtacctgcgcggcgtggcggagcgcctggacctcctgccctccccctccttcctccccgggctgaagtacgagtgggaacggcacatgaagagcatgggcgtcatccgcgccttcctcctgtacatggagcgcatgtacatccccaaccagccccagctcgcgccgctgaaccagctggggctggacctgtggcgcgacggcgtcgtccgcgcgccgcgcatcgcgccgcgcgcgcgcgcgctgctgctggaggccgtcgcgcgggacagggggggcgagctggtggacgcctcgctgctcaaggccatcacaagcatgtacatggacctggggcccgtggtgtaccgcgacgactttgagacccccttcctggagcagacctccctgttttacgcggtgagcggggagcacgcgggagggggttggtgggggcagctggagttttcgggctag

SEQ ID NO: 6063 - DNA, 918 bp, Chlorella protothecoides
atgggcaagccagatgggcgggtgtgggtgggatgctgcgattcctgcagcattcccctgagaacgcctcccctggcgccagacccgacctgcctgacccggccaccatccaatgtaccaggcaaggactccatccggtacgagaacacggtggacgtagaccccaaggtcttccagaacctgcagttgtttagccgcgaggacgccaacgggaaaggtgagcacggtgccgacagggtgccacccaagctgccgggagaccagctgtttgagtgttttgatgcgcaagacctgaatgtgaggctgaaggagctgatggacggcctgtcggtgaaggtgatctccctgttggagttttgtgtgtgcgggagaggaggtgcctccagcaggagggcattcggggtgggaagccagtttctgtgtgcaagcctgggtgcccaagtcatcctcacaccttctcctgcatggctggagtcgatgggaggagggtgtcgaccagcgccctgcaccctcatgtcgcccctgcccgcgtgccctctcccctggctggtgatcctccagcggctggtcctcggaaagccttctacacaccctcccccgccgcactctctgctccccacgcacctccaggtcttccgtacctacaatgcctccatcgtgctggaccggctgctgaccggggaggtggactcggagagcgtggaggccaagaaggcggcttacgacacggccaacaaggaggtggcggtgctgtgcaaccaccagcgcgcggttcccaaagggcatgtaggccagatggagaagctgaccgccaagatggaggcgcttcatgctgagctggcggtgcgttggcgtggcggtgcaagaggggccggcaggcgggtcgtgaatcccggtcctgaaggatgggacgcgtga

SEQ ID NO: 6064 - DNA, 570 bp, Chlorella protothecoides
atgggtggaggaggttcgaggggagaggggcagcgacgtcatcatcgtggcggttggcaacaagacggatctggtcgagaagcggccggcttcgaaggcaggtcgactgatccaacgcatcgacccaacacgattcggcaggccccgcagggcacacccctccaatgtcaccttccccccactctgtattcccatcgccaggcaagtatccatcgaggagggcgacaccagggccaaggagctgggcatcctgttcatcgagaccagcgccaaagctggcttcaacatcaaggtgaaccgcgcgcggtatttctctccacggcacgcgggcgccatgcctgcgccgtgcccccgacagggccatggtcctccctgcgcgagccagcgctgagcctggaggccacccaccccctcgccacgcaggccctcttccgcaagatcgccgctgccctgccggggatggagagcttgggaggttccaagcaggaggacctggtggacatcaaccttgcaccctcctccgccgccaaggcgggaggtgcaggcgccgcctctggctgcgcctgctga

SEQ ID NO: 6065 - DNA, 210 bp, Chlorella protothecoides
atgtgtattgtgcaccgcttgctgcgtggctgccccaacccctgccccctccccgccactgcttgcaggctggagaacagggtatcgaagaagcagcagcagattgagaaggcagagatcaacttcaaggtgaaggaggacctgaagactgtcgcactggggacgtccaagatcaactacctggaccctcggatcactgtcgcatggtga

SEQ ID NO: 6066 - DNA, 1746 bp, Chlorella protothecoides
atgtcgccctgcccgacgaccgccgtgggtgtggcctcacgcctcgcgcccacgggaaacctctttcccttccgcggggtgctggtccccctgcggcgcagcaagcagagctaccgctgcattagatgccacaccacgctcgagtcccaggccgagcctgccaatcggcgggagcccgaggcgtcagaagcccccaccgccccggtaaccctgaagcccccgcccagccggcgccccgcccccatctaccgcgccccgccgtcgtacactccaggggacgattcacggcccggcgagcggaggggccccgagggagcacccaggggccagcctggcacgcgcccagaccgaagacccaacaacaggggcccgcctgggggtgccaggccgctcccatctggcacgcggccgcctggctctccccagcagccttccaatggcagctcgggccagccataccagaggagcgcgtcccagacggccagcaggggccggcaggccaggggggcctacaacactcgaccgcccagccgcaatcctccagtgccaatcacaccagctgccacagaatcgccgcaggccgcatcaaatggtgcggtgtttgcgatgctgcaagggctcctggaatccggtgctgcgcagaacgggcggggtaaggggggccctggcccctccataccccaggaaaaggagaaaaagcaggagtgggtggacctggactccaggaggcgcgcccgcctgaaccgtcggtcggagcggcgcgaggagaggctggccaacgtggcggtccgagaggaaatatttgaggtcgggccggagggcatggcagtgggcgacctggcggccatgctggccatccccgcggttgacgtggtcaagtacctcttcctcaacggcgtgatggcggccatcaacgccaccctggaccccgacaccgtcaaggccgtgggcaaggagtacggggtggaggtgctggatcgagatgtcgccgacgtggcgtctggcgcggtcaagtcgctggacctgtccctggacgaggacgaggtggcggtgccgcgcccgccggtcgtggcggtgatggggcacgttgatcacggcaagacctcgctgctggaccacatccgcagcacgcgcgtggcggcgggggaggcgggcggcatcacgcagtccatcggcgcctacacctgcgccgtggactctggcggcgagcgccgcgccatcaccttcctggacacgccggggcacgaggctttcggggcgatgcgcgcgcgcggcgcgcgcgtgaccgacgtcgcggtgctggtggtcgccgccgacgacggcgtgcggccgcagacgcgggaggcggcggcgcacgcgcgcgcggcgggcgtgcccatagtcgtggccatcaacaaggtggacaagccgggggcggatgtgccgcgggtcatgcaggagctggcggcggaggacctggtgccggaggcctggggtggcaagacgcccgtggtggagatctcggccaagcgcgggacggggatcgacgggctcctggaggtggtgctcctggtggcggagctggaggagctggtggcctgcccggaccgccccgcgctgggcacggtgctggaggcgcgcatggaccggcgccagggcgcctgcgccaccctcctcgtccagactgggacgctgcgcctgggcgacatggtggccgcaggccaggcttacggaagggaggggagtgaaggccggtgggcgtggtga

SEQ ID NO: 6067 - DNA, 393 bp, Chlorella protothecoides
atgtggagagtgagagcgttccctgcgctcccaacgcacacacgcatacacacaccgcttccgactcccagggggtacaacatcggccaacgcctgatcgacgagtacctggctcgctccaagacaacctcctgctccgacttcaaggaggtcgcggaacgcatcgcccacgtcggcttcaggatgtttctgaacaccagcgccagagtggcggcttgggcccccgacggtcggtcctgcagcctgatcctggaggacaaccccctcacggactttgtggagctaccggagcagctgcgggggctgagctacagcaatatcctgtgcggtgtgattcgcggggccctggagatggtgcgaagtgtggggggagaggcacacgcggggtggtga

SEQ ID NO: 6068 - DNA, 264 bp, Chlorella protothecoides
atgcaggcgcgagacagggcttgggccaagatgtcgccccctgggcgccaacagttcttccaactggctccgggtcatgctcggacacaggaagacctcacagaggacagtgaggcaaccgtggactccgatgtgccgccagacacatttgacttggtgttcctggaggtggaggcggtggactacgtggatctggtgggcaacacacggaggcaatggcatgtcatggaaggggaatggatgtctggagaggtgaacccctga

SEQ ID NO: 6069 - DNA, 741 bp, Chlorella protothecoides
atggtcacgctgtccagcctggccagcagcgactccggggacgaggaggggccgggggggcccggggatggcggcgccggcgccggccaggcgctgatgcacatgaacctggtgctgaaggccgacgccagtggcagcgtggaggcggtgcgtggcgcgctggcggcgctgccccagggcgcggtggtgctgcgctacctgctggctgcgccgggggaggtgagcgagtcggacgtggcgctggcctccgcctcgggcggcgtggtgctggccttccagacgcgggcgggggaggccgcggcgctggccgccaagcaggcgggcgtggagctgcgcgcctactccgtcatctacgacctcgtggacgacgtgcgcgccgcgatggagggccggctgaccagcgtgcaggagagcgtgcccctgggcgaggcggtggtcaaggccaccttcggcggaggagcgcgccgcgtcgcgggctgcgaggtcaccgagggcgcgctgcgcaagggtgccagcctgcgcgtctggcgcggcgcgacgttggtgcacgaaggcacgctgacttccctgcgccgcgtcaaggaggacgtggccagcgtggccgcggggacggagtgcggcgtgtcggtgccggacttccacggctgggaggcaggcgaccgtctggaggcctttaagctggtgcagaagaagcagaagctggagcaggcacaggcagccgtcgcctccttcggggattga

SEQ ID NO: 6070 - DNA, 519 bp, Chlorella protothecoides
atggcctccctgggggcctgcatcggcatgcagggacacgtctcgcctacctcccgaaccagcttcactcctcccccacaccgcgccttcggcgcccgccgcccctccgctccccggcccctcccgccctgcaacgccatcggcgtgccccgggtgccgtaccgggtgcccaagcagaaccagtggctctgggtggacatctggaactgcctctaccgcgagcgcatcatcttcctctccaaggccgtggacgacgagctgggaaatcagctggtggccaccatgctttacctggactctgagaacaagaaggacctcaatctgtacatcaactgctctgggggtgaggtgatgccctgcttggcgctggccgacaccatgcgccacatcaagagcgatgtggggacggttggctttggtggcgccatgggcatgccaggcttcctcctggcagtgggcaagaaggtgagaagggcaggaaagggtgtgtatgcagagggaaaaggtcgggattcttga

SEQ ID NO: 6071 - DNA, 498 bp, Chlorella protothecoides
atggagccactctccagcgccggatccctgcgccgtccttcccaggctctcaccgctgagcctgtggagcccctgcccgagaggtggcaagcggcccttcgcaacttggacacagccagcacatgcgcagactcgcttgcctctgccctcgacgaggccctgtacctcgacaccatggagtggcaacgagccgttcccgccagccagcagcaccaggccaagcagtccctgctgaatcgagtgcgagccctggaaaccctcctgaccgattgtcgggggaacctggcagcaagcgagaagctgcgacgggagggcgaggcccgcgtgcaggagctggaaggggagctggaaaataacgccaaggtgtttcgcctccactatgaggcgctgctggacaaggaccagaccatctccgacctccaggccgtcatctccgccctgtccctgggaagcatagatcagcaggtcgaaggcgggccagggagggcccagcgatga

SEQ ID NO: 6072 - DNA, 657 bp, Chlorella protothecoides
atgcctgacccagaccttgcctcacacgcaacctttctccacgctccgcacctttggcccctcacctacgcctggccgtctttgatccctccctcccttccccccccaaaaaaacaccaaggcaaccgcctgccgccccggattcatgaccgcctgtccctgtcccagacggtgggccgccgcgtcgtggtcatcggcgacgtgcacggctgcgcctctgagctggaccgcctgctggccgcgctggcccgccccgacgatctgctggtcgtcgtgggtgacctggtgaacaagggccccgcctcgccccaggtgctgcgcctggtgcaggagcgcggcgtgcgcagcgtgcgcggcaaccacgacgaccaggccctggccgcatggcgggcctgggacgcgggcctgcccatccccaagccggccaagcacggctgggtgcaggggctgcacgccgacctggcgtgcgagctggaggccttgcccttcaccctagacctgccggcctatggcgtcaccattgtgcacgccgggctcctcccgggcgcagatcttcgggaccagcccctgtcagacctcttcacggtgggtgccggggtgtgggagggggactggggaggggggctgggggcgggccaggcgggagggggacagtga

SEQ ID NO: 6073 - DNA, 426 bp, Chlorella protothecoides
atgcggtgcgccgccatcaacgcagccttccttgccctggcagacgccggcgtccccatgcgggacagcgtggccgcctgcgcggcggggtaccttgacggcaccgccctgttggacctcaattacaccgaggatggcggtggcggcccggaggtggcagtggccctgcagactgggctggaccagagccccaggccggacgacgttgtgcaatcagtcccactgtcatgtgcgcatgtgcaacccccggcgcaccaatcttctctccccacaaccgctcccagactcagcatggaggtgtttgaggaggtggtcgagctggctagcaacgggtgcagggcggtggcggagttcctcaggacgacactcctggcgcatgtggggcggctgagcctcgccacttccatcgccaagtcagaggcctga

SEQ ID NO: 6074 - DNA, 1413 bp, Chlorella protothecoides
atgggcgtctcagtgaatgcatggacagctggaccagcaaatagcgcccgtaccgttccgttccgggcaggcccctgccgcgtctatcgttcccagcgaccacagcgagcatgtgtgactacctttcccgagatagagcggcgcttgaagcagcgagcgtgtgcgacagttagtaccgacgcggatgtggccagcacttccgagaagtcgctggatcagcttcccgacgacatccacctctacaaggacctgcgcgactccattgccaccctagacctgcacgaagatgatgtagatgcagcggataatctggagggggtctggcgattcctgcccggcccggtgcgcacctttgtgcgaggcctgagccccaggctacggggcctgctgctgtgcaatctcctggtgttggtcgtcgccacgaactgggtggtggtcaaggacgtcggcgagagcttcgaccccttcacctttgccctgctccggttttcggtggctgcggcggccttttccccctttctgtccaccgcgctcaaggaccgcaccatcctacgcgccggctgcgagctgggcgtcttcatggcggcggggtacctggcccagagccagggtctggcctccaccgacgcgtcgcgcgcctccttcctctccacattcaccgtgctggtggtgcccttcctggcgggactgtctggcagcagggtgcgccccgtcacctgggcggccgccgcactttcgctggtgggcgtgggcctgctagagcagtcgggccgcccgccctctgtgggcgacatctggagcttcgtgtctgcggtcgcctttggcatccaggtggaaaaaggggggctgggggggtggggaggtgttgaagaggaggaaagggcaggggtgcgcatggacgtgagttgcagcgatggatggccgggaggggagacacacccctcccttcctccccacatccgccatcgccagattttccgcaccgagcactggtcccgtcgcctgggcgccgactccagcctccctctcatgtcggtcgtgctgaccacgactatggcggcgtcagcaggcgctgtcgccatcttgcaccctgagtacctctcctccctgctgcatcatccgctgctgaccagcctgcagtcctggggcagcatcacactgccctggcgggaggcgctgtacaccggcctgttcaccaccgacgcggtgctgctgatggaggtttttgcgctcaaggacgtgtcctccaccgacgccgccatcgtgtacacactggagcccgtgctgggcgccgccctggcgttcgctttcctgggcgagcgctggacgccgcgcggctgggtgggcgcggccctcatcgtgggctccagcgtcttctcccaggtcgccaacagcaagggcaaagaggagtga

SEQ ID NO: 6075 - DNA, 411 bp, Chlorella protothecoides
atgcccgccgacctcaggctccgggaaaacaagaaggccgacaacagcctgctcatctcagggttgcaattggatggcgtaggattggaaaagggctccatcaccggagcctacgagctggaagacgacggcgtattgcgtacagggcaagtgggggggaccaccttcacggccgtcgggcacaccatcacctctgtcattggggcaggcatcctgaacctgccctatgccgtctccatcctcggctgggtggccggccctgtgtgcctcctcatattctccttcatcacccagtacacctcccagctcctggcagactgcggggtcattcggggagttcgccagcgcacatacacagatgtggtggaggcaaccttcggtcgccgcgattatgtcatcatcgcctggtag

SEQ ID NO: 6076 - DNA, 2283 bp, Chlorella protothecoides
  modified_base (486)..(533): a, c, t, g, unknown or other
  modified_base (689)..(846): a, c, t, g, unknown or other
  modified_base (940)..(949): a, c, t, g, unknown or other
atggagcccacccattctaccactgcaacccttgcttgcaggcgccgaccacatcgcggccgtcacccgtcacggcggcctgctgacctggggcaacgggcagcaggggcagctggcgcgggtgggcgagcgcctgtcggaccgcgtgcgggcggccacgctgctgaccccggcccccgtcccgctcaagcgccggcgctcggggcgcgcggcggtggtcgacgtggcggcggggacctacgccacctttgcgctgctggccgacggcggcgtgctggccgccgggctgaacaactacggccagctggggctggagaacggggcgctgccggcctacgcgctgacgcacgtcgccgcgctggacggacgcagcgtgcgtggtgtgcgcggcgggcagcaccacacgctggtgctggtggagccgggggcggggcgggggggcagcgccgacgacggggagggttcggagggcgccgggccctcggnnnnnnnnnnnnnnnnnnnnnnnnnnnnnnnnnnnnnnnnnnnnnnnngcgcgccgctgctcagcttcggccggccgacctacggccggctgggccaggcggcggcggcggtgggctccgacgccgccgcgccggtgccacgcgaggtggacggcttggagggcgtggcgctggcgggggccgcggcggggctggcggggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggaggggggcttgtagatgtggggggggtggagagaagtcgaggccgtttgtggaaaggtgtgcgaggggtttggggcgcttgcatgggannnnnnnnnngggcgccttcagcgaggcgggcgacgcctggctgtgggggtttggcaccagcaaccagctgggcaagggcgacgacgacgaagccccgcagagtaccaatctgggtctgttgtgcggctgcgtactctgcactgcactccaccgccaatgcagtgttccagcagtcgtccctcccccccacacaaacctcctccagacgaggtagttccccggaagctggctgccaccaagaagctcgcagatcagagggtgatcgcgctagagtttggggggcagcatgccgcgctgctgtgcgtcccccgccccgcacagacgcaggcgggcagccagcaatgacacgcttcagtgcgggcaggcacacatgcctgctgggctcacagggatgcaccatgtgcgggcaagcacacatgccttcgaggctcacagggatgcaccatggttttggggctcttcttcagacaccctgcccatcagccacatactgtgcagccgcaaagcaagaggcgcgcgcaaaggcacgcgtgaccgaggaattggcaatccacggaggacacaagggctcgacaatggcaacatatatcaacaaactgtaccatagcataacgcgggaattgtacccttaccctggccaatctcgaccggaacttgggcgtagagtgatcagtctgggacgagctgccatcaacaaactgcaccatagcataacgcggaaattgtacccttaccctggccgctctcgaccggaacttgtacgtggagtgatcagtctaggacgagctgccgtgtgtcgcgtcatccacgcgtgcgcacggcatggacttggcatccagatacgatgtcattgtgttggggacgggtctggtggagtccctgcttgcagcgtgagtggtttccaggtggcggaatgcagctcaggattgtgtggaaaggtgctgcccatctccagtgccgcagccacatctggcaagacggtattgcagctggatgcccaggacttttacggcggtcgctgggccaccctgtccatagacgacttcctggcagccctgcgcccaggacaggccgcgggagccactggtttggaagtcgccggcagcacagaccccgcctgcatcggggagtcgcgtgccttcctcgtggacctggcgccgcggctggtctatggcggcgggcccatggtggatgccctgctcgcctctggggcccaccactacaccgaattcaagctcctgcagggcaggtgggagggtgggtgtggcactgctattgccggccacttgtgcagcatcagagctgatgaggcatcggacattcagttgcacctcttggcctga

SEQ ID NO: 6077 - DNA, 2019 bp, Chlorella protothecoides
  modified_base (1142)..(1151): a, c, t, g, unknown or other
  modified_base (1679)..(1688): a, c, t, g, unknown or other
atgaccaacgccggcctctcgcggccggacctgcgcgccaccatcgcacacggcgccctgctcctccccgaccccgcgttgttatccaccggggtcgcgctggaccggctcgccctgctccagcgctcggcggggcggtacggcgcgggctccggcgccctcctctgccccatgcatggcgcgggggagctggcgcaggccttctgccgctcggcggcggtgggcggcgcggtgcagatgctgcgcagccccattgtggccctgcggctggaaagcgcggaggggagccggatcggagggggtgcggcgactgtgagcgacagcgctgggcccaaggtcggtgcctcgaggcctgtctgcactgggatatacctgggcacgggggacgaccgccaggaggtggcggcaggggtcgtcatcggaggggtggcagagattgcgtcggcactgcacctcggcgagcagatggccgatgcagcacagagtcatcctgatgggggagctgggggcgtcgtgcatggagctgggcagccctgtggtgaggtatctgatggcacagccggtggagctgggcagccctgtggcgatgcatccagctgtccatccagcgagcctgagaggccacgggccccgaccttgctgcgctgtgtggcggtgctggatgcgccggcgctgcttcctgggcaggacagggtgactggagcatgctttgatgctgacgcctgtggctgggcggggtgtgaggctttcccaaggcaagaaacggactggaccactgcatggcgcccagggtgggaccctgggcctgcagcacggaacacccctgaccccctgcggacaccctgccttgcgcctcattctctcctccaaacgcccgccctcctcaggacgctggtgtacctgtggacagaggcagccgcagagcgcggcgcgcgaagcgtgctggagccagcgctccaggctgtactcagggcggcgtctggcacggccctgttcgcggcgcaaggggccgctgagggaggtggaggaggcggcgtcagcgctggccctgcatctcttctgacggccgtgtactacacagaggcgccgtctgacctccggccagatgcgctgccctcaaatgtgacggcctgccccgaccnnnnnnnnnngggcggcgtcggcgctggccctgcatctcttctgtcggccgtgtactacacagaggcgccgtcgggcctccggccagattcggtgccctcaaatgtgacggcctgccccgaccccggcagcgaagtggcggtggactcgtgcatagcatccgctcggcagctgttccacaggcagggctgtgaccctgatgtgcaagagggctgtacggcgcacaagcctagcgtcaaatggcgatgccccatgctcaggggtgcattgacagctctaatgcaacatcaacccccgcaggacgtttggacgtttggtgaggaggggcgcttcccgctcgatcctgatccccctgcgccggacgccgaggatgtggcctcagacgaggaggccctggacgcactgcgaaccgctctcagaacagtggatggcaccgaggaggcagccaaggagaatccggatcttggggagagcgaatgtcctggaactgagttcgatagcattggttatggcaagggccctgaccagaatggggcctnnnnnnnnnngagagccccatgtcctctgtttgctgtgagaccacggcgcgcgctttcacgcggatcatcgtatacaacgggcaccatcaaactcttctcggcgcattgccctttgcatgcccatgcgtgcaatattaagaatgtcccggaactgagttcgatagcattggtcatggcaagggccctgaccagaatggggcctggccgaatggcggagtgtgcagaaaacttaccccggccggaagactacctcaccatcaacggctttcgtttcgtaagtgttgggagtatcgttcaaagtataggtgattcagcaagccatgctatcgctcttttgtga

SEQ ID NO: 6078 - DNA, 621 bp, Chlorella protothecoides
  modified_base (420)..(429): a, c, t, g, unknown or other
  modified_base (588)..(597): a, c, t, g, unknown or other
atggctgccgggttgagggacgccctggcggcatacaaggcccttctgggccctgcagcagaccctcagacccccgaggaagccgagagagaccgaggcgcctactttcagcagctacgggacagcctgagccccggcccctctctggccaacgaggtccaggcctggccccgtagtcctgccgccgacctgcctcgctcccgccacctctccatctccacgggcatgcgccttaggtatctggagtggggcaggggcggggacgagaccgtcctcatgttgcacgacgctggttccggtgctgaggcctggtcgcccgtggcagggcccttggccgcccgtggtatgagggtgctggccgtcgacatgagaggtgggaataacaggggtctgatgaagtggaaatcatgcatcaatgannnnnnnnnngtgctggccgtcgacatgagaggtgggaattacaggggtctgatgaagtggaactcatgcatcaatggcacgggcaacagatgcaagcatggcatcactcggtttctgtgcaggctgaatcaaaccttacacccacccccctccctttcggaacctccnnnnnnnnnntcactcggtttctgtgcaggctga

SEQ ID NO: 6079 - DNA, 1848 bp, Chlorella protothecoides
  modified_base (99)..(108): a, c, t, g, unknown or other
  modified_base (1083)..(1092): a, c, t, g, unknown or other
  modified_base (1297)..(1306): a, c, t, g, unknown or other
  modified_base (1556)..(1565): a, c, t, g, unknown or other
  modified_base (1634)..(1643): a, c, t, g, unknown or other
  modified_base (1706)..(1715): a, c, t, g, unknown or other
atggctgtgcttcggatcgccgaccagcctcgagtccccatcatacctatgccccccgcaacctcattgatcgcagatcattgcgacacagcggacgcnnnnnnnnnnctagatatggctgtacttcggatcgccgaccagcctcaagtccccatcatacctatgccccccgcgacctcatcgatcgcagatcattgcgacacagcggacgcgctagtctgcgcggcaccgcaagggaagccccctctgcctgaccaggcctggggtggagggatggcgtacaacgcaggcaccacggctggggagcgggaggtccgcctcccccgcgcgactgcggtgaagaatcgacaggcagcgagcaagcagattactgcggagcaaatcctgcgtgaatccaaggcactacaagcagatgattttaaagcgcctgtggtcaagatttccgacccggaggagctcgcagagagagcttgtgcactcaggtttgctccagccaaccagcctgtcctcaccgctgatccccccctccccccaccaccattccacgcagagtaccggctggcgaagcgcaaggagatggaggacgatgtgcggcgggtggggcgctggaaccccacggtctgggtcaaatacgcgcagtgggaggagcagcagaaggacttccggcgcgcgcgctccgtgtgggaacgcgccctggacaccgaccaccggaacgtctcgctctggctcaagtacgtggagatggagatgcggcaccgcttcgtcaaccacgcgcgcaacgtgtgggaccgggcagtgtccctgctcccccgcatcgaccagctctggtacaagtacatccacatggaggagatgcttgggaacgtggcgggggcccgccagatctttgagcgctggatgaagtgggagcccgaccaccacggctggacggcctacatcaagctgtgccctttcccagatggtctgtggccggcagctccgtgcatggccttgctgaccataccatgggcgaccgcctcttgcctggacggtcggcgaggtgcctgcatcgcagcgtttcacatcaccgtcgccccccccccnnnnnnnnnncagatggagctccggtacaacgaggcgggacgagcgcgggacatctacgagcggtatgtgcgctgcctgccggacgtcaagtcctgggtgcgctacgccaagtttgagatgaagcaaggtgagctgcgggtgatgctgttcttgacatgggtctctccttgtcgtgcgctgaggttgctggatgtccaagggaagtgtctgtgtnnnnnnnnnngtgttcctgacataggtctctccttgtcgtgcgctgagtttgctggatgtccaagggaagtgtctgtgtctcctgcacgcgacgtggcggctgcacgccgctgctacgagcgtgccgtggaggaactgggcgaagactcgcagtcggaggagctgtacattcgcttcgccgagttcgaggagaaggtgaaggagccggagcgggcacgcgccatcttcaggtacggactggacaccctgccgcgctctgnnnnnnnnnncttgagaatgcacctcggcccacagcttttggtggccacctgcttccccttccattcccctcgcccccnnnnnnnnnnacaagcccggaagggggggggtaagggtatatcgtgctttcccgggtgcccctcgcgcccacnnnnnnnnnngcaaccaactgcgcaagcgatatcccgtttgcgggaacaagctgctagcatccggcacaagcccggaaggggggggtatgggtatcttgtgctttcccgggtgcccgtcgcgcccacgtggctccccccttag

SEQ ID NO: 6080 - DNA, 783 bp, Chlorella protothecoides
atgcacgcctgctactccggcagggcagtcgccgggccgtccctgcacacatttcaacgaaccacgcaccctaccacacgatcaagaggcctgaagcttaggctgtatgcccagagcgccgtgctgctggatgtacgggacttggaggcccgcatcaccaacacccagcagggcgtgctgaagggcgtgagcctgacggtccgggagggggaggtccatgcgatcatggggaaaaacggttctggcaagagcacattcagcaagggaaaggatgcccgggatggactgacccaggatggcaatcacgcattcctcccatgccgcgagttgctgctggttggaggtccacgacgttcagcattgccgtttcccgagcaggtgctggttggtcatcccgagtacgaggtgacgtctgggtctgtggactacaaaggggagtcgctgctggggctggagcccgacgagcgctcccacatgggccttttcatgaggtgggcagtgtggagcgagattgaggtgtccaagttgcgctgcatggtgctcgatcatatcacagcatgcctcaggagggtgtcgaccccggtccaacccatatgcttgcgtcccaaagacggggaccccccagcctgtccgccgcagtttccagagccccgtggagatcccaggcgtttccaacatcgacttcctgcgcatcgccacaaacgctcggaggagcgcccagggccagaaggacctggatcccctagagttctacgcttttgtcatgcccaaggtgtggtttag

SEQ ID NO: 6081 - DNA, 507 bp, Chlorella protothecoides
atggacgccgccttcctgaaccgcaatgtgaacgaggggttctctgggggcgagaagaagcggaatgaaatcctgcagctggcctgcctggaggcggactgctccatcctggacgagatcgattcggggctggacatcgatgccctgcgggatgtggccactgctgtcaatggcttccggaagcagagacctgcagcgggtctcatcatggtgacacactacaaggtggagaggggcagatgtgggcagtgtgagagggagggaaagctggtatgggaagcaggaggggagctcaatcatggcgtgaggctggtggagcgatgtgtgagtcgccggagcctaggacatggaggaactcactgcttgagtttcaacataatgtctcgaggccaccacagcgttggggagaggcctatggatgggaagatcgtgaagacggggggcatggacttggtggaccagttggagctggaggggtacaaggtgctcagcggggccgggcgatga

SEQ ID NO: 6082 - DNA, 931 bp, Chlorella protothecoides
atggccgcacagttcgaggtgcggcagctgcgcctggacgcagcgcgccgcatcctgggcatggccctgggcatggcccccaaggacaagctcttccgctcctacatcgacatggagctggccctgggcgccgttgaccggtgccggaccctgtacgagaagtatgtggagtggaaccccgcctcggcgggggcctgggcgcgctgggcggagctggagcggggcctgggggaggatgagcgcgcgcgcgggctgtacgagatggcggtgagccagcccgctctggacggcccggagctgctgtggaaggctttcatcgactacgagatcgcgagcgggcggcgagacgctgcgcgcgcgctgtatgagcgcctgctggcccgcacccgccacgtcaaggtctggctcagctacgcgcgcttcgaggccacgccgctggccctgctggcgcagcgcgatgaggaaggggaggaggagggcagggccacgccgctggccctgctggcgccgcgcgaggaggaaggggaggaggagggcagggggagcgagggcgagaggagggccgaggcggagcgtgccgagggcggcgcggcgggcgtggcggcgcgcgaggcggctgcgcggcgtgtgtacgagcgcggcttccgcgcgctgcgcgaaggccaggcggaggccaaggaggaggccttgctcctgctggaggcctggcgcgccatggaggcggccagcacctgccgcccggcagaggagaccgaggcggcggtggccgccgtggccgccaagatgccgcggcgggtgaagcggaaacgcgccatcgtctccagcgccctcctccagccgaatgtagtcgaaccaggtgtcgtaggacagggggttggcgcgtacctcggcgtcgtactgctgccgcctctcggaaacgatcacctcctgt

SEQ ID NO: 6083 - DNA, 573 bp, Chlorella protothecoides
atgccggccgtcaccgcgcacatcgccgtcatggtcggcgcaaggagcggatgggtgagcgggggcgagggcgcggccctggcgcgcgccgccaccgccgccgcggcagctggcgtcgtcacgctgccggggatgggccaccgggcgctgccggatggcgcccgggccctcacggcagcgctgcaggacttcctggaggggccggcgatggcggccctgcagaggggcagcgcggtgagcaggcgccctgaagtcctgggtctgaagaccctgccccgctttgacaccctgcaggacgcgcaaaagctgagtcgtgcgcggagacgctgtgcagaacagacaatgcatcacaggaagaggcgcagacccggtgaggctcccccaccagcccgcctgatcccatggacccctccacaggcgcttggaccccggcccctccccaggccagaggctgtggaggaagccctgaggaagctggatctggagaacggagaggagccaggttcagtgggtgacgcacaccagacagccctggccaacaacccctccgactactttggcatggtcgggtga

SEQ ID NO: 6084 - DNA, 885 bp, Chlorella protothecoides
atgtcgaatgaaggatggtgcctggctctgcaagtacctctgcaagggatctgcagagtgcatggggtggcactaccagtccataatcacgtccacacactggcgtggctctgcactccctggcagctccgacccttcctccctcgccctgaccccgtaggccgcggacggggcggacccaccagatccgggccgcggacggggcgaacccaccagatccgggtgcacctgcagcacgtgggccaccccatcgccaatgacgcacagtacgggggccggtacgcggggcccctggccagccgtgtcatggccgccgcgctgggggtggcctgggaccagatgcgggcggccgccggcatccccgcctggcagccggacggcggcccagcggggccaggcacggtgagcggaggcgaggcgggtcctgagccggcgagtcgtggcgtcagagggtctgacgcatcgaacgacggctgggcagcgccggaggcgtcgagtggcgacgcggccgccaccgcgtccaagaggccgcgagtggcggcagggaacctgggagcggccgatgcaaggggcgccgacgccttccccatcagagagccgccacgtccccaagcagtctttggctctgcacgcaatgcagacgcgtacgcgcagaaccaggcctttcgccagggagaagactacagggcgccggaggggagcctggacgacagctgtccgcactgcccatacctggctcccatggactaccccctggacctgcgcccgctctggctccatgcccgctcctacgcctgcgccgagtgggagttcgaggccccgctgcctgactgggccgccgccggctactgcccagatgcgcatcgccagggtgctggaacatga

SEQ ID NO: 6085 - DNA, 546 bp, Chlorella protothecoides
atggacctccaaacgccccagccccaccccaagtaccttgatgtaggccgtccagccgtggtggtcgggctcccacttcatccagcgctcaaagatctggcgggcccccgccacgttcccaagcatctcctccatgtggatgtacttgtaccagagctggtcgatgcgggggagcagggacactgcccggtcccacacgttgcgcgcgtggttgacgaagcggtgccgcatctccatctccacgtacttgagccagagcgagacgttccggtggtcggtgtccagggcgcgttcccacacggagcgcgcgcgccggaagtccttctgctgctcctcccactgcgcgtatttgacccagaccgtggggttccagcgccccacccgccgcacatcgtcctccatctccttgcgcttcgccagccggtactctgcgtggaatggtggtggggggagggggggatcagcggtgaggacaggctggttggctggagcaaacctgagtgcacaagctctctctgtggatgcatgcattcagggagaatctga

SEQ ID NO: 6086 - DNA, 231 bp, Chlorella protothecoides
atgggctcgcgtggcggcctggtggccaccttcgagcggcacacggtgctggtgtggggccccaagcacggcccccgcggcgcgctgtccctattccacaccaagccgttcacctgcgtggcgctgagccccgacgacgacacgctggcggcgggcgaccgttcggggcgcatcctggtctggcgcggcatccgggccgccgtggagtccgccgcggaggcggtggccgcc

SEQ ID NO: 6087 - DNA, 708 bp, Chlorella protothecoides
atgcagctgcgaggtgggggccagttcaccgcccggccacacctcctcaccctcgacggccagaccgtgctcgtctgccacggcaacttcgtgcgagcgcacagcgcggtcaccggggagccactctaccgcctcacaggtcacaccgccgaggtcactgctgttctagccgatccagacaatgccaagagggtgaggtgctgtctcgtgtctggagggggggatggtgggggcccggcctgcgatgtcggggccctgggagagcccctgggatggggagtccctgctgtgctcgggggggtgctgtgtctgaagcatcctcccaaaactccccctgtcatcctccccaaactccccctgtgtgagcctgcatcacctcccccccacccaccaggtgtacacctcctctctggacggcacgctgcggcactgggacctccgcagcggcctggtcctgcgcacctggcgcgtcccggagcccgtggagagctttgcgctgggcccgccgggccacgcctggctttcctgcccggtcaacgacgcctccggccgcctcttccgctacgacctgaccaccggcaccccaggacccctgcgccgcaagattgcgagcggcagccccctgtcggtgcgtgggattgggagtgggggccctggcaggcaggtgacagcaacagcattcacgcacctgcggacgccgtcctctga

SEQ ID NO: 6088 - DNA, 1356 bp, Chlorella protothecoides
atggtggcggaaacaggagtccttgctcccggtctcgctgcccaggatgggacaggggccggtcccggaccgagtgatggcggagcacaggaagccaccccgccgtccatgcatagcgctgaaggcgctgaaggcctccgtggcaggcgacgccacgtctggggccccattcctggtcaggagaacacaagcacaggggacgcctccacgaaaaagcgcaagaggcgcagtagatggggagagaaagaggaaaccaacgacgagaaggccatcatgctcatgcccaatgaaattgtgctgagcaatggcatgaaggagttgggagtacgcgttcaagaagcaccagggaatcagagcctgcctgcgccagcatcgcacatgctagctgtgtacctcccgccctctgtgactggacgctcccccactggcgacccagaggtcctggttttccaccagcagctcaacgccctgaacaagaagatctccgagggcgaaatcgacatccctccagagggagagcggtcaccctctccccccccaacgtatgatgccatgggcatccggctcaacacgcgtgaagtcaggacgttggtgcagttccagtccagtgacagaggcagaagtggttgcgccagcaatgctccagctcactccctcgctcgacctcccgcccacaggtaccgcgagaagatgcagcgcaagcgtaacgagctcatcgagaccctgattgcgcgggatcccacctaccgcccccccagcgactatcgaccggagaagaagtggtgcaagctgagcatcccacaccgccaataccctggctacaatttcatcgggctcatcattgggccccgtggcaacactcagcagcggatgcaggcagagaccaacaccaagatcgccatcaggagggactggtgccacgattgggatcacctgcattggagcaatctcagcaacgcgcgatgtccaagcttgtgtcctctgtcgatcgccctgttcatcattctcctgtcgactcaacaaggctgcctgcatgtcattacaaaatgcagggggcgtggctcgatcaaggatggcacggctcgcgactccaaaggggctgctggtgaggacgaggacctacacgttatgatcactggagaccggcaggaggacgtgagctgggtggaggctgcgatgggggagtgggtcgaggggaagggctggataattagagggcagctgcaatgtaacggtaagggtgaggcctcaagggcatgtcctggcggaatagggaggagtggtagaaatgtttggcctgggaaggccaagatggcgctggcagactgcagcgcttgccagaatggcactggctga

SEQ ID NO: 6089 - DNA, 1992 bp, Chlorella protothecoides
  modified_base (917)..(926): a, c, t, g, unknown or other
  modified_base (1707)..(1739): a, c, t, g, unknown or other
  modified_base (1862)..(1871): a, c, t, g, unknown or other
atggcctgcggactccttccgcctctggtgactcctgtttcacgagcatcgcctgggtgcgtactcaagtggctgaccttctctcacaatacagcttttctttcaccgcgacaggatcgcaaggcatcgcccctgctgcggggaggaaccctgcaaggggaggccgcggcgggcaaggatgcctctgacaagttcaaggccatggccgcaggggagagcacggcttccctccagccacaggtggtggacggcaagtttaccgagccccgctggaaggaggggcgctgggtcctggagtccttccgcgactccaagggcaacatggactgggatgccgtcatcacggccgagatgactcgccggaggatgctggagggaaaccccatcccctctggtgtgtggatgattgctgaacatgttccaggagggggcctcatcactaaggactgctcgacacctgcactctcaaccttgcttcaccccactccatcaaacacagtcaacgaagaccccgtgaggtttgacacctctgagatcccctggtgggcctgggtccgccgcttccatctcccagaggttgggaagggtgctttccttgatatcatagcgcctctcaaactggcacacacaaccccatgcggtatgaaatccccacaggcagagaagctgaatgggagggcagccatgctgggatacttcctggctctgggagtggacaagctgacgggtgtcggcctgttggatcagcaggagtccttcctcggcaaggtggtgctgcacgtcgccgtctttggaggtatgctgatttacgcagatggtagtgggggcaatgatttgggatggatccctcttgatggagaagagtcacaggtggtcatgcatcctcggaaagccccttcccttgcacatctcatttnnnnnnnnnncatcgtcaagtcccgaccctgtccaattgcagtgctcctgttccgcaccaccggcgacttcaacaagtacaagaacctgtttgacgaggccacattttacgacaagcagggtcacaggtggtcttgcatcctcgctaagccccttcccttgcacatctcattcgcagtggaaggcgtcctgggagggccaggttcggccatccgagaaggagtgaggcatcatcgtggcgcaaatgtgcctcccgaggtccaccctttagacagggttaggaacaaggcgtgtcagatggtgagggaaagaaagagggaggttgccaaggtggcaacacggggtgactcaacttgccataagtactggcatggcatacatgtgaagcaaccacgagggccggtgtcagccgtccacgcctctggcaaaaacgtctaccgccccgcgatgcagctgtgcagtgaaaatgctgctgggcaggagctcgccatcaacgggaggggccagggtgaggccgcatgcatcgcgcatggcacagtcagcagccctccaccgacccccaaggatgggaccccttgttccctgtatccaaaccccacccctaacaccccctctcaccggctcgatgcggacggcgagggcagggatgacctttatgtaatcgccgtggtcgcccccagcctccagcccgatgtgcgccatgcgcaggaggaagcggaggtacatcaggcgactgcagcgcttgatcaccaccaggtggagcttgccgtcgctcaggtggccatacctgcnnnnnnnnnnnnnnnnnnnnnnnnnnnnnnnnntcaattcccagtcccagctgcggtgggtgctgagccagagtcgatgctaccgcttgacagcaactctgcaaatgaggcgcgggttttgcatgggatacgaggggatcaaccactgaacacccnnnnnnnnnnaccgggagatgaggcgcgggttttgcatggaatacgaggggtccaaccactgaccccctccagctcaattcccagtcccagctgcggtgggtgccgagccagagtcgatgctgccgcttga

SEQ ID NO: 6090 - DNA, 657 bp, Chlorella protothecoides
  modified_base (96)..(105): a, c, t, g, unknown or other
  modified_base (221)..(230): a, c, t, g, unknown or other
atgactgcatgcccgcacactcccctgcgctcctacgatgatgcccgccctccacaatctgatgccgtgcctgcattgctccgatcatgccctgtnnnnnnnnnnattacaatgatgtccaccctccacaatctgatggcgtgcctgcattgctccgatcatgccctgtctggggagcatgtatgccaccctgtccccccccccccccccccccccccccnnnnnnnnnntgagcccggtgctggccgtcaagcgggatgccgccgatcccaagagtcgggtggtgatcaccggccagggactcgcttccgtgttcggaaacgacgtggacaccttctacgactgcttgctggagggaaagagcggcgtggacaccattaccaggtgcagggctgcgctgagttgtgcgtcagggctggggtggttgagggatgggactggtatgggcgatggcaggctgttggtgacaatcatgatcccactcctccctcaagcgcctcctctgcatcacccaggtttgacatcaccgagttccccaccaagtttgccggccagatcaagtcctttgacgtggagggcctggtggacaagaagaatgctcggcggtacgacgacgccctttcctatgccatggtcgcatctaagaaggtgggttga

SEQ ID NO: 6091 - DNA, 687 bp, Chlorella protothecoides
  modified_base (621)..(630): a, c, t, g, unknown or other
atgtatggccaggtcaaggtggaggacgagtcgtaccagctcaagcccatgaactgcccctgccacgtggccatcttcaaggcgcggcagaccagctaccgcgacctgcccctgcgctgggcggagcttggcacggtgtaccgctacgagcgctccggcaccatgcacggcctcttccgtgtgcgcggtttcacccaggacgacgcccacatcttctgcctgcccgaccagattgcgggcgagatcaggggggtgctggatctggtccagtcggtgttcaccgcctttggctttgaccgctacgaggtcaacctgtccacccgccccgcggagtcggtggggtcggacgccgactgggcccaggccgaggccgccctggtgtcggccctggaggacaaggcgagctgtagttttttgggtggggggaaggggaaggaagggggggcgcgggaggggatgacgggttcgagcattgagtgtgggcgggcaggcaagggagtctcgagggcctggcttgggcccttggagtggcgcagtcggtcacctctgactggcgcagggcgcgaaccaactgctgcggatgtggctctgccctgtgtggcctgcctggcccgtccctannnnnnnnnnagggagtctcgagggcctggcttgggccctgggagtggcgcagtcggtcaccactga

SEQ ID NO: 6092 - DNA, 936 bp, Chlorella protothecoides
atgtgcgcggaagagcagggcctgccatccctcgcgccgcgccagccccgcactcccacccactcggccgccggctcatgcctccttgtagggcccgaaggcgacggcggagttgtgcccgccgaagccaaaggagttggagatgccgacgcggacgtcatgccgcgccttgacattgggcacgatgtcgatgccctccacctccgggatggggtcgtcgtggttgatggtggggtgcacccaccccgtgcggatggcctggatggtggcgatggcctccagcccgcccgccgcgcccaggcaatgcccgatcatggacttggtggcgttcatcttggtgccacgcatgtcgccaaacacgccgcgcacggccttgatctccgccttgtcgcccaccagcgtggaggtggcgtgcgcgttgatgtagttgacctcgtcccggtccacgcccgcgtcggccagggccaggcggatgcaggtgctcacgcccaggccctcagggtgggggtcggtcatgtggtgcgcgtcgcaggtgaaggcgccgcccaggtactcggccaggatggtggcgccgcgtgcctgggcgtgctccagggactccagcaccagcacgcccgcgccctcgcccatgacaaagccgtcgcgacccgcgtcccacggtcggctggcgcgccagggctcaaagttgcgcgtggacagcgcgcggcaggccacaaagccgcccaggcccacgggcacgatggaggcctcggagccgcccgccaccatcacgtccgcgtcgccgttgcggatgtggttggccgcgttcacgaatgcatagtttgccgtggcgcatgcggtggagatggagtagttggggcccatgaagccctggtcgatgcccaccagcgcgctgcctgtttgagggagagggggcgggggtccggggggctctga

SEQ ID NO: 6093 - DNA, 933 bp, Chlorella protothecoides
atggctgcccagaatgacgtgtggtgtggcagatcgtttgcgacggtgatctgtacctgggcgtgggcggcggggaagggcagcccagtcgagaggttccccaaccgctgcggtgatcagttcccctgcagctgttcatggggaggtcggaccgcccatcccacctctgatgaccactgcccctcaccgaccacaggcctggcacgggggtttggcttcatcaccttccccgacgacgccaccgccgcggcggcgaggagggccatggacggacacctggtggacgatctgcccctgatcgtgaggatgaagggcgagcccagctccggccccgccttccccatgcgcagaggcgtgctcgtttgcgtcctgctggtgggcaggggtcctcaccagctccctgccgcggccgccttttcctcgcatcgcggggcgtgcttgtttgcgtcccgctggtgggcagggatcctcaccagctccctgccgcggccgcctgctcctcgcatcgcggggtccccaacgatatgcccacccactccccaccctcccccaacaccacaacacatctcaggtggtgggccctcccgccccgacgacgacctgccgccggagaacaagctgtatgtcggctcgctgccccccagcatcgacgacgccgctctccagcgggaattcgagcgcttcggccccatcgcctcctgccgcgtgatctacgaccgcgacaccaaccgcccgcgcggctacgcctttgtgaactttgtggacacggaggcggcgcgggccgcgctgttcaacatgaatggcttcacaggcttcgagggggggaggcccatcaacgtcaagatctccgggcagtccggggggccgggaggtgaggaaggaggcagaggggggaccaggatgcacgggatctctgtggggaattgttgctga

SEQ ID NO: 6094 - DNA, 795 bp, Chlorella protothecoides
atgagtgcccccatcctgcgcagtgcatgcttcaggcagagcggcatgctcatgtttgcacgtgcgatgagcgccctggacgtcgtgccgaccgcggtgtgcccaaggccgttcagtgtcggggccagcagaccacgtgcccgagcgccatcccatggcccggtgcgagggttgagctcctcctcccccagcctcccgcccagggtggtatgcggctccagcaagcgcggcctgcactccgaccagatgcgtacctgcgcagcagcccccgctgcagccatggaggtggccccctctgagaccactccagctccagaggccagcctgaccctggacgacctccccaccagctccgagtcccccggcctgctggcagtgcgccacagcgctgcccacgtgatggccatggcagtgcagcgagtccacaagggggccaggtgcaccataggaccctggatcgaccgcggattttactacgattttgacatgccccagctgagggactgctcggcttgccctccattgcaaggacccatgtcgctggcatgcctggtgacattctcccttctcctccacgcacaacagcccatcacagagaaggatctcccaaagatccagaaggagatgaagaggctgatcaagcgcaacctggccatccgccgcgaggaggtaggccaggggtatggggcgtggttgtcccttggggacagggttctgggagtggagggatcacgtgacgtttgccatgccccatgcccaggatgtgtgcctggaccaccagcagacatagtgtga

SEQ ID NO: 6095 - DNA, 495 bp, Chlorella protothecoides
atgctcgaacccggccgacaccagggcggcctcggcctgggcccagtcggcgtccgaccccaccgactccgcggggcgggtggacaggttgacctcgtagcggtcaaagccaaaggcggtgaacaccgactggaccagatccagcacccccctgatctcgcccgcaatctggtcgggcaggcagaagatgtgggcgtcgtcctgggtgaaaccgcgcacacggaagaggccgtgcatggtgccggagcgctcgtagcggtacaccgtgccaagctccgcccagcgcaggggcaggtcgcggtagctggtctgccgcgccttgaagatggccacgtggcaggggcagttcatgggcttgagctggtacgactcgtcctccaccttgacctggccatacatggagtcgcggtagaagtccaggtgcccgcttgtctgccacagctcaccctgtgcggcgtaaagggggtggggagagagagttgcaagagatcttga

SEQ ID NO: 6096 - DNA, 507 bp, Chlorella protothecoides
  modified_base (219)..(228): a, c, t, g, unknown or other
atgcttcacctcccaccgccacagctggacacaccgctgccaaagccattgccgggtgacccggagctccctgatgaggaggaggaagaggagaagaagaaaaaccccaagaaggacccagatgaggaggacccagagaaggagaagcctgagcccagccaaccggacgacatgggtagaatttggggagtgggggcgggtgcctcggaagggagaggnnnnnnnnnnccagcatgggcagaatttgggaagtgggggcgggtgcctcggaagggagagaaaagatcagtccgaggggctgcggccagaatactgggccggggggtgatcgagccggccccggccactgcgcgggggaggttaagctctcgccatgtcctcctcaatatcgagtggaccgtcgagatacggacatggacagagtgtggtacgcgtgtgatcggggcgagtgatgtcgggagatacctgtgcgcgctggccacgatcccactggagcagtgcgcatag

SEQ ID NO: 6097 - DNA, 855 bp, Chlorella protothecoides
atgtggcacatcgccgacgcatgccttggtagtgggaaggtgatgtgcatgatgctctttcatctatcaatgtcgttggccttccaccaagtattgcaattggagatctggtctggcaaccaccccttctaccggggcgtcaactcgaccatggtaacagacgagggccgcgtcagccggttccggaagcgctttgcgggcctggaggcgctcaataagatctccggaggcgagacggtgattggtggaaagggcggcgcccgccccgccacgctggatgacgacagtgatgatgagggtgtagcggtggccgccaagcccgtggtcaagcccaagcagaagaagaagaagcgagctgtcgaccgtgggaggcagtcagggacgtggggtgtgtcaacaaagcaagagtgggtcgtgcagggcactgtgaggcaccgcatggagggtccagagcgtttgtggatgtatctcgcaagattgttcagggatgggaatggggaccctttgccgccgcagccatcgcctgagtgtccgggagggccattcctggggagtcgaggtctggccgggaggcgccattgccgccggggaaacttggtccagccgaaaggtcaaggtgcgcctcagacctcaaaggcggcgcggcgcgtgccacgccgcgaggtcaccctggccctcggggaggcacgccccttcaccggggtggcggcgccgctggaggtgcccgggcggcccctcttgaccccggacaccccgggcgacacgacggtggggagcttgagccccgtggtcggcaggtcgacgcccagcgccggcagtgcgttgcctggggcggagggtggggtgggtgggtga

SEQ ID NO: 6098 - DNA, 702 bp, Chlorella protothecoides
ctcgcggcctgggccaagctgtcggcggtgcagtgcaactgcggcatcgaggccacgctggacgcctgcatccaccaggtcgccacctgggagcgcgccgcggcgcgccagcgcgccgaggcagcggggggtggcggggaggcgggggaggaggagggggccaaggggccggcggcgtttgaagccaatgcagccgaggcgctggcggggtcaggggcgcgggctgaacaccgccctgcaggtggtgcagaccccccggtgccggagtccctccacgcaaacggcaagaacccatcgacgccgcgctctgcaccgcgctcgcgctcggtcagcttcgtggcgctagaaagcgcggcggttccgcagcgctcgccgagcctgcgcttaccggaggcggcgggcgcccccccgccgccctgcgccgacgagctgtacgatgcggcggaggactgcctgccgctgctggaggagcgcaccgcgccgggcggcgcggaggcggctggccttgcagccgcctccgcacacgcctgcacagacgacagtgccaacgtgctggcggggctgacgccgctggcgcgccgccggcgcgtcgcggcgcgcatgtcgcgccaggggtccgggtcgggcggcagccgcgcgcgccagctggcgcgccgcggcgcgctgccctcctccctgggcctggacgtcgtggcgccctga

SEQ ID NO: 6099 - DNA, 1635 bp, Chlorella protothecoides
  modified_base (1456)..(1465): a, c, t, g, unknown or other
atgtcggacgccgaggaccctggtacttccggagcagccccgccacccaacgatgaagggagcaacgcccgctcacgactgctggagctggcaaagcgcaagagacaggaacaggaggaagcagagaatgctgcggcagcgaagaagggacactccgtagctatcgactttggagacaacagtgaggatgaaggagacgttgcagggcttccagaacctccaaaggaacaaggtgggccggcgagaagaacttctggggcggtagacgagcatgggcatgcagtgcaagaccaagtgcatcctgtgcccctcgaccttgcagtcaacatcgccgacctttttggagacgatgaggatgagcaggagcttgcggcccccacagaggccgaccgggcgttcatagatgatacgggggtggctgaggatcagcaaattgacttcggtgatgatgacgagcagcagttcaacaaagacgacgaggcagttgagtctgatctggaggatgagctggacaagttgtttacaaagcggaagagacgcgagtcaaacactgattatgagaataaggcactggtcgatagcttcctggctcagatggaggtagcagtggaagaggacatgaaggactacgagcaaggtgagtggcatcagcctgcatacagtgagcaatctttgcaggctcagcgctgcaaagtcacattagatctattcttccagcggattgctatgcagtcagcatcaggccttggatccctagcacaaggctcccgctccatgcgtgcagggaggcctgcaacgcacaagctgaggatgttgtcgcgagtgcaagacctcctctcaacgcagaagcttcacaacgagctgttggacggggggcttctaggagtgctcaaggcgtggattgaccccatgcctgatggcacgctgcccaataccaccatccgctcgtcgatcttgaaattgctggacatccttcccgttgactgtgccatggaggaccggaaggcgcagctgaagagatctgggctggggaggagcatcatgttcctagccaaagtgtcagatgaaacagcagcgaataagcgtctcgccaggggattggtggagaaatggagcaggccaattctggtttcacggtctacgcgcggtgctgacactgctgaggagcaacaaatactgcagtcgagacagctcaggctggcagccaagaaaccacaagctgacaaggagctggaccagaatggtcgtccagtcaagttgaggcccggcgatcctggattccggaggcacgcggcaatacccgaagcagcttctctggactatgtcaaacgtcctgaatccatgacagtcctgccggttggacggaatgcagggagagaaaagcccagtgagttggtgcaggggcagggtggatcagtatggagtatgcaaccggggtgtagtccgcctgctggtnnnnnnnnnnaaagcccatccgcctgttgggagtatgttcaacccccaacacgatcagctctcattcccccaggtgagcataagctcagcaagaagctcaaggtgatggggaagaagaatcaatttggccgtgctgccaacgtcagtgtggaaggacgcaatgtcaccatccaacactga

SEQ ID NO: 6100 - DNA, 762 bp, Chlorella protothecoides
  modified_base (40)..(49): a, c, t, g, unknown or other
atgcagcagacaggcttgcctgtcttgaagacgggaggannnnnnnnnnccccaaacttccaatgcagcaacaggcttgcctgtcttgaagacgggaggacgggtgtcgacttcttgcgaaagaccttcatcagaattgatcccgacgcaattcccctaaatcaccttggaggaacttgggacaaggccgaatatgaggacaaggcacaggagcgagaagttcaggagaaggatgccgaggagagcgcgctggacgctcgcaagaggagacggctaggtgatctctggccacagcatccgtctgctcatagctgtgacccttgtcctccctactcgccgccaaccactgcagagcgagacccgctgcaccagggactcattgtacagcgtggaaatctgaaagctcgggactaccagctcgatcttgctgcaaacttgaacaagacgcagatagtatctgtgggtatgcccctaaaccagcagggtggctactattgcagcgtatgtgactgcaaactgatggactccatgtccatgctagaccatatcaatgggaaatggcatcagcgggcactgggcatgactatgagggtggaggcttccaccaaggaacaggtgtgggatgggggggggggattggatgcccgtcccttggattctgggttcagtttcgttaaagaattcttcatgcggtcagaaagactcttcagatggctgcaattctcagagtatgcacctgcgcgtgcctggcaagccacctga

SEQ ID NO: 6101 - DNA, 1440 bp, Chlorella protothecoides
  modified_base (35)..(44): a, c, t, g, unknown or other
  modified_base (1149)..(1158): a, c, t, g, unknown or other
atggtactgttgaacgcaatgccaagcgtcacagnnnnnnnnnnacgtgagggctgtgccttgagccattgtgtgacatcttgcgctcacatcgcaggcgcatggtactgtttaacgcaatgccaagcgtcacaccatccttgctcccgtgcagttgagcgtttccttgaggtcatctggtcctgggtgatggagcccatgctgtttgtgaccatcggggcctcgatcaatttccagaccctgagctctggtaccatccctaagtctctggtcatcatctgcacaggcaaggggctatggcttggggagagcaggcgtcagtgtcatcctccgcatgatcgtgaccttctttgccatgtcacgcggtgggtacaccaccaaagagaagatcttctttgccctggcctggacgcccaaggccacctcatttcaatctcccactttctttcttcatctgccacagccacgcccttggcaatgatccaagcggccaaggctggccaacccgattatgcacaatgggagcagtggggatatgacatcctgacgactggtatcttcgccatcatcatctgtgccaccctgggagtgctggccatccatctcaccgcacaccgcttcctggaaatgcctggttcttggggagaccattcaggccaatctggccctgaactgcaatcccctccctgcaccatcgagtacctgcccctcacattcatgtgtcgctgtccctctcgatcttcgcagcccgaggagagtgatgagggccgtccgcagccatctcatccctctggggctgccagcaatgtggccctgcaccggagcctctccaccatgaccaagcggcggggaacagagggaggcctcaaccagtcagcctctgcagaggggcgtcaggttgggtacgaggacgaccacaccctcctgcatcacaacattgcactggaggactatgaggttgtggcgctgtacatcgatgccatctcagagctgtcgacgctggtggcgtctggcaagcccgacgaggaggagctgcagaggttatcccaccacgtggccatgatgaagagggtgagggatgccatttgtggtcgatgcaaacctgtacctaccattaccatttcaagtcttctattaaccgccctcacnnnnnnnnnngacttgctagtgtgcatgatagggatgccagttgtggtcgatgcaaacctgtaccctaccattaccattccaagtcttccattaaccgccctcatctccatgcagagagtggagcaggaggtgggccagcgcgaggtcactgtcagagaactcttccgttcagcctccctcctggccgccaacaagcctgtcgtgtacaggaatgccagcagggcgccccatcccccatcgctgcctgcgtctcctggaaagggatcgcatgatggtgacgctgcggtgtga

SEQ ID NO: 6102 - DNA, 933 bp, Chlorella protothecoides
atggccggggcggatcgagagcaatcagggaatctgtgcgtgcatgcgcttcacctccattcagagttggatcatgtggtgttattcttgcctcgagtcacaccatctctcaacccacctggcgtcaaacatgcagcgcctgcgctctttggcatgcccatccttctcggcttcaccatgggcttcatcctcaaggcagtcggtcctggtctggtggtccctgccatgttcaagttgcagaagactgggctgggcaaagatcaaggtatacctccaactggatgctcatgggggctgggagtcccacggatcggcagtgtgcacatcaagggtatcccgtccaccatcgtcatctccgcctcctttgatgacattgtggccatcaccggctttgccatcttctcccacatcgccatcactgggggccccgagtctgggaatcttggatgggagatcgctcagggccctgtacaggttgtctttggtatcctgggaggtctactcggtggtttcatcattgggtgcacccgcatcttttattcacgcctgattcgcctggtagccatctacggtggtggtgagttgaagagatctggccagatattgctgtgccttgctgtggcgtcaggcactcgcaagggtgtaccagcaccgacggccaacatactgcatcccactgtctcatgctgcccgcgctgccctacagcccttctgatcatgttcttcctggagtactacggcatgctctcggggggcgctctggggtccctcactatcgggctggccaccgccaacttctgggagcggggactgcctcgctgtggctccctggggcccagcttcaccttctcaaccgagggtacgatgggagcagtgtgggcttctgctctgggcggatcagtgcccctgcgtgacgtgagggctgtgccttga

SEQ ID NO: 6103 - DNA, 2433 bp, Chlorella protothecoides
  modified_base (221)..(230): a, c, t, g, unknown or other
  modified_base (563)..(572): a, c, t, g, unknown or other
  modified_base (2270)..(2279): a, c, t, g, unknown or other
atgtatgcagggctctggtgtgctggaagggacaggcagctggtatgccgggcacctacctccatagacgaccgccgcgaggatgatcacagcagcattgatccgtgtctcctctggaggaggggagggagtcgcggtcagcgaggcaccccaagcggggaacggtcacatcctatgggtcatcggggtcctgaacctctggacgcacaccttcctggggnnnnnnnnnnaggaaacggtcacatactatgggtcatcggggttctgaacctctggacgcacaccttcctggggccttgcaaggtagtagtaggcggtggcgaccttccgcgcgaagggcgaacgctcctgcttgtagggagtctcaacgccatcgacattggggccctgcacggcttcagcaatcgccggcgcatttgctgcactcggatctgggccagtggacattgtgcagatcgacgctggctctcaggaggacttgcatctcctgcctgcccgacactggactgcccccgagattgccacgtgctggaaaagggcgctcgtccagtgatcagtttcgnnnnnnnnnncaggacttgcagctcctgcctgcccgacactttactgcccccgagattgccacgtgctgtaaaagggcgctcgtccagtgatcatgtggcggtagtaggacgcctccagcatgggaattcaggtgcagcttccccacttcgtgcagacacgcggcacgctccaccgccacaatacaacactctacaggaagagtcccttcgatcgcaattgcagggactcaccaagctgttggcagataatgcaccagggtgcatgaaggagcagaagtttgaaaactattttgggcgcaagatcgcggtggacgcctccatgcacatctatgctttcatggttgtggttggcaggactggagatcagactctgacagatgaagcagggaatgtcacgaggcctgctccttcacctccccccatgcctgtcaaccttaccttaagatcgacctgtgcattgctaatcgacgaatgtgctcaagtgatccgttcttgtcaatcatgcgcaatctacatgatgtgcgatgcgcatgtgggactcattctcccccgaggagcaccggcctgcggacagatggcactaccattcctcctgcgccatcgcaggtttgttttcgatggcaaagccccgacactgaagtctgatgagctggcgaagcgatactccaagcgccagactgccaccacagatctagagacggccaaggagactggtactaaggaggatgtggaaaagtactccaagcgcaccgtccgtgtcacccgtgagcacaatgcagagtgtcgccgcctgctgcagctgctgggggtccccatcatagatgcgccctccgaggccgaagcacagtgcgcatccctatgctcccagggcctggtgtatggcattgccacagaggacatggacgccctcacctttgccacaccgcgcctcattcgtcacctcattcgatgggagaggagggcgggtgtggaggggagagaaggcgatggaaagtggacatccggaaaggctcatgctctcaagctcctggaccttgcacatgagacagagctagagcagccagcagcctcacccttccgtgtggacccaacctcgaaccgattcttggatccacctcctgctcctcgcaaggtactggctgaactggacctcacggccgatcagtttgttgatctgtgcattctgtgtggctgcgactataccgagaaaattggcaacattggacccttcagagctctccagacccgctgcgctctcaatggtgccaacgtcctgacaattgccttgcagctgattaaaaagcatggcagcttggaggccacccttgccgccctggacccggagaagtacaatgagtatgggcgcccgcagttaaggtgtcatccactcttgcaccctcacgcacagatccccgagccgttcccgtacaaggaggccaaggagctcttcctcaacccagaagtgctgaagcctgagaacattccgcccatgaaatggacaagcccagatctagacggattgctggaattcctggtgaaggagaagtctttcaacgaggagcgggtgcgcagtgctatccagcgcgtaactgcggcaaagagcaagagtaatcaaggtgtgtcttgccagggcatggggaaggcagaagtccggcgtgaagaacatggtagaaaacacagaacagacaggtttgccctgagcaactnnnnnnnnnntgcggaagtccgtcgtgaagaacatgggagattggactccttctttgggcccagcaagacgcccccttctcaagcccccaaacgaaaggaggcgggtaaggttgtgccgcctccgaaaaagggcaagcttgggggattcgggaagaagaagtga

SEQ ID NO: 6104 - DNA, 2916 bp, Chlorella protothecoides
  modified_base (1406)..(1415): a, c, t, g, unknown or other
  modified_base (1656)..(1665): a, c, t, g, unknown or other
  modified_base (1874)..(1884): a, c, t, g, unknown or other
  modified_base (1960)..(1969): a, c, t, g, unknown or other
  modified_base (2270)..(2279): a, c, t, g, unknown or other
atgagcggcacctcagtggctagcctggaagagattgtcggggccaagacttggtacaatcagacggccaagctacccatggagaagatccaggggttccgcgctccataccttgccttctcacccgagcagcgtgccatcctgtctaacaacggcttcaggtgcgcaccagggtggctgtgctcgggggcagggagatctgagttttgggatccagtcgaacaccgagtacaccctacagaggcagccagctgtgtgatttactcggcgccatgctttgcatttggtgaccaccggatgtccttcaatgcgccttcctgtaggtacgactcctccatctcggagtccttcccatccaccacatctccaagcgccacaaacctgctgtggccctacaccatggactatggcatcccgcaggcctatcgcgatgtatcaacgacccaggtcacctcaagatctcacacccttgcttcaccgcaggtctgcacgaccggggtgtgcagctctgacgaggtgtatgcgggtctctgggagttcccagtgtgggatacccagaacagcgacgcaagtctggcgggcacgatgaacccccagggcgatctctactccctgtacaagctggcgcttgacaaccgccgctccggcaaccgcgcgccgctgggcgtgtacgtgacggcggcctggctggaggcggagcccgagcgcctgacccagctgaacgctttttttgactacgcggcggccctcccctacacctggctggtgaccatctcccaggtgctggactggatcaacgaccccaccgtggccaccaagtacgcaccgacctgcctgtcccccgatcagctcctggcagagctgcctggggtgaagatctgcacccagcccaacgtcggctgctcctacgtgagagggcatggggggacgtgggactcggaccagtgcttgtgcatctgccagggcgcggagtcgactaccgggggctactgcagggacgctgtggggtcctgcacagtgagttccgggcagtggggtggcggggccaggttgggaccgtgccttgctctgtcttgcagctacggcgggggccgctctgcacccagggtctggttgttctcagactccaaacctgaggaggttgccaagggctacgactttgcgagcaaggagtacatctgccccataggtacctccccccccagcccgcccccatcacctcccccagcggtggccagccccgtgtctggacccagctgggggcccgctgagtccatagccccggtccctgcccctacccaggtctctccctccatacagctttcagacgggctgtgcggcaccctcccccccagcccgcccccatcacctcccacagcggtggccagccccgtgtctggacccannnnnnnnnngctcccgccatgccctgccccagggcatgacctgctgtcctttgccggcctgaccatctccgggtacgagtccctgaacgatggctatgccgtggccatcaaggcgctggacggcagctgtgaaacctgcgccatggcccccgtgacggggaccatcagctacatctccatcgacatggtgtgcgtccacacgatagcgtcgcccgcaggtgccggcgggcatggggcgcatgtggcagtnnnnnnnnnnggttgtgcgtccagacgagagcgtcgcccgcagatgccggcgggcatggggcgcatgtggcagtgcactctactcggatgcccacaatcactccagcacgccgaccaccacgtgcatctgtctcgcgctcaccctgcgcatcagcctgtgtggagtcgtctggtggaccaggcgacacgagcaccccccccaccccccacccccacccnnnnnnnnnnncaggggtacagcgtgacgctgtccagtgtctccatccgctcctcctacgacgtcctggtgaacatctacgtcgggnnnnnnnnnnaggggtacagcgtgacgctgtccagcgtctccatccgctcctcttacgacgtcctggtgaacatctacgtcggggagagcgccgccaacaacggcatgaacaacgcgctgtgtgcccagagcccagtgtgccctcgccacctccccgcctgcccgctccctcgacgccgtgcttcctccaccatcccctccgccccacctgccccgccccgtgctcctcaccgagtcagggcctcgctctcattccccttcctccgccccccccccccgtcagagctaccaggtgagggctggcggcgctnnnnnnnnnngcctgccccgccccgcgctcctcaccaagtcagggcctcgctctcattccctttcctccgcccgcccccccgacagagctaccaggtgagggctggcggcgctagcgaagtgccctgcgccgccaccggcacgtacgtgactgtccagaccaagggcacgctgaccctctgcgacatctaccccgtggtggcctcgtccgcgccgcccccacccagccccgtcgcccgctcccccgtcatcgtggacatggacgtgacggggctatcgaccgccgtggtgaccgcggcgggggcccccgccatctgcggcgtcctggtcagcctgacgaacgacgtgtcggccacctgctccgtcacctctgtggcgggtgtgccggcgggccggcgccggctgctggacgactcctccgtgcacgtgacggcggtggtgcagaccgcggactctaccggcttggtggcctcactgagcaacaccgcgcaggccgccgcccggatcctcgcggcgggagccgtgccggtcaccgcctcctccatcatcgtgagcggggggtggtgtttctctatggaaggggggagggggtatgatggaggggtgtgtgggcggggaggcttgtcatggcgtcgcttactatattga

SEQ ID NO: 6105 - DNA, 297 bp, Chlorella protothecoides
atgcagaccgcctggcgggccagccacggacgccgcgctttcctcaaggcgcggcgcgcggcgctagtgctccaggcgcacgtgcgtgggtggctggagcgcgcgcggctcgcccgccgccgcagcgccgcgattctaattcaggccgcggcccggggatgggcggtgcggcgccatgagcagaccagagcccgtgcggctcagatcatccaggtgtgtttgtgtatgggaggtgggggaaaatggtgggaaggggcgcgccttagggacactacttgtgcccaccaggatgactga

SEQ ID NO: 6106 - DNA, 222 bp, Chlorella protothecoides
atgacccgttccgctaccccagagtgccctacgacctgtctgcccaccgccaactgcaagtgcggaacaagcggcattcctggaggtctcgatgcgtcggtcgttccccagttcatcgtcctcactaccgacgatgcggtcaccctgaagaccaaagcatctcttctccagatcaccgacaaccacgtcaacgacaatggctgtgccatgcctgcaacgtga

SEQ ID NO: 6107 - DNA, 603 bp, Chlorella protothecoides
atgctcgccctcaaggcccagaaccacatggccaccctgaacaagctcgagagggccaagggctccgacgtctccgctcgccaggccaccaaggccctggtcacggccaatcgccagctgctggccctaaacagggtgctgagcctgctgggcctgcctgctgcaggggccggcccgcagtccgccaaccacccgcaggacccaatgcatgggccccctgcgggctcgccgggcgtcctgcagcgcctggggaagaacaccattgtcagggggggatcaccgtgtgaacccaggcatgatggcctcccactcgggggcatcagcatccagagacaggagaaggtgggtccagcgcgccacggcatcgctctcgcccctgcgctgataggcttccatagacagcctcaccaggcccctccacacgcccagcacactgtcctcggcagactgagcatggagagggacaggtgtaaatgtcagagcatgcgaatgcggtgttcgaccacatgcgagggaaaaggatcagcttgcagcatgccactccacccctccattgcgtggtcgccaaggccatcccctgccgctgcacctcctctggtttga

SEQ ID NO: 6108 - DNA, 423 bp, Chlorella protothecoides
atgagggtgcagaggtctgaaataccatccccaccccttctccacgcaccctcgcagctggaggaccagcagagcaaccgggctgggtggttatttgccaagggcgcctttgacaagggtgacctgctccacctacgcgacgaggaggagcggggccggcacctggagaaggaggtgcgcgatgcggagcagcgtgaatttgcacggcagcgggctgagctggaaaggagggcggagagcgggcagggagcgggggccgctccgtctgccggaggagcaggggcggcgcccagcaagcgaccccctggagcggagatcccgagcgggaggtgcgtcttgctgcgcagctgcgccctgcacgacatgcatgtgcagcaaggagagggagggagtcagtcactggtgtccttgatggatccgtga

SEQ ID NO: 6109 - DNA, 1464 bp, Chlorella protothecoides
  modified_base (493)..(502): a, c, t, g, unknown or other
atgagaggaggggctttgagggtcaggcatggggtggcagactgtggttctgcggaaggggttttggccccacctcacccctccccctttcctctcatagcattcaatcccccccttcaccttggtcaggttgttgacgaacaggctcttgggcaggatgttggtcaggcgcaccacgcgcagcaggttgtccacgtcgctctcgatggactgcgccacgcccgggtactgcaccttgatggccaccgcgcggccgtcgtgcagggtgccgcggtgcacctgcccgatggaggcggcggccacgggggcggggtcgaaggcggccaggcgcgcgcgccagctgggccccagctccgctgccagcgcggcatccagctggcggcgaggcatgacgtcggcgccggcgcgcacgcgctccagcgcggcctggaagccgggcggcagcaggtcctcgtcctggatgctcagcatctggcccagcttcagggccgcnnnnnnnnnntgaagggggggattgaatgctatgagaggacagggggagggggatggcattctgcaagggtgcgggccatgcgggtcaaggagtgtggcgatcacctaatctcatgcacccaaaagttcaagcagccgggtgctccttctgtggccaagaaggagctggcgctggagtgtgactacgagtatgaggcggcctcgcaggcgcgctatgcggcgctggtggcggctgaccccgagctggcccccctcttcttcgtcccccccatcgtccccgacctgagctcgcgcggggtgctgaccagcgtctgggtggagggcgtgcacatcgaccgcgtggcggagctggggcaggaggcgcgcgaccgcgtggcgaccagcctgctgacgctgacgctgcgcgagctgttcgactggcgcttcatgcagaccgaccccaactggggcaactttctgtacgacgaggccacgggacgcatcaacctggtggactttggcgcgtcccgggacttccccatcaccttcgtgcgggagtacctgcacatggtggcggcctgcgcacgcagggaccgggaggccatcatccgccactccatcaacatgggcttcctgacgggtgcgcaggctgtgcgaaggggaaacgggggaggcagtttgcgaggaggagcaagtcatgctggatgcgcacgtggaggcgggctcggtggtgggcatcccctttggcaccccggggctgtacgactttgccacgcactcgacggtgaccaagcgcgtgacggagctgggggcggtgatgctgcggcaccggctgacgccgccgccggacgacagctactccttgcaccgcaagctcagcggcgccttcctggcctgcatcaagctgaaggcgcgggtgccatgccaccagctgttcgaggaggcgtacgctcgcttccaggccaaggaggggacgggagagggggagcatga

SEQ ID NO: 6110 - DNA, 1440 bp, Chlorella protothecoides
atggtggtggggtgctgtgcgtgttggacccctcccgctcatatgcgcagtatcagcccctaccatggaggaccccccccaaacctcacctccaactctttacccgtcctccttcctccaggtgccacccggcctaaaaagggcctgagtatcctggagtggacgggcggcgtgatcccacagggcgtgctggtgagcggggtgaaggccgcatggaaggcggcctggctcaccttcatgcgcgagctggcgccccaggacgccgagggggcctacgtccgccccacctactcgttcgagggcgtgctgggatccccggacttcccgctggagaccggaaggtatcgcctgtacctcggcaacccctgcccctggtgccacagggtgggcctggcccttgcagcgcgcggcctcagcgaccacgtcgaggtggtgcacctgctggacgacgcggagcgtgcatctcgtggcggctgggtcttgagggccccggacccagtgtctggagcgcgggacctgaggggcgtgtacgatagcctgagccccaggtaccggggacggtgcacggcgcccctcctcgtcgacgtcgccgcccgtcgcatcgtgtgcaacgaatcctcgctcatcgtgcgcagcctgaacgcgctgcgcctgccgggggactcgggcgtggacctggcgccccagcacctcctgcctgagatcgagcgctggaacgacaggtctgaggcaaacactgtgcggcggagagaatgggagaggggctcgcctgactccaatggcgaggggtttccagtgtcctgcactgggtgtggctgcctgcaacagaccactgcggacatcaacaacggggtgtatcgctgcggcttcgcgaccacccaggcggcctatgaggccgcggagttctcgctgcaccaagccctggaaacggtggagtcggcgctggccgcctccccctttctctgcggggccgccgccaccgaggcggacctgcgcctccttcccaccgtgcagcgcttcgacgcggtctacgccacgctgttccggtgcgggcgcaggaggattgcgcacgactaccctgccgtcgacgcgtggaaggcacgcctgcttgctgcgcatgtgccgggccaagccttgcagctgcaggatgggctgagcatggagtgtgctgccacccaccgatgcctcggaaggctgctttggccgccagggaccctccccatacaaacctgtccacaccaaacacaggactgctatgaccaggcggacgctgcgcgcagctactacacccagctcttccccctcaacccgagcgggatcgtgcccgtcctggaggacccagggaagagtttggagcgccaaggagcagaggagcggccagcgcctgtgcccatcacatccatcttccaggtgcacccccagaaggccttggctgcgtga

SEQ ID NO: 6111 - DNA, 246 bp, Chlorella protothecoides
atggcgaccctggccctccaccagcacggcaagagccgcgtgcgagtcggtcgcgtttggcgtgagggcagcgtgcacacctttgccgaattcaaggtggccaccaccctggagagcgccatggagcacgccttcctcaccgagtcgaacgagggcatgacagccaccgacacccagaagaatacagtgtactatgtggccaagcaggtatggttgcatggggtgcagttggatgacagggtatga

SEQ ID NO: 6112 - DNA, 417 bp, Chlorella protothecoides
atgctgagcatccaggacgaggacctgctgccgcccggcttccaggccgcgctggagcgcgtgcgcgccggcgccgacgtcatgcctcgccgccagctggatgccgcgctggcagcggagctggggcccagctggcgcgcgcgcctggccgccttcgaccccgcccccgtggccgccgcctccatcgggcaggtgcaccgcggcaccctgcacgacggccgcgcggtggccatcaaggtgcagtacccgggcgtggcgcagtccatcgagagcgacgtggacaacctgctgcgcgtggtgcgcctgaccaacatcctgcccaagagcctgttcgtcaacaacctgaccaaggtgaagggggggattgaatgctatgagaggaaagggggaggggtgaggtggggccaaaacccctga

SEQ ID NO: 6113 - DNA, 423 bp, Chlorella protothecoides
atgcgtacaaagagggaaggcagcaccaatatagctgggatcatcccacagattgcctatgtgcttcatagagtccgaggttgcgagtcccacgtcgtcctcgttgctggcgcaaatgtcgatcactacaacggccgcctgaccggctatgtcatctcggtggccatcatggctgcctgcggtggtctgctgttcggtaagcaggcagatttaattcccacgaacagggatgcgatgcttgcggatgttgctaagcacaaggggtgcgtccgcctctacggtatcaccggaggagtcaccgccatggcctccttccaaatgaagtttttcccggatgtctacgcacgcacagtcgagggaggtcgggaattacatcagggtgcagtgtcctcttctcactggtcttacactcacccacccaca

SEQ ID NO: 6114 - DNA, 390 bp, Chlorella protothecoides
atgggctggctggtgccctccgagatccatagcctgatgacacgtccagcgggcatgtccattgccgcggccgccaactgcctcttctccttcgtcatcggccagtccttcctgtccatgctctgcgccatgaagtggggcgtcttcctcttcttcgctgcctgggtggtggtgatgatcctcttcgtctacttccttatccctgaaaccaagggcgtctcggtggagcgtgtgcccattctgttcgcccgtcaccccctttggtcccgcatcatgggccctgcgtccctggagatcatcaaatgggatgccacacgcgcagcatcacatcaggccgcggctgaccagcgcgctgccaccattggtgacctcaagaaggctgcccagtga

SEQ ID NO: 6115 - DNA, 1374 bp, Chlorella protothecoides
  modified_base (297)..(306): a, c, t, g, unknown or other
atggcgcgcaccttcgccctcctcctgtgcctggcaggcctggtgctgcacgggcacgcagcggcgtcccccccgatcgatcctttcgccagcagctccaccgtgagcaccggcacgaacggcgccgcagccttctcgcccaaggtacagatgctcatggggcggctgcctgtccgagggtgtccaagaaggggagggggttttcgggcgacgcattttggaagatcagctctcagcttgggcatagaatgcggtatcatggtgatttgcatacttgcccacatacgggcatgtgcnnnnnnnnnngaggggagggggtgttcgggcgacacattttgggagatcagctctcagcttcggcatagattgcgggatcatggtgacttgcatacttgcccacatacgggcatgtgcgtcccctccaagcacgctgtgcattcacatgggtgggggtgcagcatgccatgtcccgggccccctcagggcccagtgcttctcactccagggcccccttccctgccagacccgtatgcctccatccccaccggagatctgtattcacatccccccccaaccccccacatctaccccacacagtcccccgccgccagccccaccgccgccgcccccgcagcggttgatggcctggccctggccgccgagtatgcggccgcccccggcgcgcagcccgcggagcagcgcctgacgtacaagggcgtggcgacgacggggtacacctccacccccctgaccacctacggcgccaccaacctgggctgcgcgctggggtatgtgggcgacaacttcacctccgactacgtggccatgggcccctccttcttcaaccagggctactcctgcggcctctgcatccggctggagtgcgacgacgcgcggtgcgagcagccggggcgcacgcgggtggcgcaggtgctggactactgcggcaactgctacgacgcggacctgaccatcgcgcagccgctgttcgtggcgctgacggggcgccagcccagccccaacccctccgccctcatctcctgggagtttgtggactgcgcgccctacagcaacggcaccatcaagatgctggtgaagcaggggggcagcgcctactaccaggccttctccttcgccaactccatctacaccatcaccgcggcgcagctgaacggggaccggctggtgcacggcaccgacaactactggagctggaacccggtgagcaccatcgaccccgccgggcccttcacactggacatcctgggctccaacggccaggtgctgcaggtggtcctccccgccctggtctccaccgacctgggcctgcagttcacgccccctgcccccgtgcctgcgcccagcgcggagtga

SEQ ID NO: 6116 - DNA, 1269 bp, Chlorella protothecoides
  modified_base (846)..(855): a, c, t, g, unknown or other
  modified_base (1029)..(1081): a, c, t, g, unknown or other
atggagatgtttgttgtgaaagattgccgtgtacctgccggggcgcggggtgagggccaggaatacaggcacagggcagaacttcccccctcccccataccactgctgctcgtacgcccgcgcgcgccacccggctggagtcagcttcctgggcaccactcggcccctcccatgaacacggttcgagcgtgttcgaaagacccaaacccatcccagcggctccagcgccccattacgcgctccaaggaggccaggggttcgagaacagcgggtctggaccgagatcgacggagtaagctgcacgcgcggcgctggcgtgaggggggctcgaatccttacagacctttggcagggacgacatcaagagctggaatgagggccaacagcttcatcgtggtcatcctggccgcctgcctggcggggatggcggccgcgcagatcccagacatagttcccatcactgtgcaggaagccctgggtccgctcccggaggtgcccgcgctggaggactcggcccctgcagtcgaagtaccgcccgccgtggtcggtgccctgcccggcaccgggccggagagcgagccggtggcagagcccgtggcggagccagagagtgagcctgcagtggagccggcagccgagccagagagcgagccggtggtggagccggagagcgagacgcccctggagcccgtgacggagaccacagcccccggcgcagccgtcatacccgtgatccccctcccctctcctgtccctgtcgcggaggtccccaacctcacagcacccagccttgctgatgtggggcgctggggccacaaggcgggagctgagggcgagcaggggggnnnnnnnnnnctgctgagcggggaatcacgcgggctatctcatcgcgagcgagcagcactcactcatctgctcccccccctgatgcccctttcaccaacagaggacctggcgggcatcgtcccggaggtgatcgcccctgggctcgagagcgcgctcggccccgacacggagttcccgctcgtnnnnnnnnnnnnnnnnnnnnnnnnnnnnnnnnnnnnnnnnnnnnnnnnnnnnnagagcagaggccacggtgcctggaccggcactgtgccgagcacagacactggtccctggggctgctggcctgtgtccattgctgagcggggaatcatgcgggctttaggcgaccaggatgccccttgcctggcacatggcccacaaacccaaccgcccctcatgcaccgcagaggagctggagggtga

SEQ ID NO: 6117 - DNA, 645 bp, Chlorella protothecoides
  modified_base (272)..(281): a, c, t, g, unknown or other
atgtgcctctgtgagcacgctggcccagttgccaggccatgccccgctggcattaactttcacacccccctgccgtcactgtcccacccccttctcaggagcggcagcgacccgctgtcggcattcctggactcgggcgagggcgggggctcgcagttcccggcctcccccttccccctcccgcagcagtactttgagacatgggaggccaagatggcggcagcgggggaggtgcgggctgccgtgaaggagggcccagcgtgtatcccagnnnnnnnnnnaggacaacgagcacctcgtgccacgggagtgacgtgggcgaacaactggacacacacgacggcggctcgtgggctgtcttcagggcccagcgtgtatcccaggcagtcgcataccgccgcaggggtcaaaggaggcaatcatcccttccctgctccccactcctctgtttcccttctgatcatcacaacaccctgccctaccatgcaggctgcgctggaggaggggcgacgacgcgaactcatggcggccattcaggccagcttcaaggactggctgcagtccacagggtccatgcggcacgtgtatgacatcgcacgcatggagcgggcggaggcagggacagggagcgggggaagggggtga

SEQ ID NO: 6118 - DNA, 1521 bp, Chlorella protothecoides
  modified_base (455)..(464): a, c, t, g, unknown or other
  modified_base (781)..(790): a, c, t, g, unknown or other
  modified_base (1487)..(1496): a, c, t, g, unknown or other
atgttcatgctggagcccggcacgcgggcggtggtgttcgacctggacggcaccatcaccgtgggcgacggccaggtggtgacccagttcacgctggacgcgctgggcgccagcacggccctgaatgccaagctgagtcacaagtacgacctgcggccgcggcggcacgcgctgcacgcggtgcgagcctgggcggccaagggttaccagcccatctacctgagcgggcgccaggggtcgtactacaacctcaccctggcctggctgatcaagcaccgctacccgccggggcccatccacctgaccaggacccacctcccgacgctgcccgtctacttctccgtgggactcttcaaagtcaagtgggtttggggttctggtcagggggggaggagggggagattgtttgtggggcctcctcgggttcaaaggattgacagggtcgggaagcacgnnnnnnnnnngttcaaagtcaagtgggtttggggttcttgtcagggggggaggaggagggggagattgttcgtggggcctccctggattcaaaggattgacagggtcgggaagcacgtggaagtccccagtgctcggtctacgaggccacggggtgtatgctctgcacggagcggtggggggtgttgcgcagctccggatggggtcggcctggcaatgagagcgagccgcccaccgcccagtccctcctttcctccatgcgccaggtacatcgagggcctgcgggccaagggcatcgatgtgtacgcggcctacggcaacaccatgnnnnnnnnnnttagtgctcggtccacgaggccagggtgtgtatgctctgcacggagcggttgcgggtcctgcgcagctccggatgggatcggcctggcaatgagagcgagccgcccactgcccactccctgccttcctccctgcgccaggtacatcgagggcctgcgtgccaagggcattgatgtgtacgcggcctacggcaacaccatgaccgacataaaggcctacgaggccgcgggagtcgccaaggtcgggaaagcgcggggcgccatgccgggtcagacctgtgtttcaagggggtatgctggcgagagtgggacagcgtcaccacaaccggggtcctcccgctggaacgactggccaacaatgtgtccccaacattgcactgtgcctgcaccccgtggacgagacacccacaaggacactcacatgcgaacagtactgcagtccctcacccctgctccactccatctcctcctcttctacgcgtgcaggagaggacctacatcatcgggccctttgcggggaagaacggcacgaagaaggttgcaaactggaccgaccacctgcccgagatcatggcacaccccgacgcagaggtccccatcccctacaccgaactgctcatcactgagatgccgggatatgtcaagtaagtcgggccaaaagtgggggcaggagggttctttgcgtcggtctcgtatgtnnnnnnnnnncgagatgccgggatatgtcaagtaa

SEQ ID NO: 6119 - DNA, 657 bp, Chlorella protothecoides
  modified_base (304)..(313): a, c, t, g, unknown or other
atgacagcgctggtggacgcgtaccagagcagcgccatcccggagtttgagcgcatcctgcgcacccaccgcgcggccatcatggccgaccccttcatcgcgcagtacgtggaggacctgctgcgcaacgtcaggatccaggcgagtatggaatggggggaaggagggcggggggcgtgcttggggccaggagtcagactgccgcgcactgcatctgtggggatggacgtcgaggggatggatgggcatcacgaccggcttccagcaccatcacccttccagacacgcaaacacccctcccaannnnnnnnnnactccacaggcatcacgaccggcttccagcgccatcacccttccgccacgcaaacacccctcccttcacccccccaggcggtgtcgcgcctggtgcagtcctattcgcgcatccgcctgtcggccatcggggaggagctgaacatcccaccgcccgaggtggagtccctgctggtgtccatgctcctggacggcaaatttgcgggcgccatagaccaggtccagggtgttctgaccctggatcgcgccgacccaaatgacgcccggcacgcggcactcgagcgctggggctgccagctggcggcgctgcagggcacgctggcggcgcgcctgaatgcggtgtga

SEQ ID NO: 6120 - DNA, 501 bp, Chlorella protothecoides
  modified_base (245)..(254): a, c, t, g, unknown or other
atggatgtgtatcttgcaccctcctgcaaacaccaaaaacctgtgcacaccttgacccgccccccgcccgcccaggtggatgtggagaaccagtactacaacagcaagggcctcctggagacggaagacggcctcgacgaggcgctggccggcttccaacaggtcctggagatggagtgcgaggaccgcgagaagtggtgcgctgggtggctcagggttgggtggggtggagggatgttcatccnnnnnnnnnnaggaccgcgagaagtggtgcgctgggtggcctcagggttgggcggggtggaggggtgggtgctgtggagttgcagcatccatggtccatgcaaagggatccggcataaaatagtagctggctgcattgcgggtgatgtggcatctcctggtgcaagatgttcatcatatgctcttgctggtcatcccgccgtctcgcgctctggaagggcccctcacccttgccccaaaatcctccctcccctctga

SEQ ID NO: 6121 - DNA, 324 bp, Chlorella protothecoides
atgactctgatcacagctggatggtcacgtatccccacacctgctatcccccgcacccgttccccacccacccaggcctctgggagcctggatgtgctgtccaatgcgtacagggccaaccccgccccgtttcgggagcagaggatcgggtacctgctccagcgcgggccggagtgcttcgacttcgaatactacctggcccagaacagcgacctgaggtgcagacagggaaaaaggggctgggaagggaggggcatggggtcctgcctagttgcttggaggtttgcaggatggatgtgctcggctccaggaatcttggcctga

SEQ ID NO: 6122 - DNA, 1503 bp, Chlorella protothecoides
atggcgaggccctacgctgatctgcggtggcctgtctgcatccgtacaggcagcaggaaccccaggggtcaaacctcacacccctacgatcctccccatacctccccagaaccccagcaccgagcgcacctgcccagcgtgcgccagcacctctccgagcacctggcaatccacgaggcgctggtgaagggcttccgcggcttcgtttgcgcccacctggccctcctgctggaagcggtgggcgtgaggggcctgcagggcgccaccccaggccccgacgccatggacagcgagggcggggagggggctgccgcaggccgcgtgtcggcggcgcagcttgaccgcctgggcttcctcattgcccagggccccccctcccaggaggaggtgtggggccggggcgaggcctcccccacccgcggctcgcccatggacatctgcgccacgcccaccctgttccagggtgggtttgtcttgctggcttgggtgctgtctggtggtgtgattgtggatggggggtgggaggtgggtgagcaagcgcggctcctgggtgcctcggcgccaggcgcagacctggactcgggaaccttgggtgccttgtgtcttccaatcgcagcccacgcctttgtggattcagtgggacttaggggcgcatgcagtgcatctcatccgcacagccctcccggtgccggtgttgtggacacccactggtccctgggtcgcatgcatgcgtaccagtacgctgcccgtccgtggcagtcaccttcctgcaactctccctctcccctcatacctccaccccaccctgcagacgcccccccccgcctgagttcgctgagccccttcttccacgacccctcccagcctgacccccccgccctggccgtggcggggtggctggccgagtccctgggcgccgaggacctgggccccggcgcggggtacggcgaccccggcggcgcggcgtcgcccccgcccccgccctcggccttcaaccagctggtctccctggcctccccctccgacctccagtccctgcacaaggccaccgtggtgcgtggcgaggatgatttccccggcggcgccgcgcgcgtgctggactgccacgactgcatcgtgtacgcgctggccccgctgcgccacgccctgatctcctgctgcaccgactgcctggtggtggtgggcgcggtgggctgcatgctgcgcgtggagcgctgcgagcgggtgcaggtggtggccgccgcgcgcgcggccacggtcaacacctgccacgactgcatcctgcacctgggcgtgaaccgcgagccgctgctggcgggcgacaaccgcttcgtccagctcgcgccctacaacgcagggtacgagcgcctggaggcccacgcagcgttggccggctgtcgctcctgcccccggccaagctggtgcccttcgtggtgcccttccgcggcgcgggcgggccgctggcaggcgggccgcccctgcaacgagacgccaggtgtgtag

SEQ ID NO: 6123 - DNA, 192 bp, Chlorella protothecoides
atgctgggcttcggtctgggcctggccagcatcgccttctggatggtggcacaaataccccagctcgtggccaactatcggcgccagcgggccgatgcgctgagtccctggttcctggcggagtggttgctggtgggtaggggtttccatggagcccgcaaggggaagggtggggtagtatggaccgtgtag

SEQ ID NO: 6124 - DNA, 915 bp, Chlorella protothecoides
atggcccctcgcagcggcaaagccgttgttaccggagggggaggatactttggcaatcggggtgtcagcctccaaaccatcacagcgccgggagtactgctaacacacagactggcgaagcgtttggcggctctgggatacgatgtggtggccctggacgtgcaagtggagcctgcagcaggcgtggaggcggtggtgggcgacgtgagggacgccaagcttctgcagggcattttccagggggcagacgtcgtcttccacacggcgtcgtatggcatgagcatgcgcgagcagctgcacacggccatcatccatgcgcccacgtcgagcacgcccaatcccctccccacctttcacccaggcacggacaacgtggtggcggcctgcatcgcatgcggcgtgcccagcctggtctacacctccacctacaacacggtgtttggcggggtggagatcgtggccggcgacgagtccctgccccttttccccctggacgcccactgcgacgcctactcccggactaaagccctggcagagcaggcggtcctggcggccaacggcgcgcggcatgttggaaaggacggcgacccaggcagggggcggctgcacaccaccgcacttcggccggcggccatctatggcgcgggcgagcggcggcacctgccccgcacggtggagaacgcgcggcgtggctggtacaaatgcacctttggcaagccctcaagcctcaccgacatggtgcatgtgagccgccgtcaggatgaggagaattcaggggcgggatgggagctgttgtgggggagggtggataatctcgtggaggcgcacgtcctcgcggcgcgctcgctggcccatgcgaacggtggtgaggcggcggggcaggcctacttcatctcaggtgggaagcatgggtga

SEQ ID NO: 6125 - DNA, 591 bp, Chlorella protothecoides
atgtacgtgttctccaacaccgaccctgagtacatcacaaacctgagatttttcgtccagttcgccatctccaaagacgatcgctgcgactacgtgatcgtggtgcagaccgatgccgacaaagcggagaggtctgggcccttcctgcccatcccgccatctcacccccacccctccccttcatcacagacgccagacttgccagacctgccgccgaacgcacgctacctgcaccacgccaacgaatgctacgactggggaaccatcggatgggcgatcaacgtcgcgggggtggacacccggccctactccttcttcatcttcatgaacagctccgtcagggggcccttcatcccgccctacgccaaggacatgatcaagtggcaggacgttctgattggcaggatcgatgcgagggtcaaactggtcggccccaccatcagctgcgaggggtccccgccaggcgggcgggtgagggagaagtggcgcgtcaacccccacgtccagtcctatgtcttggccaccgaccagggtgcccaaggagacagtgctctcgccgacctgcagtgtgcagggcatgcgcccctctga

SEQ ID NO: 6126 - DNA, 384 bp, Chlorella protothecoides
atgttcaggttcttcgagcccctcctggtggggctcggcttccccacgccccacctgcgcctacccctcctcgtggtctactgcctggcctggctgacggagctgatctggcgggtggtgcaccccgtctgggactttgaaccactcctagtccgggccgaggtgctcaaggtgggggtgacccactacttcagcatcgacaaggcccggacggagctggggtatgcgcccatctccacagacctggtacagtgcggcgccctggagtggttcctggagcgcatgccagaggaacgcccacgaggcaggggaggcagcgtcctctttgtcctcgctgctctcataggagtgttcctggtcctgcatgcgctcctgcgcgcctga

SEQ ID NO: 6127 - DNA, 534 bp, Chlorella protothecoides
  modified_base (93)..(102): a, c, t, g, unknown or other
atgcgatgcgcagggccagggccctttcgaccccgtgtgcagctgagacgggacgcgtgggtaggttccctcaccccactcgacatcatgtcnnnnnnnnnnctgtgtcgtggagggggccggaaagtttgtgggggaggagatgcgatgcgcaggggcagggccctttcgactccgtgtgcagctgagacgggacgcgtgggcaggttccctcaccccactcgacatcatgtcctggaggggtccctctgctctgaaccgagggcagggcggagcagaggcagcgaccctgcatccctggggcgcctctcacaccgacagcctgccgtgccatgctctcactctccaccacccaccctcgccctccgtcccgccccccatcgcaggcgacggggtcgctgcccccaccccaggcgggggacaggggcgccacgccctggacccaggcggtggacctgcacatggggtccgcagaaccctccgccgccgcgcccgacgtctggctggcggccgcggcggccagcgcgaggctga

SEQ ID NO: 6128 - DNA, 1473 bp, Chlorella protothecoides
atgcatttcgaacacgggctgcctcacacagactcccagcgcacgagaaaacctcttcgtgggttagatcatgaatattattaccaattacacattgagcatactgccagaagatggtgcacgcatgtaaagatcactacagagcacaaccatgggatgcttacttggaagctttccatccatattcaggacgtcctttggcttcttgacgaggaacttctcttgtctggtggacccatagagccatgcactgagagttcgcggcgcagcagcacaattgtcagaactaagctggaaagatgtaaatctaagctacaaccttacaaaaaacatgttggaaccttgtcaatcctttgggcagagatgttctggttgacactggcacgtgcgagaagtggcaccgagagacgtgtccgtgaaattatcgcgataggctcttcgcgatgggtgggtgagcaccaggaccgtcgctgcgcccgagcttgcgcgggatggtcgtgctcagagtgcaccaccgtcctttcgggacctttcgacctcagtcaaggtgcgagctgctttgctggatccccacctcatccacgagggaaatggagggcttccactgtaccagacaaggcattgcattcagagtctgccgtaagtgggccggacgctcagcccacacgttcgctcagcctgctccgcccctccttgcagccatggcgtctcgcccagcagcgagcgacgcacgccccgggcctcgagcctggctccttcagcagcgcctgcgccacaccctgccccaccctcctcatccaagccgcagtcccaccggccccgcaccgatgtgcagctgggggtccccgtcgacagcctggaatccacgcactaccgctcgctccttggttccgcacgcgtggaggtggactcctggcgcggcaaggagtacctgaaaccccgcggctagcccctccagcttggccagtcccgtccctgcctgtgcatggcctttacatggatgcatatccccacgacgacactcctgtggaggcctccaccaccacccctccgcctcccttctccccagacgtctgctgcgtgacctccggcgggcgcgtgcactcgcgctggaagcctgagaaccaggactccttcatgctgcaagccatccccgctgtgcacgacgcggcgctggccagccgcggggcggtggtcgtgggcgtcttcgacggccacggtccccgcggcggcgaggtttcgcgcggcgcgcgcgactccttcgccaagagcatgctggcctcggccaccgggggcgagggtgggccagatcccagcgcagtgggcgcgggggaccccgccgccggcgccctggtgcagggcctgcagctggccgccaccgagctcaacgccagggggcgggactactcacgcagcggcagcaccgccgtcgtctgcatggccgagcctggcaggtttgttgtgggtgggtga

SEQ ID NO: 6129 - DNA, 1077 bp, Chlorella protothecoides
atggcggccgacatggtcaagctcgatgatgggaaaggccttcaggtcacggaggtacactcgtctcccatggacactgttttcacaaacttcaaggctggtatggagggcgtggacaaggagaaagtgaaggccatcgtgcacgacatgtccaaggtaggttgtgaggattggatgttattgcggataggaccgggtgcacacatgtacgaattctggtgtggcgaaccctccaagccaccagctggatcggaccacttcaagaacgagcagcgcaaggcggcggcgacggatgtgaggatccatcgtatgaaacaggcggccgcacgcctcaccgcagaccagctcgccggctttgagaggtgtttgatgtttgtgttgttccttaatctcgatgttaaggaatttgcagggcttgtcgggacagtggatgctcaggtgtgcgagctgaatgcaaccagggatctgagccgaacctggctgcacgttgacatggatgctttcttcgcggccgtagaggaaagggaccggcctgacctggtgggtgttggtgtgtatgagagggcagaatcctgtgtacttcaagttgctcagcacctggccctctctctccgaatactggtgcagaaagccaagccgtttgctgtgggcgggatcggcatgatcagcacggccaactatgtcgcccgtcgctatggtgtgcgatctgccatgccagccacggaagggttcaacattctcggcagtacacctgaagctaggctgagcatatccgtctcctgccctgcctctcgtcatgagcaaaccccaaggccttcacaggccagcgcgcaaaccaggtgcagcggggaacatgtgttgtccggaggagggcgatgcgttgcccatggcagctcccgtacagaggcccgaggagctggtcaatggagtgctggttcgtgcccgccccttgacccagcctcagcacagctgccgctgaagggagctgcaccagggcaagggctactgtctctagctacccgaagctcccaccctatcttgcagggcggtgttcagggactacgacccggagtttga

SEQ ID NO: 6130 - DNA, 1020 bp, Chlorella protothecoides
atggcgtcgtcagtgagtcggccaccggtcaccgtggagaaggtcgacaatttccaaccccctgcagcatcgaagaccaatggcgatgtgcatgggaaccctagctcgacggcaggcaacgccggcagctcaggacctgactctactcagattgccccgtctccatccaaggcccagcaggaccccaacaagtggcttgcggatctaattgcccacctgtggccctacgcctcgaatgccatagaggccttggccaatgacatgatcccagatatcctggccgctagccgcccatcttttgtgcatgacctcaagctcaagaaattcgagctggggaaggcacggccgaagctcaccaacctcaggcaggcagcaggccacatatcaccctgcctaaccactccacccactgctgcccatgtcccagaccgcatggccccctgcgcagcacggttggacccccttcatcgccccgtcccacccccctcctcccatctctgcacccccgcccaggccttggagctgtacatctccgtgcccaagctccccctgctcgtttctgaagtggtcccggatccgttggaggacaccctagccctgctcatgtcccttacggtcatgtgcaccgacctctggctcaagggcaccgccagggtgactctgcgtcccctgctggaggagatgccggtggtgggcggcgtgcgcatctccctcatcaatcccccggactttggctatgacctgaagctcgggtatgattcgcggtgtgagggcggagtggtggggcaaagcgagtgggtgggtgggggtgactactctgccgccaccactgcgcatggctgcacaaaaggaaagagagtccatccaaccccatgccactccccacatgtctttgcctgggccccccaagcccgacctcctcccctcttccccagtgacaggtttgtgctggagacgatggagcccctcatcaagtcctgggtggacggcgtcgtcaaggagtctgtactccagccgtga

SEQ ID NO: 6131 - DNA, 294 bp, Chlorella protothecoides
atgcgggtcaaggagtctgagaagtcctcaccgctcacgctggcgaaccgaagggggcaggcagccttccccgcgcccctgtcggtgcacgtgggactggatgcagtggaggacgagagcaccatggtggagatcatcatccaagaaaagggctgggtagggacttccaccgtcggcaagctggagtttcccctggccacggtcatcaagcgcatgaagaccaagggcgagttccacctccaagaaggctcgggcactgccaagctggacctccgctggacgcgctacctgtga

SEQ ID NO: 6132 - DNA, 855 bp, Chlorella protothecoides
atgctggccaaggtctgctccgatcgcaacaagccaaacggacaggtagcagtgatactataccgcgagggtgggtgcaccggtcacgaggcatacctcactaccgccctgggtgaatactacgacagtgccttttgccagatgagaggacacacctactgcccccttataaagcaatggaatccagagcccaactacctaccatgcccctccgctcccttgcagtatgagctgccctccactctggcggctgttcgtcagtttgttgctgcgctggaaattcgcaaggttccgggtgttggcaagagccctcctggcggccctgttcagccccgtctcgctcgacttcttcatgcgcatagccctgggcctgggctccacgcgacactcggacccgggccccgacggcagtgtggggaggaagggcatgagctgcgagaggacgttcagggatgcctgacgatgccaaaacgtctcgggtggccggcagtgactttcagcctcgcctctccactgccatatgggaagggccatgccaaagcccattgtgccagagccccaggtggccctgccctccccgccaggaacatgagcgaacctcgggatctggaagcgaagctcggtgagctggcggagcacctcgccgcagacatggccagcgaggatttgaaggggcgcaccctcaccctgaagctgaagtgctccaactttgaggtgggtgggcggggaacgatttgctggctggtagaagcatcataccttgccatccatgccagcgtgagcgggagccgggaagggtgccagagccgcctgctgcaccggctctgcggcctcctcacccctttttgctgctga

SEQ ID NO: 6133 - DNA, 702 bp, Chlorella protothecoides
  modified_base (402)..(474): a, c, t, g, unknown or other
atgtgtactgtaggcgttcgggtgacgtatgccgacgcatgccagcaaacgacgtggtgttcaagagctgatgcgtatgccacgctcgagtcaaagctcgtgtaccacgaaagcctgtccaacgtggactaccttcacggcggcgccgagtccttcctcacagtcacaaacctgcttctgggtaagcgcacgcgcaccgcgcccttcctgctggatctatgcatgctggggcagtgtcactgggctggtgccccacaggcaccagcacagaatcctgttgagacaatcctcggcccatcacatttgcagtgctgggcgcaaagcaagggctggatcggtatcatgccacgccaaaggaccttgccaacgaggaagatgaggcgtaggcagcagatcctcccnnnnnnnnnnnnnnnnnnnnnnnnnnnnnnnnnnnnnnnnnnnnnnnnnnnnnnnnnnnnnnnnnnnnnnnnncccctcccaccactccttgtagcagtctgcgtgtctgagcagcaccctgcctcagcttgcggcctccatgagcctccagagctggttggtggcctcaaagcggggcatctgcggggccaggtcgaagagccgcacatccgccttttcaggatccgagaccgtgcccgcaatgcggtcgggattgtcgaaccgccagctgatcttggatacgtgggcgtacaggcttag

SEQ ID NO: 6134 - DNA, 1878 bp, Chlorella protothecoides
  modified_base (182)..(191): a, c, t, g, unknown or other
  modified_base (885)..(894): a, c, t, g, unknown or other
  modified_base (1311)..(1320): a, c, t, g, unknown or other
atgcggtttaggttcgtaaacttgctttgcgatccttctggcggcccattacacaccccagtcgagctcttctttatgccgctgcctcctccaaccactgccctctcccgtctgtgttcccagataccccaaggtggtgaaggactgcatcgaggaggaggtgcagaccatcggagatgtgnnnnnnnnnncgtctggggatgcggtttaggttgataccccaaggtggtgaaggattgcgttgaggaggaggtgcagaccatcggagatgtggaggtcccggtggacacgtcgcagcccaacccaaacggcatggagtttgacaacctgtacctcgacatgaatggcatcatccatccctgcttccaccccgaggacaagcctgcgcccaccacagagaacgaggtgagtggtcttggcctgaggtcgatccccgggtgtgcaagccctcaccatgaccttccttcgtgtgcacaagcctgcttgagctcgtgcatctgggctttggtgcgtctcaaccaggctcggtggttcgacaggcctggcggtgtgcccctttgcctgggccgcaacacggcatcgactcccaccccccaggtgttcctggcgatatttgactacatcgaccgcatctttgccatcatccgccctcgcaagctcctctacatggccattggtgcgataggagggatgccatccaagggaacccattggattgggtgctgggccctgtgccctgcaccctctacccggcgggggcaccccaactctcaagggattgggttcagcagcgtcccatcccggttcccggccctgtccgcataccccattccccactttcttttcgccctgcttccagacggcgtcgccccccgtgccaagatnnnnnnnnnncccctctacccggcaggggcaccccgactctcaagggattgggttcagcagcggcccatcccggttcccggccctgtccacaaaccccattccccactttcttttcgccctgcctccagacggcgtcgccccccgtgccaagatgaaccagcagcgctcgcggcgctttcgggccgcccaggacgcggaggagaaggcgcgggaggaggagaagctgcactcgtcgccgccacactggtcgcctgcgggcgtgcctggcctcctgctacgcagccctgggttcttaggattgtccagggcgcgtggaaaggcatcatgttatggcaattcccccctacttgcccagcccctgtgtatcctttccaccccccgccgccatctccaagccccaactctctccgctccgccctctcaggnnnnnnnnnngctcatccccgtcattctggtcgcctgcgggcgtgcttggcctcctgctacgcagctctgggttctaaggagtgtccagggcgcgtggaaaggcatcatgttatggcacacaccccccctgcttgcccagcccctgtgtaccctttccaccccccgccgccatctccaacccccaactctctccgctccgccctctcagggcatcaacatccccgcccgcgacgagtcgtcggtgttcgacagcaacaccatcacccccggcacccccttcatgcaccgcctgtcggtggcgctgcagtactatgtgcacctgcgcctgaactccgacccgggctggcgcggggtcaaagtgctgctgtcggacgccaacgcgccgggggagggcgagcacaaggtgatgacctacatccgggagcagcgtgccacgcccggccacgaccccaacacccgccactgcatgtacggcctggacgcggacctcatcatgctggcgctggccacccacgagccgcgcttcgtgctgctgcgggaggtggtcttcacccccgccccgcctga

SEQ ID NO: 6135 - DNA, 660 bp, Chlorella protothecoides
atgaggctgaatggggaatctctcgtggggagctccacaacttcaaacaccagctgccccttcttggctcgctgccagctcatgctgtcacgtgccgcaccccccgcgcccctccagatcatgaccaacccctccaacacctccggccccggcggcaagctgaagcaggccatcgaggccagctttggctccgttgacgcgctgaaggagaagttcaacgccgcggccaccacccgcttcggctcaggctgggcctggctggtcgtgaccccggagggcaagctggtggtgaccagcacgcccaaccaggacaaccccctgcaggcgggactggtggaccaggcggggacccctgtgctgggcctggacgtctgggagcacgcctacgtgagcggggttgccttttgggcaggcgacgtgcctgaggacggggcatgcgagcagggcgcgggtcgtggggaatcccctgggtgctgggtggagctgtttctaggtgctcgggccatgcggcccgaggtcgcccatgatgcatccgtactctcgtcgggcgggggatgccggacctctcaccccccggacacccagtgggtcctgccttcaggaagtcatcaccgcgccccctcccccgccctcttcctggcgccaccatgcagtacctga

SEQ ID NO: 6136 - DNA, 705 bp, Chlorella protothecoides
atgaatacgggagacgttttcgacgagcacctgggtgtcatcgcagccctgcgggacaactatgcccggcatgacgacaccgacactatccgcgaactgctggggatacaggaggagttagagggcttgttgagctcccgagaagacacggtcaagcaagctatacaaggtgtattgtcctcgcgccgtgagcgttctgacacagggcaatatgcagggatggattacctctggaaacaagggcctgcatccctcctccattgctcccttacagccctcagctccagagtggaggaggcacgcatcaaggcggtgtatccagaggaagagggtgcacacgatgcccgactgcgtgagctggaggccagggtggctgcctcgaaacagcatgtggcccagctcaccacagagctggaggccctgggaaagcaacgccagcagctgggcagcagcatgaaggaggtcagcgtgaagaaggcgcaagtggaccacatgctgttggaggacgagcctcgcatcaggcatcagctaagcctgtacgcccacgtatccaagatcagctggcggttcgacaatcccgaccgcattgcgggcacggtctcggatcctgaaaaggcggatgtgcggctcttcgacctggccccgcagatgccccgctttgaggccaccaaccagctctggaggctcatggaggccgcaagctga

SEQ ID NO: 6137 - DNA, 450 bp, Chlorella protothecoides
atgttgcgcttcgctgcagcccagctggcccgccgaggacagaacctgcccgcagtgaccacaacggtaggaacgaggatgcgatgccctgtttgcgaatcatcattgagtcgcgcccccgcgcaggcattcatggcagcacccagccccaccccgcagggcctgcgctgcttttccgaggcctcggccgcggagctcagcatccctccccagttcagcatccccggacgttacgcctccgccctgtacatggctgctgttaaggcggacaagctggatgcggtgaccaatgagctgtctcaaatggccgggctcctcaagcagagcgacgacttccgggagtttgtcagcgaccccaccgtcggccagaaggtcaaagtggagggcatgagcagcgtcatggatggtctgggcgccagcagcaccaccaagaactttttcggtgtgtag

SEQ ID NO: 6138 - DNA, 339 bp, Chlorella protothecoides
atgaaccagggagcgctgggcctgcttctgatggcagcccccggacactctcacgcgctgcagagtccagtagagctgacggagggcggcgtggaggcaccctcacagccagggagtttgctggactttgaactggccacacccccgcttcgagttgggtaccagggagactggctggatgtcagccctgccatgcttgcaacatgggacatcagccccctggagcccatgggggagccaaagcatctgcgtgcctacgccctgtgccaaactggctgcaaggaggccacacacgccttttgcaaggtgcataccgtggctgtgtgtgtgtggatgtga

SEQ ID NO: 6139 - DNA, 207 bp, Chlorella protothecoides
atggccgacttccagaacagggtgcagcgttgtgtgcagcgctgccaggatgcagcccaggagtccctccccataaagcccagcgagaaggacattgccagggcacaggacaagctggccaactgcgcggcggactgcgcccaggagtacgaacgacagatcccaaagctggaaaagtcaatagtagagcagctggcacgggcgtga

SEQ ID NO: 6140 - DNA, 432 bp, Chlorella protothecoides
atggaggcccaccgggactcccccccacttgagctggccggtaccatgccttgggcattcccctacaactacaccttcaatgcgccgtcccggaaccggcaggtgggtggagtggtgcaccatgcaatggaagagcaggtggtcgtttcccttgccgctgatgtctcggagcgcaggtgccctctgtcatgcagcgacgaccgcccccggcgagagagcactgccaatgaggacggctacaactggagaaagtatggggagaagcacgtgaagggcagctcctgcccccgctcctactacaagtgcagcttcccagggtgccaggtgaagaagatcatagagcgcaacctgaagaccggcttcgtctccgtctgcctcagcaaggtgagcgggcagggtctggactggcctggagaattggactctgcctga

SEQ ID NO: 6141 - DNA, 954 bp, Chlorella protothecoides
atgtcacgatcccatcggcgagcagcgaaaaccccaccctggctgggtgtgctcgtggatactgacgagcgctggagcaactacttgtacatcctaggcaccgcgtacccccgcttcctatggctcttcttcgaatacagtggcgatggcatcgtctggctggccatcgcccttgccgccttcttccagccgcgtgccaccctcacccagcaaaccctggtgcttaatttcttggcggggtgggctctagacctagtgctggtggggaccctcaagttcctcatccgcaggaggcgaccggtgtacaacgtggcagaggacttcctggtcgtcgtggcagtggatgctcactccttcccgtctgggcatgcggcacggtacgttggtgtgagggtgtcagcgggaggacgcatgctcatggatcaggcaggaatttgggtttctgatcctttgcctgggcagagcctatcctcggctctctttcctcgccatgtactgggctgtgtccacggcactgtcgagggccgccatgggtcgccactacctcgccgacgtggcggcgggcctgctggtgggcgtgggcaccgtgctcctggtgtccaagggtggctactccagggacacgctgctcgtgagccaggcgcagacaagggcactgcggcagtgggcccagtcctggctacatggaaagggcatagcaagagcagggtagctgccgatcaagatctgacgattctgtgcaacgagctgaccgtatgtctacccgtgctggaggatctgggaaggcgctgtgcccgcacgtgctctgtacagctgtgctgctcggggccatgcagtatgcttgttagggtgcagcccatgtgcagccgcaaggagcctgggataggaacattgtacggcatcgcttcaaaaggcttgcatggagggaaacaaaggaccttccgtgctctgtag

SEQ ID NO: 6142 - DNA, 972 bp, Chlorella protothecoides
atgctgctccccgcactcgccgcccgggaggtgggcaccctccggggcccacgcctggagtctaaggccgtcggagaccccggactggcgctaagactttgcgatgtggcagatttgaatctcgaggatcgtgggggggtgggagcgctggcatggaatggccccactgccgacaccctggcggtgggtcatgctgatgggcgcctggtcctctggcagccggaggccgacacgcgctccgagatcgacacagtgagcatgtggttgtgggtagggtgttctccatcgcacccgccgtctggcaccctgtatacttcctgggtttcccggccatggctcctgaccagtcacctggaagccagctccctccccccatccgaccagggccacaccggccccatgcacggcctgtccttcctccccgacggcactgtcctgtcggccgccggggacgggcaggtgcgcatgcacagcctgcgccgcggcgcgacccgccccttccacctccactccgcggccgcgacctgcgtgctggccgtcgaggcaggtgaggcaggcacggggctcttgtggccgggacgccgcgccctggtgcgctgcgcgtcctttggcgcacacccgtccgcggagtggccgtggcaggccgctgacagacctgcttccttgtcccaacaccccatgcccgcagcctcgtttctgtctggcagcagcgatgggaccgtaaggctgacggacacccgggtcccgccgcagcccctcagggagccagactccccggcgcgcggctcctgcctggtcggtgagctgcagggcggggcgcgctccggctggggctgccgggctgtcggtcacggtgtctgccggtcgtgggatgtcggacaggccttgtggtcggcacgcgccctgcaccgggcctgcatgcccttcctatggtggcctctgctggccccgtccatgtcccgtctggcatga

SEQ ID NO: 6143 - DNA, 897 bp, Chlorella protothecoides
atgcgcgacctggtggggtcggcctactacgtcgcccccgaggtacggcggctgctgggatcacatgggacggggagggggtggcggggaaaagggacgatggaacaggggtttcagagtgcgcagagagcaggggatcagtggtgggatcaggccccaccacgccacgcgtccttcatcgcgaggcgctcggaggctgcaggatccctccctttgccccctccctcctctcacgcaccccactcccaccccctcccactcaacccccaccccaacccttctctgcaaactcaggtgctgcaccggcattatggcagggagtgcgacctgtggagcctgggcgtggtgctctacatcctgctctgcggcctgccccccttctggggcagcacggaggccgagatcttcaagtccgtgctggaggaggagctggatttccagaccgcgccctggcccgccgtgtccgagggcgccaaggccctggtcaaggggctgctggaccgcgaccccggcgcgcggctcggcctcgcagaccttgccagggatccctggctgcgggagcggggagggtcgcgggccgcgcccctgccgcccatggtcatccagcgcatgaaggcctttgcgcgcatgaccaagctgaagaaggtgcggcggcgagggggacccgcagaagatggcagaggggtgtcgaggaggggcggggggcgtcttaatgaagaggctgacgcagtgcctacttggatttggggttgctctggcggcagggctgactgcacatgcactctggctagccaggcaacccacaaggcaacccttgcaggcagcggtgctgagtgccgccaagtacctgaccaaggaccagattcaggggcttcgggagctgttcaagtcctttga

SEQ ID NO: 6144 - DNA, 378 bp, Chlorella protothecoides
atggtgaagaaggtggcgaaacgaggcaccaaacgcgcggcgtcccaacccgaggctgacaattcagactccgagggccatgccacggtcatcgagcaggccatcgcaggggacgcgagccagccttcgccggcaggccctgcgcctgggacggagccctacccccctcccaacccccctcccacagaccgccccgtgcgggtctatgccgacggtaggatgccgggacgaggcttcgaggtccgagcagtgaagtcacgagtgttcatccgaccaccaggccccccggtccccatcgcaggcatcttcgacctcttccactttgggcatgccagggcccttgagcaggcaaaaaagaggtgcgcaggcctggactag

SEQ ID NO: 6145 - DNA, 2166 bp, Chlorella protothecoides
  modified_base (941)..(950): a, c, t, g, unknown or other
  modified_base (2007)..(2016): a, c, t, g, unknown or other
atgaggggggggaatcccatcacaggctttgacttgggaaaagggggtgctaggctcaggggccggcatgtttgtctactccagcaggtccagtcagaacctagggtttgggagagccatgccacagcgcgtgtttactgctgcatgggcactacggctgcggctgtgcctggatccagccccgggactgctgcacacccagtgagcgccactcgtgctcatgcagcaagcggtcttttggcagccgagtcgcgatctcgggggggagcactacatgcctatactcgtacacgtcgtcgtagtagcgctcgctgcggtggtggagagttcagagcatgtgaggttttgcagggactcgttggtgccgaacggcatgatggactgtacgagaggtctgcgcgaaagaaaggcgccacaagattgtttgcagcttatgaaacatacccaatgatcaatgaatatgggtggacttcccgccagtcagccgatgccacgccagcaagactcacctccatctacccgtttgccccctcaatctcacgcatcacaggaccccacgcatcactcacatgcaagggtcgaggaggcacgacgcacttcattggtccagcagcaaacgagcctttgacacagcaaggagggtggtcccctcgtcctcgacgtcggagaagtcctgagcccaggcaagcgggtgggggagaccttgcgcgtccttgctctgccgccattcgaaattcaccggacgtgactcacccagttcatctctccagatgcggtcaaggcgcgcgtagccaccttgacggggtggaggatccaggactttcgcctgtatgcaggctgcagggagtggctgcaccactcggcggacgcccagtgcccccaagagtgcactgcggtcccccgactccgcggtggcatgatgatcaaggtgccagagtgcnnnnnnnnnngtgcccccaagcgtgcactgcggtcccccgcctccgcggtggcatgatgatcaaggtcaaaacgctgactggcaaggagatcgagatcgacatcgagcccaatgactcaatcgcccgaatcaaggagcgtgtggaggagagggagggcatcccacccgtgcagcagaggctgatctttgccggcaagcagatgaatgacgacaagctcgccaaggagtacaacatcgagggaggctcggtcctccacctgccggtgcatgcccctgccggaaaaggccgtccctccccaagttcgagcgcgcgcttcagatcgagcgatggttcagtgaccgagccgtgcgtctacaatatgcagcctctgtgggcattgccagcgctgccaagtcctgcacgaccacgttcggggatcctcctcgcatccgccaaccagagtgaatttcacaaaggctctgactgcgagcttcatcgcattctgggcatggccagggatgaggaggcggaggccctgcccgtggaggacgaggagtatgaggagtacatcccggtgaagaaacggcggcagttggaggtccagtcccgcttgtccaggctcggccggccgtcgctggtcgctcccttgaatggagagcctctccggaacaaggacggcgggtcgtccgatggcgcgggggcagcacccagggatcaacagccggccgtgcagcagcgtggcaaggagtccctgctcatcctcaaggccaaggccctgcaggaggtgggtggaccatgggaccactgcatgcgcagggagcggcttgggcgagaccgagcaggagcgcgtgctgaaggaggaagcagagctgatgcgcagcatcacccagaaggcggcgctgaagacttatgcggaactggcgaaggacatcaaatacacgcaagtgatgaagacggggtggaagccgcccctcaagtaccgcctgacctccgaggacgagcaccaggttcgtgtttgtttgtcttttctttttggcagtggagggggaaggagtcctgcaaaaggacatgctctgggagccctgcnnnnnnnnnnctgacctccgaggacgagcaccaggttcgtttttgtttgtcatttctttttggctgtggaggggaaaggagtcttgcaaaaggacatgctctggcagtccagtgtgctctcctgctggcacctgcaattccagagcatccaactctatga

SEQ ID NO: 6146 - DNA, 843 bp, Chlorella protothecoides
  modified_base (664)..(673): a, c, t, g, unknown or other
atgccggaccccctgccccaccacagcgtgtacgagcacgccgcggtgctggccccgggctcgccggcgcagcagccgccggcggcggagctcatggcccgctccaagatctcctccctgagctgggacccgggcagcgagcaccgtgtggccgcctctgactacgacggcgccatgagcctgtgggacgtggagggtctggcgttggtgcacgaattcgaggcgcacgtgcgccgcgtctgggcagtgcactactgcgcagcggcccagggcctgctggccaccggttccgacgacggcctggtcaagctgtggtccaccagcctcgccaccatggtcggacagggccaacccccctccccacccatcatcccctcccctgcagatcgacgtgggcgtcaacgtgtgctgcgtgcggtggcgcccggggtccagccaccatgtggccctgggctgctcggaccaccacgcgtacctgtacgacacgcgccatgtggcgcggccgctggagacgctgtcaggccacaggtgcggcgcgggctgtggtcaaggcgccgggtgcttgttgttgtcgtggatgagggggcacctgggcaggccggctggtctgggatctgtgcactcacggctctgcctgttcccatcatcgtggttcggggtgcannnnnnnnnngatctgtgccctcacggctctgcctgttcctatcatcatgtttcggggtgcgtgttcatgtccatcctgtccccaagattccccacaccacctggctttcccccaccccacccccgcatttggcagcaagccagtgtcgtacgtgcgctggctggactctggcagcctga

SEQ ID NO: 6147 - DNA, 1650 bp, Chlorella protothecoides
  modified_base (138)..(147): a, c, t, g, unknown or other
  modified_base (412)..(421): a, c, t, g, unknown or other
  modified_base (1317)..(1378): a, c, t, g, unknown or other
atgcatgggcgcgacctgcacctcgatgcccccaattctcagttatctcgctggatctggtccctccacccggctccaagaacaccacagcaccatgggcgaagggctgtctgcatggcactcgcgcccgtcccaacnnnnnnnnnnccaagaacaccacagcaccatgggcgaaggcctgcccgcatggcactcgcgcccgtcccactcggcagatcaaaccagcctgctgaccgcccggccccctcaagcaggcagcgcaccggcctacagcaccatgtaatggacatgccagcggttcatgcgtcctccgcgggcccaggggaggatgtggcctcgcatgcggacttctcctgccccgtgtgccgcgagcggcagcgtgacccggccccccacctgctcctccactttnnnnnnnnnnatcctgcgccacgtccagcgggacagcacctgcccctgctgccggtcctacctcacggaggcccgggtctggcccaaccacctgctggccggggtgtgcaaggcgctggaggtgcgaggcgcgcgcatgcgcctgtccccaatcgcccgcctcaagcgcctgctggaggaggttggccccgccatgctgccagaggagctggacgccgcgctgcacctgctctggacgcagcggcagcgcgaccctgcaccccacctgctcctccacttcctccagaagacgaggcgagggggtggatgatttggggagaggggggggggaggtctttgcgtcctgtggtgttggaggggctaccctatcatgatgattattggctggcgcggcgaccccatcatgccttccctggccaagccttgccagcctggcctgaagccaggctctttcgctcctcgcccgatcaagtcacatcccctgcaaccccaacacctcccttaccactcgtgtcgctgcccatcgttccttcctccccaccccagtcatggcggcccctcccctcaccccacaggcagtccaaggaggcggagctggacagggtgcaggaccggctggactgcctggagaccgacatccgcgctgtggcgcggcgggtcgaccctggctgcctgcctggcaccgagctggaggacactgggtccagccgcgaggagggtgaggactccagcaacgcctcgggcagcggcgtgtcgccccgagaccccgcccccggccccgacccgacgcaggacctggcaggcgccccgctcttcgttcctggcggcaagcgcgcccgcctgtcgcaacacctggacggcctgctggcggcctacgaggcgcggcgcggcgcgggcgcgggggcnnnnnnnnnnnnnnnnnnnnnnnnnnnnnnnnnnnnnnnnnnnnnnnnnnnnnnnnnnnnnngcgggggcctgggcgcgctggcgggggcgctggacctggtccaccgcgccgcggcgctggagaccgtggccgtcatcccgcgcccgcctggcgcccggcccaacagcatcgtgtcggggctggagtacaacagccgcggcaacctgtttgcctgcgcgggagtgtcgcgccgcatcaggtggggagccgggggtgggcgggtgcctgggcggatgcccgatccacggtgcacacctcctggacaaggtttcgacactactgctccatactga

SEQ ID NO: 6148 - DNA, 1356 bp, Chlorella protothecoides
  modified_base (218)..(227): a, c, t, g, unknown or other
  modified_base (297)..(306): a, c, t, g, unknown or other
  modified_base (484)..(493): a, c, t, g, unknown or other
atggggaacagggactatggaaatggcgaccacctcggggcaagttcgaaattacaggatccccggcgtattcacaaagctaatgtgatcgaatgccgcgctgaaccgcgtctgcatccgtcgtcgggagtgaggtggtgcccctaccatgaagcgcggcagtccccggttgctgccctcgggggaccgccggcggaccattgctctcttctttgccnnnnnnnnnncaacccctggatgggcaccatgatggagagcgccgaggaaggccaggtaggtggactcgggagggagggnnnnnnnnnnccagccgcagcctgttcgccgactcgccttccagctcccaggtccttgctcagtcccgggaggccgcccccttctccttgggccccaactgcacagtggacctggcccatgccgacgccgctttcatcaagggtcgggtggaggccatggcatcagagccgggtccactgggagcccnnnnnnnnnntgaatccttgccctgacccgcaggcatcagggccaggtcccctgggagccttcgttccaaacacgctcagaccctcaagccccccgcacctccatccccccctgaacctgcagctgaccaggggcgaggtgagggccatcgtggggcgggaggtccccctccccgtggatgcgcggtacggcgtgcaatcaagcgagtcggtgccgggggtgcaggacgtgcacgctgagctggcggcgctcatggctgccagcctggcggggatgacccccgtggagggcaccgcggtgcgccgccagcaccgcaccacgaccgcagagatgggcgtggcggcgcgcgatgcgctcaacgataccagcagcgtccccgcgcgcatcgccttcctgaacgcgctggcggaggaggcggcgccgtacgcgaccacgcgcgtggcggtggtcaccaccagcggcgtggatctgcgtggcgtacggcgtgaggtactgccctggctgcagtaccacaccgagatgggcgtgtccaggttctacatcgtctacaacgggcacgacgcggcggcggtgcaggcgctggagaccatccgccatgtgcgcctcatccacgtgcacgagccctgggcaaagggcgtggacagcgccctggtagagctctactccggcctgtccaggcagtggaaggggcgaccggggaactatgcactcatggtcacccagggtgaggcttcgtgtgggtggggagggtggggtgcctgggaatggggaggaacagggacatgggagggcgggacggaccacgcatgtgggaccgcgagggttgggtgtgcgccgccgccgcgcggttccgcagccttcccggtggcctga

SEQ ID NO: 6149 - DNA, 1389 bp, Chlorella protothecoides
  modified_base (1003)..(1012): a, c, t, g, unknown or other
  modified_base (1210)..(1219): a, c, t, g, unknown or other
atgcaagtgctctcaaaaaccaagatgacccagaatcttgctgacgtggacctgcgcaagagagagctcgccccctctccacatcgagagacacaggacttgccgctcgccaacctcatcggggaaggtatgcgcaaatctcgcaacaaacaagatggggcagacaatgagcttcggtctgtctcagttggacgtggaggagatggtccaacacagcaacggggcgtgtgcgcagggcggagagtcgtggagggggctgaggttggacaaagaccgcaaggtgagaggggcgaatgccgtcgggtcgccactcgccactcgagaagtgcacctccttcctattcctcagcgcgtcttacgctgcaccaggtcggggtcctcactactgatcctcgatgccgtgctccaaacagctcctattctgtggtgtctttggcgcagggcttcatctcatctgaggagttcctgagcattccggagctctccatcaaccccttggcacaacgcttgtccttttttgtagagagcatcaacttcaaggagtttgtcaccttcctctccgggttcagtgccaaggcggggcgggaggagaagctgaaggtcatgtttgatgtgtatgacgtcgacggtaagagaccgagggttggatgggaagggagtggacgtgtaatctctggagtatgggcggttgctgccaagctgtgctgggccggggacatttcgcgactgagggccacttgtgccaacctatcttcatcccatctgttcactcacgcaggcgacggcttcatctccgaggacgacatggcgcagaccctgcggtacctcattggcagtaccctggccgaggccgagctgcgcagcgtgatcgagcggaccatggtcgccgcaggggctgatgccaaggggctgacctttgcgcagtacaaggaggcgctgggcgacacccaactggccctcaaccttgaacatgaggagctcatggtcatttggagtaacgcannnnnnnnnntacacaacactgctatgcggccagacagcacgaggagctcatggtcatttggattttggtcccaagtgtcctgcctcggacgctctgggcattgcaaggaggtccccatgtcttggctgagactcatcgcggcgcttgtcttcgccaagtcccgaaggaatgtcacaaagtcctcatgtcacatcacaatgctgcttnnnnnnnnnntgtgcttttcattcaacacatcattgaacatgggcctgggcgttctttgtctttacattccagttttggtcccaagtgtcctgcctcggacgctctgggcattgcaaggaggtccccatgtcttggctgagactcatcacggcgcttgtcttcgccaagtcccgaagtaa

SEQ ID NO: 6150 - DNA, 936 bp, Chlorella protothecoides
  modified_base (317)..(326): a, c, t, g, unknown or other
  modified_base (869)..(878): a, c, t, g, unknown or other
atggtactcccaactgacgacctatgcccttgcagtacaaaggacgaccactccatcctggttgcgttctgctggcatgtcactgccttatttacagaggacgaccactccatcctggttgagttctgctggcatgtcactgccttactgtgctggggggagtcccagaattcgcttctacgcaaatattacaagccctccagcactcgcgcaaaacaaaagctccaggttattttcgatcaatgttacgatttcccgtcaatcggacattccatctgggtttcagacgttcgagcagcagagcattcggtttcggnnnnnnnnnnagctccagcttattctcgatcaatgttacgatttcccttcaatcggacattccatctgggtttcaaacgttcgagcagcagagcattcggtttcggaagcactcgtgccatgccaggacggcccaacctcgggaggctcacagccgaagacctgacggccctccgtgccgagccgcgagctactgcggttctgaatttctggtttggcgagaagtgggagacggagggtcttcccaacccgaccgagaggctgggggtctggtatgggaagagcgatgccctggactccagcatccgggagtcctttggaggggaccttgaccgtctcctggagggccggctggatggctggcgctcctccctgctgccagcagtggcgggcatcatccttggggaccagttcactcggaatgcgcgtcggggcacggccagcatgtacgatgctgatgccaagacgctggagtggacgcacgccctgatagcggatggcagcattgctcggctgccgtacgcgcttcgccacttcgccgcgatgcccctcannnnnnnnnnacatgtacgatgccgatgccaagacgctggagtggacgcacggtctgatagcggatga

SEQ ID NO: 6151 - DNA, 5577 bp, Chlorella protothecoides
  modified_base (299)..(308): a, c, t, g, unknown or other
  modified_base (481)..(490): a, c, t, g, unknown or other
  modified_base (927)..(936): a, c, t, g, unknown or other
  modified_base (1409)..(1418): a, c, t, g, unknown or other
  modified_base (1876)..(1885): a, c, t, g, unknown or other
  modified_base (2655)..(2748): a, c, t, g, unknown or other
  modified_base (3155)..(3164): a, c, t, g, unknown or other
  modified_base (3652)..(3661): a, c, t, g, unknown or other
  modified_base (4141)..(4150): a, c, t, g, unknown or other
  modified_base (4848)..(4857): a, c, t, g, unknown or other
  modified_base (5259)..(5268): a, c, t, g, unknown or other
atggcatcgaatgtgctccgaatcatgcatgcctcagcctatgcgcatccacttcccactgcaagcaggcatgaaggcttcagcaaggcgggatccgttcgcacctcgacccttgatgccattggactgtccatgacagccatccgtgtgagcaccctggagatcctggagtctcgctccacgaatattctcttggccgtggagtgcctcaagatgggccagaaggcgtgcacggcagacagcaatgaaaacattgggtccggcaacaaaggcaagaacaactttggcacgagcaacgnnnnnnnnnngccgtggagtgcctcaagatgggccagaagacgtgcgcggcagacagcaatgaaaacatcggctccggcaaaaaaggcaagaacaactttggcacgagcaacatcggtgctgcctgttgcaggtaatgccaatgtgagcactgccaactggggaaacaacaataacggcacannnnnnnnnnaccgccgctgcagccctggatggagattaatcagtgctatggaggtgctgcctgttgcaggcaactccaacgtgggcactggcaactggggaaacaacaataacggcactggcaatcgctgcttcaataaacatggaaaacgcaaggttcagaacgactgtagcctgctcgagttccggaggcatgcatgggtccttgccttgccgccgcctcccgccaaaaagtctccacctccacccgccaagaagtcaccgccagacccaagcagcaaacctccgccgcctcttgccaggaaacttccacccccacctgccaagaagtctccaccgccacaccccagaaattctccacccccacccgccaagaagtcaccgccgtcaccctccaagcagcctctacccccacccgctaagaaggtgcccccgccgcccaccacnnnnnnnnnncctccacccgccaagaaatcaccgccagacccaagcagcaaatctccgccgcctctcgccaggaaagttccacccccacctgccaagaagtcaccgccgtcaccctccgagcagcctctatccccacccgctgagaaggtgcccccgccgcccaccagaaggtcgccaccgcctccctctgaaaggtcacctcccccacccttgagaccaccttctcccccaccctcagggtccagggcccctcctccgccaagaccctcaccttcagccagcccacctctttcgccacctcccacccctccaccaagcccatcgcctccatctccaccaccacgtgcatccgccacactacagttcagcgctcttacagatgggaaggtcaacgccacgtgtgttgttaccacggtggggtacattccctacatggttgcatgcaatctgtactcatccctcttgggccgaattgggttccnnnnnnnnnnaccaccacgtgcatccgccacactacagttgagcgctcctacagatgggaagttcaacgccacgtgtgtttttaccacggtgggggacatttcctacatgactgcatgcaatctgtactcatccctcttggcccgaattgggttcatggaggaatacagccccacatccacagtcactaccattgtgggggagtcactcccgcaaacggtcatgaggaatttcgtcactggctctgcattggtatacaaagacagtcttgctctgagcgaggtgatggcgctgactctgctaaacccttcaccaccacctcccccgggaccctcgcccccaccaccagcatttgggttcatcagtgggagcgtcaccagagcagatcaaacatttacattctcggtgacgcttggaagcgtcgtcccagacgctctcttctacgctttcttcacgacagatgggatannnnnnnnnntggaagcgtcgtcccagacgctctcttctatgctttcttcacgacagatgggacttagtggccctcaagttctcaggcgggagctcaaacgccctgaccctgaaattgtgaatctgatggcgatcaagttgcccacccgcaacaaagtgtttcaaaaccatctgcctcgaatcctcaatgccgacatcccaggcagcaaacggctgcagaacagggtgctcctgcctcgcagtgttcgtgggtctcaagattcagagtcattgctagcacccatctctctgccgcttagttcgcctctgcttgtgaaactgtacttggcctcatcagccgaagagtcctcagcggtggatgtttcaccatttcctcaacagcaaggacaacgacgtgaaacctatggagtgataacatggtggccactccaaccggtgtttgcaaaattcttgggcgatagtgatagattcgacacgtgcattgggattcttcatgtgcgatcagttccgcacgacctgacgcattgcggaggttcttccggatgcggagatgctgttcttgaggcgacgttgaggggggttagaagctgcaatcgtcatcgggttccggatggatccctccggaatgccgcgacaagcatctccgccgtcttccctgatacccttacaaacataaatgatgaaagcaacaaaccaaactcccgacaagtgaatccaggaggcggaacagtgacagcgccgcaaggtgcaggatgtcaccgaccgccaggaactcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcgcacccgcgtcagccggactgcggtcgccccttctacaaccacttcctcagcattcccgcccaccgcaggccacatgcagctccactttcgtcgcgcttcccagtgcaatgtgagccgtgtgctattttcatgagggaaggggctcggggttcaccagcggcatcggtgaccttcctattctcacgaagctgtcgcgcacatgcctccggccgggccccccacatccgtgttcctactcagcatttctggggtccggggaaactgcttcttccccctcgcgcacatgcctccggccgggcccccaacatccgtgtccctactcagcatttttgggggtcggggaaattgcttcttcggtcaggcacgcatataacccactgtgctcgagtcggcctgttggnnnnnnnnnngtctgctcccgatgctcctccaacatgtcgcttttattcgattccgtacagtctgggagcccatctgtacctgacgacggtcgacagtgcagatgccacttgcaatctgggagcccatctgtacctgacaacgggcgacagtgcagatgccgtttgcaagcacatgggcttcagcaaggcgggatcggtccgcacatccactctcgacattatgggtctctcattgagtgccgtccgtctgacccccctaggaatcgtgacaccacgctcgaccaagatcctggtggctgtggagtgcctgaagccaggccagaaggcgtgcccagcagacagcaatggcaacattggctccggcaacaagggcaagaacaactttggcactgagaatgtcgggaatgataacatcggtaatgccaatgtgggcaccgccaactggggaaacaacaataagggcacgagcaatcgctgcttcaacaagactggaaacnnnnnnnnnngaacgttggggatgacaatattggtgagcaagggctccaatgtgggcactgccaattggggatataacaatgagggcaccagccaccattgcttcaacatgtctgggaaccgcaagaacttacagggttgcagcctgctcgagttccggaagtatgcatgggtccttgccttgccgccgcctcccgccaagaagtctccacctccacccgccaaaaagtctccacctccacccgccaagaagtccccacccccacccgtcaagaagcctccgccaccacccgccaagaagccaccgccaccacccacccggaagtctcctccatcgccacccaccatgaagccacccccaccgcccgccaagttgtctccaccgcctcctgccgagaagcttccgccgcctcccgccaagaagtctccaccaccacccgtaaggatgtcacccccaccctcaagcccaagccctcctcctcccaatgccnnnnnnnnnnctctcctccgcccagcccccctccctcgccctctccaccacctacacccagcccctctcctccacccaggccccctccctcaccgagcccccctccctcgccaccaccaccctcaggaccagcaactgccacacttcagttcggtgctcctgcagatgggaagcccccctccctcgccacctccaccaccatcagtaccagcaaccgccacacttcagttcggtcttcctgcaaatgggaaggtcaccgccgcgtgtcttgtcactactacgggttacaaaccttactccgtcaattgccagctgtttacgtctatgtttcaaacgcttacgaccatggaggaaggtagccccagatccagcatcacttacatcatgatggcgttggatgcaacgtatatgacagattattctcttggctctgcatttgtaaatacagataagaccacccttcacgaggtggtgccgctgaagctgctcaacacctcaccacctcctccgggagccgcccctccaccaccagaatttgggtctatcagtggaaccgccactcgctccgacaatacctttacgttctcgttgacacttggaagcttagttccggatggcttctactacgctttctttaaagaagatggtgcgctagtacagagcttcgccggatattattctggccccccggccaaagtatctacaacnnnnnnnnnntactacgctttctttaaagaagatggtgcgatagttcagagcttcgccggatatttattctggccccccggccaaagtatgtacaatgttggactatgccactgcacaatttgtgtcctatgcccaactagtggcttacaaaactgcaggtggaagcacaaatgtcctgactctgaactggatctattgcaagacggcagtgaagttgccccacatgcaacaaagtgtcaaaaacccacttacagagaagttccttgcgaagtgcatcgggtcacctcatttagggacggccaaagacctgaacacaagcaagaagggcagtcatggcacaacttgtggcggcctcaagatgtagaccagcagacggcagccacgccgctgctgggctgttttcaccctggnnnnnnnnnntgtaaaccagcagacggcagccacgccgctactgggctgttttcaccctggccttggacccaaggctttacacgacagcctccttattgcaagcctgacttcaaacatcgaccaagaatgattatggattgcaaattcaaccagagtgataagggtgtgcatagggagctgaaatgtgggggaggggtggggctgggtgcttgggggagcacaccgccacacctgatcttatgggagctgcttgatggcatcaatgctgcccatgcaccggcttggtatctgtggggaattcctggggcaccgttctaa

SEQ ID NO: 6152 - DNA, 1605 bp, Chlorella protothecoides
  modified_base (383)..(392): a, c, t, g, unknown or other
  modified_base (717)..(726): a, c, t, g, unknown or other
atgcggtggctagcacagctggaagggggaacaaccccacgcctgctcgtgctcgataagtcaggcacatggatgacaacccacccgcctcttgaccatctcaccctcagtgctgatgaagatggtgtggggtcccttggcaggctcggcgcccagtgcaatctgggtcacgtgcacgacctcgtagccctccatgtcagcatccacggccgcgacgatctgcacctccttgcctggtacgggcaacggggaggcaggtgggcgggagcagagaccacatcgccgcgaggccggctgctgtgcctcagggcaatcacccccccaacaacacccgtcggcatgcgtgctgacggccgcctaccatacgttatgcagccccaaannnnnnnnnntggtacgggcaacggggaggcaggtgggcgagagcagagaccacatcgccgcgaggccggccgctgtgcctcacggcaatcaccccctcaacaacacccgtcggcctgcgtgctgacggccgcctatcatgcgttatgcagccccaacaatacctgcaggaatctccacgccgaagaatctgcacacgggctccaccatggccctttgcgctgggttgtctggtgggtaagataccgactgcaatgtgtgtatctctcccgtgcaggacttcttggagacgaaacctctatatgcaaatttaatgacatacgccaagatcgcttnnnnnnnnnngtgggtaagataccgactgcaatgtgtgtagttctcccgtgcaggactgcttggagacgaaacctctatatgcaatttaatgacatacgccaagatcgctcgtttatggactgggatgctggtgcaggaccgtcggtgccgatgcgaatcaagggggcgcaatgtgcagcgcgcgggaactactaccatagggcgctagctcgatgccatagacccacactcgctggtccgacctcacctattccatcccttgtggaagatacaatcaaattcactatcttcctgcgagtccgagatcgtgcgaaagtgtctcgtccgctccgacaagcaggtgcgaggtgccgcagggtggaagggctgcagcttgacggggaggcccaactgagaggattgcaggcgttctcatcgcgtcaagaaatgtgcaacattgtatatcatgacaactacaaggttgtgtatcgaagatatgcgtcactcttcttccttgttggcgtcgacaacgaggaggtggggaccgcagggccgggctgcctggagatcgagtcagcatgcgtatctgctgggggaaatgagctgggcatccttgagttcatccactgcgtggtggagaccctggacaagtggttcagtaatgtgtgcgaactggacatcatgtatagcttggaaacggcgcgtccaatagtaatgtggcttgagtgcgaaaccccttgctgcatacaacgaggttgcattgcaaaccctcatcttaccctcctttcctccacacgcgaccaggcgcactatatcctagacgagatgtgcatgaatgggtgcattgtggagaccaacagatcgaatgtgctggcgcccgtgcacctcctcgagaaggcaacgacgtga

SEQ ID NO: 6153 - DNA, 729 bp, Chlorella protothecoides
atgcacattcggaactcgctgcccgacgaggtggtggtgcagcgcatcgacgagcggctgtctgcgctgggcaacgtcatcgcctgtaacgactacgtcggcctcatccacccagacatcgaccgcgagaccgaggagatcgtggccgacgtgctgggcctggaggtgttccgccagacggtggcggggaacacgctcgtgggctcctacgcggccttcacgaatcaggggggcgtggtggctcccgggacgaccgtggaggacctggacgagctgtcctccctcctccaggtcccgctggtggcggggaccgtcaaccgcggcagcgatgtcgtcggcgcgggtgagctggctctgtgtcggtttggagggggtcccaagtacagacacccagacaatcagggtggcgggagcaggcccggaaaaggggagggagaggcgcagggcccggcgctggacgcatgggcatcatcggtggacacacagcgaggcactctcaagcatggcatcgggtgcggcggcgggctgcaccctgggacgcgcttcctcaccctcctcgcccccctccccttccaaggcctggtgtgcaacgactggagcgccttctgcggcctggacacaacaacaacagagctctccgtgatcgagtctgtgctgaagctgcggacgagcaacccctcccagattgtgaacgagatgagggcctcactcatcgacagcatggtctga

SEQ ID NO: 6154 - DNA, 378 bp, Chlorella protothecoides
atgagcggcgggggtggctggaaccctcgtggaggacttgcctcccagcctgtgcactggccaaggcctccttggtcgaccggggcggtgggcacaccccatcacttccctcctcgcatcccacgagccatgaacgtcccctcccctctgcaccccaccaccacagttcgcggcctgggtgggttctacacctacggcttcacccatggcggccccgtgtctgtaatttggggctggcccctggcggtgaccatgaccctcaccgtggccctgcccatggccgaggtgtgcagcgccctcccaacgtccggcggcgtctacttctgggcgggcacccttggcggtcggcacgggcctctctactcctgggtgcgatga

SEQ ID NO: 6155 - DNA, 876 bp, Chlorella protothecoides
atgacgtgccccgtctcgtctccactcctcgcccaggaggaggtcaggatgcggctggagggcggggagggccccatcggcatggtcatctgcccctcccgcgagctggcccgccagacctacgacattgttgttgcctactcagaagccctcagggcaggctccctccgcggctctctgtctgaccctgaactcctgcctgtggacccctgtccccaccgattgacctttccagaaactctgcaccccacaaactctgccgcagacggcgcccccgagctgcgcacactgctgaccattggtggcgtggacatgaagtcccagggcgacgccatccgcgccggcgtgcacatggtggtggccacccccggccgcctcaaggacttgctggccaagcgacgcatgaccctggacgcctgccgctacgtgtgcctggacgaggcggaccgcatggtggatctggggttcgaggaggacatccgcgagatcctgtccttcttcaccggccagcggcagatgctcatgttctccgccaccatgcctatgaagatcaaggcctttgccgagtcggcgctggtggaccccgtgaccgtcaacgtgggccgggcaggggcgaccaacctggacatcattcaggaggtggagtacgtcaaggaggaggccaaactggcctacctcctggagtgcctgcagaagacaccgccgccggtgcttgtgtttgcggagggcaaaaaggacgtggacaccatccaccagttcctgctcctcaagggcgtggaggcggtggccagccacggttccaaggaccaggaggacagggagtgggccatccagagcttcaagacggggcagaaggtaggaagacgtggagtttga

SEQ ID NO: 6156 - DNA, 624 bp, Chlorella protothecoides
atgtacctgcagcaggtgatcagcatcagcgaggggcggtactacgaattcacccgcgcgcagcagtacgggttgtactgtggctttataatcctgcacggcgtggccaacgccatctccgtcaagctcctaggctggctcagcgtggtgtcggtgtactggcacgtgctgggcacgctgggtgtggtcatcggcctgctggtcatcgcgcccgtgcaccaaagcgcggactgggtattcggcaccttcatccccaaccccgacacgggggtgagcaaccccttctacctcttcctcctggggctgctcatgagccagtgggccatgacggggtacgacacctccgcacacatcgcggaggaaaccaagaacgccgccattgcagggccggtgggcctcatcatggccattgtgggctccttcatctgcggctggatgttcctgctctccctcaccttctccatccaggaccccgccaacatcaccaacccagacaccatttcggggggtgagtcatggaggtgctgtttgggaggtggaaagggggaaggtgttggaagaccacacagggggggagggtgcctgggcactgctgcagggaggggtaggttgatggcactgtga

SEQ ID NO: 6157 - DNA, 501 bp, Chlorella protothecoides
atggcgcccctctcaccctggcccctggcctccgacacgcggcatagggcccccgccacacacgcccccccgccgctcctcctccgcccgctgctgagcgtgcacaaggcggagctgctggactttggcgccgccatgggcatcccccacgtcaccgaccccaccaacgccacgccggcgtaccagcgcaaccggctgcgcgcgctgctgggcggggcggggccggaggtgcatggcgcactccaggcgctgcagcgggcctgctcgcgggtggcgcgggaggcgcgggagcgcggggacgccgcgctcgacgcggcgtctcgggcatcacacggccgcttcccgcctccctctgcggcggtggacgcgctggctgccaggctgggccgggaggggaagctggtgggcagctggacggggggcgggtgcatcgtgcgccccgtccccgggtcaaagggccgtctgatcgactgcgcgccgcagggccctgcccaggcctga

SEQ ID NO: 6158 - DNA, 384 bp, Chlorella protothecoides
atggcagggcgcccagtcctgcggggcctcgtgacggagggcctccgattccgcgtggtggacgccaagggccaggtggtggggcgccttgccagccagatcgccaaggtgctgacgggcaaggacaagcccacctacctgccccatgtggacggcggtgatgcggtggtggtggtcaacgctgcgcaggtggacttcacggggcgcaagtgggaccagaagctgtatcggtggcacactggctaccccggcgggctgaaggagcgcacggcgcgggaccagctggcgagggagccggaggctgtgctgcagaaggcggtcatgggcatgctgcccaagaacaacatgcgcagggtgggcatatgtgatgggggggccaagtag

SEQ ID NO: 6159 - DNA, 621 bp, Chlorella protothecoides
atggcgggctcctccgacgaggacagcgaagacttcgacagcgaggatcaggatgcgcccgcgggcgtgcccctccgcccgcgcccggccggcaccttggagagcagcgatgaggagcggctgggcgagggcagcgacggcgacgacagcgaccttggcagcttgctggacgaggatgacgaggaggaggaggaggaggacgacgacgacgacgatgaggaggacgatagacgtccccgcgccccgcgcgtcgggcaagcaggtgcgcgcccgccccgaggagcaggaggccgcccccgcgtcggcgaagaaggccaaggtggccgccgccgccacgccggcccccgtctcggcgaagaaggtgaagaccgcagcaacgccggccgccgccgcgcctgcgcccgcggcggcgtcaccgcactcgccctcgccggctgcatggctgagtacgtcgccgcgctgaaggccgtgctgcaggctcagggcccgcagcgggtgtcggcgctgggcgcgctggtcaagcgcccaccccaggtgcccaagctcaagtcgacggtgggcgccaaccccgccatcttcctgcacgacctcgtcaccgacatcgtgtccctcgtggagtga

SEQ ID NO: 6160 - DNA, 414 bp, Chlorella protothecoides
atgcctgctcccctatccccaccacgatccgcgcagaggaatgccgggctggaaaacgggcatcaccccccgggcgacgcccccgccgccccaccgcaggcccagacccagctgctggcggtggcgccgcaggacacctacctcgactcgcgggcgggggcgctgcgccaggtggagagcaccattaccgagctgggcagcatcttccagcagctggcgcacctggtggcggagcagggggaggtggcgctgcgcatcgacgagaacgtggacgacacgctggccaacgtggatgcgggccaggcgcagctgctcaagtactacgacaccatctcctccaatcgctggctcatcctgaaggtgtttggcgtgctcatgctcttccttgctttcttcgtcaccttcatcgcctga

SEQ ID NO: 6161 - DNA, 837 bp, Chlorella protothecoides
atgcagtggctgctgcatctggaccccgatgagctcgtccagcccggtgatgcctcgggcagcctggcggaggtgctggggcgggtcccgccccacgtcgcctccttgcgcttcatgaacttcgaaggccagtcagaggccggggatgtggtcaaccggtatgagcaggtgacgctgtttcgggtgcacaagcacttcatcacccccgaggcgcactggtaccgctcccgcttcaagctgggcgcctccacctccttcctcctcctctacgccaacggcaaggccgcggtgcgcgtggatgcgcccggggctgcggtgcgcgtggacgcgcccggggtgcgccacctggggccccacttctggacgggggatccctcgccgcgctggcagtcggctgacaaccccgggggggagttcaccaacctcgtttccgacgacagcgtcatcctgcactacccctactcatatgtctccgacgtcgtggacaaggcacatcgctcctgcccggacagctacctggcagctgcgcgggcgggggaccgcgccaaggtccgcgagtgcttcgtcatcgaggccgaccaggacgcctacatggcggcggcggcggggcccacagccgtcaccgacttcttctactcgcgctttgtcctgagcgagggagtcagcgtccgctgcaccgacccggagaccaagttgaaagtgagccggcttccatatcttgggaagggggggggggagttattgaaggccacttttaggggcagtttgggggggctagaatccatgggtgggaggaagagtaggggaggcgccgcagagggcgcggcgtgccaatag

SEQ ID NO: 6162 - DNA, 555 bp, Chlorella protothecoides
agctgactggcgaggaccctgcccccgtccctgccaccgacccggaacgactcaagggcctgtccagccctcctgaggaggacgaggatgagggctcggatcctggcctgtccggggtctggcgcgccatccccttcctcccaagccttgtcgaggccatagtgggcacgccctacgaggaggaggaggaggaggaggcggcccacgaggatagcaggagccggcgccgcgccgacgagcagcgggcggccgaggccgcggctgcgcacgcctccgctgcggcccttggtgccgagcagaacgagccggtgccgctgcgagtggacccgcgcgcccgtgaccccctggccgagcccagctcgctgctgcggccgggggaggccgcggccctcgccaccctctgccccacacggcaccgcctggcgcgctggcagctggcctacagcacgctgcgggacggcatctccatgcagaccatgctgaggatggggcatggcagggctcccaccgtgctcgtcgtccgagacatggacaggtgccgacgggttgagtgct

SEQ ID NO: 6163 - DNA, 357 bp, Chlorella protothecoides
atggccaatggcccctctgcaggcttggtgggagacatcacaccaacctgcggcgtgtctgatgaggaaaagcacgctttagaaagtgctggtatccagaaactcaaggccatgctcgggggagggccggcggctgacgagatggaggagctgtggagggagtacgaggcaggggagtccactgaggccgcgttggtcaaggactttgacaaggcgcaagagtacgaggcagggcagggcatggtcctccaggagttcttcgactccaccgccggcaagtggcggaccggcctgggccgggcctgggcggcggagatcgcgtcccgccggccgggtgccgccgcccaggaagattag

SEQ ID NO: 6164 - DNA, 351 bp, Chlorella protothecoides
atgtccacggcgtccgacgtgccggaggcttccggggctctggacaatggagaacctagcacttctgggccggagcagaggcatgcgctgggcggaaagaagtacacccgtctggagctgcccaccccggagcagatggccggccaagaggcaatgaataactgcgccgtgcgcaccgtgctgtccgctgtgatgggcgcggggctcggtgccatgtttgggctgttcatgggcaccatggatggcgcgggtctaggcatagatgggaggctggcgacggaaaatcagaagcagaatgtgcgccagatcatgaaggacatggttcgcaacactagctccaagagctggtag

SEQ ID NO: 6165 - DNA, 504 bp, Chlorella protothecoides
atggatgtgatcaacgccgtggtcaacaacatcaagacggtgggtggccggctgcggcctggtgtgaggtctcccgatgtggactcgggctctgggagagtctgtcaatgctgtgaggcctcacatggggacttgcaggaccatatgccaccacataaggtcaacttgtcggcgccccagaagacaatcctgatcaatgtgctgaagaccacttgtggcttcgcggtggtggaagacttcaagcagctgctcaagtacaacatacggctcctggccacaccaccagaggaggaggaagccaaggagggagagggtaaggccaaggccgaggatgcggagggagctgacgaggagcagcctgctcccgttgagtcggcagcggaggtcagcgaggagaaggttgagcaggaggtggaagagaaggtggagcaggaggtggaagcgggcaaggatgaacccgctgctggtgggtcagaagcgcccgagacaaaggcacatgtgtaa

SEQ ID NO: 6166 - DNA, 654 bp, Chlorella protothecoides
atgccccgtgctgaccttgcactcgatggtggacgcgccgcagcctcgagcgagggactgcagatttcagggtttccgccgctccctgtgccgccttctgtactacacgttctcccataccttcctccttgcacacacatcctccctcctcaccctcaacaggatgtgctggcggcagggcacggcgggggggtcagcgcgctgctcgttcccggcgcgggcgagcccaactacgacagcctggtggcggatcccttccagcggcgcaaggcggcgcgcgaggcggaggtggccttcctgctggacaagctgcagccgggcatgatcgtgctggaccccgactccatcggcggcctggcgcgggagcccaaggaggtgcagaaggagcgcgcggaggcggcggccgcggccaacgcggcggccctggcggcgcagcgcgccaaggccgacgccaagacgccgatgaagggcaagaacaagcccactcggaaacggcggaagaagcagcagaatgtcatcgacgacaaggcgccagcgatgcgggcgcgcatggccgagcagggcgtgctgggcggtggccacgctcggaaggagagcgagcccatcccggagtcggtgccacgcgccctgcaccgcttcgtcgtccggaagtga

SEQ ID NO: 6167 - DNA, 468 bp, Chlorella protothecoides
atggcacaggcgagtgacgtcgacgacatggaacccctgctgctgacggccaagctcgaccccgcctcccgggccctgttcaccggcctgcgaaccaagtacttccctgccgagagaaactacctggatgcccacctgaccttgttccacaagctggatcggaggcaggaggcggcggtgcgccgggacgtggcctttgcctgctccaccagctcccccatgcccctggactccctgcgcgccaggctggccgggcagtggaagccgtggctcactccccaggaccgccagggccatcgcgcccacatcaccatccagaacaaggtgtcccccgaggaggcgcagggcctgttcgacgagctgcggggcacctggcagccccacaccctgaccgtccaggggttggagctgcacatttacaagggcgggccttgggagctcctggaggcctacgactttggggcatga

SEQ ID NO: 6168 - DNA, 789 bp, Chlorella protothecoides
atgacggatgcggtagatgctgcggcccccgcgcgggccaataagtcgagaaagaggagtgacggccctaagaccggggtggccaagtaccggcgaggggaggaggtctccaccaagacggtcaaggataagaagctgaagggccagctcttgtacacagagcggtgtgtgccacgggctctgggatgtgttgccagctgtggagcggttgtgaatgcgcagcagactgtgcttgcggacacccggcagcatgcactgaatctcttacctccgtgttcctctcacccttcccccttcactttcagggtgttcaaggatgcccagaaggcagctgcgcgcgtggatgactggctgctgccggctgcggctggcggcttggaggcggagggcatggagcagacgtggcgcttccaccaggaagacatcgtccaggcaaggctttgtgattttggagggtggaggcagggaacgatgcccctcacatggccagcggtagaagtaggtgccgggcccaaggcctttgacctctccctcccttccctaggcccctatgcgctggccaccacccgcgcagggcggtaccttgcgctgggcgggcaccgcgggcacctagcgctcatggaccgcttgcagtcgcgcgtgttgtgcgaggtgcaggtcaaggaaagcgtgcacgacgtgtcggtactgcacagcgaggcgttcttcgccgccgcgcagcgcaagtacgtctacatctacgacaagcggggcatcgaggtccactgcctcaaggtgagcgcggggtga

SEQ ID NO: 6169 - DNA, 849 bp, Chlorella protothecoides
atgtccaaaaacggggcccgaggagttgcaaccacagtcgcaccagcacctcatgaccgggtgcctaaagatgattttgaagagtgcttagcgagtactgctagccaaggggcatgtctgcattgcaagcatggttgctataggcgagctgttgttcacccgccctgctttcttaagacaccaatatggcctcgaacggcaactggggaccaagcgcggttgtcagcggtgatactaaggaaagactctgccgcgatggatcgttcagtggccatggcactcctgtgcttgtcccttgtcggctcagccctggctgcacagagtatcgaggtgaagtcctggttcccggagaatcccaccaacgagtttctgcccggcaaggaggtcaaggctgtcctgggccttcacaacgccggttccagtgccctgaatgtgagctacggcgctggcctcctggcctcgccgtacgatgccaaccaggtcctcttgaacttcaccacccaggcgaggagggcgggtaggggtgggagagttggcctcggccttccctgtggcagactgcctccaacccacctagctctgcaggctcgcccctcacctctccaggcctatccccctactgtgcagtacctgaacaatatcccgctggcgccccagcaagaagccagcgtagactacacgttgcacttcccagcccagatccccccccacgagttcctgctgaagctcgtcctctacaccactgtggatgagcaactggaggggcacctggtgtacaaccaggtgggtcctgtgctgttgaacccggggcagcacgctgcatcgactctggggcaccgtggattctga

SEQ ID NO: 6170 - DNA, 438 bp, Chlorella protothecoides
atgcagcagggcgctacgcttggctctgcgtcgggtctcctcaccacaccattaggctctaccaccacccaacaaccttgtgcaggctccgccatcctgaacgcctacatccgcgaaacggcctatcaggcacacaagttcgtgggcggcacccgccccatccgcccgcttgtgcgtgtggccggcgcggctggcgccgcggtgaccgggcctttctgcggcctctccaggcccaagcgccgggggtttgcacgggacctctcccgcgggatcaggggcctagccaccgcgatcctggacgaggcgctgggggcagcaggggctgcggccggcaccgctgccggccgcctggacggccaggccggggtggcagcgggggcgctgcagcgcacgctcaaaggagccaggaggaagctggatgcacagccccggaactga

SEQ ID NO: 6171 - DNA, 786 bp, Chlorella protothecoides
  modified_base (617)..(626): a, c, t, g, unknown or other
atgagcctgctccgtgaatgctgctcaacctgttgcacggcacttgcccaggagcggcgggagcatcgccgtgaggaccgagacgatcgacgagaccacaggagatccagggattcggagagtcgtagatcaaggttcgaggatctcaagccgcatggccgcctcgcaggtcccgagacaggggcaaggatgataggcgtgacgatgacagagacaggtcccgggagaggaggagcagtcggcgatccaggtgtgtactgcaactcctggaagattgttatttgccccctttcaatggggcgacctgcggtgccctgctctccccctgcagttccaaacccagtcgccccttcttccaccatgactctctcccctgcaatgcagatcaccccggcgccgtcgcagcaggtcgcggtgatcagcgacaccagcatccccatcatgccggcgggcagcgtgtttggaggggccgcctcgcagcaggccacgcggcacgccaggaggatctacgtgggaggcctgcccccatctgcaacggaagacggcgtggcttcctttttcagaggggttgccagtgcaagaaaatcgcttgcacaacctggctggggacgcgcccnnnnnnnnnngtggcttcctttttcaggtgagggggagcgatacgaaactggtgtgcctcagacgcaagttgatgtggcacgagttgtgtgctctttgcagaggggttgccagtgcaggagaatcgcttgcgcaacctggctggggccgcgcctgacgcctgactcttga

SEQ ID NO: 6172 - DNA, 1866 bp, Chlorella protothecoides
atgacggagccaagcctttcacagacaggccagtcctttttggttgtcagggatgcttgctgcaaggtctggggtcaacacaggtcagcgcaaggccacgcctctgtaaaaacttggctcagtatcgctgcaatgtcagcttgggtcaattgtcatccgtctgcagcatggccagtggcagtgagcggagaatggccggagccccgagttttggtactactgtttcgaagcatgagatatgcctgcaccgtgccgagtgagctgttagcagaccgcccagtctctgtgcgcgcttggccggaacgctcggacttcggccatatgcagttggcatgcatgccatctctgtcgcacataggcatggcccggtcatctctcatacttaataccacacgagcattttcttcgtgccgtccacgagcctatgccgcggctttcccccaagtcctcagggcgggggaggagtcggtggggctagaaacgagagacgtgccgattgaccagcagcgcctcctgcaagtgggcatcctgggggttcctaatgcagggaagtcgacgctgaccaatgccctggtgggctccaaggtagggaggagtggttggtgggatgtgaggtgcacgagatgctggcattgccgcccagccctgttctgctcgacggcataccagccccaattacaacacatgcaggtatcagccgtgtcccccaagaccaacaccacacatcactgccggctgggagcatatacacagggcccgagtcaggtcgtgctctatgacacccctggcattgtgggtaaagagcaaataaaaggggctgggcatgagacgagggtgatgtcagcatgggggacggcctcgagctgtgacctcgtgctcttcatcctggacgctcacagacagatccaagtacctgacccacgtgtcatccgtctgatcagcaaccttggcagcagcgctggcacgacggacctcccgcctgccatcttagttctcaacaagtgtgagatggtgccaccagagcaacggccagacctgttatcgctggcaggatctctccgagacttgcacgatttccaagacacattctgggtcagcgcgctgaaaggtggggtgaaggaaggagtgaaaggcgaaggagggtgtcttgctggcgcttgctggctggcgagaatatgtggtagctggagtggctttgcaaacatgagagtggaggacaggaggacacagcgcagacttctatcaggttccgatggggactggcaatggcaaggcgctgtgcggaacgtctcctcctccccctcccatgatacattcagggagaggcgttccaggcctgaaggagtacctcctgagtcaggctactcctggccgttggactctggaggcaggaatgtccacggatcgcagcgcagaagacctcgccctcgagatcgtgagggagaagattttccagagattttacgatgaactgccctacgagctgacagtcgttccggtgtcctgcaagtcgctacgggacggctccatgcgcgtggagcacatcattgtggtgccgcacgagggcgtcaagaagatcgtggtgggcagtcacggtgccgcactcaagcacgtgggcaccagcgcgcgcatggagctgcagcgcatgtggggccacaaggttcacctcatcctcaccgtgaaggttgccaagtgaggagggtgctggcagtgatcactcgacgtctggttgttgtacagaggccaggagaatggaggtatatcgatataaggggatacaagtcgagattgctttgccagggttatccatgctcattgtcttcgatgggaagagatgattcaattgtcggcgagtcagatcgctga

SEQ ID NO: 6173 - DNA, 1464 bp, Chlorella protothecoides
atgtcgtcggcacgcactgttgttctcctgatcctcgcggtggcgttgccggcatgccttgcgatgcctcgcttcattaaggacgatctgtccgtccaggggatccagacgcagcccgatttctgcgggtgggcgcattgcttgatgggtggagtggatcaggttgctagggaccatgcgcgtctgttgcagggtatgtggaatcttccccagcttcagattctcgcgtcgctttacacctttagttcaatcaacgagttcaaacaacgaggtgatggtcaaatacatgctggcgatacttatattacttattgcagagactccgagtgcccccccttcaagctggtgaaagagactgataactacgaagtgcgaacatacgacgaggagaagtgggtcatcaccaatgtgactgactcgttctacaccgtagcctaccccaaggccacgacggtcctcttacctcacaactcaaaccctcctccttgtccgttgcagcgcctgctcaagtacttcaagggtcagaatgacaagggcacgcacctgaacatcaccacccccaccgtgtcatacctcgagttggatgatgacagaaagggcaccaagaaggcatacacctttggatggttcatctctcgccacatcgaggagatccctaagcccactgaccctgagctcgagatcgtgacctaccccgagacgacccgctacgtcagggtcttcggtggctacgcctcagagggtgagggcatccttgccttggacagatttggggatggcacggtgactatcataccttcaaagcatggatctggctgcaactatcaaattccagccgcaaactacctcacaggaaacattgtggagcaggctgtggcgctccaggatgtgctgagcaaggaggggaagtctttcgagcccaaggcacggaatgggaagggctctttggttgcgctgttgggctcatttggttatgattgatatcgtttaatgcacaccttcaccctgcgacccatttcacctgtggcgcagggactgctggcggctgtgtatgatgcgcctcaaaagctcctgaaccgtcacaatgagatcttgctcgtcatgtctcggatttgggatcacaggtcacaaacttacgtaatgtgtaccaaaccctttcaacactctgtgtcgagggtacaaggcctgataatgcagcgcgtctcagcgcaatgcgactacacaatatgttcattaattgaagccagcgtcttccttgtcccgcagtatccacctaggcagaataggggagagtcctccgagactggacacgatggcctccgcattccagtcctgccttgcgctgctgcagttgcaggtgtacagggagacgctggaattacaaccgaatgtcgacgaaaaaggaatcgacgacgaagccgacttccagtgagcaagggatggaagacccgcacggaatcttga

SEQ ID NO: 6174 - DNA, 600 bp, Chlorella protothecoides
  modified_base (250)..(259): a, c, t, g, unknown or other
gaaggggggcgggcggcggcgcaggcttctaggagaaatgggtgggtgggcgttctcttgtctcttcatattgatacatggactcggcacgtggcattccctcatgtgctgacatatgcactccagaatcccaccgctctgtatctgtccacccctctgcagctgcgggctgttcccggggtccggatctacgggcccgggcccgaagagggcatggggcgggcagcgctggcgtccttcaacgtggagnnnnnnnnnnacatatgcactccagaatcccaccgctctgcatctgtccaccctctgcagctgcaggctgttcccggggtccggatctatgggcccgggcccgaagagggcgtggggcgggcagcgctggcttccttcaacgtggatggcatccaccccaccgacatctccaccatcctggaccagtctggtgtggcggtacgctccggccacatgtgcacccagccgctgcatcgagaactgggcatctccgcctcggtgcgggccgcgccctacctttacaacacaaagcacgaggttgatgtgtttgtggaggcgctcaaggaagccatatccttcttcacgatgtga

SEQ ID NO: 6175 - DNA, 393 bp, Chlorella protothecoides
atgcggcggggggagcgagctgtgctggacatccagccaggctatgcctatcagcacaggacctgggtgctcgatatacctcctgggcttcgtaagggggacaccatccacgcggaggtggaggtgagcatgggaggtggaggtgaaggcttggaggtggagctggtggaggtggtgccgggcaggacagtgcgagcagtgctggcagccgaggatacatttaaggtcacggagcaggcggggagggactttgagaccccccgggctccttataagggcttccactccctccagcgacgacagacctctgggtgccagtcaaacttacttcacgatgcaaagtgggacgcccctggaggctacgctcggctctgggcagcttcccccaggtga

SEQ ID NO: 6176 - DNA, 486 bp, Chlorella protothecoides
atggccctggacggcatcatgtacgagggcgtcacggtgcgcatccgccgccccgccgactaccaggcagctgccgcgctgtccctggggccctcccagcccaatcccaacctcaacctgatggccattggtctggacaagaaagcgcaggaggcagcggccgcggccgtcgcggcggccgccgccccgccctccgcactcccggcccagcccctgcctccggtgagttggggctgcggttgtcaacagacactagaatgggaggggcaatgggtcgcggctgaggagcatgcacatgagggtccccctagctggcgcatgactgtcccccaccccttcctcccgcccgccacccaccctacctcaggagaaccggggatcggacaggatctttgtcggcgggctgccctactacctcaccgaggagcacatccgggagctgctctcctcctttggcgttatccggcagctggacatcgtccgtga

SEQ ID NO: 6177 - DNA, 522 bp, Chlorella protothecoides
atggcagagatggccatggctggcttgcacgggatgaagatgggcgaccgcgccctgacggtgaagcccgccaacgacaactcgcgcaacaacgacggcgggggcggttctgtgaccatggtggccccgccccgcgtcgtccgcctgctggaggctgggtttgctggctcattggtcaccctccttgaacaccaaatcgcagtcactccggacgagctggccaacgacgaggagtacgccgacatcatggaggacatgcgggaggagtgtggaaagtacggcacggtgctccaggtgcggaataggggagaaggctatggtgcaggaacggtccacatcccgaggcctggcccccctgacgcgcccgcggtccccggcctgggcaaggtgctcatcgagttcgcggagccctccgccgccatcgccgcacggaatgccatgcacgggcgccgcttcagcggccgcaccgtggtggccacgctgctcaccgacgacgactacaagctgatgaagtgggactga

SEQ ID NO: 6178 - DNA, 1077 bp, Chlorella protothecoides
atgttcgcagcgaccacatgggccttgaagaggctcctcaagtttgtgctgaagcgcaacctgaagcagtggatcgccaccgagatagacctggaccaggtcgaggtccagctcggccaaggcagcctggagctgcgtgaggttcttttgaatgtcgactacataaaccagcagctggaccacacgcactgggaggtggtgaccgccttcgtgggctgcatcagggcctacattcctctggcctccctgtaccaggactcctgcagcatccagctcgtggatgtgttcctcaccgtccagccccgggcgcagccgggccctgcgtcgcatgcgcccggcgcagcccccggcacaccgagacccccgccccccgcccccacggacggcgtgtccgacggcatccgcatcatcgccgggggtctggaatccctggtccagcgtctgcaagtccaggcctcgaacatcgtggggcgggtactgctgccctcgcagcacagcagtacccccccagccctcctggtcctcaccctggagcagctgagctacaccggggccgagccggaggcctccagcctgacctcggcgccgcggagcacgcgcagcgtggacttccggggcctggccctcggcgctaaggtcgacgccggggcggggggcgctgcggagcccctgctggcgggcgcggatggcgaggggtgcgggggcacgatgtccgggtgcggcacgccctaccccaccgcctcgctgggcctgaccctgggtggcctggccgccgacctgaaccctggcggcctggccaccctggaccgcctggcaaccgtgctgcgaggcatgctgggggcggggggccaggccccagggacgaagggggcgggccctgagccctgtcgcgagcagcatgacccccctggggcctgggcgtcgcgctccctgctggagagcctcatgctccccgactgcgaggacctggtgctggaggcctttgctggcgctgagtctgagctggaggtcccggtcagttgcctggggggtggggaggctgattgccagagactgggtggcctgctcgggggatga

SEQ ID NO: 6179 - DNA, 264 bp, Chlorella protothecoides
atggcggtgcgattgatgttggagggtgaggtcgcgctcgtgacgtccagctggcgatatgcataccagggtcgtgccgatgcgcctcagggagtcaccgagggggacaccctggagttcgaggtggagctggtgcactttgagcgggaccagatccgggaggacaccacgactgccggccggctgacggtggcctccaagtggaaggaccagggcaatatgctcttcaggagggtgggtaggatgctcactgctgggggatga

SEQ ID NO: 6180 - DNA, 3531 bp, Chlorella protothecoides
  modified_base (1629)..(1638): a, c, t, g, unknown or other
  modified_base (2561)..(2570): a, c, t, g, unknown or other
ctcttgatcaagaccaggccatctaatccggggagccgcgctctcagccaacggcttgacttggctcaagccggaaattgcccattgcgggggggagcctgcccgacactttgtagagagtcctgttgctgtcatttgccgaaggaggtgtgtaaagagctgggaagccttgcatttcctctgtttgtgacccgtagatgtgggtacaaaataatcatacaatggtgtatcttgagcgcctgcctgagtatgtccacggctgtgcgcggattacttggttccgaatccttggtacatggcactatccgaagctataacagtgcaaggtttgtgtcccactggcacaggtcagactttgagattcactttactagcaaatatgggttaatcgtaaggcttgaggtgttctgggttctcattggccatacatcccagttccattctacttttgattacttactgtggagtccagtgcatgtagagggcgatgaagacctcggactgtacccggtctacatctttctctcaaaacaccggccccagttcaaggcacgaccttgtgtttatcctccaggttactcatgccccagattatcgctcttaggcagagaagaagaggccgggcgcatggtgaccgccgctgcgtctgccactaaatcacgctgtctccgggcagcatgctttagcttttctggagcattcctctcagtgaatgccacccttcaagctgacaagtgggtctcctgggaatgtacacatgacaatggcgctgtgctcttcgttccgacggcgccttcatatctgaatctcggacaagaaggctcccgacttgatgtgaccatcacaaatcattatgattgccgatctcccttcaacccaggcacagatgatccagaaaaggaaccagtgtcaccgacgaacgtcactctctgtttgtatacggatgctcagtgtgacaatcattctacgccaatgatgagcattgtcaaattcaagtattcctcatttataaaatgtacagaaagtctttgtcgctcgcaggcgcgattccagtataggctctctccatatcctgccgaaggtgtgtcattcctcgtatctattttcgtatttgagcgcttggaggttgtggttctatccgagcatctcccttgtgtatttacttcgtcttccaagaaagcttctcacgcaataaaggagctgggaaaaaacgatgagaccattttgctgctcggagacagattctttagccgaaagaaaagagtggttgcgatggacaccgtccttctgtactgtcttatggggcaacctcagcatcgagaccttgtacatatgtggaggctcatggcattccttctaagcattccttcgagctctcgttcgcactcccaaccaccaagctgcactcatttcgaagctcgtgcagataggtgcgccccagggttcaaaggaaagctgtggagtggctctcttgacaatctcctgacaggccccttgttgagatgttgtggtcatcactacaggcaggatcctgatgaagaaagtctgctctgcaattacttgctatgcaccttgggaatagcatgcaagcatgctttccgctgtttcagtaatgttatcaacaaagtnnnnnnnnnngctcccaatcaccaagttgcactcatgtcgaagctcgtgcagctaggccccttgttgagatgttgtggtcatcactacaggcaggatcctgatgaagaaaatctgctctgcagttacttgctatgcaccttgaccgcattccgggtggtcctacgattagatttattgctggattgtaccacctggttgcgagctggacctccgtttgactccacgctatccagcgtcgtatctgaacgattagactcgcaacacggacagcgcgatgctgctcccggggtagagccttgttttcagtgtaatgtgataacaagaatcttcgatgaggacggggcagcatatcgcttgcctgtggttgctgttgctcgtgagcaattgcggatgcgcgctggtcaagtatccgcagggttccgaggtcagacagcgatacgggaaggcgccgatgttccgcacatcagcaggaaatcgctcaatatcaactctttcttctgcaatctttgccagggccttcacaatcagaacctggtcgaggtgtcgtacagtccagccggcagtggagtctacctcggctcaccctctctgctcgtgctccacgaaagtggccgcatactgtgcagccatgataccttcccggacggcgagactacgtatgtcctcgaatccaaggatggaggggccacatggcaaaatctgagctccgtggctgcgcagtattggagcaacctcttcatggtccaaggtggttcacgcatgtctactactcctcgcgcagataccatctacttgatgggcaccactcacagcacgtttggagcaggcatagccctctctgagtcgagcgatggtggctcctcctggcggcacgctgtcctctttgagcctcccagtggttgctcatactccacaggagctgtgcctgtccnnnnnnnnnnaactcatctcaatgttgtgcctgtcaaaatgtttacctccgtgtatttgaaaatcactcctgacattgtctcctcgcaggagctgtgcctgtcctggaccatggtgggctcctgtatcgaggctttgagatgtggtgtgggagctggctggtgtggccccaggcctatcaggcctttgtggtgtatgccaacaggtcgtccaccctcttggatcctgcgtcgtggacacggactgaggctgtcgctttcacaaggtgactcggatatgattccggcatggatgccctcccctgtcgtcagtggaggattcctggaggggaatacggttcttcgacccgatggacgtgtcagcctcctgatgcgctgccgtgtgtacaacgggcagagcgagatgtattctgtccaggaggcttgcctctttgacctgacggcatctacgagcgacatggacattcgtgaggctcggttgtccctcagatggcagggacacgtgttcatgccaggtggtgggaacaagttcacagtcaggtatgatgtgcattcacgaatgtacttgagtctcaccaaccccagcatcgataggtatggcgtcaacccagacgcaaggaacgtccttgtgctggtcttctcccaaaatttagtggattggaggattgccaccacggtgctcgtgcccaatgatggcctggactgggaggccagcctctggttcactgggtaccaatatgtcgattggcaaacagacggtccagacatcgtgatggcagtccgcactgcctaccagggtgcgcacaatttccacgactccaacaggcgcgtggcatggggtcggagaacaatgggttcctgtgccgcacacttggggacaggagaccccccaccactaaatcccctgcccacctccatcgcgacagaatcgcattcaagcgcctccagaactacatgcgctacctccctgtag

SEQ ID NO: 6181 - DNA, 846 bp, Chlorella protothecoides
atgatgtgtgagagcaccacactccatactccgtctcttgaaccacacctagcacccccttacaccttgcagcccaaaatgataagccaggcagatggcaagggtggcaaggagattcccattcccggtgtgaagaccatcccttcctacgagagggattacctgcccacatggaaggaccagaacacttacatccgagaccgagggacggcggaacaagagtttgagctcgtggagtatgacctggactcggaagacgagcgctggctgcaggacctgaacaacggtcagcttcatgctcgtcatctccaggaacgattgcccaaggcgagactcgagatgatgctttggaagctagagatacacaatgcagctgctacagatagggccctggcctttgcgggtgccactgcggctgagagaatgagcgtggcggcttgctccaccaccgaccacatgccacgcgaggaggcgctgcagatgctggaggaatcctgcacggggcgcgatgtgcttcgggccacggtgtacgactactggctggagaagcgacgaaggctgggcaggcccatgctccgccgcctgcaggcactgacacctcccaatgacaacaacccctacaatgtgttcaggtgtgaggcctgctctggccttgcctgtgaacccgagtggtgtagagggttgctctggatcactggcgactcgcctagcctgcatggtctcctgctcctacgcacccctccccaccctcacttgcagaccgagggaaagggtgcaccgtccccagacgcggcgcagaagggagaacaacgaggactccctggacaagttgcggatggtccgtga

SEQ ID NO: 6182 - DNA, 930 bp, Chlorella protothecoides
  modified_base (449)..(458): a, c, t, g, unknown or other
atggcgaacttcgacctgaaggtggtgctgctgggagcacagtcctcgggtgagtgtggcattcggtactccgttccggtcggtagagctggtaagcgagcatcatatgatgcaaatatctgctctgctcacaatgtgcgtccagggaagagctgtctgctgcagacatacgtggccaaggagtggaggtctaccctgcgaccgacttatggtgctgccttcgccgcacggcgataccagctgcctaacggccattcagtgtcgattggggcctgggacacatccggatcgcctgcatttcagaatgtcagcaagcgattcatccagggtgcggacgttgcagtcgcagtgtgcgacttgaccagcaggcccagctgggagaagctcaaactctggtggactctgcacacttgcagaacaaagaactggcctgttgcatggcactccannnnnnnnnnatgcatcagtatgcccgactgtacacctgtgcacgccgcgaaacaggagcagccaggcatcctgatctttgtggcttgcagtaaggcagatctagtcacagatttcgcgccgccccgcccttctcccgaggctgcaaagcccagcgagggaaagggtgcggacgctcaaggcaatgtgcctcgagtctccacccacgcggggggggacagcgagcgcatgcgcagtggcttccaggaagctacctcacaggcccctacggtgcgctttgaagatgaggtggacggcgtggtgcccgagacgcgcggcgaccctcactccgacggacagacacccgaccccagggtggtggccggggtgtctccagctgccctcgactttgtggaggtggatgcctactgcaagatgacgggggcatccctctatgttgtgtctgcgaaaacaggtgtggtgggcggtgtctctggtctttga

SEQ ID NO: 6183 - DNA, 342 bp, Chlorella protothecoides
atgtcccttccagaagatcatcgatacaattatgtggtcacagcacagaaaccaagcagcgttcgtcactccgtggttgggtgttttactgcaccgggggctgtgaacctgatcgtctcgaagtgcacgagactggagatcagtgtgatcacagcagatggactgcagggcgtcatggatgtccccatctacgggcgcatctcagcgctgcgcctctttgctgtggcgggtgaggagactgagcgcctcttcctcctcacagagaagaatcgctttgccgtcctgaagtgcgaccccgccacaggtgcgctgattgccgcagcgactcacgatcctccgtga

SEQ ID NO: 6184 - DNA, 1248 bp, Chlorella protothecoides
  modified_base (635)..(644): a, c, t, g, unknown or other
atgacggctgcatggaggaccgggggcgctggccaggtcggcctgctggctgctgctcgattccatggcactctcaatcctgcctccaaacccgcgtgtgccttcctgcaggcgagctgcagacctgcgccaatggcgacgcctcggaccgcatcggtcgcccggtccagtcgggacagatgtgcatcgtcagccccaagcgggacgccattgtcctgcacctgggccctccgggtggcaccagactgtgttgtgctggtccctcccacagcttccactttacccaatgccacccacccccttcccaacttccttctgcctttgcagatcatcccggtgagccccagcggggtcctttccgaggcttacaatgtcaggatcgacgagctgaacctggtcgaccttgtgttcctggacgcagaggactttgagggtctgcccaccatcgcggtgttgtatgacgatggaggaggccaccgccatgccaagacgtactccctctccctccccagcaggctttgcaccaaacgaggttgttatggccttgtcagtcaaggtcctgtggccctcgtcagacttttgctccctgtgctggggccagggtccacctttcgtcacgatcgtagatctgccannnnnnnnnngttggtccctgtgctgggcccaggggccacctttcgtcacgatcgtagatctgccacccctcgctgtgcaggcctgacgctcacagggcacatgccgagcgctcttaccctgtccccttccgttcgaacatcttgcaggaactgctgcagttccgctgggcgcaggagaacctggatgccgtggcgaacctgctcatccccatccccggcaccgacggcgtcgtggtggtcggccagagcaccgtctgcttcctggcgcacaacgcggtggtgtcagcctccatttcctccaccatcgtcaaggcgaggctcgcttggggatgatgttttggctgccacttgccgtgcccctcacccacgcacagatggcatgtatgagaatgtcacctcctttccccctccccttgacgtgtcccaggcttatggtgccgtcgaccgagaagggaccaggttcctgctgggcgacttcaggggcgagctgctgctcctggtcctggagcaaaatgggccgtccaagaggtgcgtgctgtcgtggctagggcccttgctgtgccgcgccggtgacgtgttcagccagcatgtggcactcgctggatcgttctga

SEQ ID NO: 6185 - DNA, 1449 bp, Chlorella protothecoides
  modified_base (461)..(470): a, c, t, g, unknown or other
  modified_base (1182)..(1191): a, c, t, g, unknown or other
atgggccgtccaagagggctaccctgctgctgtccactgagcttgttagactgttggtggaagctcccggcccagggtcatggctggggcagcactgcgcctgcacagtgccccctacagccacttcctttcaccgtcgagcatgcgttgaccgtggccctgcccccgctcgcaccggcagcgtcactggactccacattgagcggctcggccgcacctcccagcccagcaccatctcctacctggatgccggcgtcgtgtacatcggcagcgcatgcggcgactcccagctcatccggtgggtggcgacgtgtgtgtggcatgatggactgcacactttgtggtgtggaggggagcgaggccttgcgtgaagcgcggccgtcgagacggtgggcccaggggcgggcggaggtctgtccgtcttcccctctcacctatttcccctgcagctgcctgaagcnnnnnnnnnntggccgtcgagacgggggccccaggggcgggcggaggttgcatgcccacccgccagaccccagccagccggacagcttcctggaggttctggacaccaccaccaacctgggtcccatcgttgacttctgcgtggtggaccttgaccgccagggccaggggcaggtggtcacctgttccggcggcgcgggggatgggtcgctgcgcattgtgcgcagtggcatcggggtgctgccccaggccaccgtggagctgccgtccctcaagggcgtctggaacctgcgcagggtcgggcatgtgggttgggcctgtgagacgctcctaggaaggatacgattacaagcagcagggtccacaaagggccactgggtggtccagggcaacggctttcccactgcccacctgtcatttcactgctggtggcactccacatggggacttgcagcgacccacacgatgatcatcatgaccctttcccatccccccaggagctttgaggatgagcacgatgcgttcctggtgctgggatttgtggaaagcacgagcgtgctgggaatgaatgcggctgaggagattgaggaggttggggtgccgggctttgacgaccgggcacaggcgaggcaggagagaaacgggcttctttgatgtgccggtgacgggaaagaggagggaggacaatgcagcctttcaccaggcaccgcgggggtgcagcannnnnnnnnnagcggtcaaacgcttgttgcaagctcagatgtgccggtgacaggaatgaggagggaggacaatgcaacctttcaccaggcaccgcgggggtgcagcatgctgtatgctccaaagcaagctggtcccccttcttcacatgccgtagacgctgtggtccagcaacctgctcggcagcctggtggtccaggtgacgcccgctgctgtgaacgtggcagacacccagacgctgcagcgtgtcagtcagtggtccccgcctga

SEQ ID NO: 6186 - DNA, 402 bp, Chlorella protothecoides
atgatcgagcaagtgctgctgcccttctaccctgggcttcacatgggcgtaggcacagcttgccacaattgcatcgcgatcacacgcctcctcgcgctcctctccccctcagacgctgcgaggaaactggtgaacggggacgccgacattgccatcaactgggcgggcggcctgcaccacgccaagaagggcgaggcgtcaggcttctgctacgtgaacgactgcgtgctgggcatcctggagctgctgaaggcccacgcccgcgtgctgtatgtggacatcgatatccaccacggcgacggcgtggaggaggccttttacaccaccgacaggcagggcaagggggccagtgggtgtgcgaagggggctccttgtgggagggaggggctggcggggtcgtag

SEQ ID NO: 6187 - DNA, 477 bp, Chlorella protothecoides
atgccctcctctcatgagtcgattcccgcccttgcagtcgacgccaagagcgattcgctgcgcctgattgatgaccagacatttgagaccctggaccggtaccagatgcctgagtccgacatggcatgcagcctgctctccacaaccctgggcgagacaggtgcaggcccctactacattgtgggcaccgccacgaccaaccttgcagagcgggaaccgaccgagggacggatcatggtctttgaagcagtcgaagggaagctgcacctggtgtacacccatgaaacgagaggtgctgtgtacgtcctccaccccttcctccacaacgacgagacgatgctcgtcgcaggaattaacagcagggtgcagatgtacaggtgggtcggtgctgtggctgtgaactgtttctggttatgggtgcgtgctggggttcacgaggccctatttctgtgttgcatatggcaagtcggaatctaa

SEQ ID NO: 6188 - DNA, 276 bp, Chlorella protothecoides
atgaagcctcagcgcattgccatgacgcatcatctcatccttggatacggtcttcacgagcatatggatgtctaccgcccacgtcgagcccagcacgacgagctgactgcctttcacaacaacgactatgtcggaatgctgcagaccacgacccccgaggaggcgcgctccgaccctcgtgcgttcctcaagtatgggatcgagctggattgccccatcttccatggcctctttgacttctgcaggctctatgctggggcctccataggtgaatga

SEQ ID NO: 6189 - DNA, 243 bp, Chlorella protothecoides
atgaccgtgagcttccacctgaagcgggagggcttcttccccggcacgggcgcgctggaggacaagggggagctgctgggccggggctactcgctgaacgtgccgctggacgagggcatcgacgatgagcagtacttgggactcttcaggcccaccctggacgccgtcatgcgcagcttccagccgggtgccatcgtgctgcagtgcggtgcgtccctggggtcggtggctgtggccggatga

SEQ ID NO: 6190 - DNA, 345 bp, Chlorella protothecoides
atgaccatacggacccgggccgccaccctcgcagcagctcagggagtggtcttgcaccgggactatggcaacgggactgagacccgtgccgacaaactggctcggtaccgcgcaaagcgggctaggcgcagctttgccaagaccatcaggtacgaaacgcgacgcgtgtacgccgaggtcagacccaggattaaggggcgatttgtgacccccgaggagctggcctgccatgaggccgggggggcgcctatgcaggaccctcccgctgagggtctggaggtggcggagcctgaggagctgctgcacatggtacctacatgcttccatgggctggagtatgcctag

SEQ ID NO: 6191 - DNA, 681 bp, Chlorella protothecoides
  modified_base (248)..(257): a, c, t, g, unknown or other
  modified_base (404)..(413): a, c, t, g, unknown or other
  modified_base (498)..(507): a, c, t, g, unknown or other
atgggggtgcaccaggcgcgggcccacttcctgaagaccctggggcgcatcgtggatgagccggaggtcggcgccgccctcaccagggtgtactggcaggtgacagccagtgcgcaggggtgtgtgtgttggggactggagtgctttgctctgtcagaagcggaatgtggtccatttcccggaagcattttccagaacagagtagacccaggaccgggtgtcaaggcatcagttcatgactcctgctnnnnnnnnnngacagccagtgcgcagaggggtgtgtgttggggactgaagtgctttgctctgtcacaagcggaatgtggtccatcttcaggaagcattttgcagaacagagtagacccaggatcgggtgtcaaggcatcagttcatgactcctccannnnnnnnnnaggttggatgtacagggggctgggagctgcattgttacttccaggctgccctcatggaacctctgcaagggcgaccgcccctggnnnnnnnnnntgtgcctctccattcctgcagcctgggaacagcgtccccttcctggatctggtggagcgcttgacggaggcgcccctcaccgccgatgcctgggtgaaggagctgcaggtccccgtggaggtcaaggtgggaggttggatgtacagggggctgggagctgctttgacactttga

SEQ ID NO: 6192 - DNA, 897 bp, Chlorella protothecoides
  modified_base (189)..(198): a, c, t, g, unknown or other
  modified_base (679)..(688): a, c, t, g, unknown or other
atgctgtgttggcttttccccccgaaccatgcatgcatatcaccttgcaccctccactggctcattccttgcgctcagtcagcgcctgcttccctctcctcagcggcgagctcacccctgcgcaagcatccgatgcacatccatcccttgccccccactccctcgacctccacaaaccccaggtggatnnnnnnnnnngcctgcttccctctcctcagcggcgagctctcccctgcgcacgctcccgatgcacatccatcccttgcaccccactccctcgacctccacaacccccaggtggatggggcctgggtccccgcacagaccaacttcaccagcctggccactcccggcagcgtgggctcgggcaagaccgcgctggtcacgctgctgcacgagggcgggcatgccgcgcatttcgccaatgtggaccaggccagccccctgtgctcgcaggagcgggcgcccaccagtgtggcctacgcggagaaccagtccatgctgctggacagcctggcgggggacgccgcctggctggcgcggtacgccagagatgctgcggggcagcccgtgccctggagcctggtgcgcgaggcaatcgaggccgggcacccctacgccgcattcaccgtgcggtcaatgcttgccgtgccctattttgaaaaggcgttgtacgacnnnnnnnnnnggcaatcgaggccgggcacccctacgccgccttctccgtgcggtcaatgctcgccgtcccctactttgaaaaggcgttgtacgatctgcccgacgaccaggtgggtgggtggagagtggggtgggagggattgtgatggggggggagggtggagcagcaactggagaggctctcgggatgggccgtggttgctggcagactacgaatga

SEQ ID NO: 6193 - DNA, 1167 bp, Chlorella protothecoides
  modified_base (40)..(49): a, c, t, g, unknown or other
atgtcggggtgcggcgtgatctcgtacgccccgtacgcannnnnnnnnnccagtgtgtgtggtgacgtggcatgtcgggtgatctcgtatgccccgtgcgcgcgaagcaatccatctatgaccagcggaacacttactgcatacagcaaagggaagcatatttctatcttagatccttgccttccggcgagacgcaggcgcatgctgagatccagagctcattcggttggcttccccggtctccgccttcacatcagtgctctccgggcccggccacccacgcctcgaccttccatcgtcatggcagctacagccctgcccggcaatcccgacgtcagcaccttcatccaaggcatcaatgacaagtacctggaggtgcaccgggcgtacgaggacaacttctgggccaccaagatggctttgtctggggccagcacctccgctctcagcagcaccaagaacgccctggatgagttcctgtcctcacaggaccgcctgcgggcggtgtgcgatgcggaggcccgccccgacctctcccccgagcagcgcagggtcctggcggtgctgcgccgcacctttgccacctacgtctccgaggaggagagcgtggcgaccctccgcgcccgcctgaacgacctggaggcggagctggcgggggtgcgcaatcgcatgcgcctgggcaccaccgaccccgccaccggcgagttcaggcccgccagctccgtccagctgcgcaacgccatgaagatgagcggggaggaaagcgcgcggcgggccgcctacgacgccctgcgctccatcggccccgccatcgccgggccctttgcggcaatcgtgaggctgcgcaacgagctggctcggcgggcgggcttcccgaactactacgacatgaaggtgcaggcggcggagggattcacccaggcccgcctgttccagatgctggacgggctggaaagcgcgacgcgccagctcgccaccgacgcccgcgccaggctggctgcggccaagggcaaagacagcctcaaggccatgggtttgtgccactcatcagaagatgttggtgctgtggctcggtgcagagaggcgaaaccctggcacggtgatgctgcgccagagtggggaagggcccatgccctcgagagcctgacgtcacagccgtgcacctga

SEQ ID NO: 6194 - DNA, 783 bp, Chlorella protothecoides
  modified_base (267)..(276): a, c, t, g, unknown or other
  modified_base (503)..(512): a, c, t, g, unknown or other
atgcatcgcatgagggagatggtgttgatgcccgttcaagcctgtcatcgcctcagggaggtgagttcctgccgctgctgcagcctgagtggcggcacattgcaacgcagagtggtcctcccccttccccagtggtcgccaacttgcgcggcggtggcgagtgagtgggtttggctggcttttgtgaaggggcgtgtggggcttcagagccctaagtgcgagcttggcctttgtcacatcacattctcctgaccttccttctgtcannnnnnnnnnggcttggcctttgtcacatcacattctcctgttaaagtgaagagggctctgtgcgcactcttcttgacgccctgtttggcaccggctggcgtgacgcggggtccctgtcgcacaagcagaacgtgtttgacgatttcgtggcctgcgcggaggaactcgttgcccagcgctactgctcgccggccagcctcgtcatccagcgctggccgtcgccgtcctcccgtctnnnnnnnnnntgaggggggcgcttgcatgggctgcacgggcccgcgcagcaccgcgcagcgctggccgtcgccgtcctcccgtctaccttcccgccgacacgccacccaccaaaggcccccctctaccaccccccttcctgcgcagggtggcagcaacggcggcctcctggtggctgcctgcgccgagcagcggccagacctgtttgccgcagtcctgggtcaagtgggggtcatggaccttcttcgcttccacaagttcaccattggtgcggtgctgtga

SEQ ID NO: 6195 - DNA, 1902 bp, Chlorella protothecoides
  modified_base (153)..(162): a, c, t, g, unknown or other
  modified_base (319)..(328): a, c, t, g, unknown or other
  modified_base (772)..(781): a, c, t, g, unknown or other
  modified_base (1533)..(1542): a, c, t, g, unknown or other
  modified_base (1663)..(1672): a, c, t, g, unknown or other
atgtctacgattaagcctgcggtcctgcaatggggcccatgcaagcccttgtaccttggctatcctgcgagtggccccagtcgcccctgccaacccaaccccacaatgcactccacccaacacacttcagggccagccgccctggccccttcnnnnnnnnnncctgccaacccaaccccacaatgcactccatccaacgcatttcagggccagccgccctggccccttgcagcctgcatgagcgcagggccagcccaacctggtgtccatcctccaggtgggggatgggagggcgctgacgcggttccttcatgtgacnnnnnnnnnncccaacctggtgtccatcctccaggtggggaacgggagggcgctgacgcagttcttccacacgctgcaagaaatcgcggcggcactggcgtacctgcacgccaacgacatccttcatggcgacctgaccggcggcaatgtgctcctggctgccaacagcaaggacggccgcggcttcaccgccaagtcggcgtggtggccttttcctccctcctggcaacccctcctgccacctcatccaactccgcaggtcgtggattttgggctgagccgcctgattggcagcgagtcgtacctgcggacgcggaccctgggctgcgcagagtacatgtgaggagcttgccagggttgtattttgtgtgggccatccaaggaaccaaggtctcagccctatggcaggatgccccagctcgtctcatcaacagtctacctcgttgccctctcnnnnnnnnnngacggccgcggcttcaccgccaagtctgcgtggtggccttttcctcccttctggtaacccctcctgccacctcatctaactccgcaggtcgtggatttcgggctgagccgcctgattggcagcgagtcgtacctgcggacgcggaccctgggctgcgcagagtacatgtgaggggcttgccagggttgagttttgtgtgggccacccaaggaagcaagggctcagccctatggcaggatataattcttgcaagtgtgcatggcttggccagcccgacccttgctggcgtcagcaggatcacgatgaaacttcaacgacacccaggtcccagctcgtctcatcaacagtctacctcattgccctcttataacctccctgccctccactccaggcctccagagctcatcatcgatgggctgttgaccaaggccggggacgtgtatgcctttggcgtggtgctgtgggagctgtacatggggacgcgtgcctgggaagggctgaagacctccgaggtgctcaaccacgtggcctccaagcgcagcctggtctttcctcccagcaccccgcacagactcaaggtggtttggtgcactgggaggagaaaagggggttgggtccctgtgcagagtgtgctgggcacgaggtgcctggccttcaaccccgacgaccgtccgacattcagtgacatcctcgtggaggtggactcggtgctcaaggatacgcagtacatcctcaggaagttcctggcacgnnnnnnnnnnggtgctgtgggagctgtacatggggacgcgcgcctgggacgggctgaagacctccgaggtgctcaaccatgtggcctccaagcgcagcctgcatgggcatccccaatgccggggtctgctnnnnnnnnnntctgcagatatcagctggcgaccccgaccatgcacatcagtataccccctctccctcctttccaaacaaactcaggtgctgggcacaagttttccgaccctaggtatcccttgtattccataagactctctgccccccaagggagcatgggcatccccagtgccggggtctgcggcggtggttgccccgcgccccgtgacaggcgccacgccagcccgccatgtggctga

SEQ ID NO: 6196 - DNA, 2847 bp, Chlorella protothecoides
  modified_base (72)..(81): a, c, t, g, unknown or other
  modified_base (1005)..(1151): a, c, t, g, unknown or other
  modified_base (2387)..(2396): a, c, t, g, unknown or other
atgccagtccccgcctgctgtaatcacgcgggtctgcatgccgactttacactcagaatcttcaaccctccnnnnnnnnnncctcgccagcatgccagtccccgcctgctgcaatcacgctggtctgcatgccgactttacactcagaaccctcaacccctcccccctgctgctgcaggagtgtgtgccgggatggtctcggcacacgatgattacataacctcgctggcctgctccgtcagcgccggcgtcctcgtcagcgccggactgcgcgggggcctggtgcgctgggacctggagcgcctgacggcctcctccctcagccaggtcagggaaagggtgggggccgtgtacctcacacctgcaagaatgtgtggattgtctagcatggagatcagcattgctcgcgcgttctccccgccctctgcgcctgcccgtcctcacagtcctccctcgtgttcccccctttcctcaccaccctgcagcctgcgccctacgacgccctgccatgccccggcgtgcccccgcccagcttctacgctctggccttggacgccggcgccggcctggcggcggccggccaggccgacggcggcattcgcctgctggacccccgcgccggcccggccacgctgcgcgcgctgcgcgggcacaccgacgtcgtgcgcggcctgctgctctcacgcgacggccggcgactggtcagcgcctcctcggacggcacgctgcgcgtctgggacgtggccggcggcgggcggtgctgcggcacctgggcgccgcatgcggggtcggtgtggagcctggcctcccgtgacgccgacctgggcagcgtgcacagcggcgggcgggacggcagcgtgtaccgcaccgacaccgtcggcggctagacccggcgcctctgcgcgctgggcgcccccgtctcggcgctcgcggttggcgagcggggcaccttctggacggcttcctctgttctatccagagcggcgcggtgggagggaggggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgaccccgacgttcctgccacaatcctgtccgaagggcgggacgccggcggcgacggccgcggcgactgctcccacccgcccgcgctgtgcgacgcggcgctggcctggacggcaggggtggccccgctaacggcggcggccgtcaccacggaccggctgcgggtgctgacgcgggacgcggagggcgcggtcgaactgtgggacgtggggcgcgggcgcgtgacgcggcactgggaggcgtcgggcgccgagggtgccgggaacggttccgcgccccccggcgcggccgcattccaggcggcgcggcgcgagctgttcgaccccacgcacagcgtgggcgcctggttctcagccgacctgcgcctgggcagcctgggcggcgtgctggaccccggcgccgcctttggcgtggaggcctacgcgcgggagctgggcgcgcacgccgcgcccgccgacgccaaggccagctgcggcgcgctcatgctgtccgcgctgtttggcgcctgggcggctgcgggggggggtggcggggaggctggtgctgaaacgtcggtcgaggacgcgccgcaaggaggggaggcgtcgcccggatctgtgggcgagggctcagaccctgcatcggccgcggagccgggcccgtccgcctcagaaacggtcagcaccgcgcctggtccgcagtccacacccctcacgggccagggccggcaggcggtggccgcgctggggcaaggcgtcgcaccctccgcgacctcggccagcttctcgctggacgccgaggcggcggaggtcctgctgctgggcgacgcgccgtggcgcggcagcctggctgagctggcagcgcggggcggcgaggcggaggccctgagccccgtgcccgcctgggtcaggagcgtggtgctggatggccaggtccccgtcagccgcgacctgaagctggtctttactctgctgcccctggaggtgagttggggtgtggaagcggggctttggagggggggggcgtgtaaaaaggctttacttgaaacttcggtcacgaggcaggttcggatgccccagcgcacaaacagatgttgtcgcgaggcacaggctgggcggcggcacaggctgggcgtgaataagctcggatacaagtttgcacctcaagaccatccctctcccccccctccaccgcaccttcacaaagggctccgggctgccgtcgctgctgcagagccggctgcatgcacccaggnnnnnnnnnncaccttcacaaagggctccgggctgccgtcactgctgcagagccggctgcatgcgccccgagtgctcaccgtggacaaggtggtggagtacgtgggccgccggctgcgcgacgcgggcttgtccccgggggaggcccccctgttctacaacacgcgcgccgctgcggcctgggaggcgggcagggccgcgcagaccccggcgggcgccgcgccacggcccaacggccgtgcgagccccgtggagggcaggccgccgcccgctggggcccccgccggcccggacctggtgctcacctgcggcggcacggcggtgccctgggacttcagcctggccgccgtgcggcagtggatctggaagcgctccgatgacctggtcgtgcattatgccctgcagccgcggggcaccgagctcgtcctgcccagcatccccctgccccccatcgacacctga

SEQ ID NO: 6197 - DNA, 219 bp, Chlorella protothecoides
atgcctcaccaagaactccctctcgacagccctgattccacaaaatgccgcacaggtgacctcaacccctcccagcgcaaccccttgctgacgcgtgtggaggtgagggctgggcacggcgccggcaagcccaccgccaaggtcatcgccgaggtgtctgacatgctggcctttgcagccggcgtgatcggcgcgccctgggtgcacagcagcgcctga

SEQ ID NO: 6198 - DNA, 387 bp, Chlorella protothecoides
atgcatgatcgggaggctggaaacccagggaaacccagtgcagaagcagctcccgctgccggagcggggagatacggtctgtgccccaggcacgccgtgctcgccgcctcccgccgtcgaggcaccttgttcatgcaccgaccgagcgcagggcacgcctggatcaccgattacggcaaccccgacacggccgaggacttcaactggctcctgcccctgtcccccttgcacaacgtcgcccggtccaaggacaacggccagtaccccgcgttcttgctgaccaccggcgaccatgatgaccgcgtcgttcccctacacaccctcaagctggtggcgacgctgcagcacacgctggcaggtgggacgtttggtagcattagtgtatga

SEQ ID NO: 6199 - DNA, 777 bp, Chlorella protothecoides
atggactacgaaaagtttgggacgccctttaagaagggccagcgatactactacacgcataataccggcctgcaggcccagagcgtagtgtacagccagtcctcgctggatggcgagcccgtggtgctcatcgaccccaacaccctcagcgccgacggcacggtcgcgctcagctcctgggccttcagcgaggacggctcgacgctggcctacgccctctcctccggcggctccgactggcagaccgtgcacgtgctgggggttgaccccggcatgggggccacgacgcagcacccagacaccctgcgccacgtcaagttctcctgcctggcctggacgcacgacggccgcggtttcttctacaaccgcttcccgccgccgccggaggggggtggcgaggcggggaccgagaccgcgcgcgccgacaaccaggagctggcctaccacgtgctcggggatgaccaggcgcgggacgtgacgatcctggccctgccagagcaccccgactggatgattgggtgcgaggtgagcgacgatggggggcgcgccatcctctccatctcctccggctgcgagcccgtgaatcgcgtctggatcctggacctggatgcggtggggcggagggccgacggcgccctggacttttccccctttgcgcacggcgccgctggcagccgggagctgcccctgaacaagctcgtggacgacttcaaggtgagggagatttggggatgggaggagaagggcctgaagcagggctcgacgctggggcggtaa

SEQ ID NO: 6200 - DNA, 225 bp, Chlorella protothecoides
atgccccatgccctccaagtccttctcccacacccctcctcccctgcagcgagtcccgtggacagcatcctcgacaaggacaactacacgctcgaggagctgctcgatgaggacgagctcatccaggagtgcaaatcgctgaacaaccggctcatcatcttcctgaagcagcgcagctctgtggaggccttggtgggctggcttgcggggacgggggaggtctga

SEQ ID NO: 6201 - DNA, 498 bp, Chlorella protothecoides
atggacctgctcttctccctgctggcctccccccctcccctcaactgcatgctggccggctacttcagccgtgtggtgggctgcctgctggcccggcacgtggaggaggtgggcgcctacctgcaggcccaccccgcgaccctgaatgcgctgtgcgcgcactgcggcaccacctcggtggccgaggtggtggtgcgcctggtgggcgcgggggaggtgggcggcggcggcgcgccgccgccccccgcgctggactggctgggcgagagccagctgctcccgctcctgctgcgcgcgttggggcccgaggcgccgcccgacgcggcggccaacgtggccgagatcctggccgccgtggcgcagtcgcccggatcgccgctggtggcgcccctggcggaacctgaggtcctggcgcgattggtgtcgggcgcgctgagctccggcacccccggcgccgcctcgcacgccctagacgtctgcctggcactgctggagccg

SEQ ID NO: 6202 - DNA, 2421 bp, Chlorella protothecoides
  modified_base (153)..(162): a, c, t, g, unknown or other
  modified_base (686)..(695): a, c, t, g, unknown or other
  modified_base (1363)..(1372): a, c, t, g, unknown or other
atgatcggatctgagactaccataatatcgaattcggcgcacctgggcatcggtggaccaggatcctacggcgaggaggctggtgtgcgggtactgggggacgggaatcaaggcagcagacgtgcacgattctcccaggaaatgccggcgcgnnnnnnnnnnatggatctgcaacgtgagaaaaagaggggtacagacacatcgactgtggggggtgggtctgggtacaagtcagggcgcgagaactccatgcacatcattctcgcaagcgagccagacacgagacaattgaattttgacgttggctttgggatttttcgtgtatgcattggcagatcatattatcatattgtcagtccctcactgccaccattttccatgagcaacctcgagcaagtgatccgggaggccacgagcaagcgacaccctgctgttcctgcaagcgagctccgcgagatcaaacagactttcaccggagaatgtgtccttggcgttccagctcctgcttacgaggttgcgggagccaaacctccaggtgtggtgctaattgttatgcgaggctacgacacacgcctgcaagcctcatgcacagaggacaactgcctgaagccgaccattatggcagacggggttcaagaggtgagtggtgacccattctcgtgccttgtatggggagcagtgaagannnnnnnnnncatgcgcgactacgacacacgcctgcaagcgtcatgcacagaggacaactgcctaaagccgtgcaccccatgtcacacaaaggtcttggaactgtgcatcgggtattcggctggcaagcctcccagccctgcacccgccggagtggcgagcgagctcgtctccagggctctggagctcttgttccaatggaccaccaagtatgccacaaaacatgtgcaggtgaggcctcaagttgcgtgggtcctggtgatagccggagcgcccttgctgtcaagcttgcaggctggggtggtgctcctacatcctaccattgggtggcatgcctgcagatcgatcccacccgtccggccctactcacacttcgtgctgcccacacacctacacgatgcacagttgctgctcagctacatgtacctcaagaacaagctcaagcttcctctgcaagacctgccggtgcagccagcagcctctgcctccccaccctctcagctcagccctgcagccctgcgacatcagagcgagaactgggatgagatcgtgtactcggccaagtccactgtccatgagttggctgcgcccaatgcatggtccgatcctcaggcgagcattgtgtgctcaaatgcccatgcacactggtttgcccggcagacgagccatctggcggccnnnnnnnnnngtctcatattgctgcaaagctggcaggctgcgcccaaagcatggtccgatcctcaggcgaggattgtgtgctcaaatgcccatgcacactgttttgcccggcagacgagccatctggcggccctgagcgcggcgtgcgggctggacgctcctggcgaggatgatgctgggcaggattgggaggatgtggaggaggcgggcccatcctctgccgtggcaacggaggggactagtaccttcaagacggcttggcccagattcgaccccggacgggtggacctcgccattgctggccccctcctggaccaggcggcagctgcgcggcagctggtcgtacaggagctggtgcccgtgctccgcgccgagcttgcaaggggcggtgcgcatggcgccgaggccggccccctcctgtgcggtctggaggaggcctcgcgacagctggacctcccgggcatcgccgcgctggccgagcgctggcgggcgctgaagggcgctgcggccgaggcggggaccgagcgggcagagggatcgccgccgacaggatccagggctgcactgggcgccgcaccgggcgacaaggaggcggctggccgcgggcaggctcccaccacaaaagggctcggcgggcggatgccccgcgtgcctccttcccaactccctgatgcagacccctatgctgggatcgtcgatccagctgccccccggcccgggccacactcaatcgcgaaagccgtggtggagccggcggccgtcgcagccagggcacccagcgctaagcagtcgtcgctgccggaggaggtgcgccgacggttggccgagcaggcgccgaccctccccaccggcctgcacacccagttctgggacagctcgcaggcggtgtcactgacgagcggcacggctgaggtgtacaatcactggggggccgtggacgtcgccaagggtgcgggagggaaaggcagtgggagatgggatgcattgttgaggaacacccatctcttcacccaggaaagaactgcgaggcttctgaacgcctgcggcaagaggtcctga

SEQ ID NO: 6203 - DNA, 2730 bp, Chlorella protothecoides
  modified_base (1296)..(1305): a, c, t, g, unknown or other
atgtctctgtgtgctctgtgcagggtcatcttcctggagctgattcccggctttgctttgtaccgagggttctatgagatgggggcgtacgccttcagagcaaccttcagcccgggtgtaagttgcttggggcagagcgtttgctgtttgatagagatgggccgattgcttctgttatgtagaaaagaaacacaacctggcaacattgttaccagactgcagcaccaacacgcccgcttcctcactcctgcctcctttgcagagcaccaggggcctccagtggtcgaccctgagcgacccaggcaacggctctatcgctgtgctcatcatctttgcagtggagtgggtggtcttcctcctgcttgcatggtacctggaacaggtcattccctcgggcattggggtgaccaagcatccgttgtttttcttgggaggaaggttttccaagcgtgccggcccgcagccctcaaaagcagggccagatgcagtcgaggtgatgcagggattccggtggtccagctgagaagtcgccgtaccgccagcagtgtctgggctcggcccttgagtcgtccaaccttgaaaaggtcccaatcaccctccccccaggtcatcgttgagcctgaggatgtgcaggccgagcgtgcaagagtggagaatggtggagccgatgaagcctgcatccagatcaagtccctcgtcaagattttcccagctgttggtggcaacaaccctccttcaacacacacacacacacacctccttcccacgcaaaggcgtttggccgcagtcaaggggctgaccatggctgtggaacgcggcgagtgctttggtctgctaggcccaaacggggccgggaagagcacaaccatcaacatcctcaccggattcctcacagccacacacggtaatcacgcgggcgctggctgtcatgtttcagcatgctgcagtaagctctgtgatcgtggaaggccacgacacccggaacggcatgaggcccattcactccatcatgggagtgtgtccacaggcaaggagggtgtaaaattccttggaaagcagtcactcaagcccagcatgtttctggtttggacattggttcatcatgatcctgccggccccttccaggataatttgttgtgggagcagctgacagccaggcagcacctgtcattctacggtcgcctcaagggcctgaagctgcatgcttcaatttttctaatcaggggtgagagtggccgggcatgcaaacacataaccagcttctcccggggagcttggcttccacacccaccaatnnnnnnnnnnaggaagtgtcctgctctaatctacccgtgcctccacattacagggagaggacctggagactgccatcatcaagtccttggcttctgtgaacctgttacacggccgagtgggagagaagcaggggcgagagtggccgggcatgcaaacacatatccagcttctcccggggagcttggcttcaacacccaccaaccctaccacccacaggtgctgtcgtactctggcggcatgaagcgccgcctgtctgtcgccatctccttcatcggttcgcccgctgtcgtctacctcgatgaaccctcaacgggcctggaccctgcatcccggcacaatctgtgggacgtggtcaaggaaggaaaggaaggaaggggcatcgtgctcaccacccacagcatggaggaggcaaacatcctctgtgacaggctgggcatatttgtggatgggcagctcgtttgcctcggcacccccaaggacctgaccactcgatttgggggatactatgtgagctggtatggggtcgtgggcgcatgtggggatgggagcggtgatccaggggtcctatggaggccacccgcattctcagcttggcaggagcccgcatggccatcacctgtctctctcctcaaaccgacacaggtcttcacaatcatgacgccagcggaggagggagagtctgcccacagactggtcctctccatgagcccgaatgcccggcagacctactccctggctggcacgcgaaagtatgagctcccaatgtctgacgtgaccctggcgggagtttttgaggctatgaccacagccgctgcccacctcaccatcctggactggggcatcgccaatgccaccctggaagaggtcttcatcaaggtgagtggagggggaaggatgaaggggatctcgccaaacatctcggcgtggagggcggcaactgatctgacattccctttgacaccctcatcacttttgcgctttcccatgcaagaagctggactcgctcatagccctctgtttctctcagtagcctacatgcttgcaaggtgggctcctgtcgctcctggagtagctgccacaggggctcagaggtgggctcctgtcgctcctggagaagctaccacagggcctcagaggtgtgttgagctcgagtacgattttcagcagcccatatctgaacagctcaagtgtaggtgcgacgcttgtagtccagctgctgccgagcctcgcttccgaaggcctgaaccagactccgtcccctccagctgcctggccaggagctcatcgctggagcctgattggatgacagggaaggtgcatgggtgccgtgatgccgaggtaagatcccgtcgggccacaagatgctgggatggcaccagagaaaccccacaacccacagcccaacccagcctacccagtaccgcagcattgtaa

SEQ ID NO: 6204 - DNA, 1887 bp, Chlorella protothecoides
  modified_base (708)..(717): a, c, t, g, unknown or other
  modified_base (1174)..(1183): a, c, t, g, unknown or other
  modified_base (1753)..(1785): a, c, t, g, unknown or other
  modified_base (1837)..(1846): a, c, t, g, unknown or other
atggcttctggaccttttaagaaagccaggtatgaagggataaggtctcaaacatgccttgcctgccttccgcccccaacagggagctatttatgcgtctggcctatcccaactggggctcatcctggggtcagatcggaacagattctttcccacctactatgtggagccatccctcatctccaccagatatgtgagtctgtttctgggtgccgtccaggggaagctggtcagggtggttgctgcgccgtcatcctcttttggttccgagtcaaactgcttgccgatcctcccttgacctgttccatccttcaacaccaatcccagtacaacgccagcctgacggccgtggtgaggaatgccagctcccccagcgtttccctcttcctagaccagctcggcacctcactcgatgcgctgagcaacgcagtgggactgggactggcagtgccctcaatctcccccgtcacgggcgagccggcgtggcaggccaatgcgtccgccatcaacaggttcctgtactgcggctaccctcaggtgagtggggctggcattctggaagtcagagcgccgctgcttcctggtcaggaagcacgctgcatcagactggtcagcagcctgccccatacaatgcattctgctcccccggtcctctctttagaaagtctagtttcaacgacctgggctggtcgtacggggagcctaacnnnnnnnnnncagactggctggtcgtacgggaagcctaatctctcatcagcctcgcacactctccatcccgcccagatccggtgtggcgggcgggtgcaggaggactatgaggtgtcccaggcctgggactttcaaaacacgtcggtggagacggggcagtacaatgtgaggatgtggttcaatggaaccgggcgtgtggatgtgtacaactcctttccaagcctcctacgagtcaatcaggggccaatcagtccacaactccctgcagggcatcaacttggctgcaaactccttcctgcaaagagcactgggaccagggtaccaatcccgcctcctagggttccaggagatgcccaaggcaacactcccagcagggcgggtcaaggccacttgcaggacatgctggtgcccccccttttcactcaccatccattaccatgtgctcaggatgtgacgcgcctcaccnnnnnnnnnnctcccagcagggcgggtcaaggccacttgcggcacattctggtgccccccctttttactcaccatccattgccatgtgctcaggatgtgacgcgcctcactgttagcatttccaccctcctgggtccactcttctttgtctggctgagccagctgctcctgcccacaatgctgctgaccctcgtctatgagaaggagaagagcactgcctcctctcttcaacaggctgaggaccatgatgaagatgcatggactcggggatggtgcttactggtgggtggcctgggccgagctctggcttctgtgcttcaagacggctgtgcaaggagtttgggatgtcttgccgcatgtagtgttatctatccctgttatgcccgtgcacccaagcttcctctcttagaccttttaaacagaaagggaatcacaaccttgtcaaccatccccccctctcccaaaacgccgcaggctgatccagtacacatggttctttatcatgaacttcctcttctccatgatcctcgtgggcatgggctgggccgtggaccttcccatcttcaggctcacatcatannnnnnnnnnnnnnnnnnnnnnnnnnnnnnnnnactgtgaccatccaggacatgtcaatgctgcctttgagaaagtgctatgtcnnnnnnnnnngcaaggtttgttgggcactgatgtccaggattcagaactag

SEQ ID NO: 6205 - DNA, 1572 bp, Chlorella protothecoides
  modified_base (370)..(379): a, c, t, g, unknown or other
atgacccctcccgagcaaggagaggcagcccacaagcttgtgctgtccatgagtcccaatgctcgtcagacatatgcgttggcagggacaagaaagtatgagctgcccgtcgcagatgtgacgctagcagaggtcttcaacgagatgactgctgcctccaatcacctcacaatactggactggggcattgccaatgccacactggaagaggtcttcatcaagattgctgggcattacatcaagtacctgacctcgccctccttctccactgcagttcgccaaggacctcggcgtcaagggaggaaactagacccttggcactggctcctcacaccttgcccatgtgcttgcttgtgtcatagacctcttnnnnnnnnnnaggaaactagacccttggcactggctcctctcacgtcttgcccatacctcgcttttgaaagcttattcgcaacgtcagcatgcagaagagaccttgcaggttcatggatttcccgccatgcgcagctcgcgctgctggcaatggtcgcacgatcgccatggactctgatcagccaggagctcccccgtgcttcgacatcctcatggaatatacagaagcagcatgaaggctcgttgcaaagggaggtgagcgcagccggtggtcccccgcgaaaccctcgcctctcgtgcggccccggtttcacgatggcggatgcgattcgtgccacaggacgccagatcgcctgcccaagcttgacatgcgccacccactacccccgcgcagacgacattccgaacccaagccactgccttgttcctgaagaacgtagcccagcagcgaagacagaggcgcagcaatgccttgctcatcatatctcctgtgggtttgccctttttaccctttcgatacccacttcatgctgcttggggttgcctggaagattgcatgacgacatactgccggatattcaagtgctatttgtgggatcgggtgcaggcactattaacattgaggcccacagggccttcctggcacatgtttatccccatcagcagctgacgagttcctctcctccccgcatggacctcccaaaactttctcacctgcagtgtggctgctactgcctgcgatgctgcagtacaaatggatcaagacagtacacatgccggaataacacagagggagcggcctgccggttctacgaggactgcgaggaatacgacgagtctcgttgcggcttggggtacagtactgcggcgcaggccatgtactgccccgtaccgcagccgagcacatggccggcgctgatgcagatccccaggacagcgcggcgtgcggagccctggcggcccgcagctgcaatgctgtacacaggtgatgagcggggcgcctcagagcagctcgccaacgagctctttatcgatcctgcgccgagtcctgcagaggagggtgctgcagcagccaccttccaggaaggcctggccgtggtaagtcagcccttttggtggaaaagaggggaagtcggagggtggggtgaggcggccctggccgcgcactcctgctggtcttccaagccagatcagcccaggtga

SEQ ID NO: 6206 - DNA, 1620 bp, Chlorella protothecoides
  modified_base (141)..(202): a, c, t, g, unknown or other
  modified_base (400)..(409): a, c, t, g, unknown or other
atggcttgctcagccgcacgccctggacccctgcacaggcgtttggccgcagtcaaggggctgaccctggctgtggagcgcggtgaatgtttcggactgctaggtccgaatggggcgggaaagagcaccaccataaacatnnnnnnnnnnnnnnnnnnnnnnnnnnnnnnnnnnnnnnnnnnnnnnnnnnnnnnnnnnnnnntcacagccaatggaggtgggtgttgtatgagatgggctcaggggggtgggctgcgatgcttgcatgagcctgccgagaccaacgctatggttgccggcctggggagcatgaatgctccgcgccatgccggcaccgttaaattactccttggttgcaatggtgtgcatctggaccaactcctcaccggagactctcccnnnnnnnnnncggcagtgcctaagcccacccggaccatgggtgtgggctgcgatgctcgcacgagcttgccgagaccaatgctatggctgccggcctggggggtcatgaatgctctgcgccatgctggcaccattaaattcctccttggtggcaatgatatgcatctggaccaattcctcaccggagattctcctggaatgtgcccttccttctgtggcaggcagcgtcgtggtggagggcaacgacctacgggatggaatgaagcccatccacgccctcatgggcgtctgcccccagctcacagcccgccagcacctcgacttctatggccgcctgaagggcctgaaggtggggccccgtgtgtgggcgatgcaccctctgtgcgcttgcggtcctgtcgcgctgtcagtcaaagggatgcaaggggttgctgccttggtacactcagctctgggtaccagcagctccatcatcccctgtacccaacacagggcacggagctcaaggaggccgtggatgctgcgctgaaaagcgtcaacctgtacaactccggggtcggggacaagcaggcatccagcagagagtgctcaagacctgactgctgggcccgcccacccaacttactgcaggttcaagcatattcgggcggcatgaagcggcgcctatctgttgcgatttcctttatgggctcacctgctgtcgtctacctggacgaaccctcgacgggcatgctcatgtgtcttgaggttttctttttgctcctctgcaacccccgcgacgccccttcgcccgccacgacacctatgcacagggactggacccggcctcgcgccagaacctctgggatgtggtcaaggaaggaaagaagggaaggggcatcgtgctcaccacccacaggcatgtacaatgttgctgttcctgctcattccgccctttcctccacctcccaacacagtatggaggaggccacggtcctgtgtgacaggcttggcattttcgtggacgggcagctggtgtgcctcggcagcccgcaggagctgacttccagatatgctgacttttatattggggtcgcctctgagatggctggccctttcattctgaatctgaggttctgcacggcaggggctccatcaaaacccctgtcatctgcatcggatgcgagctctgcatgcctcctgtgccaacaagtaccttccccacccgtcgacccaccttga

SEQ ID NO: 6207 - DNA, 1587 bp, Chlorella protothecoides
  modified_base (30)..(39): a, c, t, g, unknown or other
  modified_base (939)..(948): a, c, t, g, unknown or other
atgcgcgccggtgggcttgactgggaccannnnnnnnnngggtggctggggatgggctctgtggagatgaggcggccttggtggctcacacaggagcaacctggactgggacgcttggtgtgccttgtgggtctccgaacaagtgtcacgaatggacaatctcctgcgacaccccaacctctcaccattccattcccaggcctggtgcaacgacacctttgccttcaacgagatttcccaggcctgggacttccaggacacctccaccacctcgggcaccttcaacactcgcatgtggtacaatgcgacgggtcggtatggagtgtaccagacaccgcccaccctggtccgcgtgaaccaggtgcggggcctagagatttccttttgagccagggagtggtggtgcggtctggatggggtggggcccagatgacagggaaggcacttggtgaccctgccttgcatggcgggcgagtgtccctgggacatcacccctctggctctgctcatcagacaatcggggggagagcgcggtgccttggctcgccgcaccgcagctcctctcaaacactgtttcatgtctgccatctcagtgccgttggtacgaggcctgccgcgagtacaacaaagaagctctccctttcctccttgcccttcatccagggcatcaacctggcgaccaacgccttcctgcaagccgccctgggtccagactatcaggcccagctcctgggcctgatggagatgcccaagccctgtcagcgccctctcccaccccgggcctgccaccactctctgcagggcgccaccatcctgagtctgaacttctctgccctcctgggcccactcttcttcgtctggctggctcagctgctcctccccactatgcttgctagtctggtgtatgaaaaggagatgagaccggataaccccctctgnnnnnnnnnnccatctttggcgtggaaggagaggttaggtcttgattgccgtgcacgtgccttgttgctggaatgggggagcggatgccgctggctgaacccatctggatgtgtcagccatgtgcatgaccgcacgcttgtgcgctccctttccacccaggctgaggaccatgatgaagatgcatgggctgggggacggcgcatactgctggcaccacctctctcgtgcctctgcctcagacttgagctgtctgaactgacacaccggagcaccccctcttcatctcagcttgacctatgccgcgcactcaacctccctcccccaggatcatccagggtggcatctaatgcacgcatcatacaaaccccctccactacaccacaccgatgtcgcacaggtgttttacttcctgtgggtcaactgcctgatatcctttgcgttcttgctttccaccttcttccgctcgtcacggacagccgtggtggtggccttcctctacacctttgcgacggggctgattggctacctgctcctcacccagttcatccagtcgggtcattggtggtgcgctgggctcttttgttggttggtgagggttgggagactgtactgctgagtgtgaggatggttcataggatccgcaattga

SEQ ID NO: 6208 - DNA, 1131 bp, Chlorella protothecoides
  modified_base (362)..(371): a, c, t, g, unknown or other
atgccactgcagccagcacagtcctgcaggggaggggtgtccccgcctctgctcctcttgtacactgatgtaatgtattccagtgttccatttggggatccttgtggcgtcttgaagctcagtgggcaagtcgcaggagctcacgctgcgaatgtcgacacgagcactgatgccctgaacaaccaccaccccgaccacttgcagaccaggtttggcacccaggcgcgcgcgctcttcataaagaatgcggcgcagcagcgccggcagcgccgcaccaacatcatcctcatcctgtacccggtcatcttctgcatcctgctctacgtgctgcagcgggggagtgcagcggcaagctgggtggnnnnnnnnnngtggcgtcttgaagctcaggtgtgtgcttgggtggtactccctgccctgtgggtcacaggggagcgcagcggcaagcagggtgaggaggatgcgtcgatctctccctcgctcgctggtgccggtgtgtactctgttctggacacacagcgcactgagcctcctgtcacacccccaacctcccaaatttcaaccacgcagtgcggctgctactgcctgtcctgctgccggacggacgtcgcgggcacgaccacttgccgcaccaactccgccgccgacccatgccagcagtccgacgactgccaggcgtacgacgactctcgctgcggcgtggagtactcggtcaacgggcaggcagggtattgcgcggtgccgtacccgcccacctggccggcgctgatgcaggtgccgctgacgcggcgccgcgccgagccctggcgccccgcggccgccatgctgtacacggggcaggacgcggcggccgccgcgcagctggccggcgggctgttcggcgacggggcgcctagcgccgcggagcgcgccgcggcgcaggccacgctggcggcgggggaggcggcgggcaccatctatgcctcgggcctgtcccagctggggctgacgctgggaacctggcgcccggtgaccgacttcatgacttactacctcgagccgggcttcctgcagggagagaacgctgaggatgtgggtggacgcggaggacatagggggttggggggggagagatggggtgatgggacctag

SEQ ID NO: 6209 - DNA, 843 bp, Chlorella protothecoides
atgatagtggcttataggaacctgcgcgccacgctgctgcgtatcatagccccactggtgaggcgcgcacgggacccgggacttagttcagggctcccggcccgcatcctgtggcttgggagccttggggtggggcattccttgcccttcccccagcccgatcgaaggcacctccttcactactatactacatttcctacaattccacagttcttcatgttcctgctctggctgatcaacatcgcggtgcgcaacgacaacccataccttgagtactttgtcgacaaccctgacccagccgtggtcacggtgggggccatccccgcgtgtgccaccgacatgtacattgaaagcccttgctgggacttcctgtaccagcccaacaacaacagcgctgttgagctggcccggcccagtaggaagctgggaatgacagttgaagtagttggcatgggtgtcttgtcaggcactgtgccaagtcacaggctgttaccgattggtgccttcctgggttggctctgtctggggttttggagccacacgtactctacacagcaagcctggttctccctcgaggccgctgcctctgtatcttgtcctcccatcccccaactgagctatccatgcctatcaactctgcaggccatcgtcacgggcatccgagagaacaacccggggcgtccaatcccagccagtgccgtgctaggttttcccagcatggacgacgtcaactcctggctgcagaacaacaaggagcagaccctgggggcgtatcacttcacccccaatggctcaaccggcatggacttcctgctccagatcaactccaccgtgggttgctag

SEQ ID NO: 6210 - DNA, 2277 bp, Chlorella protothecoides
  modified_base (109)..(118): a, c, t, g, unknown or other
  modified_base (210)..(219): a, c, t, g, unknown or other
  modified_base (824)..(833): a, c, t, g, unknown or other
atggtagagatcgattgggttttgcctgagacagggggcacagcattacttcagacgcaaagaagccttggaagcgggctgctgcagtgcagcccagcggacccagcgnnnnnnnnnngtgagacatggggcacagcattacttcagacgcaaagcagtatgttggctgactcctgggtacctttcttccacgacaccacaccctcaacnnnnnnnnnngtggccgcagaggagcagcgcatgaggaacctgctcgagcttcgcacagctcacgtatgccccttccctgctctgaccccaccaggacatgaccttgccacgtcgcctgtgcctccggcagccgtggaggtgtttggcctgaagcaggtcttcacacccggcatcctgaccagatttgggcacagcctgaaccgcgctctgtcagtgtcagcacatcttccccccactcctgcacagattcttctgcggctgggtgccgaagctgaggcggaagaagaacaggcgccccgccaagccggtctcccagcgcctgaagcccttctgggcgatcaagggctcctggttctccatcgagcaggacaagctgttctgcctcctgggccccaatggcgcggggaagaccaccaccatcaactgcctcacaggtgcggcaggacccacagggtctgggtgttgggaaggggccctttgtttctcactggccaatcattggaaggcagggtaaccaccacacgggggattcttagctcccccctcaccatgcaaaggccactcctcccgcctgcaccaagccctcccactgttcaaccccccccacccgcctnnnnnnnnnngaccaccccatgggggactcttagcttcccccctgaccatgcaaagggccactcctccagcctgcaccaagctctcccactgttcaaccccccccacccgcctgcaggcgtgctgccccccaccggcggcgaggtgctggtgtacggcgagcgcctgggctcctccggcggcgcggaccgcatccgctccatcatgggcgtgtgccagcagtttgacgtgctgtggccggagctgtccggtgcagagcacatgcacatctacggccgcgtcaagggcctgccccggtccgcgctgcgcgagcaggccgccgcgctgctggagtcggtgcggctgcagggcgcggcgcgcgtgcgcacgggcgcctactccggcggcatgcggcgccggctgtcggtggccatcgcgctgctgggcgacccgctgatcgtgtacctggacgagccgacgacggggatggaccccatctcgcggcgccacgtgtgggacgtgatcgaggcagccaaggcggggcgcgccatcgtgctgaccacccactccatggaggaggccgacatcctgggggacaccgtcggcatcatggcgcgcggccagctgcgcgctctgggcacgccgctgcggctgaagcagcgcttcggctccggctaccagctcagcgtcagcgtcgtgccgcgcgtgacgggggccgacggggccgccgccgcccgcgcgcaggccgcgcgggcagacgaggtcagggcctacttcagtgccgcgctgggcgtggcacccgccgaggagaaccgggcctacatgcacttcctggtgcccaaggcacgcgaggcggagctgccgggcgtgctgggcacgctgcgcgagcgcggctcggagctgggcatcaccgacgtccagatcgcgctgaccagcctggaggaggtcttcctcaccatcgcgcgcaagcgaccgggggcctgccccaccctggccgcacagctaccacctgccgacacgtcggcgtgccacccttccttctccacccctcaacctgcaccgaccccaggccgagatggaggccgccgaggcagagggacgcgggtcggtggaggtgcacctggacgacggcaccatcggccacgtgcccctgggcgacgagttcgtggaaagcgagaacggcaaccgctacgcggtcaagtgggcgcaggacgaggcggggaacctgcaggtgctgcgctgcgtgccgctgagcgccagcgagggcgccccgtcggacgaccggccgaccgggaccccctcctccaccggctcagacgcgccgccgggcgtgtcgttcaagccgcgccagagcgtgctgctttgagcgtccctggctgggcagctgctggccttgggacacccccttcagggggggactggccgggagctggagaagaaaaggacccgccccaggggcatacctgcttccattga

SEQ ID NO: 6211 - DNA, 1227 bp, Chlorella protothecoides
atggactgcaggattttggtaggcatttattcggttgatagacagtcatggcctgctgcgcgggcatcaagacgtccccctggcttcccagaggaggggaactccaccatcgtaccgaaacagccatgggcaccgtccgtctctgtcgtcgtggagccggggtgcagacctggaaggaatgaagattcaacttctgcctgggcactgcaggaatgtgctttgagccgtgctgtacgcggcccagagtgcagccaagaggctgcaccattgcggatcgtctactgtgctgtagggggacaccgcaccagctacgtgccatcggcatttcttcctcccttatctcccgagattggaccgcagcatgcacgatacctcgctgaggcgccagcgcttgatgaattgaatcaaagactcaggatgtcgctggtccacgcggctgctcggggcatgcccatcggctcatgcactctcattacatgcacagcacagcggtcgattggttgccaccaaaggaacctacgctttccccccgcggtccagacatacgtagggtctatgagcaaggctcaaactgtaacggtatcccgcaggctatcgtgcaacgcattcttcgggtttgggaagcagaatgacacatgtgaggaggtggattgctggttgggatacatgctcctcgaattgcaccacaacccacccatgtccctgattatgaggagtgaggtggaagactactacaactacatggggatgctggccgcagagggcaactatgacaaactggaagagctgttcgacagtgagctgggctggatcgaacagggctggcttatgctttgtgcaacgctggcatcgatgcatgacagcataatccttgtgtggcgtggaacctgtggatctcctggttctccttgccagcaccgagaacgacctgcccaagctggaggagctggtggcggcgggggcagatctgagcgtcaaggtgaccaagggagcggagtattcgcaggtggtcatgaacatggtgaaagcaggctcagcaatcaggacaacaccaaacacgtgcatggtgaaattgttctgtggaatgtaatgtgccttagccagtgcacaggagttgccaccctggaaagccggaaagcgatcgaggatcataccatgtgcatggcggtggcgattcgtgtgccgagacgcttcagatgccgcatgacttctgtgacgactgcctaa

SEQ ID NO: 6212 - DNA, 2208 bp, Chlorella protothecoides
atgtgttggagcctcgatatgctgggtggtgtcgctggtgggaatcccgccgtccactgtgaaagacagagggggtcccatgatgtgttctcaccaaaggctgctcagcatggtcgccagcattccactgtctaccttcccccacttgacacccccgcagcatccgagggcgcttcgaaaaggccatcagagccgcccaggactccatctgcgaggccatctcggccgcagatggcacccccttcaggcaagacgcatggacgcgggagggcggcggcggcggcatcacgcgtgtcctgcaaaacgggaacgtgtgggagaaggcgggggtcaacgttgcgtggcgagatccatgcagcccacctgggcctcagttgcagcctggtcactggggcacacgaaggcggtgcaaacgtcgaggtgctttgcaaatccagtgcgccagggaagcgccaccctcccaattccatccctcatacagggttcgcgcatacctttcttcgcggcgggcatcagctcggtgatgcacccccacaacccccatgcccccaccatgcacttcaactaccggtgggtctcctagtagatgtacaggcatgctcgccccacgggagtgttggtggcttgctgggcagccaggcatggctgcatgtccatcctgctagtccctctcacatccccccccccttccctccccctcccacggccaccagttactttgagacggaggagtggaatggcatccccgcccagtggtggtttgggggcggcaccgacatcacccctaactacgtcgtccccgaggacatggcccacttccacggcacgctcaagggcgtgtgcgaccggcacgaccccgagtactacccgcgcttcaagaagtggtgcgacgagtacttcctgatcaagcaccgcggcgagacgcgcggcctgggcggcatcttcttcgacgacctgaacgaccgcccggcggaggacatcctggccttcagcaccgacgccatgaacgccgtggtggaggcctacgtgcccatcgtcacggcgcacaaggacgacgccttcgacccgaagcagcgcgagtggcagcaggtgcggcggggacggtatgtggagttcaacctcgtgtacgatcgtggcaccacctttggcctcaagaccgggggacgcatcgagtccatcctcatgtccctgcccgtcacaggatgctccaagcaacgtgggctctggagttgtctgctgcaggatcgcagacacacctgtgaggcctctcgacagggtccggcacccgtccctgacccctctgcacgtgcattgcatcctgtttgccccctgtgcttcctggctgtacgactacgtcccggcagagggctcccccgaggccgatttcctggatgcgaccaagaaggcccgggagtgggtgtgagcatgaccccatgccgtcccgtctgctgtgttagtctcgtcactgcgtcgctgctgtggcaccctgtcggcgaaggctatgctgtcaggctcgcgagcagatccaccacttccacgtccgcgccgtcgtgttggggcttgctgccaaagtgtttctcgacaccctgcggcccgcacgcatgctgtctctcgattgtgtttgagctcgggactggggccgctcgcctcacggcccagtctgagtgccccgcgcgctcctgggtggtggcacgagggcatcacgggcccgagggctggagggcggtgcccccctcctggggcgcgaggaatgcatcacccttgagcgctgcaaagagagggtcctggagcgcccggcgggtgatggccgcgtcctcgtggatccggtccaccagtgcctgcccgtgggtgcacgcgtcatgggtgagtcatcgcagagagcgcctcgcaaacagcagcgcggcgggagcatgcacctgcgcagaccaggagccggatctcctcgccgtaaaagtcctggtcgaactcgtgcagcagccagggctcgcaaaccctctgcttgtttttgaacacggggttgaagcctgccgagagggtgcagctgggtcagctggagcaggtgcagcatggacgacggcccagcccctccgtcagcacctggccaggagcgccgagcgtcgcccaccccccctctcgtcacacccaccgacgctcatgcacatggggtacacttcgggggaccggccgaccgacgcccagccggcgtag

SEQ ID NO: 6213 - DNA, 723 bp, Chlorella protothecoides
atggagacctgcattgacctgagatccagggcagcctgccacaccgggcccctggctcccaccccagcaacataccccacaccctgccccggacccctccctcttcgccaggtcaagctcttccgtgggctgtaccaggacccgacctttttctcccaggtgccgctgcaagtggccgcggagcgcgagatcgcgcggtacctgtggcagctggcgggcagggacgccgccaacttctcctggaccacctcgctgtcggagtttgcgcaccccaccgtggacagcatcaacatcgtgggccaggccatagggccctttgtctttgccgccaacctctttggcttcgtgctgctggtgggtgggccagatctcgagggggctcggcatgatctgggctggcgccggcctgggttggcggggtccgcagcagagggtgctggtcggaaacctgcgtgggtcgagctcagccaggattcccacgcccccacacagctgtcgtccgtggtgatggagcgggagcaagggctgcgccaggcactcaagaacatgggcatgctagactccgcgttctggctctcctgggggttcacggagctcctggccggcattctcttctccctgctcatcatcggctttggcgccgccttccagttcgacttcttcctgaacaacagcttcggggtggtgaggcaatgggagggagggggttgggtggggtgctga

SEQ ID NO: 6214 - DNA, 375 bp, Chlorella protothecoides
atgcactttgttgccaacagggaggatggcgggtatgagctgagcatctcggatgcatgcggtcgccagatgtggggtccacgctccctcagggccgtgccattcgcagctgccctccctgcaggcggcgtggcgggcactgtgctcagcacgggcgtcagtcaattcctgagcctgtataatgctgctctcattgggcggatcctgctcacctggttcccccaggccccagaggccatctctcggccactggccacagtgtgcgacccttacctgaacctgtttcggggcatcattcctccactgggaggcacgctggacctgtcgcccatcctggcctttgtcgcgcttgatgtgaggtccaggcggggatga

SEQ ID NO: 6215 - DNA, 1149 bp, Chlorella protothecoides
atgtctcaggccacccccctgctctgccccgaattcctggccgaagccctggcgcagtatgccgtgcctgccgcgggcccgccgccctccttcccccggcgccacatcaacattgtggacgcgctgctgccggggaacaacctgggacgcagcgtgtccaaggcctcggcctcccgcttcgcctcggcctttgcgcttggcctgcgcacactgcgcggggccgtggacaggtcgccctcaggggcgattgagggcgtggacgccttcttcaagaacgcatggcaggcccccatgcgcgcggcggccgaggcggcggcctgcctggcggggctggcctccctggggcccctcggctgggaggggctggtcggcaacggggccggcacgggacaggggccacgcgccgggcccggcctctcgcccccgcccatcaacatgcccccgccgccgccgcccccccgctcccaggggcagtggggcgggggcatcccagagggcgcgctgccgagggccctcgcgccgcgccccgcgtgggtgtcccagcgcgcccagcgcgcccagcaggcgacggcgccctggtcgccgcagccgcccagcgacggcctgcaggccgacctcctgcgcagcgacctggcggccctgctggccaacatggaggcggcgtgccggacccggtcgccacgggagggcgacgactggcctcgcgggaccgcgtcgcctgctcgcgccgagccgctggagcccaccgccgcactcgccgacctcagcctgcgtgacggcgatggcgcccgaatggacccgcgggggcgggacgctggacagcccgccgcggctgggcggccaggggaagccatggaggccccgtcatcgccgcaggctggcagctctgattctacgccgactctgcctgcgacgcgagacgcgggaaacggtgcctcgccaggcgccgagaatggtgctttgccaggcgctggcaacggtgcctcgccaggcgctgccgggagtggccctagacccccaggggcgacgccagcgccgctggtgagctggagcgccgtggcaatgggcctgcggcgcgccaccattgccgagacccagcgcgacccaaactccaagaccacgtccccaaaacttcgaacaacagcatga

SEQ ID NO: 6216 - DNA, 1392 bp, Chlorella protothecoides
  modified_base (215)..(257): a, c, t, g, unknown or other
  modified_base (1261)..(1270): a, c, t, g, unknown or other
atgagccacgaagaggaccagctcatccccaaccttttccgctacatccagtcctgggaggcggagttcattgactctcagcgcgtgtgggctgagtacgcgctgaagcggcaggaggcgctggcgcagaaccgacgcctcaccctggaggacctggaggacagctgggaccggggcatcccccgcatcaacaccctgttccagaaggaccggcnnnnnnnnnnnnnnnnnnnnnnnnnnnnnnnnnnnnnnnnnnngacaagggctggcgggtgcgccaggacttcaagcagtaccagctactccccacatcatcccctccccccaccacccctctcccaaccagacgccgcggatgaaccccttctggtggacccaccagcgccacgacggcaagctgtggaacctgaacaactatcgcacagatgttatccaggcgctgggcggcgtggagggcatcctggagcacacgctgttcaagggcacctacttccccacctgggagggcctgttctgggagaaggccagtggcttcgaggagagcatgaagtacaagaagctgaccaacgcgcagcgctcggggctgaaccagatccccaaccgccgcttcacgctgtggtggagccctaccatcaaccgtgccaacgtgtacgtcggcttccaggtgcagctggacctgaccggcatcttcatgcatggcaaggtgagcaagatgctagtggaggttttgtcgtttcggtgttggtgggaccagacaatggccctgttggggggcggtggttacatacgcaatggccaggccttgggcgcgccatccgttcttccagttgcatctggttcccattctggtcgcaagcagctcgtcaaagagccgaactgcagcctcccacgcatgcgcacaccctcttgtggacacacacaggcatgaatgtcccatcacgtgcgtacacacgcaaacccaccctgcccccctcccgcccacagatcccgacgctgaagatctcgctgatccaaatcttccgggcccacctgtggcagaaggtgcacgagtcgctggtcatggacctgtgccaggtgtttgaccaggaactggacgcgctggagattgagacggtgcagaaggagacaatccacccgcgcaaatcatacaagatgaactcgtcctgtgcaggtgccttgagagggggctgctgggtgtgtgggtggggggtgccggctgggagtgctagcaatgaatgctgcaaatgtcagcaatgcatcnnnnnnnnnntcgtcctgtgcaggtgccttgagagggggccgctgggtgggtggggtggggggtgccggctgggagtgccagcaataaatgctggaaatgtcagcaatgcattattgtttgggcatccctga

SEQ ID NO: 6217 - DNA, 3375 bp, Chlorella protothecoides
  modified_base (301)..(310): a, c, t, g, unknown or other
  modified_base (1022)..(1031): a, c, t, g, unknown or other
  modified_base (2906)..(2915): a, c, t, g, unknown or other
atgctgcgcgtggggtgcgaccagctccctgtcccgccggcggtcgacgtggcgtgcgtgctgcgcgacgccggactcttcggcgccgcgcccgaggatgccgcctacctggccggctgcctggcgggtgcagggctggaggagccactggcgtttgccgcggttggcgaggcgggggcggtggtgtgcgaccacgtgtcgcgcctggccgagcgcctgggtgccatgctggagcgcgacgcgcgcggatacccgctctggcggctcgtgtcccgcgacggcgccttggagcgcgctctcnnnnnnnnnngtgcgaccacgtgtcgcgcctggccgagcgtctgggtgccatgctggagcgcgatgcgcgcggatacccgctctggcggctcgtatcccgcgacggcgccttggagtgcgctcttggcgagctcaccggacccagcctggcgcgtaacctgctcacgcaggcgccggccttgcgccgcgccgcgctggcaggcctgctggacggcgacgcagcggcgcacggcggcgccgacgctgctgcgcaagcgctgggccttgccgaggtctcctgccgccgccgccacgaggcggggctcctgctggcgcaggacctggcgcgcagcctgggcctggcctgcgacctgtaccgccgtgcgggcccggccggcgacgcctcgccgaccacggtcgtcgcgccgggcagcgagggcgggcttcgactatgcatgtccggcccggggctggagctgctgccgcgcaaggtcgcagatgctgtggcagctctgggcgccgacgcagccgacgcccggctggtgcgcttcaccatcgcgcgcgtggatgaggacggtgagtacgtcgggtttgagctggagggctcgcccctcttcctcctggacacctggatcgtggcgcacaactgctggaaggccaacatcccctggaaggacgatgcatctacctcctgagtgtgaggacagcttgtgttacatgtctcagccgtggtcacttgcccnnnnnnnnnnctacctcctgagtgtgaggacagcttgtgtcacatgtctaagccgtggtcacttgcccctttttgtgtcaatggctcaccatatgagtatcatacacccactttgtgttttggggggcctgcatccacgctcggctgctgcaatctgcccctccctcaccctttcaacccaattccacaccgtcacgcaggtccccggcctgcccgcgccgatcgaaaacatgatcctgcgctacgtgaagatgaaggcggactggtggaccaacgtggcgcactacaaccgcgagcgcatccgccgcggcgccacggtggacaagacggtttgtcgcaagaacctgggccgcctgacgcgcctgtacctcaaggcggagcaggagcggcagcacaactacctcaaagacggcccctacgtgtcgcccgaggaggcggtggccatctacaccaccaccgtacactggctggagagtcggcgctttgcgcccatcccctttcctccgctctcctacaagcacgacaccaagctcctcatcctggccctggagcggctgaaggagcagtacacggtggccacgcgcctgaaccagctgcagcgcgaggagctgggcctggtggagcaggcctacgacaacccgcacgaggcgctgtcgcgcatcaagcgccacctgctcacccagcgcgccttcaaggaggtggccatcgagttcttcgacctctactcccacctcatcccctgctatgagatcgagcccctggagaagatcaccgacgcctatctagaccaggtgggggtgagggggggctggagatgttgggaggagggaggaggggtttgggtggggcgatgggttgctcggaccactggaaacggagctgcttggcaagtcgagggtctgtgcctcgacacgaatgcctcagagaattgtgctggcccgcttcacatccgacccagatgtgcggcagggtcccctcccctcgctcatacattccaaatcgctcattacccaccccgtcaaccttgcacacacgatcccacccttcacgtacacaacacacagtacttgtggtatgagtcggacaagcggcacctgttccccaactgggtcaagcccggggacagcgagcccccgcccctgctggtgtacaagtggtgccagggcatcaacaacctggctgacgtgtgggagacagagaacggcgagtgcgtggtgctgatgcaggccacgctggagaagctgttcgagaaggtggacctgacgctgctcaaccgcctgctgcgcctgatcgtggaccacaacatcgcggactacatgacggccaagaacaatgtggtgatcgcgtacaaggatatggcccacaccaacagctacggcctggtgcgaggactccagtttgcctcctttgtcatccagtactacggcctggtgctggacctgttgctcctgggcctgacgcgggccagcgagctggcgggcgctcccgctgcgcccaatgagttcctctccttccgcgacgtgcgcgtggagacgcggcaccccatccgtctctaccagcgctatgtgaacaaggtgcacatgctgttccgcttcagcgccgacgaggcgcgcgacctcatccagcgttaccttaccgagcacccggaccccaacaacgagaacatcgtgggatacaacaacaaaaagtgctggccgcgtgacgcgcgcatgcgcctgatgaagcacgacgtcaacctgggacgcgccgtgttctgggacatgaaggtgggcggttgtcctttggtgtgttgggagagggtgtcggactgcagaggagtggttgatggggagggtgccagccttggatgccagaaaacactgctgtgcagcgcgagggtcccctnnnnnnnnnnaaggtgggcggttgtcctttggtgtgttggtagagggtgccggactgcagaggagtggctgatggagtgggtgccagccttggatgccggaaacactgctgtgcagcgcgaggggcatttctttgccctccctgattcacacccgtttgacaatcctccgcgcatctcgccgctgcagaatcggctgccgcgctcgctgaccacctttgactgggacaacgcgttcgtgtcggtgtactcgcgcgacaaccccaacctcctcttctccatggccggcttcgaggtcaggatcctgccgcgcgtgcgcgctgcggcggagggttttgcgcacaaggacggcgtgtgggcgttgcagaacgagatcaccaaggagcgcaccgcgcaggtcggtggcttggggaaggagatgatgcatggttggtttgtgattggggcctggatgccgcactggctatcttga

SEQ ID NO: 6218 - DNA, 306 bp, Chlorella protothecoides
atgccctccatgcaggcctcccgtgacggtccacagtgtgggtgggaggacctgaggaggcacgagaacgacttgaccttgcgtcttccaggccagtatggatcatgggccgtgactgggcatgccgcgacggtgccgtaccgctgcttccgcatctgcataatgcagatgcaaaaggggaatgagaatccctggcatgcctccctggctcaaatcgagctgtatggcaacctgtacgtggatgggaaggaggaggatgccgatgtctgggagctggctggtgtggccgccaatggactcgggtag

SEQ ID NO: 6219 - DNA, 984 bp, Chlorella protothecoides
  modified_base (881)..(890): a, c, t, g, unknown or other
atgaccatgacatgcgccccttccccccttcctttcgagcagtgcgttcagcagcacccgctatgggagacctgctccatgctcaggcaactcgtgcgagaggctcgcgaggcggatactgcgatgggcagcccagagaagctcgtgtcctctctgcaggccgccgggccgccccgactcccttcacgccaggaggcggccctgtcagcacgcttcctttccagaaccaccccaggctgtgttgagctgctcttcgtgtgtcccggtgacaaaaacggggtgacctactggctggcaacccagggcggtcagcagcagtgggtgaaccccatgctctccggacgggtcaaggtgcgcatcccgctgaaacagagcgactggttggctgagagccttgacgagggcatttgcacatggtcgcagactctcagctccgctcccatgggactgtggagaccacagtgccatgatttcatggtggcagctgcgccattgttgccactggcttgtgttgcctgtctttttaaatcgctgccaaacgtattctcccccctcccaccactccaggtgcaagccagcagtcctgcatgccgaagcaccaacccggcgtcttgtgtggcgctgggccctccccgcctcaattttgcggctccccggagcgaggcaggcaggctggtttcctggtggtcgctggacctcgggcctcggcaccagctggcctgttcagcctacactctgcgccacgacaagtcacacgacccactgcgcagctggaccctgcaggtgaagacgttgagggggactctgagactgaaagtctccgggaatcaacgcacgaccgttcctcgcctctggaacattttgggggctaattttcttgnnnnnnnnnngatgttgagggggactctgagactgaaagtttccgggaatcaatgcacgaccgttcctcgcctctcgagcattttgggggctgattatctttga

SEQ ID NO: 6220 - DNA, 3252 bp, Chlorella protothecoides
  modified_base (461)..(470): a, c, t, g, unknown or other
  modified_base (1496)..(1505): a, c, t, g, unknown or other
  modified_base (1618)..(1627): a, c, t, g, unknown or other
  modified_base (2122)..(2131): a, c, t, g, unknown or other
  modified_base (2592)..(2601): a, c, t, g, unknown or other
  modified_base (2878)..(2887): a, c, t, g, unknown or other
atgtccttcgcgctgcgagtcctgaagggaccatctggatccaagaaatctatgacaccactcaaatacttttataacgcgccttgcgatggttggggcactggggggatccgcctatccacctgttattggtcaaccgcatcttctccgcccggcatcggcacgtcatcccgatgggagaagaagacattccaagtgttcaaaggtgtcgcggatgaccttccggaagtcgctgtgcaggttgtgacccgtcgcgaccgtcgagactcattggccttctctaaaccgtgtgcagaatttcggacgcgctctttgcctccatcgccaatcaaaatcagcgtaaggcatcaaggtgttttccggggggtagtctgcgagggcgtatttgacgagcatggtgtgtttgtcacgtctggcttggttgggatgccgagacatccactttcctctttgatgttccnnnnnnnnnnaaactaccaccctgcagtgactgaagaccacctagtcagcttgagtgttgtgttcggcaagctattgcccaaggcactcaggaccttggacacgggaggagtcttttgcttccaaggagaacctagcgggcgcagtgtgtaccatgtaagagaggggcactcctttacgtcggattgtaaaggggaattgctctgcaacctaactctaggacatgttggccagcgccccactccaatgcttgcacagatccagggacaatcaggttcagagccatacttggtctaccctgaacatttttgcgagtgtcacgccttccagtttgacgtcctcacaaagcaagactctgtgctggtgagtgcatttgcagcgctgtgttctggccccatggctgatcccagatgtgggatgtgggatcgagcctggtttgcatcctgcatgctcaacagtgcccccaccaaacctggccctcatgcagtgcaagcaccaacttgctgctcgcctggcgtgctcacttggcacgctgcgcacttcgacagtcagcgaccttgtcatagcagatctcttgctccaaccacctgggggcgtttagtgtctcaggtgttgcacacattcgcattccaagcttcagcttcatcagagaccccactcttcacgatgcctttgcgatggctgctatcacgagtggacacagcctttgtggacgcccactccaggacctctggaggtctcgccaagactcgggcagtcgtgctggacgacacggcagccctgcatgagcacctgcatgcccatcacatgcacatgcaggcccaggggcagcggagggtggcccctttcgtgatctggctcctcatcttccttcacgtggcctttgttggcgggctgctgtggacctggtactctcaaaaattaggaaaggcggtgatcggagctgctaagcgagaaagccttccacaaaaggtgagctggagcctggtgcggtggagcgggaggtttgcaagcttttgcgaggtgcgtgaaccgtnnnnnnnnnnaaagaggagcgtggtaccttgttggggctgggtaaatgctgacatggtgaactgtgtctacgaattcgccatgcccaaccttcggacagctcctgacatcaaagccaagagtnnnnnnnnnnggagcgtggtaccttgttggggctgggtaactgctgacatggtgagcatagagcatggatccagtgcaccctcacgccatgatgtaccgggagtaagcaagagtcaacccttactcccagacgatgagggaccaaccactgtgtacaatcaccagaaccttcatggacctcgagatgagctactctcccctatgcctgcgcccatgcccgcacaatgcacatttgaggctggggaagacggtttggggctcatgctgaggaagcgaaactttcggagttctttgccacgtcatcgcccatctttccatcctctcgacacaacagcaaaacaatgtagcgtcctcctcacatcagagtccgcaacgaggaagcagctgatacaactagtatggggttgtctgacctttgaagtgagaggtgcgtacatggagatcgaggatacctttggagatcaggttccacccgtcagtaagagtggacggcacgcctcaaagnnnnnnnnnngtgagaggtgcgtacatggagatcgaggatgcctttgtagatcgggttccatccgtgacaacgatgtaactgtcctcctgaagcaacaacccggctcaaggcgctggcagcatttgagtgccgcggcaggatcgaatttagagagtaattataccgtgatcctgggcagccaccgcaacagctgtctcaagattgagaaggatggagtgctctgttgctctgtgagttttggtcgatactgttgtgctcattgctccagacatgcatgcgtgggcttcaatctgatgtttcaccattggacgcttacacactcgctccccacggatcccccaggggctgcatcactgtgggtctgggagatcctgggacgaacgtcagtcacacctggcgggacccagatcccatcgagagcatctcatacgcgggtgtgcggtgcagagaggggtgaaccgtcagcggtnnnnnnnnnnccatcgagagcatctcatacgcgggtgtgctgtgcagagaggggtgaattgtcagcggcgcaatgttcacaagggggaccacttctgagtcgacacgatcctgcagaccgtgcagggctgagtgcctgggacacacacattgtgtaccgagccattcgggtgctccctgtgctgaacatgcagcagggcacagacctcaaggtaggccccatcctctgcatgcactcacttgacgcatggcagctggccctcgtcaactgctatatgcagctgtttnnnnnnnnnncatgcactcacttgacgcatggcagctggctctcatcaactcctatatgcagctcttcacatgttcaccatgagtttccccacctctgccgaacacagtctacacaactcccctctctcctggacctggcatgcaatacactgcgtgactgcctgcgcccttcaagcgtttcggcagtgctggtggtggtcgatgcactggaaccgacactgcctgtgctgcgccaagctgcgctgtcctttgcggccgagcacctgcaagaagccctggcccaggatcccgagggtgtggcgggtctgcccgcccccatgctgtctgaagtcctccgatcccaggccatggtaagcaagttccaggcgaggtaa

SEQ ID NO: 6221 - DNA, 504 bp, Chlorella protothecoides
atgcagatcctggatgccggtctgcggcgcgactttggcttccagcacatcctgtacgtctattcggggaggcgcggcgtgcatgcctgggtctgcgacgaccgcgcgcgctgcctgagcgacgagcagcgcaccgccgtcgccaactactttgcggtgtaccgcggccaggagggcggcctcgctcgcctggccttgggactggaggagcaccccgccgtcacgcgtgcggccgccattctggagcccgtgttcgtcgaggggctgctgtccgacgacaagcggcaggaggcgctgctggcctacatcccctcggagcgcgtccgggagcgcgctcgccagcgctgggcccagggggaggccggggacgacgtggcccgctggcatgcgctggaggaggaggtggccaaggagcaggcggtgggtccggggtcaaaggaggggcgtgcggagggtggtggagggggagaagcacaggctcttggctgttgcttgggtgcatga

SEQ ID NO: 6222 - DNA, 375 bp, Chlorella protothecoides
atgcgcagcgttgtgtttgcccacgcctacccacgcctggacctggaggtgtccaagaagatgaaccacctgctgaaggcgccgttctgcgtgcaccccaagacgggcaaggtgtgcgtgcccatcgaccccgaccgcgcacacgagtttgaccccgagactgtcgtcacagtcggccggctcctggaccagctgaacaaggcccgagacggggtgaaggggagcgatgcgggcgaggagtggcgctccaccgacctcgtccccgccatccagaccttccgggcttgcttcctggacggcctccagggcgcatgccgcgagtcgctggccgcccgtgccagggagagcgccgctcagcccaccctggtgtggtga

SEQ ID NO: 6223 - DNA, 249 bp, Chlorella protothecoides
atggagggccacgggcccggggcagagcatccctttgcgggagggatgcccccagtggatgaggccatgctggaggacaagcggaaggtggcgacgatgtcgtggctcgcgagccctatccccctcctgccgttgctgcaggctcgcaagtggcagcagctgaatagcaagcgctactccgacaagcgcaagttcggatatgtccaggcccagaaagaggacatgcctccaggtataagggggcagtga

SEQ ID NO: 6224 - DNA, 1461 bp, Chlorella protothecoides
atgcagacccagggacgcgacttgggtgcgagtgtagaggagaatcttgatggccgggccagggacaggatcgctaaaagcatccaagttggcggcggagatggcgcgcacgcgccagtcggttttgctgccgaacgcagcctgctcgtaggggctggtggtggtgacgatgaggtcgtcgccatgcacgttggtggtcttggtggtgagcgcggtggcgccgccgccctcccgcgcctgcttctcgatctccgcgatctgctggcgctgggcggagggcggcgtgatctccgcgcccaggatgatgtcgcggatctcgctctgcgtcagcgcgcccacattcacgttgttcttcttggcgtacgcgatctccaccttgatccactgctcgtcggtcaggctgggccagatgtggtgtggctccgtcaccacgctcttgtccggcttcagcaccatgcgcgacttgtccacgttcacgtgcagggcgcgcaggatgagcaccaggcgcgagaaggcggtgtaggaggagatggtgcgcagccagtcgtcgtacaggttgaacagcagcatctgcggctccgtggccttcaggatcaggtcgccaaacttctcgatcttcagcgcggcctgctggagctccgaccctgtgatgacaatgttggggaagtcgaggaggtggacctccagcgggtccagcatgcccttgcggcttacgatgatgcgcttgggctgctcctccaccggctgcgagcggatgagcgccgccacctcctccgccgtcttccacttggccagctggctgaggcgcttctgccccgcccacaccgaggtgtggatgatcttgaggaagagctggcccgtgcgcgggttgaagatgaagatggcgccgttgatgggcttggtggtcaggttcccctcaaacgtcttgtggatggtgacgcggtagacgttggtgtcgtccacaaaccagatgatctggttgctgaacagctcgccatagttctggctgctcaggtacggctcggtgggctcgctggagtagagctgcagcgccttgcgcactcgctcgcgcagcacgtacatggccgggttggacttcatgatcttggccagggcctggaccaccaggggcttggcccccgggaaccagttgccaaaggcggagtgcaggttgtaggccaggtccacgcccaccatcacccccgtgggcgaggggtagatgctcatgttgtcggtggtgtagtccaggaacttggcgcgcgtataccgctccacgtcgtgcgagtcgtaatcgccccagcgcagctgcacgtccacccaatatttgttggtggccttctggtcgaatacgtcgttggtgtcccccatcaggctgggcttggccaccggccatttgtaggccgcaaacagcaggatgtctggtgtgttgggaaagagggaaggggggttgcatgcggatga

SEQ ID NO: 6225 - DNA, 588 bp, Chlorella protothecoides
atgtacggctcctccccgccggacaacccggcggtgaaggagatccggtgcatcgtcatgccgccgcagtggggcagccacgcagcggtcaaccttcccgccggccttcccgagcatgagatgctgtcggacctggagcccctgggctggctgcactctgcgccctccgagtcgccccagatggcgccagtggacgttgcggcgcacgccaaggcgctggagacgcacaagtcctgggacggcgagcgctgcattgtggtcaccgcctccttcaccccgggctccgtcagcctgacggcctacaagctgacgcccgcggggtacgagtgggggcgcacacaccgcgacgccctttccaacccaggctcaagcggcatcgtgtacgctccaccactcgccacccttctcacgctccgcatcctcgacacaatgcagggagtcaagttcagcagcgcgatgaagtacggtttgaagctggacaaccccaaggagttctacgcagaggtgcaccgtcccacgcacttcctagagttctccggactggaggacgcaggccctgttgcggacgtggagaaccccttcgcctga

SEQ ID NO: 6226 - DNA, 3447 bp, Chlorella protothecoides
  modified_base (3318)..(3327): a, c, t, g, unknown or other
atgtcgtcgcgcaagttcaggcacgacaagcgggtctacctgggcgccctcaagtttgtgccgcacgcggtgtacaagctgctggagaacatgcccatgccctgggagcaggttcggcatgtcaaggtgctctaccacgtcactggggccatcacctttgtgaacgaggtgccctgggtgatcgagcctgtctacctggcgcagtgggggaccatgtggatcatgatgaggcgcgagaagcgcgaccggcgccacttcaagcgcatgcgctttccgccctttgatgacgaggagccgccgctggactatgcggacaacatcctggatgtggacccgctggaggccattgagctggagctggatgaggcggaggacggcgcagtggcgcgctggctgtacgactcgcgcccgctgcagcacacccgcgcggtgaacggcccctcctaccgccgctggaagctgccgctgccggtgatggccaacctgtatcgtctggcggggcagctgctgtccgacctggtggacgccaattacttctacctcttcgacctcaactccttcatcaccgccaagtcgctcaacatggccatcccgggggggccaaagttcgagccactgcaccgcgactccgacgcgcgggacgaggactggaacgagttcaacgacatcaacaagctcatcatccgcacgcccatccgcaccgagtacaaggtggccttcccctacctgtacaacaaccggccgcgcggggtacgactcagcgcctaccaccaccccatggtcatgtacatcaaggcggaggacccagacctgcccgccttctactacgaccccctcatccaccccatcgctggctacaagtcgggcgctggtgtcgcgctggaggacgactacggcgaggaggacgaggcctgggtgctgccggagggcggcgcgccgctgctggcggacaccccgctctccagcgacaccaccaccgccggcatctccctgctctgggcgccgcgccccttcaacctgcggtctgggcgcacacgccgcgcctgcgacgtccccctcgtcgccggctggttcttcgagcactgccccggcaactacccggtcaaggtgcgcgtgtcctaccagaagctgctgaagaactacgtgctgaacaagctgcacgcgcggccacccaagaacatgaagaagcggtcgctattcaagtcgcttgcggccaccaagttcttccagtccaccgagttggactgggtggaggcggggctccaggtctgccgccagggctacaacatgctcaacctgctcatccatcgcaagcacctggcgtacctgcacctggactacaacttcaacctgaagccggtgaagacgctgaccaccaaggagcgcaagaagtcgcgcttcggcaacgcctttcacctgtgccgcgagatcctgcgcctgaccaagctggtggtggacgccaacgtccagttccggctgggcaacgtcgacgccttccagctggccgatgggctgcagtacaccttctcccatgtgggccagctgacggggatgtaccgctacaagtacaagctcatgcgccaggtgcgcatgtgcaaggacctgaagcacctcatctactaccgcttcaactgcttccccaccgaccaccaagtcctgaccgagcacggcttcctgtcgctggacgatgtccagcgccacttccggagcaatgccaccctgcgcgtcgcctgcttcgtggacggcgcgctggaataccatgccatcaactcgggcgacgtcaccgtggccgagggcaggcaccgcctgatcgcgatgcagggcggcgacgcgacggcccgcggcgtctcgctcacgcccaccgacaaccaccgtatgtacgtgcgcacggacggcggtgaggcgggcggcgagccaggcggcttccgcatcgccacggctgacgaggtgcatgggcttggggagcgcgacaaccaggcgcgtgtgaccttccaggcgagctgcgcgctcggcgcgcgccccgacgtgggcgcgccgccctgcctgggggccctggggctgcaggtgggggaggagctggatgccttcctgcgcatatacggcctctggctgggcgccggcgccctggacccggccgcccaggccgtggtgttggaggtcgagtcgggtgccgcccaggagctggcggagggcgcgctggccgcgctgcgccgcgtactgccggccggcgacgaggccggggcctgcgcggcggctgagggcggcaagaggcgctacgccatcctggcgcccgcctggtgggcctacttctccgaggagtgcctgcctgccaagcagggccgggcagtcggcggtgctgtgtcgggtgcggatggcaagtctgcgtccatgatcacaacccccaaggccctgtggccctgggtgctgcgctgcctggacctgggccgcgcgcgggaggtcctgcgcggcctctgcgccgtggccggcgcgatggggcctggttcgaacggcgggcatgtcgtggtcgccagcccgggcctccgcgacgagctggtgcgcctgtgcctgcacgccggctacaccgcgcactttgaggcggccggcggcgcgggcgggtaccgcctggagtttggcgcggcggcgcaggcgcagccctcgctgcgcgtggcgtcggactgcgaggcgcgcccctacgagggcaccgtctggtgcgtcaccgtgcccaccgcgcagcagctcatcgtcgtgcgccgcgtgctggcgggcggcgtggagagcagcagcgccggaggtgcctcgaccgccgtcacggcggcatcgcgccccgtggtcgtgggcaacaccggcccggtgggcaagggccccggcgtgggcttctgggcgcccacctggcgcgtctggctcttcttcctgcgcggcatcgtgccgctgctggagcgctggctgggcaacctgctggcgcgccagttcgagggccggcagtccaagggcgtggccaagacggtgaccaagcagcgcatcgagagccacttcgacctggagctgcgcgccgcggtcatgcacgacatcctggacatgatgccggagggggtgaagcagaacaaggccaagaccatcctgcagcacctgagcgaggcgtggcgatgcttcgcgcccgacacccctgtgcgcatggcggacggccgcgtgaggccggcggcggaggtcagggtcggcgaccgcgtgctgggcgcgggcggcgaggcgctggctgtccggcgcaccatacgcggccgcgacgccatgttcgccgtgggcgtgctgccagggaatgcgcgnnnnnnnnnncgtgctgggcgcgggcggcgaggcgctggccgtccggcgcaccatgcgcggccgcgacaccatgttcgccgtgggcgtgctgccggggaatgcgcacgaggccaaggcgcttgctggtga

SEQ ID NO: 6227 - DNA, 300 bp, Chlorella protothecoides
atggtggggggaggagtcagcgggagcgtgactccagagtgtccttggtactttctcagtattgctcactgcgggccacttccccctgtgactctgcccggcttgctcccacacccacccaaccgcgcccttcggccccacccacccctcgcagtgggctcctgggctcgtgtggacaacaaggccgtgatcggggaggacgtggtcatccgcgacgagatctacatgaacggcgccattgtcctgccgcacaaggagatcaaggagtccgtgctggaccctggcaccatcatcatgtga

SEQ ID NO: 6228 - DNA, 342 bp, Chlorella protothecoides
ccccacccccccctcctctctctccttaaacacacgaaagatccccatggtgggccactggagcgacctgtatgggcgtcggcccttcatggccgccccccagcttgcctccctgggcagcctcggcgtggtcctgctccacctccgaattgggctgccgctgtactggtactacgtcgtccaggtgtgcatgagcggcttctctgccctggcggtgaatctggccttcctggccgacaccctgtccccggtcaaccgcccgccggccttcggcctggtgctggccgtcttctcagccgccgtcatcctggggcccacactgggcagccacctgggcgctga

SEQ ID NO: 6229 - DNA, 1005 bp, Chlorella protothecoides
atgcgatgggctctgtcccatcatagcgaggagcggcttcctgagatgccattactcgcgaggctgcctgcccttccgctgaggcctcttatccctcagcaggcaacaggaacggcaacttcaggtgtggtcactgcacccaggtggcacctgcggtgcgtacgctccgcgagtcacccccccccacgtggacgagcgcccgcgcgaatcaagttgggtgctgggagctcctgcaaccaccattcgctgagcccaccccacatgcggacggtcatccaacgtgttaaatccgccagtgtatcggtggatggggaagtagtgtccagcatcgggcccggcctgctctgctacattggcctgggcaaggatgacagcgaggaggatgccgcatacataattcgaaagatcctgggcatccggctgtggcccagtcaggatgggaagaagccgtggcatcgcaacgtgcaagacgtcgatggcagcgtgctctgcgtcagccagttcaccctctttggtcgcttgtcggggaacaagccagactacagccgggcccaggtgcccagtaccgcacgggatcagtaccatgctgtcttggaggcgctgggaaaggcctacaggcctgagcgcgtgcgtgacggcgtgtttggagccatgatggatgtcgcaagcgtgaacgacggaccggtgacgtggtatctggacagcaaagagcgaggtgcccccccgggctggccgaaaggccccgacgcagtccgagtggcggccatccccgggccagacagccggtcaattggtgcgaagaggtcccgccgaagcggcatcagacttgatttgggcattccaagaccattacaagcgggagtggactccatcctacggaaacgggcagggttgcctcccagactgttctcactatcaaggaatcactccggcgtgatgagtaatgcgaacaacggcgtgccttccttccacaacaaccacggcccttttcacattggctcatga

SEQ ID NO: 6230 - DNA, 1623 bp, Chlorella protothecoides
atgcatggcaccatgcttcagggggtatggagatgttcaccctttccgcatgatgcgtgtgggttgatagggatcgatgcatactcttcgcgaccccattttgctcaaccacgccatgccatacccaggcctggcttcctcatgtgcatcgccttcatcgatcctggcaatctggaagctgatttgcagacaggggcaaggacgggttacatcctattatgggttgtactcgccagcacctgcatggtgagtagcatggctgggtggcacaatctagtttcgagctcgactgcgaaaatacaaggtgcttgccggctctgcttgctctcagagtcacactttccgcacattggccctccctgtcctccattgctgcagggcatgctgctgcaggcccgagcatgcaagctgggcgtcaccactggcaaacatctcgccactcattgcaggtgtgtttgggtgggccaaaacgacgtgcatgacttcccctgtagtttgggagggtattggattgtgggagcatcctcaagaccatcaagcctgctgaggacgagcagggcgaacaagtatcatctccctcacagctccgtccgctgcctgacacatgcctccacagtccaatgcacccaatctcaactgctacccctctttgccttccccaaactcagggcccagtactcccccttggtccggacagtactgtggctgatggctgagctggccattgtgggctcggacatccaggaggtcatcggcaccgccctcgcgctgtccttgctatctcgcggccacatcccggtctgggcaggtgaggtgcatccctgggcccctgccccgggtgccgctgtggatgagccactgcctgcctcatctgccatgcctacgaccctggcgccgacaagccggctcgatcccggccgcaatcttgtctcccttcctttgctcaacccaccgccctgcaccgcactcgccgcgcaggcgtcatcctggccgccctcatcgcctttgccctccttgtcctcgagaaggccggcgtgcactggctggagcgcaccttccagggcttcgtggcggtcaccatggtggccatgggcggcctcttcttcatggcagacatcccctacgccaaggtggcagaaggtgcgtgcatgtgtcgagtttcggagcggtgctggggcaaggcaggacgtaagctgtgtcgtggcaggccatgagatgcggtcagtgggcccttgttgcggtggtcctgcgagcgcctttccagcgccgttcggctacacgcagacagatccatgccatttctctcccacccccccctccctccaacccaaaggcctcttcatcccgaggttgccgcgttccaccattgccatcgcgtgcgggctcctgggggcgatcatcatgccgcacaacctgttcctgcactctgcgctcgtgcactccaggcaagcgcctggtccgggcgaggctgggtgttgccagggcctgcgtgcactcggggctcttgcccctgaatgcatgctgcttgggaagcgctgtgcgcccaagactccacggctgcgttcgaatctgtgtgtccgcaccccgccaggcagccaccacgccccaaccctgccacactga

SEQ ID NO: 6231 - DNA, 255 bp, Chlorella protothecoides
gactcggctcaaacagcgcggacaggagccttcctgaacgcctggggcggcatcgcggacgaagagggtaccatccgctccgcaggcccccgccccacagacaagcaacccaccatactcccctgcctgcaggagatgacggccgatgagatcgcgtgggtggacgcctaccacgccaaggtgctggcagcgctcaccccacgcctgtcgggcagggagctggagtggctgaaggaggccacgctgccgctgtag

SEQ ID NO: 6232 - DNA, 246 bp, Chlorella protothecoides
atgaatcccttgggactcaatctgagaaatttctccgtggcagagacagacagcggcgtggtaggcttcgcccagctcaagccgctgactgcctctagcgtcgagctggcctccttggtcatcctggagaagcacaggccgctcgtcctcactgctctggctggcacggtcgtggctcgggctgcagctcaggacaggctcgtggtgatgaagcggcttggaaaggaagattcgatcaggtcatga

SEQ ID NO: 6233 - DNA, 462 bp, Chlorella protothecoides
atgggggcacagtcagctgcccatgctgttgagtcaatgcactggtggaatttaggccatgacgcacccgctgccgctcagtgcgatcagcgcctatccatcctgatgcaggtcgagatcaagctgcggctgaaggacgaggaggcgcatgcccggctggcggcggctctcaaggcatcctaccgcaccacccacgagcaggaaaactacttctttgacggcagcagcgccgagctgagcagtgcccgcgtgatcctgcgactgcgtttctacaactttgacaagaaggccctgctgacagtgaaagtgggcagggagggaaagcaagtgcttgtggatggagtggggcgctgccccgaaacagaggtggaggtgccgcctgtacaggcacgcgggtacctgagcaatcccaacaagctcctggaagcagggctgcctctcgtggacggcctgaagcagtga

SEQ ID NO: 6234 - DNA, 630 bp, Chlorella protothecoides
atggacagtcaatacatgttcatagatgtcatgaggggcaacaccactgcctacttgtcctacttgcaggtcaaggaaggtatcgggaagctgctcgatggtgtcgactttggagcacggggtctgcgtctgcttgggtcagacaccgtgtctgccttcaaactgattggcagggccgcggcaggcgggacgctcaagccaagagaggtgcaggcgctgcggcgaactttcagagacgtgctgacattcatccccttcaccatcatcctcatcctgcccctgacgcctgtcggccatgtgctcatctttggcttcatccaggagcagctccaggcggcccagcagttggcggagcaggagggggacgagctggagttccagcgcgccgcggcggccgcggcggccgagctgggcaagcggtggacaggcgaggcgggcgcggcgggcatggcgctgcagccaggggcggcgggggcgggcgcgcaggaccggccaagctggaaggtggcagaggaggaggagggcgaggagggccccgctgccgccgccgtgcggtcgctgaaggagcgcctggaaagggcggccaagctgtcgtacaccgacccgggggaggcaggcggtgggaactag

SEQ ID NO: 6235 - DNA, 201 bp, Chlorella protothecoides
atgcacatgagtcagttcaaggttctggatgaggagctcgcgcctctggctgccgcgctggaggaggacgagctggtgtacatcgaggccgctgagctggcgcggctggcagatgacatcatcgacctgcgaacctccatggggctcggggacacccaggtagaaagggcgggacatcgggtgccagggtgccgtttctag

SEQ ID NO: 6236 - DNA, 411 bp, Chlorella protothecoides
  modified_base (262)..(271): a, c, t, g, unknown or other
atgggcaaggcggcgcggacggtgatgatcgccaatgtgtccccctgctcctcctcctgcgagcacacgctgaacaccctacgctacgccgatcgagtcaagggtgggttgcttgtggtgtggcatgttcactgggggggcatgcggaagggtgcccctgtgagctggcgggtgcgaggagtgctcgagccgcggaatgaaccccagtgccgtgccaagcagtgcacccactgtcctcctcacaccaatcttcctgcagaannnnnnnnnngtgcccctgtgagctggcgggtgcgaggagggctcgagccgcggaatgaaccccggtgccgtgccaagcagtgcacccactgtccccctcacaccactcttcctgcagagatccggaagccccaacctggcgtccccgcc

SEQ ID NO: 6237 - DNA, 2316 bp, Chlorella protothecoides
  modified_base (1467)..(1476): a, c, t, g, unknown or other
  modified_base (1858)..(1867): a, c, t, g, unknown or other
atgaggcatcgagtgctgcccgaatgtgtcgcgaccagatcatccctaccccaccgactccggggtgggtctaagcggttgagtacctggatcaggagacatttgaaccgctgcgaagccgggagggggctgccagggagccagtacttgaaggggcgccccgacagaccgagtcgaagccggcatcatgctggatcacgagtggaggacgagggggaggggagtcccagccgcttgagggcgcgaggtaccaaatcagcacggggcactgcacgcgggtgtgcagacgaccggcatgcttccaggtgcacaaggctcggtgttgaggtctccaaatctctctttgaattgcaaacgtcaggcagcaggagtggcgcacattctgctaggtggtttttgagcagcgtcattcagcatggcggaggtcacggaggtgagataggtccaagcccaagatcagcatgtgtttacgtatttcggagtgatccctcccacgtcacccccgtcccatcgcgccagccatacaacactgcaaagcgcgacttcttggtgaagatccaggagtcctctcagaagaaatgggaggaggccaagttgttcgaggtagacgctccgagtgagggtgagacagtggagaagttcttcgggaactttccctacccctacatgaatgggctgctccacctgggccatgccttttctctttccaagttggagttcgcatcagcctaccatcgcttgtcagggaagagggtgctcttcccccaagcctttcacctgaccggcatgccaatcaaggtgagcggaggcaggagtaacagctgttcagcggtcagactggaggagcacagagtggggcatgacaactgccataggcgtgaaggaaaacgccccttccatgctgttcagcggccagactggaggagcacagagtggggcctgagaagtgccataggcgcctgcgccgataagctgaagggcgagattgagagagctcaagcgccagaggaagcaaagcctgtggttgctgtcgttgcgaaggtgcactggaggaaggatgcgtgcaggatgaggcaggaagggtcaagcctgcatgatggattcctgctgagcactgatgcggtcatcgtgatgacgatggaaatcagtggtgctctgttgtctaggacccctctcagccccttcaatctgcaggccccaacagagagggatgacccttccaagttcacagggaagaagagcaaggccgctgccaagactgggccaggcaacactcagtgggagatcatgcggatgagcggcatccctgaggaagacatccccaaggtagtcttgggttctagtttgagatcaagagcagggggcgctggcacccaagggaggcgcccattactggaggcctggtgcccgagtgtgcctcgatgcgccaagcaatactcgagtgcacgcagctcaagagtgcataannnnnnnnnnagcgcccatcactggaggcctggtgcccgagtgcgccttaacgcgccaagcaatgctcgagtgcacgcagctcaagagtgcataacctccctccccacactgctgcagtttgcggatgccaagcattggctgcaatacttcccgcccctggctgtgcgggacatcaaggcaatgggttgtggagtcgactggcgccgcaggtatgggtttataccgcggggtggggacggagctggggtacaattcaaagtagcagcccagaatgataaagtggcatggcaagtgctgcgagggatggcctcagactgtgctcaggcgaaatcctcctcaaacccgcgcagttttgtcaccacggacctgaacaagtactacgactccttcnnnnnnnnnncagcagcccagaatgacaaagtgacatggcaggtgctgcgagagatggcctcagactgtgctcatgcgaaatcctccccaaacccgcgcagttttgtcactacggacctgaacaagtactacgactccttcatccagtggcagttctggaccctgtacagcaaggtactgcgagccatgtgtgctctgagatgccggcatccgctccagcatcctgcacctgtccctgcatggcttgagggcaagatcgtgaaggacaagcgctactccgtgtactcgcccaaggacggccagccctgcgccgaccatgaccgcgccacgggcgagggcgtgggtccccaggaatacaccctggtcaagatgaaggtgctggagctgcgtggaaagctggcagctctggaaggtgccttcaatgctgttggtggggagtggagtggggttatgcggtga

SEQ ID NO: 6238 - DNA, 1131 bp, Chlorella protothecoides
  modified_base (323)..(332): a, c, t, g, unknown or other
  modified_base (839)..(848): a, c, t, g, unknown or other
atgaccaaggtcctgaaccgaggtgtccccatacaccgtcacagctggcgacctgttatgtacaaaacttaccgaaattccggcccactatgcagtgccaggtcggtgtgctcggagggtgcttgggcgatcttgactgtggtgtggaccgcagattccaagcacgtccgccatgctctcgctcctcctcacttatactgcagcggtttcgagattaagcgctggattaaacgtatcgcatcgagatgcctggatcacaatgagggaatcagcataagaacgcgagtgaaagctgactcctgcaaacgcctagcgctttggannnnnnnnnnatcgacagaccatcgtgagcagaatatccggtgtgacgctgtgtttgcttgggcaagggccctccaccgcccccccacgaatgtccctttgcagccggttgtgcgcaagcagcacaacagcggatacaagcacaaggccaacgtcaagtcttactttactcagtttgaggagaccatgcagcagcggcagctagaggcacaaattcgtgcgcgcatggtaggagctgggactaccggcaccgcctgctggcctctccaagcctccttccttgcccaggccaggaggtccccccgtcctagcgccaccccggccaggtggcccccccgtgctgccacccccccagctggcccagcccggacttgcaccgccccaggtgccgccgcctcttggtgtaccacccccacaaggtgtgctgcgtgggagtctactcgtgctgatcccgatctagtcatggttctttcttccagggctggggttgggagggaggtgggcatgcctgtgcagtnnnnnnnnnncaccacccccacaaggtgccacctctccctgcatacaggcttggccccgccaacattagcagcatccccacctgcggtggcagctcaacctccaggtgagagtcttgagaagccttgctttggcggggtggaagtgcaagttagagccagggattactgtctttcacagctacctgacttgctaaccccctcgatactcaatggccagaactgtcgctgcaccgcccggatgagtgtgcggtgtgagcacccgggaggagcatactacctcttaactccctga

SEQ ID NO: 6239 - DNA, 1590 bp, Chlorella protothecoides
  modified_base (1271)..(1280): a, c, t, g, unknown or other
atgtgcacaacactccactgccctgggcctggtgagaatgtttatgagctcctgctgcccatgaaaacacggcaccgttcaaaccagactctcgcacatggcgagcaagccgggcattacaacatccagccggcaggcaaaaaattagcaagctggaaagaatttgatcctcggattgtctcgtctcggcatgggtggcaaaggggggaagcacaggtaggcagggcggcacgcccctgcctaccaggctgccagcactcccaaggaacgaggtggctcgcgggccgacgcccctcctcctgccccacccccccggggtcaggccgtcaccagccccctgggcgctacacactcccccccagcctttgcgcgcccgcctcagtaggtgtaccccttctcgtacatgcccttggccgcctcctcggactcgttggcagggtcatactgacccctctgcgcggtggagttggcggcggcgcgcttgatcagcgccttctgcgcggcctcgaagttggcctcctcccccttccaggtgcgcagcacggagttctgcagcgcgcgcgcgtaggagaagctgacatgccaggggttgggcgactggttcatggcgttcaggttgagcgtggcctccagctcggactggccgccagagaggaacatgatgcccgggacggcggggggcaccctgcggcgcagcaggcgcagcgtgtagtcggccaccacctcgggcgcggcggggttgccggagtcggcgcccggggtcaccatggagggcttgagcaagattccctcgaacagcacgttgttgtccgccaggtacttgaaggtttccgcccacacagcgctggccacctccaacgtgcggtcgatgtcgtgctcgccgtccagcaggatctcgggctccacaatgggcaccaggcccgcgctctgcgccagcgcggcgtaccgcgccaggccgtaggcgcagtcgcgcaccgccaggggggtggggccggaggggatggacaccacgctacgccacttggcgaagcgcgcgcctgcgcggtagtactccccgcaccgcacgtccaggccgtccaggcctgcgcacctgcagggtttgagtatttgaggagtgggagtgggtgtcggaggaggggcgcatgggaggcggccttggaaggagcagaggagggcacaggaggatgtgagccgcaatcgagtgggtgtctggggagctgggtcccgacccagacgggcaggatggaacagccggcagccacccagctgcnnnnnnnnnnggaggagggcacaggaggatgtgagcagcaatcgagtgggtgtttggggagccggggtcccgacccagaccggctggatggaacagccggcagccacccagctgctcaccagctctcggagttggagccggggagggggtgcagccccttgtcgaccttgatgccggggacgatgccctgcttcttcaactcctcggtcatcttggtgcccttacgggtgtcctggaacagagtctcctcaaacatgatggcgcctgagggggtggggtggcagcgggttcaggagcacatccacgcccctaaaccctga

SEQ ID NO: 6240 - DNA, 750 bp, Chlorella protothecoides
  modified_base (284)..(324): a, c, t, g, unknown or other
atgtcgcagctcctctgcagcaaggcggcagtcttcccggccttcgtggccgggcgaccccaccgtgcccagcgtcggtcggcgcttgccgtgcgggcaggcaagtacgacgatgagctcatgcagacggcgggtttcgcgctgctgccatcgcggcggactcgggggcccccacaccatcattgggcccagcatgggggccccgggcgccacgcatgcccgcatgcttcgccaccgagctcctcggagctccgactgcgccccggtgtgaggatttggaggtnnnnnnnnnnnnnnnnnnnnnnnnnnnnnnnnnnnnnnnnnccccccacccccctgcctctcctgcagaaaaccatcgcctctcctggcaagggcatcctggccatggacgagtctaacgccacctgcggcaagaggctggagggcatcggcctggagaacacggtggagaacaggcagacctaccgcgagctcctggtgaccaccccgggcctgggcgagtacatctcaggtgggtggtatggtcccaggcagcgtatgggggggggggaggggacgggacgggtgtcaagatgtggggttgatgaggttgaaatggttctgtttcatgccgctgccctagcctgggcagcgtgtgtggggggggacgggacgggacgggtgtcaagatgtggagttgatgaggttgaaacggttctgtttcatgccgctgccctggcctgggtctgctcatggggtagcatttaa

SEQ ID NO: 6241 - DNA, 762 bp, Chlorella protothecoides
  modified_base (263)..(272): a, c, t, g, unknown or other
atgatcggcggcatgcgcatggacctggagaagtcgcggtacgagacctacgacgagctgtacgactactgctaccgtgtggcaggaacggtgggcctcatgtccgcgcccgtcatgggcatcgacacgcagtacaagggacccctggacccagtgtaccgcgccgcgctgagcctgggcaccgccaaccagctcaccaacatcctcagagccagggacggcacggaacgggaactgagacagcacggccctcagcctggcgnnnnnnnnnnttttgcgaggcagagccagggacggcacggtacgggaactgagacagcatggccctcagccaggcacctgccaatcgacgcgccgcgcatgggagtcaccgtggaatctgcctccccctcacctgctgccgcatccctacggggaccccaaagctcatgtcaaaccctcaaggccctttccaccaactccgcacagggacgtgggcgaggacgcacagcagcgcagccgggtgtccctgccactggacgagctggcacgctttggcatcagccccggggaggtgctggagggcacgctggcgcgcgcgcccggccaggtggacccgcgctgggcggccttcatgcgcttccagatcgagcgcacgcgcgccgtcttctccgaggcggaggtcggcatccgccagctgtcgcgcgacgcgcgctggccggtgtggagcgcgctcatcctgtaccgccagatcctggacgccatcgaggccaatgggtatga

SEQ ID NO: 6242 - DNA, 360 bp, Chlorella protothecoides
atgcagccgctccccctccgggccgccgtggacgtgctgtcggtgctgagcacccccgactttcacggggtggggctgcacgttagctgctatgagatctatggcgggaagctgtttgacctgctgaacgcgcggaacaagctggaagtgcgggaggacggcaagcgccgggtcagtcggtcgcaagggcagcgcttttgtgatgttcagggggcagaagttcaggccagagccacgagagtgggacaggtcatgggggacttgctccatcgcggttgtgatggagtctcaaccctggaccactgtcgatgccaaggaacccatgttggtcatgcgtgggtcccagggattcaaagttga

SEQ ID NO: 6243 - DNA, 321 bp, Chlorella protothecoides
atggtgtttgcgctgcggaacgggaacgagcccaagaggccggtggtgggcaagctcaccttcatcgacctggcggggtcggagcggggggccggtgggtctgagaagggcagcggtgatgttggactgggcaacggccgagctgcatcgtgggggggttgccacctcgagccccgggccccatgtgcagacacatatgacaacgacaagcagacacggctggagggcgctgagatcaacaagtccctcctcgccctgaaggagtgcatccgggcgctggacagcgacgcgcggtgcgccgagtggggagatgggggttga

SEQ ID NO: 6244 - DNA, 252 bp, Chlorella protothecoides
atggcctactacaccgtggcgcacctccttcacgagggcgacatgtatgctgtgaggtcgggacccgtggatgtcagggacctgaccaacgaggtgtggaactacatattcctgggcggggagctgccgcgggacacgcccatcccccgggacctgctggctcgggcacgccgtgagttcgagttctggtacccctttgacctccgcgtctccggcaaggacctcatccaggctatgcagccagggctgtga

SEQ ID NO: 6245 - DNA, 615 bp, Chlorella protothecoides
atgcgtctcactccatccggcccctgccttcctcatcccacacagacccctcccccacacacgcccaactccccctgccaccccctctctcctgcacagaaccacctgacctttgcgctgtacacgcacgtcgcgctgtggggccccgacaagtggccccgttccttccgctgcaacggccacctgcagctgaacaacgccaagatgagcaagtccacgggcaacttcaagaccatggagcaggccatcctggagtacggcgccgacgccatgcgcatcggcctcgccaacgccggcgacaccatggacgacgccaacttcgagcacgacaccgccaaccaggccatcctcaagctctaccgccaggtggagtgggcagtttactacacggagtggcgggatcgccctgcgagaggggcatcgcgagaaaaggtccgttctccagtgcacatcagagaggccaggaggtcgtgcggcgccaagggcatgcgcgacgggccgcccgccaccttctgggaccgggtttttgagaacgagatcaacgccgccgtgcaccgcaccaaggccgcctacgacgacatgaacttcagggacgtcgtgctcgcaggctggtga

SEQ ID NO: 6246 - DNA, 720 bp, Chlorella protothecoides
atggcggccacgctgcgcccagagaccatgtatggccagaccaacgcctgggtccggcccagcgaccccaagaaccccgactctgaggtcggcaagtatgccgccttcagggccaagaacggcgagatctttgtcctcaccgcccgcgccgcacgcaacatgtgcttccaggacctcacccccgagaacggtgtcgctgagaagttgctggacctgacgggggaggacctgctgggcttgcccctccggagcccgcgggcgacgcacgagcggatctacgtgctgcccctcctcaccatcaagatggacaaggatctggtgaagaagcccaagctgcgcgagctctactccatcaccgacgagatggtgctgccctaccaggtcccacggcacgcgccggcaggtgtagcgttggtagcatcagcgcacaggccctccggtgctatgaccacacacaatccgcatcgctgccgcactcactgcccgcgcctgcaggtcatccccatcatcgatattccgggcctgggtgacctggcggctgtcaagctgtgcactgacctgaaggtccagagccaggtcccccaactgccccaacactgcgatccccactcacagaacgacacagagaagctagccaaggccaaagcggagtgctaccgccgtggctttgactctggcgtcatgctggtcggcacctacgccggcaaaccggtgtgttga

SEQ ID NO: 6247 - DNA, 732 bp, Chlorella protothecoides
atgaagaaacccatcaaggacggattcgagaaggccgccgggggcagcgccgggaagaaggggcagccggcggtgcccgccagccccgtggcccacgcccacatccatgtggtcgaccgctttggcggctggaaggccagggccctgcaggtgctggcgggcctgtacgacgcctccctccctgactgcttccccgccaagcccaacgagacggtgctgagcgcggtggccagtgagcccgagctgacggccctgccgcccaagcagctgcgccccacagtcttcccctttgtggcgtacaagacgaagcaggccaaggaggggggcaaggaggtcctctccgtcaagctgccctttgacgaggcgcaggtcctggaggccagcaccggctacatcctcagcggggatgaaaggggggagacgggactggctgtgcggcgtcaggcctacgccacgctgaaggccaaagcactgctcgcccagcacgtcttcgagaaagcgaccaatcttgcggcaccctcggcgccggctagcgctgccgctgcctgctgccgtagtcgtgccaaaacccttactcctgccttccctcttccgcacagggccctgcaagagctcaagggcctgcagtccatcaccatccacaagctggccttcgacgagctggccactgcgggcgacgagcgcgtccgtgccgctcttccgggcgagcctgtcatcgtgtttacatcgtag

SEQ ID NO: 6248 - DNA, 675 bp, Chlorella protothecoides
atgaagctggtccagggtgggagcgtgacggtggtggaggcggcgcgcgcggtgctggcctcccgaggcgtgggcggcttcttcgccggcaacaccatcgacgtcttgcgcaccgtcccctccaaggccctggagctggcggccttcgactcctacaagcgcaccctgcgcgccacaccttgggtccccgaccgcgccatcggcgccgtggcgggcggcctggccggcatcacctccaccgtcgccatttacccactggagacggtgcgcacgcgcatggcggtcaacggccacacctttgtgcagacgctgcagcgcgtgggctcgcacggcggccttccgggcctctacagggtgagccggcaaggggaggatgagggggggagtgaggggcctaggggggtgggggtgcaagttggcatgcccaagagtgcaccgggtcgaggaatcctgcgccgcacttgcgccgctgccgccctccctgggcatccatgcgcatgcgcgcggaagctgatgcagggatccccaccgcatcccctctcccccaccgtcgattgcactgcagggtttggatgcgagtctgattggcacggtgccctacacggccatccgactgggactgtacgacgccctcaagtactcctggaagcgggcgaccgggaaggagcaccttga

SEQ ID NO: 6249 - DNA, 705 bp, Chlorella protothecoides
atgggattatgcgtttcgaccttgccttgcaggccttcacaatgttctccttctgcggtggaagggacaaaacgggcgttgctcccacacccccctcccgaatcacagcctgccggtgtctgcatgccagccccactccccccttctccccctgcagagcccggcaagccagatgtcagcaaggcccccggcgacatctcctatgcccagaccgtgaaggagggtgagaccaagacgaccgacacatcctccaccaccggcagcaagccctctggcggcgcggcgcgcaagaacaaggccggcgaacccctgagcaacgagcccaacttcaactacgcccagaagcacgccgagaaggctggagataaggccggcgaggccgcgcagaagggcaaggagtcgctgcacgaggcgggcaaggctgccaagtctgcggcgggcgagagcgtggaggccggcaagcaagcggcgggcgaggcggcgcaggctgcgaagcacaaggcgcgcgaggtggatgaggctgcgggtgaggcgctcggccatgcgcgtgaggcggcgggcgaggcggccgacgccgcgcgcgagtacgcggccgcggcgcgcgacaaggttgccgaggctggcgacgccgtgtacgagcaggcggcgcgcggcgtggagtacatcaaggagcacctgcccacggtgcacgtggagcacgacgag

SEQ ID NO: 6250 - DNA, 1158 bp, Chlorella protothecoides
  modified_base (889)..(898): a, c, t, g, unknown or other
atgtcgaagaatgaccgcctaaagtcccatcccatacacgtcgaggaggtgcagctggttgtcgagagttcgcatcaatctgctcaggcgacacctccggcacagaaaggcagacgaggtattctagttgcggctgcagcaaaagcgaagcacaccacttccgagccaggcgttacctctggaggacgtcgcaagcactcgggtgcggagcctgactcctcaaagacaactgcagtgccccccaaagcacagcagacacttccagcctgtgccaagagcaaaggacagggccttggctcaggcagcaagcaacatcatgcgaagaaggcagctggcaagaagtcccaagcggcagccgttgccgcacaggtgcaacagggcgtctcgaaatccgagccaaaagtgctgtccctcccgaggcctccaaccctccctcccccccgagcaccgagtatcaagaagtacagcccggcagatttgcagcagggcctgaagagagggacgctcttccgtgccgtgatccgctacaatgcctcggatacctcccaggccttcgccaccctgccgggcctctctcacgacatccttatcaagggtgcgattgcccagggccattccatggagggcgatgaggtggcgctgctcattctgccattccaggactggtatgtgaggtctgagcctgccagaggcgcaggaagggctggaggacctgcgagcgcgggcgccactagggaaggcactccagccaaagcagcaggacagcctggtgccaagactctggcggcgccaagcggcagcggcgctgttgttccagtcccgcagccaggcgcatcgtccccccatggctccaagaagcatccagaggcagagggccccaagcaagcannnnnnnnnnggcatcgtccccgcatggctccaaggatcatccagaggcagagggccccaagcaagcagccctgccatccactccgcttggcactgacggcgtacaccagctggcatcccagcttgacaagtccctggtcctggaaccaggtaggcgggggcatatgttttggatgcatcagcggcatcgcgatggggtgtgcaacatatccgcagcatcacgtctttggatcctgcatcgaagtctggatgtcaggcccagcacgctga

SEQ ID NO: 6251 - DNA, 405 bp, Chlorella protothecoides
atgtgtttgctgacggaacacgcttcccaccctgcagcccccgcgctggcgggcatcctgacggtgctgtttgcggggctggacatgaaggcgtgcctgggcgggcgccagcactacctcctttacgccctggtcccggccctgcacccgcgcatgctcatgacgctggacgaggagggcaagcagctctccgtccccgtgcgcgtcggtgcggcggtggacgtggtggccgccgcggggcggcccaagaccgtcaccggcttccagacccacaccacgcccgttctgctctccgcgggcgagcgcgcggagctgggcaccaccaagtacctgcccctgaccagcgtgctggagggggtggtggtgctcaggcccaacccggactgggtggaggaggcggagtga

SEQ ID NO: 6252 - DNA, 270 bp, Chlorella protothecoides
atggcctgcctgccccagactccctggcgcatcggcgaagaagaatgcgtggggcgtcgggacctgcggtccgcccgcaccttctccatagaccctcccactgccagggatctggatgacgccctgtccattcaggaactggggggtggcagctaccgcgtgggcgtccacatcgcagacgtgtcccactttgtcagcttgaacgcgggggtggatcgcctcgccttttctatcgtctgggacatgggcgcagacggcagcattcggtga

SEQ ID NO: 6253 - DNA, 1071 bp, Chlorella protothecoides
atgaatgtggtggagaaccgcaacgacagcgacaacagcattccccgaggtctcctgaccgccaccgttgcaccctggggagagtacagcctgggtgccaccgtcccctttgccggggatggcctgctcgagctgtggatcaaggggagcgtcatgtttggggccgccatccagttccgtgataggcgtacgctccggtcctccaggccagcctccctgaacagccgcttcaaccccaccacgtttgtggtgctgggccccgacgacagcggctggttcagagccctggtgagagccccaggcctgactaggttgcactacgctattcctgcaccagcaacacctgggacaccatttcctttgtcgacatctcaggtggggaggtgggaagcggcctggttctactcccgaccctccggcctgccatggcagaccaccgggtcgcagctgccacctgccctccgcactctggcagcctcttcccctactacactctactacctgcagcgccagtctcgacccattgccaagcagcccaccccacctcccccccacctctgttttgcaggccagggctttgccctggcgatcgccgaggccaacctgttccccgaggagcaggaggtccagactgagtcggcaaccacaggcatccccgcctccccctccgacgtcgcgatcaactccgccagcgacctggtccccctctacggtccctccggcgagctggtcatcaacacgggggcgttccctgacagctacgacttcctgctggccctcaagcccaccgccacctccggcgacgtggccaggatctgcaacaccctggctggcaccgccagcgggaatgtggcggagttcagggggagttgcaatgccgggctgcaggcccagatcctgaacgccgagatcgactcggactcccctctcagctggcccttcaccagcgtcacgctcaactccgaggttgggggaggagagcggctggagaggagggtgaagggcgcgcatgttgtggttggagatcggaaagcagtgtgcccaggcatccgcggacacatcgcggtttga

SEQ ID NO: 6254 - DNA, 285 bp, Chlorella protothecoides
atgggcacgctgcgcgcgctgtttgagccgcggggcattcgcgtcccggcgcccctccaggccggggtcacgcgctggggctccgaccccatgtgccgcggctcctactcctccctctctgtcggcgcgctgggcggtgccgactatgacatcctggcggagaacctggggggcagggtgagactggggcagtgggcggtgggcggggagggggaggggaaggcgggtgcggagctggtttggtcatctgatgggggtagaggcggctgcacagcagcttgttag

SEQ ID NO: 6255 - DNA, 1473 bp, Chlorella protothecoides
  modified_base (1341)..(1350): a, c, t, g, unknown or other
atggagtggacctggacggtgacatctgcctttgtttccatccacgcctggggtcccactgctctggagcatgggcgatggcgcggcgtaccgccctgctacctcccgacggagggcgagcccccctcttccgcctgcttgcagggtcccggcggtgtggcggcggttggggagctgggcgcctccatcatcacgggggtggatggcaacccagcggccatcatcgccacgcagctgggcatccccatggcgaccatccgcacgcacacaccgatctacctcgaagggggggtggaggccaataaaaccctcgacgaaaaggtcagtggggacagccagagactttcatcggatggagattcacccctgcccggcatgcctgggaccatcctcgaggccggactggtgatgggtctctgttcctcgagaggacaggcgggtgggaagacagctctccatgccttccacgcatgcgacgtgggacatgcattccctcttccaccctcactcggacccccataccttgtcaacccccaaggtggaggcccaccacaacttcctgctggacgagtgccaccagatccgggagcggctgggcgccgccggcggcgaccagcccctgggccagaccctggaggccctgtggaccgagcacctgccccgcctgggactggcctcggccgcagacctggcccaggcgcggcagctgttcgagtggcacctggccaacctggagtttgccaactcggagcggctggacagcctgtccctgcgccactgggaccaggacgacccgaacgagctgcccggggcgcacacctttgtccccggcggcaacgcgcgctgggtgcacacgccgcggaacaccttccgggcggatgccgccgtggtcaccgtgcccctgggctgcctgaaggccggggatgtggagttcaggccggcgctgacgccgcgcaagctgggcgcggtggcgcgcatcaactttgggacgctgaacaaggtggtcctcctcttcccccacgcgttctggggcggggagctggacatgtttggccgcgccacgccctcccccgaccaccgcggcgactccttcctcttctactccgccgacgtgctgtccggcggcgccgtcctggtcgccctcgtggcaggtgcatcgatggggccacccaagggaggtggccccacctacatggggccctggctgatcatcaagagggtgcccagggttctaaatatcaagcactccctgacgtcgcccggcatccctccactccagccctgttttcgcgcctcacatccccactccaaatccctcccccacaggcgccgccgcagccnnnnnnnnnnaaatatcaagcactccctgacgtcgcccggaatccctccaccccagccctgttctcgcgcctcaaatccccactccaaatccctcccccacaggtgccgccgcagctgagtacgagacgctga

SEQ ID NO: 6256 - DNA, 459 bp, Chlorella protothecoides
  modified_base (167)..(176): a, c, t, g, unknown or other
  modified_base (429)..(438): a, c, t, g, unknown or other
atgccttctgtcacctttcccacggtcatcgcagtcaagggctacatcaactttggcgtgtcgccggcggtgtctgcgcgcatgcgggccaccaccgacgcgcgcgggtccgtggtggtgatcggcgcggggtgcgcggggctggcagctgcccggcagctgcgcgnnnnnnnnnncaccgacgcgcgcgggtccgtggtggtgattggcgcggggtgtgcagggctggcagctgcccggcagctgcgcacctttggctaccgggtggtggttctggagggccgcaacaggcccggcggccgcgtgcatactctgcgcctggaggtgagcggggtcgttggtgcaggagggtgggcgccggagtggcatgttcctggtgtccatgctgaaagtgcaaaggctagcgaatggagtcgacctggactgtgnnnnnnnnnnatactctgcgcctggaggtga

SEQ ID NO: 6257 - DNA, 807 bp, Chlorella protothecoides
gccggcggcgagggcgcctgggcgctgggcccggccccggagcccatcccgcgcccgctggcggagcgcgcggcgcgccccacgctcgccttcctgggcgcgcccgacgcggagcgctacatcgccggcctggagtgggtgatcaacatgtacgcgcgcggccgggtgcaagactaccgcttcacctacgacctggcggcgcccacgctcctgggcctggtggccagcctcgcgcacgaccagccggcggtggaggacggcgaggagggagcgggggagggggagggcgccgagcggggtgtggctggcggggagtcgtgcgggccggagggtgcccagccggcgctcggcgccgggcgattggcaaggaacggtctgaagagggaccaggcggcggcgaggcctgatggcgcggcacgccagccaggtggcgccgacgcggagttggctgagaaagcgcacggatccagaaacaatcgggccccagcgatggacgtgccgagtgccgtggcgccccggactccccccccaccaaagagccctgccgcccccagcaaacgctcgagggacgaggacctggcccccgcgctgccccgcccgccgccgccggcctcgccgcagagctcctccatgcagcccctgatcccggcagcgtgcgcgctggccacgctgccgctcagcggcaggcagtttgcggccagcgcgctgcagcacctcatggacgacgggcagggcgcggccctgcgccacgtctacgcgctgtgcccgacgtgccagcgcatcggcgccgagatcgcggctggttag

SEQ ID NO: 6258 - DNA, 954 bp, Chlorella protothecoides
  modified_base (398)..(407): a, c, t, g, unknown or other
  modified_base (734)..(743): a, c, t, g, unknown or other
atgatcatggaaggggtccagaagtcgtctgagtgttgtgtttacaccaggaggggtggagtgttgctgcatgttctctgctcgacctcacccgccgtcggtcagagtctcgagcaagcccaccatcccattcctcccgcgccgccgcccacctggatccccccacgcacacaccgcagtgcgcgagctggcacccacggagaagctgagcgccgaccaggtggcattcgtgcacctggacggtctgggccgcgtgcccttctccaacatccgccgcccgcgccccctgatggagctgggcggcgggccgggtgtcgcggaggagggcgcggaggccgggccgggcgcgccggcgcgaccccggcgccggcgcctggaccaggagccgctgctggccnnnnnnnnnncggcgggccgggtgtcgcggaggagggcgcagaggccgggccgggcgcgccggcgcgatcccggcgccggcgcctggatcaggagccgctgctggctgcacgcatcatgatcgaggactgcatgtccctcatcctggacgtgcaggacatcgaccagatctttgtcgcggctgcgggatggacggctggggaagggtgtggagaacatttcagtcatgcagcggtgcaatggcacgagagctgggtaggctggatccaccccatgcacatgggcggagtcacggcgcctctgtcagccatcgccgcaccgaccggcgcccgtcttgnnnnnnnnnnaggtggtatgagtgtgcgtcgagggctcattgccagggacggctggggaagggtgtggagagcatttcagtcatccagtggtgcgacggcacgagagcggggtaggctggatccaccccatgcacgtgggcggagtcacggcgcctctgtcagccgtcgccgcaccgaccggcgcccgtcttcgcactcccactccaagcactcccactct

SEQ ID NO: 6259 - DNA, 990 bp, Chlorella protothecoides
aaaaacaaaaacccaacaaaaccaactcaccagatcggtggcgaccaggatgcgcttggcaccctccttgaactccttgtacacggccaggcgcgcggcctggtccatacccgcgtggatggtggtggaggggaagttgcactggcagaggagcttgttcagctcgcgcgcgcgcgcgacggacttgacgaagatgaccacctggttgaagtccagcgcgtccagcaggtcattcagcttccggttcttggcgtcctcgttcagcatgacgtagtgctgcaccaggccatgcagggtcagcttggcctcgtcgtccacgtagatctccatggggtcgcgcatgaagcgcttgcacacgggccgcacctcggccgacagcgtggcgctgaacatcatgacctgcttgtcgtggggcgtgcgcttgaagatggcctgcacgtctgcccgcatgtccaccgactccaggcacttgtcgcactcgtccaccacaaagtggcgcacgcgggacaggtccaggctgccctcgtcagccagggccttgatgcggccaggggtgccgatgaggatgtgcggcgccttctcgccgtccttgagcaggtcgcggtgggccttgatgggcaggcccccgaagaagttggccagccgcaccgacttgaggtaggtggtgaagcgctcaaactcgtgcgtgatctggaaggccagctcgcgcgtgtggcacagcaccagcacagacacctgcccgtccacgggctccagctgctgcagcgtggagatgacaaacaccgcggtcttgcccatgccggacttggcctggcagatgacgtccatgcccaggatggcctgggggatgcactcgtgctggactgcgtcgacggtacaagggggggatgggacgggggaggggggttgggagtctgggggaaggaagaggcccaagtaacatcctgtcgaggtccatgcgcgtctggagggggaggtcccacaaagtag

SEQ ID NO: 6260 - DNA, 2838 bp, Chlorella protothecoides
  modified_base (255)..(264): a, c, t, g, unknown or other
  modified_base (468)..(486): a, c, t, g, unknown or other
atgtgccaggcaccctgtttctcaaaactcatcaacacagaagggtgccacgagcgggtccgcagtggctgtgagggccagcagtcccagcagcacaaagtatgctgcagggacaggaaattttcgaagattattaagtttaccagctcgagctccaccaaccaggttcagcgacccagcatcccgttttgctggtcacagggagtacctccaacttgcctgccaacacggcattcacccagtcctttgggaggnnnnnnnnnnccccagcatcccgttttgctgatcacagggaatacctccaacttgcctgctaacacggcattcacccagtcctttgggaggtacttgaatgccaggaagagactgaagaggacgactgagcctatcagaggaaacttggctgcatcctgtacaaatatggcatggggggatggggtgggggccactcaggcggtctgcagtgcnnnnnnnnnnnnnnnnnnncacccgggcagcccgtcaccagctcaccctctttgtcatggagtcctgtggcgggctgtccttgacggatcgcctgctgccgacgtaaacggtggccgcggcagtggccacgatgttgaagttcaccggcaccggcaggaaaatcggggccaccgccaggccagccaggacggcatggccaattggacagggcaccttcagaggtccttcctcacttccagccatgtcgtgcaggggggtgcgctacgcgtcttggcctcggggtgggcaggcacttgccgcgatcaccaccggctaggccaggatctgcaaagtacccgctggatcacagtatcaggcaccccgcggcatcggggaggggaaggggttgtgatcttgcaccagaatgttgcccaaatcccttgtgcggatctctcgggcaaaggaggtattcaatcatctgcaatgaccccttgcgaaagctggaagaagaatacaccgtaccccagcggcttggacctggtgacgagttggtacaaagcctgttggccgccagactattttggagtgtcctccagccaccgagataaaaattccttacaggagacttgtcgcagtgtttcagagccaacgcttcatgctcttggacctctcctctctcgcacacaatctcccagccgccgtgacaagaaactacgagcggggcaggcgaccaggctcgcggtggccgtgctccgcgccctgccaccaacaggacgaaccaaaaaccgctgtaattccaaccattcaacacgtgccccattcatcggctggatgcaatgcattaggcaggccacttgtagatcaggtggggagggcatcctctttcctggctcgcccgtgatggtgacacggccagtgctccatgctccaaggctatgtatacaatattctaaccctggtggtccctatgcccctcatcaatgtgcagtgaacatcgcagccctcccccgagcttcccaagtggcagcgcagtgcagagctcgtccaccccggcgctttttaggctccagcaccccctcgctccacccaagccgctcccgctcgtccggcatggcgaccctggccacccccactggcggcagcatccgtcaggagctgaccagcctctttggggcctccatctcctccacattccctgatgccggggtgcagccgtcggtggcccagaccaacgaccccaagttcggggactaccagtgcaacaatgccatggccctcttcgccaagtgcaagggcaaggtgagcagcgctgcctccctttgggccccgatccgcccggccgcttcatccgccgcccccacctccttccccccgcgaacagacgccccactccaaacacacacacaccagagcctcccctcccccctttccgccgtgcaggagggcgcgcccaagaacccacgcgccgtggcggaggccatcgtggccggcctccccgcctcggacctggtggagtccaccaccctggccggccccggcttcatcaatgtgcgcctgtcccacgcctggctgggccgccacgtgggcgacatgctggtgtccggcatcgggtcgtgggcgccgcgcggccaggccgggaagcgtgtggtggtggacttctccagccccaacgtggccaaggagatgcatgtgggccacctgaggagcaccatcctgggcgactgcctgtgccgcacgctggagtactgcggcgcggacgtgctgcgcctgaaccacatcggcgactggggcacccagttcggcatgctcatccagtacattgccgacaagcggcccggcggtctgtcggcggccgaggacgaggacgtggccgacctgcaggtgctctaccgcgcggccaaggcacggttcgacgccgacgaggggttcaaggtcgcggcgcgcgaggcggtgacccagctccaggggggccggcccgagtacctggaggtctggcgccgcatctgcgccgcctcgcgcgccgagttccagcgcatctacgaccgcctgggcgtggagctgcaggagcgcggcgagtccttctacaacccgcgcctgcaggccaccgtggacgcgctggtggagcagggcgtggcggtggagtcggacggcgcgcgctgcgtcttcttcgagggccgggatgtccccctgatcgtgcagaagcgcgacggaggcttcggctatgcctccaccgacatggccgccctgcaccagcgcctgaccgaggaacgggcagactggatcgtttacctcaccgacgccggccaggcggggcactttgagatggtgagcgcgtgtttcaagggagtgtgtgtgggtgtgttttggggggggaaggggggaggggggtaa

SEQ ID NO: 6261 - DNA, 183 bp, Chlorella protothecoides
atggccattgtcagccatgacgacctcctcccgctcggcggcgtattcaaccagtactacacggagtgccaggtcatcggcacggaggaggaggactcgcgccttctgctctgcgaggccaccgccgtcgtgatgaggcagtgcttccacctgctgggcatcaccccactgtaccgtatctga

SEQ ID NO: 6262 - DNA, 702 bp, Chlorella protothecoides
atgcatctgctggagcagggcagtctatgcacaccagctgccaagtcgtttgcagctcctggctgccatgtccccagcgcacgccacacatgctcccttgatcccaggcctgacatctctgaggaggagctggaggaggccacctcggccatgggctatggcgccgtcaagtacgccgacctgaagaacaaccggctgaccaactaccggttctcctacaacgagatgctgagcatgcagggagacaccgcggtctacctgctgtacgcgcacgctcgcatcgccgccatcctgcgcaagtctggaaaggacgtcgcggagctggccaacagcacgaagatcaccctgggcaatgacctggaagtggccctggccctgcacgtgtctcgcttctccggtgcgttttctggtggcgagggctggcacgggggaatgcgctgctgtggcgaccggcaggcgctgccgtgtgggagaggtgcagggcgcaggggttgtgattttcatctgcagaagatggccatcgttagccatgacgacctcctcctgcccggcggtgagcattcacgctgtgcactcgaacttcccctcatacgtgcagaggccgtggaggagatgctgacggacctgtaccccaaccgcctcaccagctacctgtacgacctgtctggtgagacccagggggagcgttggtgggtgtgctga

SEQ ID NO: 6263 - DNA, 510 bp, Chlorella protothecoides
atgccctgccctgggactgggtgcactgcagggcacggaccagggtggcgtgaggcacaggatgtggatgacacccgcagccggtgctctctccccgctgggggcgcaggaaggcctggcacagggactgggggcctgctccgcgcctcctgctggcctctcctcagggtgctcagggccttcgatcgaggggacaacgcatcccatgccgtcgccctcgacgcctcgacccgcaccccacccccctggctcaaaggcttcggcaaccacctggcccggcccatcctgcgggagaagcaccggcccgacatgagcgaggaggaggccagggcgctgctgcgcgagtgcctcaccgtgtgctactaccgcgacaagaacagcatcaaccgcttccagatcgcgcgggtgtcggccgagggcgtagacctgggcgagcccttcgccctgcccaccaactgggaccacgcgctgttcagggaccctgccgcgcacgccgtgggcacgtggtga

SEQ ID NO: 6264 - DNA, 435 bp, Chlorella protothecoides
atggctggaagtgaggaaggacctctgaaggtgccctgtccaattggccatgccgtcctggctggcctggcggtggccccgattttcctgccggtgccggtgaacttcaacatcgtggccactgccgcggccaccgtttacgtcggcagcaggcgatccgtcaaggacagcccgccacaggactccatgacaaagagggagggtctagagttctcgttcagccccctggaaatcgtcctgtcggccagcgccgccctgttctccgcctggtacctgaagcagcgccactggtttgccagcaatgttctgggcctggccttctcgcttcagggtatcgagcacttgtccctggggtctgtggccgtcggggtcatcctcctggcaggtaggtgtcgtgttttggggtggggttgggcggagagggagaggatgtag

SEQ ID NO: 6265 - DNA, 381 bp, Chlorella protothecoides
atggaggtggacgaggtgacgctgtcccccgccgacgaggacgaggaggccttcaacgaggtcccctaccagggcccccgctttgaggagctggatgagggcctgcaggccgagctgcttcactacctggacgagcgtggggtgaacgctgacctggcggtctacatcaccgccctcaactttgacaaggagcagcgggagtacacccagtggctggagcgcatgcaggcctttgtggcccagaaggcggatgggccaggcgcagggtcgagggtccaggagctctgcgcgggcgcgcgcggccagcatcgaccctgctccatgacaaatggaaagggtgcacggcatcctgctcgctgcgggcccggcgggtgcgcctga

SEQ ID NO: 6266 - DNA, 402 bp, Chlorella protothecoides
atgggggaggtgcgtcagaatgaaggcgtggtgctgggcccgtcgtggtctcccctggtccttagcagacaacaacatcccaaaggggggtggcgcagagtgtcacacgagttcaatgccatcctcccgcctcccaaccccagcctctgcattccgcccctcacatcgtccctgccccagatctttgcggcggggaggagggcgggttatttccccaaggaccgggaggtgcggatcgaccacgtcggctttggcctcgtcatgggagaggacgggaagaagttcaagagccggtctggagatgtgcgtggggatggaggggaggagggctgtgatgcatcaggcatgttgctcccagtgggccctatttatgacctggtcatcaggtcggctgtggtctaa

SEQ ID NO: 6267 - DNA, 804 bp, Chlorella protothecoides
  modified_base (554)..(563): a, c, t, g, unknown or other
atgaaggcatcgtatcatgatgtcgccactcggctgcgtggaaccctcttgcactgggaagctcatggaactgcactggaatcacctctcgtccctcaggcagtcattcctccctcccgccctctatcgtgtggaaatgtccacaagcgacttcaaggtaacttgacgcccatccatgccaaccccaagtccttgacttccatggctaccggagtgtcatgcctttgcttattggaccacaagtttggaccctggacagtgcacgcaagcgagatcttcgccacctctagcctctcctttgcctttgtgaacttgaagccgattgtgcgggggcacgtactcatctcgccacggcgtgtggtcaacagattcgcggagctcacctccgaagaagtggccgacatctggtgcgttcatggctcatgcacatctggcagggctgaccgtgcaggcactgggccactgctggcccgtgcctcttgcgtgtgctgggctggaactcccggcgtccacacacaggctgactctgcgccaccgcggctccgcccaactgnnnnnnnnnnttgctggcccgtacttcttgcgtgtgctgggccggaactcccggcgtccacacacaggctcactctgcgccaccgcggctccgcccaactgcaggcacctcgcccagaaggtcagcagccggctggaagcccacctgggtgcgagctccctgacccttaccatccaggacggtccccaggcaggacagaccgtgccacacgtccacatccacatcctccccaggcgggctggggactttga

SEQ ID NO: 6268 - DNA, 1308 bp, Chlorella protothecoides
  modified_base (1061)..(1070): a, c, t, g, unknown or other
atggagaagggaagctggggcgatggtgtcgtgatagaattgggaaccgggccggttgcggagtttccgacagggttgttgtcataccaagggaacgcggcgactcgctcgcccgcttcacgacctgaatgtctgcctcatcgcaagccagtcccttgcattgaatacactctccgttctcaccatcacagccctccatgccttgacgggagaggcatcgatcggcccaccgcccctcgtcatgaacgagtcggactttgcctgccccatttgcctcaacctgctctacaaacccgccgtgaatccggtgtgcgggcatgcattctgcttctactgcctcttcagggccatgtccccttacgaggcctcccactgcccgctgtgccggcatgcattcgggcacctgccaggggtgagctggccgagggtgggtgcggggtgctgcgattgcccctttcccagccccgtgcacccccgcccaggacccccgcacctcctcctccctcctggcctacaggtctgcgcggccctggacgcggcactccgactgagcttcccctccagctacgccgcccgtgcggtcgaggaggagggccaggcgtcaggccagggctacagcatccacggcgtcgagcacgccgcccaccctgcccgcctccccgactccctgcgctgctgccaccctggctgccaagcagtgctggccctcccccgcgtcctggcctgcggccacgccctctgcgcagcgcacgctgcacccgaaggctcgagggccgcctggggctgcccgctctgcgctgtgcccacccccctccccgtggcacggtgcggggtcttggaccgcgcggtggccgccctgtgcccccagctgcacgccgctgccgcggccacggagcaggcagaatgcgggcctcacgacacgacgactgcgacgcaggcgtcggcaccccaggcccagggccgctcagcgacgccgacagcggggcccccgggcaccgcacaggcgggcgcgcgggctggtgcggagggtcagggcccggcgacgcaggcccccctggccnnnnnnnnnnacaggcgggcgcgcgggctggtgcggaggggcagggcccggcggcgcaggcccccctggttggtgcccggaccgcagaggcctttgttcactacggcgccggctgcgacgcctgcggccagcaccccatcgtgggccggcgctggcgctgccgggactgccccgcggcgatcggcttcgacctctgtgcgcggtgccacgccagctgcggcgccggggtcgcggtgttgggacggtga

SEQ ID NO: 6269 - DNA, 285 bp, Chlorella protothecoides
atgaggatcttgccgtcggcgcccagctgctttgcccaggccgccatgacaaacgcgtcgttcacagagatgcagccgatggtgtcgacgcccttggccttcagcttgtcagcgctattgatgaagccagggacgtgcttggatgagcacgtgggggtgaaggcgcctggcactgccacaaaaaccacctggggggaaggcagagagggagggctggggattgagcacagggttttcgtgcaaggagaagctcctggggaagcaccctgggcagcgggggcgtga

SEQ ID NO: 6270 - DNA, 423 bp, Chlorella protothecoides
  modified_base (44)..(53): a, c, t, g, unknown or other
atgccctttgccacgctccgctccggagcccctcccccccgatnnnnnnnnnncatctccatggcgacggccgccaccacgggcactgtgggcgccagtctggcatctgccggcaaggcgatggcggcggggggtgccgccgccgacctccccggcgcccagaaggcggcccagcagtttgcgcgcgagtccttcgccatggacatggctgccgacgtgatggactccgccctggagacagatgacctggaggaggagacggacgacgtggtcaaccaggtgctggacgagatcggtgtggacctgtccgccgccatggcgccggccggcaaggcgagggtagccagcgacgcgaaggccacgacgatcacccctggccaggaggaggacgacatcctggcgcgcctgacggctctgaagtga

SEQ ID NO: 6271 - DNA, 1314 bp, Chlorella protothecoides
  modified_base (993)..(1107): a, c, t, g, unknown or other
atgttccctcccaagagggcgttgacatggaagttcaccccattctccagctttgcaccacttagagcatcaaacaggagtgaatggagtaagcatggtcgcgtcaggcacgcagcagcggctgcagcaattttcagcggacttgctgctgcaggaattggagcacccatcaaccccttttatgatggttcccaggctaagaaggaattcgaggctgaaaagagtggccgccggcgcaagtcggaccggctttgggcacccctcccgacggatgacagacctcctgatcctggcgaatgtggcagctttcggcacgcagctcctcaccaagcagggtctcacggtgtggggtgccaagaggtcagctggagggacattggaccctatctctgtgcggtccccttcctgcacctgcaatgcataccacatcctcttccttctgtgcgcagcgcgacacatttgcttcaccctgccatctctgcaggtgaaccagttgattgtggccggtcagtactggcggctcatcacacccgccttcctgcacggcaacctcgtacacttggccatcaactgtgcctccctgaatgccctggggggcaccctggagggactgtctgggcgggagaggctggcctctgtctacatggtggctgcggtcacgggcaacctggccagcttctggggcagcccttcggtctcgctgggggcctcaggtgcggctcgaggttgggatcagggggagctctaggttggtcctcacaatccacctgcagttttcgtatgataatcccggctttcacacctctttgcaccctgagctcatggcatcccttcatccccctcctgccaggggcgatctttgggctcggcggcgccctggccattttcttctaccagaatcgcaatctgtatggccagcgcagcgatttcgtgctcaggcagctgggccagacgctggcgctcaatgtggtctatggcttcgtgagtccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaccgtctggcacacactcccagggggcacctgggcggcctcgtcggtggcgtgctcgccgggtacctgcttggacccaggctgtcgcttgctgagaccgtagacggccgtaaagcgattgtggatgagccgccgctcaggctctttgccagggacccggtgatcctgccgctgccggggggtgggcgtgggagacggggctga

SEQ ID NO: 6272 - DNA, 1182 bp, Chlorella protothecoides
  modified_base (665)..(674): a, c, t, g, unknown or other
atgacgaaagccgctactgcgggtgacgaacccatcggctggtgctatctggatgccagctcccagagccagggaccctttcccctcgactacttgcaacgcctgcaacaggctggatacttccatgccgaaacgcttttctggcgggaggggcaggcggagtggaaacacctgcaagatatccccgacctccacgcctccctggaggcagccacactggcggctgccccacctccagcggcgcagggagcagcagtggatggatcaaccggcgatggcccggcagccccgcaggatgacctgagcaccttcatggctgagatctcggcgctggatgctgagcaggctgatgatgggcccagcaccccaccgcccgaggagcagaccttcactgatgacgatggcacggtctacagctgggacccggccacgcgaaagttcctgccacagggtcaggggggcccaggcggtgctgctgtgcagtataacccagaggacatggtttttgagggggaggagctggacatcccggattttgtccgcccaggagacgaggtcaggacctggtcgagggcctgggtggtgcgggggttgcactctggagcgagaaggaatatgccgagggaagacttggtggtggtcaacctgggttctgagatgcactnnnnnnnnnnggggcctggctggtgcaggggctggcactctggaccggctcacagccatgtcgagtcctcgtcgccaccacagtcttccgcttccgacggagaggaggagtccaagaaaaagaaggcaaagcctgacgccaagactggcaagccagcatcagaggcagccaaggatcccgtgaaggaggagcagccttcgagccgcgaggcactgttggcagaggcaaaggagaaggcagcccagaagaagcaggcgcgggcagccgccagcgcggagtggtttgagctgaagcgcaacaccagcgtgtatgttacgggcctcccagaggatgtcaccctggcagagatggtggagaccttttcaaagtgtggcatcatcaaggaggatgaccaggtgcgatgtgtgttgaattgggatacgaagaggatggatggatcgatggatggatggatggatggatggatgggcagcgtgtgcattgagtgcgccaggcctgggactgcccattcatggtag

SEQ ID NO: 6273 - DNA, 390 bp, Chlorella protothecoides
  modified_base (330)..(339): a, c, t, g, unknown or other
atggtgaagcgtcgtaccgtgcatcaatttgacaaccatgtttggtctcttctcaccatgaagatcgtcgggctgtccgggggaatcgcgacggggaagtccaccttcgctgcagagttgaggactttggggttcccagtcatcgactctgatgacatcgcaaagctggtcgtgaaaaaggggcgatgggcgcaccgacgtatcgtcaaggctttcggcagcggcgtactcacacccgatggtagggcctactgcagacggagatctggggcatatggcatataccgaaatctagatgtctcaattatggaagagcacacctgcactgcnnnnnnnnnncggcctcctgcagacagagatctggggcatatggcatataccgaaacctag

SEQ ID NO: 6274 - DNA, 579 bp, Chlorella protothecoides
atggcgctgtcccgcagtcctttcggaggtcatgttcttggggtcacttgggctggcgtctcccacacttgtcgttgcttgccaagggtctccacgtccctctatacacaagcaatgctacacgctctgcatcacacccctgacattcccatccagatcgtcgacatgccactcctctttgaaacggggttctatcacttcaccagcccccgcctgctggtagctgccggggaggacatgcagcgccgccgcctgatggccagggacggattgagcgaggaggcagccgatgtccgcatctcctcccagatgccactctctgccaagaggaggctggctgacatcgtggtcgaaaatgatggggacatggaggagctgaggcaatccgcacggactgtgggtggattgctgcagcgtcatcgctggctgcacatctgcgatagtgtacgtgtacctgcatggttgccgtgtacacatcgcctcctgtgtatattcgacctggacgcccgatacttcgctgtgtttctcagcatccggattgtccgcggctcgggaccggagtgggtgtcgataccttga

SEQ ID NO: 6275 - DNA, 651 bp, Chlorella protothecoides
  modified_base (396)..(405): a, c, t, g, unknown or other
  modified_base (518)..(527): a, c, t, g, unknown or other
atgggcacgcccggcgtggcgggcctggcgacgcggagcaaccatgtggcggaggtggtggcgacgctgggcatcgaggccgcgcgcgccacggtgatggaggagatcgcctacaccatggggcagcacggcatggccatcgacgcgcgacacaccatgcttctggccgactgcatgacggcgcggggggaggtgctgggcatcacgcgcttcggcatcgccaagatgaaggactccgtcctcatgctggccagcttcgagaagaccaccgaccacctgtttgacgccgcgctgcacggccgcgtggacgacatcacgggtgaggagacgttggggagaggggggcatttgggggggtccggggcatcgagagggtcatgggaagtgcctcgctcnnnnnnnnnncacggcgaggaggtgcgctctcgacgtgggcggccggcgccgccgaccactactggagttctcctccacacagagagcagcctgtgttgggtgcggccccgagcctgcacggnnnnnnnnnnggccggcgccgccgaccactactggagttcacctccacacagagagcagcctgtgttgggtacggcccttagcctgcacgtcggcgccgcatcaaaccgccccgccgccccaccgcaggcgtga

SEQ ID NO: 6276 - DNA, 3174 bp, Chlorella protothecoides
  modified_base (526)..(535): a, c, t, g, unknown or other
  modified_base (1706)..(1715): a, c, t, g, unknown or other
  modified_base (2387)..(2396): a, c, t, g, unknown or other
  modified_base (3111)..(3120): a, c, t, g, unknown or other
atgcttgcgagcacaccagtcagttaccaccaaacaccgtcgacagtccaagggccccgcctcacccgtgaggtacgccagtgcctgcgccagcttggggcgggtgaagaacttgtccttggacgttgttcaccacccccatcagctgcagcgcctccgcccgggcctcctccgtctgcggggtgtgggggtgatggcgtgcagcgtcaggtctggtacatcgcagacaggcagcaccggacccagggctcccaggacgctccaatcccgccgtcgccacccctccccttccccggtcacagcccccctcgcagcacacacctgcggcacgtggatgttcatctcatccccgtcaaagtcggcattgtaggcgacggctggcgattgaacagcacgatgtcgccgtctgggacaggtcagggagagggatatcgtgacagggggaaagtccgggtgtggggctggtttttgtgcatcgtgctgggtagggtgtctattgatcagaaggacaaggctgagcggttgnnnnnnnnnnccgtgagcgggggaaagtccggatgagaaggcaccccgagaggcatggcagcgagaggaatgcatgtgaccaaacctcacatggctcctgatggtgcttcgaggagtgcaccgtactcgtctggcacgcaagggtcgttaccccttcctcctccccagccacccctcgaccaacccctcgaccatcccctcgaccaacccctcaaccaacccctcaaccaacccctcgaccaacccctcaaccccaccttcgaggtgcctctccacaatgtccccgatcttgagctcggaggcgatgcgccgccggtccccgaacctgaggaagaccttgtcgccattggggaagatgacgaaggaggcccccggccagtgcgacgcccccgccagcacccgctgcttcagcttctccatgttgtgcgctgtcacgcgctccgggtaggtcagggtcagggccatgaggcgaggcacgcacacctcgctgactcgcaggttggggtccggggagatgacggtgcgtccggagaagtcgacgcgcttgcccgacaggttcccccggaaccgcccctgcttgcccttcagccgctggaccaggccccgcgttggcttggcccccccggtctggtacattgcgctgaggccggggaggtcgctgttgatcaccgtggcgcagaggaattggaggtagtcccagtgctccatcaggttggaggcgggggcgccggcggccaggtcctggcgcagcgtggcgttggtctccacgatgttggccaggcgcatggtgatgtcgtcctcgttggaccctgccccggcgtccatctccacggaggggcggatgcagacggggggcacgggaaccgcggagatgagcaggtcctcggggcggccggccacgtccagcagctccagatcctatgcgtggggtccgtcctcaacccccaggcgccacacccacacccacacattccgctccccaaaccccccaagacgactcacggcttgtggaatattagtgaagagctggcgcacgcgcagggggttgaggtcgtccatgactctggcaaggttgccacgcagctggtcgttgtactggcaggccatggccaggtcgtcttggatgctgtgggaggaatggggggaagggtgactacgctgctccgcaaagctgggccggnnnnnnnnnnctttccaatggcccacatgtttacgcaaggatgccagtccacactcgcaggccggccggctccctttcagacaaaaagatactttgtgaaacagcagcatcccgataaacacacacgctgcacgtccccacctcccactctggaacaacccgcccgccactcacacgtcagcccgccccttgttccgggtgaaagggtcatggatgatcttgagcgtccccgtgaccttcttcaccacgccgttttccgcgccgcagtgggggcagagcttggtgcgcttgcatcggtccaggacgcgtttgaagacggcctcgcgctgcacgcgctccgtgcgcagcgagcggaagcggcgcaggaaggcgctgcgctcccccgccggcagcagcacgcgggagcaggtcttgcagacgcactgcaggatctgcaccgtgttcttcaggtacccgatgtggaacacgggcagctccagcttgatgtagcctgggaatttccatccacccaaggtggacaccatcggcaccctgatccacctgcttgctgcaatgatccagagcccggaggccaagcaggcatgagaagtgctgccagtgcaggtcaggcgcctggacccaaaacccctgcccgcctcaccaaaatgccctgtgcagtcgctcaggtgctggccgcacgtcnnnnnnnnnnacatcggcaccctgatccatcagcttgctgcaataatccagatcccggaggccaagcaggcatgagaagtgccgccagtgcagttcaggtgcctggaccccaaccccctgcccgcctcaccaaagtgccccgtgcagtcgctcaggtgctggccgcacgtctcgcagatggcgcgcttgttgctcacgcccagccgcccatccagcaccccattgggctgcggccggcgctccggcatctgcaggatggatgggcgtggcggggacctgagcatgctggcgaggcagcaggttatcacagccgtccgggcattcactcgcgcgcgaggcacctgagcccatttccccttcacccccactccaaccccagcatcgcagctgcttgctgcaccgtggaaggcggttggatgggtgggttggggcatggcagtggaagggtcccatcacgtcttcaccatgttccagtcatccctggcactcacatcctgcgggggacattgggctcctcgtacgactccttggaggaacacagcttggagcgctccgcaggacctggcggagcagggcgtgcccccgccatccctcacgggggaggcgccgagccttgcgccggcaactcgctgggcgggggggttcgcctgacacgagcgggggtattgggccgggagctcttcgtcaggatattaatatccagagctgtacacaatcaacagtannnnnnnnnntttcgcctgacacgagcgggggtgttgggccgggagctcttcgccaggagataa

SEQ ID NO: 6277 - DNA, 339 bp, Chlorella protothecoides
atgttcaccatcgacgagatactggaaaaccccctctacagcgaggaaattgagagggatgtcctcgcagaggcgggcaggctgggacgagtggagaaggtcaaggtgtacaagggcaaccccgatggcgtggtgtcgatcaagtttgccacaggggaggcagcagacaagtgtgtaaagctgatggagggccgcttctttgctgggcgacggctggcggcattcatgtgggacgggtacaccaactacaacatgaagctgcaggagactgaggagcagcaggcagcccgactggaagcatttggaagggagctcgaggagggagggaaggagcaatga

SEQ ID NO: 6278 - DNA, 390 bp, Chlorella protothecoides
atgacgctcaaaacgttccactttgccggcgtcgcgtccatgaacgtgacgctgggagtcccgcggctcaaggagatcatcaacgcggccaagaacatctccacgccgctgatgcaggtaagggcgccgggctgggctgggggggcgagagcagcaggccggcgtgcccatggatcagccagtgggaatgatcaaggtgtaacgctgggagtgcaacgactgacaccctgcgccatgcacgtctccgagattctccctcaactcccacgcgccagcaagcctcccttgtcccccacccaaaccaggtcagggcgctgggctgagctggggtggcaagagcagcaggccggcgtgctcatgaatcagccagtgggaatgatcaagatgtaa

SEQ ID NO: 6279 - DNA, 507 bp, Chlorella protothecoides
atggtgcctcagcacgacgatgtgcctgccggctcccagggtccgggaggtgcaggccagggttgtgggccagccgccgaacgcccggccggctctggtgtggcggcggagtatcacgacgccgactttgactggtccgaggcagcagcagaggcagccgccctggtggcatctggtggcggggtttgcgcggcagggtgcgcgcctgcgtgcgcgcctggtgcccagggcggcgcctgccacgcgggtgacgccggcgaggaaggggcagccaccgcgacaggccagcagcccgggagcgagccctgggagcgcttccacgcccagcatgccagcgcccgattcttcaagccgcgccgctacctcctgcacaccttccctgcgctgcgtgctgagggcctgcgcctgctggagctggggtgcggggccggggcgagcctgattcccattctattggccaacccgagtgccaggtgcccccccggggggtgtgcaggctgggagtga

SEQ ID NO: 6280 - DNA, 792 bp, Chlorella protothecoides
atgccgccggtacgcgggggccctgccagcccagagccgtctttgcacacttcagagacggacaccagctcactgagtcggacccagaagaagaagaggcgactcaagctggcgcgggcacaggccgccctcctgctcgaggctggcatcatgcctgaagatgcccccgccggcaagcggcagcgtgcagccctcggcgagcaggcggtgttggccagcagcgagctttctacccaggccagcctgaccatgaccccaggaggcaccaccgatcacacctccccccgtactgacgccgcggccctgaccggcagcagggcaacgccgctgcctgcgcgcccggctcgcgctccccagcccttcctgcccagggccctcgcggcccagcggcccctccgcgccgacctttcttcccaggcggccgtcacgcacgcggcgctggcccaccggcccctcgcggagggcacgggcgaggccgcctcgccccgccgggccgacggcgcgcaggggcctggccaggccggggttgccctccccgggcccccacgttcgcgcctggcgccccacggcaactaccaccgctactacgggtaccgcctgggccaggccttcgaccacgacccgcgcctggcggtgatggagcgctcctggtttgcgcggcgccgctgcatggacgtcggttgcaatgagggcctggtcaccctggccctggcgggttcgctggcctgtaagagcatgagcatggtgggggtggacatcgatccccacctcatcaagcgcgcctgcacgtag

SEQ ID NO: 6281 - DNA, 246 bp, Chlorella protothecoides
atgtccgccctgaagggcttgtttaagaaacccgacccccgcgcccagcttcgcacctcccagagggaggtcacccacaatgtgcgggacatcgagagggaagtcctggctctgaggcgagaggaggccaagactctcaaggtgcagctgggatgctgtcgggaagtcaacatggatgtggagtttgagtgggctcccgggtctgtgcagcgttggcaggaaggcatgcggaccctgggcaaatga

SEQ ID NO: 6282 - DNA, 492 bp, Chlorella protothecoides
atgcctgcttggcctccgggctctggatcattgcagcaagcaggtggatcagggtgccgatggtgtccaccttgggtggatggactgcctgtgcgcagccctgctcatgcacgagtccttgtccagcacctctcccaaccccctctcgcctctcctcttctacaattcccaggctacatcaagctggagctgcccgtgttccacatcgggtacctgaagaacacggtgcagatcctgcagtgcgtctgcaagacctgctcccgcgtgctgctgccggcgggggagcgcagcgccttcctgcgccgcttccgctcgctgcgcacggagcgcgtgcagcgcgaggccgtcttcaaacgcgtcctggaccgatgcaagcgcaccaagctctgcccccactgcggcgcggaaaacggcgtggtgaagaaggtcacggggacgctcaagatcatccatgaccctttcacccggaacaaggggcgggctgacgtgtga

SEQ ID NO: 6283 - DNA, 1989 bp, Chlorella protothecoides
atgggggtggtgaacaacctgtgtacacccaagaacggggagatcctggtggcagcaacccaggattttctgacctcggcctacctgctcacgtccaaggacaagttcttcacccgccccaagctggcgcaggcactggcgtacctcacgggtgaggcggggcccttggactgtcgacggctgtttgtgagcctggagacggcggagaagatctacaccaagcagggccagcacatgtgccccgcggacggctacgtctgcttccacaactcccacctcatctgtggccgcctgggcaaggtgacactgggcggcggcaacaaggccggtctcttccaggtgctcatggccgattactcagcagccgtcgccgcagaggccatgtcacgcctggccaagctgtcggcgcgcttcatcggcgaccagggcttctccatcggcatcgacgacgtgaccccggcgccggagctgcagcgcgccaaggccgccacgctggccgcggggtacgggcagtgcgacgacttcatcgccgcctacggccgagggaagctggcgctgcagccggggtgcaacgcagaggagtcgctggaggcctcggtgaccggggtattgaacaacatccgggagcaggccgccaaggtgggggcgctgggtgcttgtggtttgggtggtggcatccactttccatgcctgtcgcctgtggcgtctccccccccaccacagcaccctcctgccccatgccacgaccccctacccaacgcacccccaggtgtgtatggcgtcgctgcaccccctgaactcccccctcatcatgagccaggctcccccatcaacatcgcccagatggtggcctgcgtgggtcagcagtcggtgggcggcaagcgcacgcccaacggcttcaccgaccgctcgctgccccacttcccgcgcggcgactgcacgccggcgggcaagggcttcgtggccaactccttctactcgggcctcacccccaccgagttcttcttccacaccatggcggggcgggaggggctggtggacactgcggtgaagaccgccgagacggggtacatgtcgcgccggctgatgaaggcgctggaggacctgtacgcgcactacgacggcaccgtgcgcaatgccgcgggcggcgtggtgcagctgcagtacggagaggacggcatggaccctgtgggcatggaaggaaaggacggcgagcccgtggcattccagcgcgtcctggccctggtcaaggccacgggcgccggcgccgctgggcgagcgggaggagcggggatgatggccagcagcgcggccagcgggggcgtggccagcgtcgccacgggcgccagcgccgctgggcgagcgggaggagcgcggacgacggccagcagcgcgaccggcgggggcgtggccagcgttgctccggcgagcagcgggggtgcccatgacgctgcacagcgggacgcaagcgaggcagcgacgggcgggcccgagcgagacgcgagcgcagctgcccagggcacgggccatggcgcgacccatgacgcgaccggctccccccgcaggcctcgggaaggtggcgaaggggcggcaaaggaagaaatcgccgcgcccggcgcgcgcctctccacgcaggcctgcccgctccccgcggagctggaggcggcggtggcgcaggtgctgggccaaggcacctttggcgagggctcccccttctccagcgccgccttccgcgaccgtctggcgaccttcctcgccgagcaggtcgctgcgctgcgcgccgcgcgggcacgcctgggcctgcccgccgacgcgcggggtgctggccacctggagcacctcgtgcgcgtgcaggcgctgacgcgcgaggcgctggcagggttcgttgcgcagtgcgccgcgcgctacgagcgcaagcgcatcgagcccggggcgacggtgggggcctttggcgcgcaaagcatcggtgcgcggacgggagatgaatga

SEQ ID NO: 6284 - DNA, 189 bp, Chlorella protothecoides
atggcctgccagtacaacgaccagctgcgtggcaaccttgccagagtcatggacgacctcaaccccctgcgcgtgcgccagctcttcactaatattccacaagccgtgagtcgtcttggggggtttggggagcggaatgtgtgggtgtgggtgtggcgcctgggggttgaggacggacccctgcagtag

SEQ ID NO: 6285 - DNA, 504 bp, Chlorella protothecoides
atggagaacatccacaagctgcagctgggcctcaatgcctccaccgtgaagctggccctgatggaggcgcccaaactcaagctgaaggccgagcacatcctccgtcctcctcaccctgttccccccacccgcctgcatgacctccgtttcagcaccctcggtgaggaccagctggaggtgcggccgccgctggagccggctcgggtgcccgtcctcttccagctgcagacgctggagaatgcgctgcccggggtcatcgtgaggggcatccccacggtggagcgcgccgtgatcaacaaaaagcagggcggcggcttcaatctgctcgtggagggcaccaacctcgcggtgcggaggaggatggggtggtgctttgggcccgaggaaggggggaatggtagatcaacgacgccacctggtggggcttgctgtcagccgctgtgggagtcatcgagccctgtttgcgtgtccaggataaggtggacgcttgacagcacaccgtga

SEQ ID NO: 6286 - DNA, 267 bp, Chlorella protothecoides
atggcccccctaaccacctacttcaaggatgaggaggactgcctgggcttccccatctgggtggccgagctggagctgatcgtggggagcgcgaggggatcctcccgccccgacagcatcgcctgcctggccctgctccacaagctggtcgccaccctcgcccgggcgggccgggaggaggtgcgggcccaccagcggcgctgcgaggacgcggtgctccacgtcctgctcaagggcgccccgccctcggtgagatcgagcgggtaa

SEQ ID NO: 6287 - DNA, 180 bp, Chlorella protothecoides
atgacggtgtcgcccgccaagttcgagctcaagggcgagggcttcaagcccaagcagagcgccgggaacaaaaaacgtaagaagaaggtgctggagtcgttggagaagcaggccctcacctgggacggcttcgatgacaagctggcgcccacccaggtctggttgtgcggtgggatttaa

SEQ ID NO: 6288 - DNA, 672 bp, Chlorella protothecoides
atggccacggtcgtcaaggacgcagccgaggctgtgcgctctcgcctgaatgccgtcctggcaggagttggggaggccccgagcaccctgatcagctcctcccccgagtggaaagcgctggaggcgcacgcggtggccgtccagaagctgtgcgtaagggtttttggggtttggggtcagaggaaccagggcgcgctcccccccgaaggcgtattcccaacccccaccacccccatcaggcatctcaaggatctgctcagtgacgatgcgcggaccaccgccctgacccgggaggccgagggcctgtacctggaccttgcccgccagaatgcaacccccgaaacgctgcaggtggggggtggggccttggatgctttgatgcagggccatgcacagagcaggcagcaaagaaatgtgaaaatgattcatgtcgacattgcagagcctgcatccgtcagcagcattggtgcacagtctatcattaactccagcaatgtgcgtgcccccatgcagctgctcctggcgctggcagagaaggcgggtgtgaagaccaagatcgatgccatgtttgcggggcagcacatcaacaccacggaggaccgggctgtgctgcatgttgccctccgcgccaagcgcaatcaggttggcggctgtggtatgtctttgctgtaa

SEQ ID NO: 6289 - DNA, 936 bp, Chlorella protothecoides
atgcaccatccccctcgtcaccttgccgagctcgacgccccactggtcgaaggagttgatgccccagacgaaaccggaggtggccacgcggtgctcgtagagcgccagcagcttgcccagggtgcagggggtgaggtcggggaggagcaggctcaggctggggcgattgccggtgaaggtcttgtgggggatgagagcctggggaaccccctcgcccgccagggtcgcggcatccttgcccagggccagcgcgtcgggctgggcgaagaagttgcacatcagctcctcgtggctcgacaccttctcgccctgtgggagaagagaacgggtgcacgggttggacgagctccaagaaagcgcggggcggcggcatggcgatgtgcccgacacgatggcaatgaactcggcggggatgaccctcccctggtggatcagctggtagaaggagtgctggccgttggtccccggctccccgaaatcaatctcgcccgcaccgaacgacacgcccttgccgttggactccatggacagctgctgcacgtggggtgcaaagtgcgccagcgactgctggtagggcaggatggcggtggtggggtggcccaggaaggtggcgttccacacgttgaacaggccctggagcaggggcaggttgctggagggcggcgcggtgcggtagtgctcgtccatggtctgcatgccgtccaagaaggagcgcacgaccccgaagccgtactgcaggctgagtggcagcacgccgacggcggaggagaccgagtagcggccgcccacccagtcccagaagccaaaggtgttggcggcgtcgatgccaaaggcaccgacggccggcaggttggtggacacggccaccatgtgcttggccaccgcctcctgaccaagcgcggccgtcagccaggccctttggagagaggggggtaa

SEQ ID NO: 6290 - DNA, 336 bp, Chlorella protothecoides
atggaggcatgccggccctcacagcatgttatctggcagcattttcatttcaaacggctccccaaccaggtgatcaccgatgccggcaagaacgtggtgcccgaggtctgggaggtcctggataagatcaaggcgttctctgagcgggtgaggtctggggagtggaagggtgtgacgggcaagcccatcgacaccgtcgtctccatcggtatcggcggctccgcgctgggtcccctctttgtccacaccgccctcgccacggcccccgaggccgccgctcaggtcggtaaaactttggcattcaatgcaactgccgccctcctgtgcatgccatga

SEQ ID NO: 6291 - DNA, 4350 bp, Chlorella protothecoides
  modified_base (146)..(155): a, c, t, g, unknown or other
  modified_base (1302)..(1311): a, c, t, g, unknown or other
  modified_base (1912)..(1921): a, c, t, g, unknown or other
  modified_base (3035)..(3044): a, c, t, g, unknown or other
  modified_base (3774)..(3783): a, c, t, g, unknown or other
  modified_base (3850)..(3859): a, c, t, g, unknown or other
  modified_base (4319)..(4328): a, c, t, g, unknown or other
atggccttcagcgccgaaatcaccccccgaatgtttcgagtgcgcgcacgcaccgtcacaccctccatgccgggccgatgatcggcactcatcacccacggtgaagggcgggattgcggcgtatgcttcgcacgagccgaagatannnnnnnnnntttcaccatcatcaccgtcacctcgtcatcttacaagatcggcactcatcacccggtgaagggacggcgctctctatgcttgggagtgtggcggaagctgcgacgcgcttcttggctggcacacgcaggacctcagacacaggccagtcgcgcgggaggagcacaaaagtcggacatgagacccctcctaggaaaaggaatcagtttctttggaagataccccagcctgcgccccgcctttccgacaacgccagggcaccacagcgcagccgcacagcgcgcctatttgtccgggaaaccccccgtccacgggaagctcgcatcaaatttcagcatgtctgccgcatcaaaatcgttctcgaccgtggtgctggggggaggagtggccagcggctacttcgctcgggagtggatcaaggaagggggcaaggggagcgatctcgccatcatctccgatgacacggtgagcaatactgaattcgtggtgaagtggagtagatgtcatcaaggacccgaagttgacgctccatgcgcaccgtgcaacttgcaggttgtcgcctacgagcgtcctgcactgagcaaggcctacctgttccccgagggtgagctggtcttgcatgcgtgcaaccggtcgtgtgttgagagtgaatttctgaattcgggcgctcagaatatatttgggtggatacctacatgtctgccagcgctccttggcacctaccaaccaacacctgaccttgccatgctccaggtgctgctcggctccctggattctacacctctgtgggtgtgggcggggagcgtcaagatccgacctggtactccagccacggtgggaggcttgctgatgggcatcgagtacctgacggagacagcaatcaaatcgaccgacctgaagaacaagacgctcacgactgaggatggcaccgccatctcttttgagaaactcgtcattggcactggcgctcgggtgacccggctggaggacttcaagactccaggtgctgaccttgagggtgtctactacctgaggaaggtcgctgatgccgatgctcttttggagggcatcgcagaggccaagaagaaggggccagatgttaatgtgcgtgcggttggagctgggcgggtttgggagactgggcatgcnnnnnnnnnnaagatgttaacgtgcgtgcggttggagctgggcggatttgggggactgggtagtttattgttgggattaaaagcgggtttgtcgattggagtttggaaacctgtctcggcgtgtgtatcattgtctctgctagctatcgtcgatcaggcatgctggggttggacaggtcatactcctcctgtagctcacggattggaggctgggtgtctgagcgttcatgccgtgcactctgtcgccctcgcactggggttggcagggctgtgcaccagtcttgtggcatgcccagatgctgaagtttgtccctccttgcgcggcgctgcgtggctggcggccttgagcctgctggcctataaagtacatcatcacatcatgtactctgccaacacacaccacctcaggctgatggagcggctgctgacccctgagctggctggattctacgagaagtactacgaaggcaagggcgtcaagctgatcaagaaggatctggtgacggccctggagggcacagacggcaaggcattaggctcaagcgactgcctgtacttgtgtcccagcgaagggggactccgaggatgctgcacacgccaacacaccgtcnnnnnnnnnngctgggggcattcctgtgccatcttggaaggcacaggcattaggctccagcgactgcctgtacttgtgtcccagcgaggggggactgcgaggatgctgcacacgccaacacaccgtctcgggtgcatgtcggagtcctccccttgtcggcgtgctttgcctccatctccctccccggttgttgcccatcgcagcacaccctctgacagtctccccaacccttttccccttcatccttcaggtcaccaccgccgtgctgaagagcgggaagcgcctgccggtggacctggtggtggtggggacgggcgcccggcccaacgtggagctgttcaagggcgccgtggacctgctggagggcccccctggtggcatcaaggtggacggcaggttgcaaacctcggcgccaggcgtgtttgccgtgggcgacgtggcggccttcaagccggccttcacgggggagctcacacgccaggagcatgtgaccaatgcaagggtggggacggagcactcactgatccaggatggggtgccagagcgcggcgtgattggggtctgaccaccttggtggttgccgcgcctaagccaccagcgcgctcgacagggctgactggggcgtacgtggcccgtgagatcctgaccccgggcactcagcccgagtacgactacctgcccttcttctacagccgcgaatttgatctgtcctggcaggcgaaagcggcacttgctgtgagacagctctctgtgctctgcaacagtgtgtgccatggaggcgacaccctccgggtgggcccaggaggaaagagggcaaaggggggggtaggagtgcaggagttgagattgcactgggatgcaatggactgtgcaagaccgtggtacgaagcaaaagcggcacttgctgtgaggcagctctctgtgctctgcaatagtgtgtgccatggaggcgatgccctccggggggaccccgtgcactttggcgaccagtccagcggcaagtttggcgcgtactgggtcaaggatgggactgtggtcggcgctttcctggagagcgggagtgagggtgccggcatggggcgaaggtcgtacatgtcctgtgctggctctggtgtggctggggnnnnnnnnnngcgaggcaaggcgcacctcctctcccatgctcaaagagaggccgcaaaggccagaccctgtgcctggaggtcgctgggggccttggccttggtctggatgacttttttgatggccgcattctcctctgcaggtgggcgtggggagggcccgatgaaccgaagcagtacacgcgaaaaggccctgcaaagatgccttttccctggcgcacagtccgtcccctatccatctgcctgcgcctccccccagccacaccagagccagcacaggacacgccccggcagaactgcgccattagcagccatccagcatcacacctcgtcacccatgtaccctcatgttgactggctgttctgttacacaagaagcatcatcttctcagaacggtggagaccgcagggcacagagtctacaggaattcatggcaccaggcaagaccaggggctcgtacgtgctgtctccgcctcagcgagactcctatgcgaagacgtcgatgggcagcgatgcgccgttggtcgtgaagctgcagggaatgcggggtatgggatatggcagcagccacccggcaaggaatcaccccttcacccacttgttgtgccatgggtcgccaatgtgctcaaacaggttggtgatggggcccttgccggtggccttggcctgggcgacaaagcccaggaaggccagctgcagggagcgaggagggggggggggggcaatggaactggggaacannnnnnnnnnaccaggggcagcacccacccggcaaggcagcacccattcacccacttgttgtgccatgggtcgccannnnnnnnnntcgcgtccccccccctcactcctcccagagcccctaccattgccagacggccattcttgatctccttgagcttgagctcattgaggttcgcctccgaggtgctgcaaggatgggaggcattcgcgatcagaccagcggatgtcagcaacatcctgggagcgtgccatgcacatgtgcaacccttgtcgccatgcacgacaacagagcatactggacccctccagccctctccgggaaaccacctacttggagaagcccagggggtcgaagatgtggccggggtacccagagacgccagtccccttgaactgaccctcgaatcctgggcaggatgtcatgtgggggctcaggggatgaatcaggcgcagagtgcgatgacgctgggaagtgtgccaagcgtccccgactcaggtggccatcaagcacacaaccccttcccacagcagccgcctcacccagnnnnnnnnnntacgccagtccccttgaactga

SEQ ID NO: 6292 - DNA, 4059 bp, Chlorella protothecoides
  modified_base (602)..(611): a, c, t, g, unknown or other
  modified_base (1170)..(1179): a, c, t, g, unknown or other
  modified_base (2995)..(3004): a, c, t, g, unknown or other
  modified_base (3190)..(3199): a, c, t, g, unknown or other
  modified_base (3352)..(3361): a, c, t, g, unknown or other
  modified_base (3859)..(3868): a, c, t, g, unknown or other
  modified_base (4014)..(4023): a, c, t, g, unknown or other
atgcaggcttcttgggactgctgccccacccctgtccttcaatttcagcctctcatctcacgaagtctcagtcgggctcgacgctgcctctctctgagtgcgcccccctcccttcatgcgcaggtcccacctggagaaagccatctcccagcatgggggcatggcggtcgtgctggcgaggctgggatgggcggccgccaagcgggcccggaaaccgcgtggctactggtccaacctggagaatgtgcgcgccgagatccgcgccttcatcatcgagcaccacctgccagagggactctcacccctgcccgcttcgtgcccgtctcattggagcgcgcttgcatcccatcaccgccctttgcccgattcctggctctgaaaggatcacacaaccccacccctgcagcagccccaggcccctcctcaccccctccagctctccatcccgctcccaccaggcatcatgccgcacaagacgacgttcgtgcggtgcggcaggcacgacattgcccgggcggtggagcgcttggggggcctgcaccacctcaccaccgcgctggggtacagcaatcccaggcctgcaggggccggcgcgacgcagnnnnnnnnnncgcccgggcggtggagcgcctggggggcctgcaccatctcaccaccgcgctggggtacagcacccccaggcctgcaggggccggcgcgacgcagtggcaggcacatgtgtccaaggtcgctgccgtcaccaagctctccggcaagcaggtgcgtgggcggggcgggttcctggccgccatgcacgtgcttgctgtgccgccgcccgggtcagggaggggtgagagggctcctgggccgactgccctgaccctgccgccacccacaggggctgtttcacgtggcagcatgcacatacgacaaggagcccaaggaagacgggcaggaccagggggagagcggggtgtcgtagctgggcgcagccgtcgctccgcaccggggcggtggggcccgcagcgagccgggttcccgcggagccgatttgccgatccctgtgccatgaatctgggtaccgtgcccacctgcagtccagacgaggccagagcagggtgcttgggcgagaacagggcgggccggggcgaggcgcggggtcacttgcatcacacccttccaatcagagtnnnnnnnnnntggtgccgatttgccgatccctgtgcgatgaatctaggtaccgtgcccacctgcagtccagacgaagccagagcagggtgctggggcgagaacagggcgggccccggcgaggcgcgggttcacttgcatcacacccttccaatcagagtgtgggtgcagacatgtaaagagagggagagtgccggggcccatgtccctgctcactgctgtgcactggctgcgctcctgtttgcagcgggcacccatgcgccatgcgcacggccgagactcggaaatgagcgcggcagggactgggttgccaccagtgcgggggtggctgcccgctgcacgccgaatcttgttcagaactgcattcccagggtgccgctcatcccgacagatcctcggccaggctcgcacaccacggccctgaagatgtacatggcaatgccggtcctccccggaatcacaagagggggggtgtctccatctatgccttcccacttcgtcattcttccacaggggaatctcctgcaccccgtcctctctcttctgcctggacagcctctggtgttccgtgccacagcagccttcgtgtcggcggcccagagatcgctcctctcctcacaccccgctcgcgtgctgggggtgcagggacaccgagaccaccgcgctgccgtgcaggaaggcctggcgcagcgtccgctgccgcgcctcctgccaccgcaccgtgcggccatcgcgcttgccacgcatgaggacggtgtaccgctccgagacgtcccgcagcacgaggttcagatgcttgtcaaaggctgcgagcctccctggtccggcaggaaggggaaaggtgtgtggaaaggtgggcgcgtttcgtgctgggagagagagatttgcctggggcatggactgagatggcttgcgtttggccccagcagcagtgcctgcaggctgccaggcagctctgaccacgcgctcgccaaccatctcacctgtgcatcgcccacgcacaccatgggcatggcgtgtgacgaccagcaggggcgcaccgcttgccatggcccccttcaggagcaggagggggcctccagacacgccgttggagatggcatccagcgggtggcaccaggggagcaaggcattggcaccattcccactcctgacccacccaccccgcattttgtcagtccctgcagcagggagaagcccacctcgctgatcggagggctagctgatgctggtacgagcgcctgctcacgcgggcctccgactcattgctcgcggatcgtacctgcgaggagatgcggtcccactcagcgatcatcgcacaccggctgcatgcaacctgatgccaggcaatcgactcacggttgccggggcaagatagtcttcgtgatcagtgggcagcagcctccggtacgagtacagattgttcagtggctgggcgcttgggacgggcggcaggcaagtatcggaggcaagcgcggcgagcggatcgaagtgccgcgacgcaaagttcaggctgctgccatgcatgcactcagggtgcctctgggagtgtttcacacaaaggttgtgccatcccgagtcgactgtgtcatcaggcctgtacagatggtcttcctacttcttccgcgctgccttctccaccaagccagagatggcaaagcgctgacgcagtgttgcgctcacctcctccaggctcactccctaggaggggagaatgaaaagcatgcatggcaaacgatgcagaacgtcttgctcgtggcaggtatcaatggggttatgaaacgcaggcgcccatcggagcccactctgatccacccgcccgacgtcnnnnnnnnnncttggaccgccaagctgctgagcaaccccgagctgctgtgcagcaagattcgcgaggaggcaggggagctctgtgccacatgggaggaggacgagggtgaggtggtgccggaagcaggcagaggacgtcgggcgggtggatcagagtgggctctgatgggcgcctgcccgacttgtgcagaatgcnnnnnnnnnntgagcctgagtttttggtggccgttggtctgctcatcccaatcggcgcaaggaaatgtgtatgcgccccgcacgtggcatgacgcacgagccattgctatgcctgtccgggtctcaagcatcaccatggtctcccagccggatacgccgcagnnnnnnnnnnaaagcctgagttttggtggccgttggtctgctcatctcaatcagcgcgaggaaatccggatacgccgcagcccgctcaccctcgactgcggcctgcgccctcctatcggcgatgatgcgctccagcgcaaagagggtgggcagcggcgactccgcgcgggaggtgtgggtgcctgcctcgcgcactttcccgtcctcctcccgcttcagggtcgtgaagtagcaggtgggggcattggtgtgacaggccgggccgatggggtcgcccacatagatcagggagtcacgatcgcagtccaggtggacactcagcacctgcgcagggcgttgtgtggtggtggtggggagcaggatacctttgaatccgttgtggagaggcgacaggcatcaaccatggctacaaaaggggcaaacatgtggcatgagacccccctttcccccaaatacacacggtcgctcgactttatcccacaccttgatgaagtgtccagaggtctcnnnnnnnnnntttcccccaaatacacacggtcactctacttcattccacaccttgatgaagtgtccagaggtctcgcccttacaccaccggcccttgcgagacctgctgtagaagggagtgagcttggaggaggtgagcgcaacactgcgtcagcnnnnnnnnnngcacagtcgacttgggatgacacaacctttgtgtga

SEQ ID NO: 6293 - DNA, 486 bp, Chlorella protothecoides
  modified_base (413)..(422): a, c, t, g, unknown or other
atggcactcgttgcgccgctgtcccgcccatgccccagctactccagcgcgggacacgcatgtatggcacccagccccttattgaatgtgcatcggccacccccgaccgcttcaaatgcaagacgcgtctctgtcagagcgtgtgccgcccagggccggaatgggacggcacaccagccttcagtactccccagcctgaagtgggacagcaagggcctggtcacagccatagtccagcatgtggagactggagaggttttgatgcaggcctttgcagacgaggctgccgtccttgagaccctggagaccgggcaagtctggcaggccatgggagcaggggtggaagcacaagcatgtcacaagcctgccaattcaagtggtagcatgttcctgagtcggtctatccctgcgcnnnnnnnnnngggtggcttggtcggacctgtgggaactcgtgcatccgattctgcccatgcatgtcggggttga

SEQ ID NO: 6294 - DNA, 813 bp, Chlorella protothecoides
  modified_base (476)..(485): a, c, t, g, unknown or other
atggcgagctcccgagcactgtctctgtctggcggtgtgcgtgtcgcccggctggttcaccccgcgacacatcccgtgctgctccctgcccggaccacatggccgcctgcattcggcaggcggtcatgcatgcgaagcatggccaccgcgactcccgccttggagagcgagcagcgggatgtggcctcccatgcaggggatgctccagccgtgcaccggccgaccatggagccgggggccttccagcgcctcccaatcgttgcctccgccaaggagctggtcaggacctctgtcaggcgtgcttcacgggttggcaacaataacaagctcaagaacgaggctgccaaggcccggaacaggtgcgctgcgggcagggcgcagcgcaccgagctcagaagggggatctcgacgccatggaaatgtcttcaccgcatcctacgtgccctgctggactccccatcccgcctgctgctgcnnnnnnnnnnaaatagggcctcacgtgccatggacacactgatgaaggagatgtgtgggccactgggccagtacaggagcggcttcccctccagggagcgtctgcatccctttgatgctgcgctgcttgacctgacggtgggggccgagcggtatcgcaggaccctcgcacagctggaagccttcaagaagacagctgtgcaggtgagtgtgtggccagggcgggtgacagggctgaaggtggtaaggtgtggagccaggtgtgagcctgggggcacagaattgtcccccacccaagtagatcgtcctcttggaaccctgcctcacccgccctggtga

SEQ ID NO: 6295 - DNA, 870 bp, Chlorella protothecoides
  modified_base (161)..(233): a, c, t, g, unknown or other
atggggttgcgcgccagagatgcgagactcagaattcctaccccgatgagcagtgggcctgcaaaatttggagccgactcagcctctcgggagatgtttcggcaaagcgatctcctgatcgctaaaagccgtcgcatttgcaggtgtcgaagagaggaggnnnnnnnnnnnnnnnnnnnnnnnnnnnnnnnnnnnnnnnnnnnnnnnnnnnnnnnnnnnnnnnnnnnnnnnnncctgtgcacatgcgacccacgacaccaggagctgctgatcctgatggtgcaagcaagtgaacccctcaacgaaatcaaaatatttggcggggccatctccgtgcctctgccgtctcggctccaggatgtctcggacttcaggccagtccccgaccaccaggaggtgagggctgtggtgagtggcctggacggcctcatcgactcgattcctcttggcgagatgcacagcccccaaccccacacgccacccaccgagcagatattcaccgatgcagcgcgggaccagagcctgatcgtggaggtcgtggtgagggcatcaggttcagggatggtgggcgtgcatcaggcgggtcatcacagcccaccaaccgcccatgcacattgccccgcccaggagtttcaagaccaaccagacgaggacgccgctggatttttcttcaaggacctggcagatgtggggcaggcggtctcctcccggctggacagcgtccagggtctgggcagcagggatgtgccgccccttccccccagcctctacgtgtccttggctgcaggccagcacaccgtggcaaagtcaggcgcggcatccgaggcgcttgcgatacaggtgcgtgctgcttggaccgtggtgtggtga

SEQ ID NO: 6296 - DNA, 447 bp, Chlorella protothecoides
atgctgggcgtggcgggcatcctcatccctggcctgctgaccaagattggcatcctcaacgtgccagagtggtacgatgctggtctcgtctcgcagcagaactcccccatccccttcagtgagcaggtttcgtggtgggaggaagttcacccgtcgcgcgccagctctcagggaatgatgccagtgtgtaacctgctccctccctcccctcaacccacagagcccctgctcctcatcgagctctttgccttcaactttgtggagctgaagcgcctgaaggacatccagaagcctgggagccagggggagccaggctctttcctgggtgaggcggctgctgtgggaaggggtagtgtgcttgatggccaccggagtcagggatgcttggcacacttcccagcatcatcgcactctgcgccttgcttcatcccctgtgcccccacatga

SEQ ID NO: 6297 - DNA, 489 bp, Chlorella protothecoides
atgccagacggtaacaagacgggaggaggccctggggtgggcggtggcgacatgcatcgagggaaggggtatgctccagatgaagagttggcatgggctgcgacggctgagggaagcagggaagagagccgcggcgctgtgtgggacgtgctgctggactttgagcgcctgccgtcctttcttccaaatctgacggcctgccaggtggtggcccgcccccacgtgggccgcctgcaggtcctgcagcgtggcagcgcccacagcttcctctggcacctccaggcccaggcgctgctggacctggtgctctggcaggacggcgtgggggtgcgcaaggccaagttccggatggtggagggcgacttcaaggtgggctggcggtgtcgaggggtgggactgagttggaggggcggagccggcatctggtgccagggaccggcaccaggggcagagctggctccggggctccatcggcctggcgtgggctga

SEQ ID NO: 6298 - DNA, 429 bp, Chlorella protothecoides
atgctccccgtttgccctggcgctcgagctgctatcccgattggccagaccacaaagccttccttctccgccgacattccccctcccacccccctccacctgcttctcggacaccgtttgatcccacagggagcgccccagggcgtgcaggtgcatctgcgacgcctggacgagctttcttcactgcatcgccgcgtggtcgccagcgtggccgtccacgccccccgctccgtcatctgggaggccctgacaggctacagtgacctgcccggcatcatccccagcctggagaccagcgaggtgctcccgcggcggcccggacccgcgcatggtctcctccgcctccgccaggtcggtgctggggcgctgcatgcagtggcacccgcacacccacatccctcgcgcatcggcgctgggacggaagcatga

SEQ ID NO: 6299 - DNA, 441 bp, Chlorella protothecoides
atggagcggctgaccctggccaccctcctgcacctgcccacctctgtggtgttcgtggccgacctgacggggcagtgcgggaccagcgtgggcaagcagtgggccatcagacccatctgcactgactctcgggccccgaatcgccacaggcaagagctgaaggcgcgatttcccaacaagccctggctggatgtgtgctcaaaggccgaccttttggaggccgagttccgggtggccgatgcccatcgggccgggcagggcaccacccagccccctgaggcgctgaccacggcggtagagtgggcagtgcacgtgccagaggcgctgcgcgtctctgccaccacagagcagggactggacggcctgaaggttagcctgagtgacacggtgcgggcggcgctagagagtctggacgcctgggtggatgccgcggaggtctga

SEQ ID NO: 6300 - DNA, 282 bp, Chlorella protothecoides
atgccccaggcaaatctctctctcccagcacgaaacgcgcccacctttccacacacctttccccttcctgccggaccagggaggctcgcagcctttgacaagcatctgaacctcgtgctgcgggacgtctcggagcggtacaccgtcctcatgcgtggcaagcgcgatggccgcacggtgcggtggcaggaggcgcggcagcggacgctgcgccaggccttcctgcacggcagcgcggtggtctcggtgtccctgcacccccagcacgcgagcggggtgtga

SEQ ID NO: 6301 - DNA, 2658 bp, Chlorella protothecoides
  modified_base (793)..(802): a, c, t, g, unknown or other
  modified_base (1033)..(1042): a, c, t, g, unknown or other
  modified_base (1525)..(1534): a, c, t, g, unknown or other
  modified_base (2036)..(2045): a, c, t, g, unknown or other
  modified_base (2629)..(2638): a, c, t, g, unknown or other
atgcccgaggtcatggccgagtacgagtctggtggcggcccccccgaacgcggcgcctgctgctcctgccgccccgaatccctggcgcgctgggtcaacgccgcgcgcttcgcctgcgtggcctcgctgggcctggtggccgcggccagcccctgggccctggccacggcggaggcggtgaccatgacgctgctgtacgcgctgacgctgccgcgcaaggcgcgcgacgcgccctacgcctttgccgcctcggccgaggacgtgctggcgctgtccctgctccgcgccggcctggtcctggtgtgccacttctgcggcaccggcgggctgcaccagcgcccctacctctacgcggccaccgtcctgggctgcatcagcctgcccctggccatgttcaagaccgcggcgctggagcagggacccctgccccccgccaagcaccccgctttcttcctcttcttcctgctccacgccggcttcgcgctggcgcacatggttgccgcgcgccaggtcagcatctgggcgcggcggcggcaccgcctcggactcacgggcctaggctacccctgggaggagggggaggagacctggctgctggcgggggagctgtcggcgcgcgccgagctggacgccctccagctcagcgccgaggacgggggcgcgttgcttcaggctagcgactccctcttcatgaccgactgcctgggggtgacggtacactaccgcctggtgcacccgcaggtgggagggtgggagggggtgggtgagtatggaggggagagggagggggatnnnnnnnnnnacactaccgcctggtgcacccgcaggtgggtgggtgggagggggtgggtgtgtgtggaggggagagggagggggggagcgggaggaacggcaaggagggggcttgacgtgctggtggattgtggctaccgcctggattccaaggatcaccatctagcaggctccagtgggtgcactgcgtcaccaatccccgcccctcccccccccaaaaaaaaaaaaatcttcaacccgnnnnnnnnnnactgcgtcaccaatccccgcccctcccccctcccccccaaaaatacaatcttcaacccacaggggcagcctcgggccacgtccacggtgatactcctcctgcacggcttcggcgggggcgtgtttgcctggcgccacgtcatgcgcccgctggccgacgccagcgggctcagcgtgcttgccttcgaccggcccgggttcgggctgacttcgcgccccccacgcccgccagacgcgccaggcggtaaccggcacaacccctacgcccagcgcttccaggcgcgcatgaccctcgagctctgccgccgcctgcacatcgctagcctcgtgctcatggactggagctggatggaggacagggtggctcgggggatggctgtgacaggtcacatgaccttttgtggcaccgccccagatgcggcgcccaacgctacagctgttcaggcccccggattcccagctgggacactgatcatccatcccnnnnnnnnnngagggatggctgtgacaggtcacatgaccctttgtggcgccgctccagatgcggcgcccaacgctacagctgttcagccccggattcccagctgggacactgatcgtccatccgtgcgacaccccgctgtctcacccgcagggtatggcgacggcgcgctgctggccctgcgcgtggcatcttcctgcaccgcacaccgcgtggccgccccgcccggcgacgacgccggcgccagaccctccacgcgggacggctcggcgcactcccagcgggaggggccggcgctggccagcagcggcaccacaggctcccccggcaccccgccgcccccaccctggcacgcgcctgcgccgctcgggcaccccccgccggggccgcgccgcggcggccccacctcgcccgactgggcggggtcggcgcccgagcagcaggcgctgctggccagcttgctgcgtggcgagtttgtccccggtgcgcactggcccctgggcacgggggccannnnnnnnnngcagcaggcgctgctggccagcttgctgcggggcgagtttgttcccggcgcgcactggcccctgggcacgggggccggcgtgcgcgccgcgcggggcgtcgtcgaaagggatgcgcccgtgaagacagcgccggggtcgtgggggtcgcccgcctccgacgcaggggcggccgtgcccagtcccacggaaccccccaagcccgcggctatgcccagggcggcggagccgtcccccttcttgcaggccgcgctggaagccaagccggccatgcaggggtccacgggtgttgcgaatgcagcaccatcgtcagagccggcgccggcgccggagctggagcgggcgcccagcatcctgccgccagggccgccgctggtgcggggcgtggcgctgctgcaccccgatatctccggcgtccccgcgcccctctacgcccgcgtgctcgcgcagagcaggtgcgggccatggacgaggggaggggtgtgtgcaaggagcgcaggcagagccagtgtgcacacctttgaaggggcatgggacctaccaacatggcgcagagctgctgtgcctgcaggcgatgagggcgggnnnnnnnnnngccagtgtgcacacctttga

SEQ ID NO: 6302 - DNA, 990 bp, Chlorella protothecoides
  modified_base (295)..(304): a, c, t, g, unknown or other
atgactggcatcgcccgccttgctgctgagattgcgtgggcctccaaaattggtgcgggccatcgatctcctgaacgtaacaccagctcggggagtgggatcccacacctggtactgcacacattgaaggatgttcaatacgtgtcgatgccccgctcacatcagggtgcactccctctacccgatgctgaatgccctattgcttacaggagcttgtccaagattgcgtgggcctccaaagttggtgcgggccatcgatctcccgaacgtaacaccagctcggggagtgggatcnnnnnnnnnntcagggtgcaccccctctacccgatgctgaatgccctatcgcttacaggagcttgtccaagctcaggccccccggccatggctcgcagggcagcgggcctcctgctgtgcctctttaccctgggagcatgcagtgtccatgcgttctacctgccaggcgtcgcgcccgaggactttaaaaaggtcggtgagggcccaggccttgcccccgtcttgtcgtcgtcgtgcccactccccccacgatccacaccatcgcatcgaatgcagggagaccctgtcaccctcaaggtgaacaagatcatgtcggtgaagaaccttccctacgactactactccctcccctactgccgtcccgagaaaatcatcagctctgccgaaaatctgggggaggtgctgcgtggggaccggatcctgaattccccatacacggtgtgtgacagtgtggggagaaggggggagtcggaccctgtctcaccatctgaaagggcggcttacaggaggagtctctcgcgcaaggctttctggacccccactcgaacgccgcctccccctcccaccgcccccgagcccctcgacagacccagtttcgtgtgcccaagtcctgcgcggtcctgtgccgcatcgcaaagctggacaagaagcaggccagcgcgttcacgaaccgaatcgatgacgagtaccgcgtga

SEQ ID NO: 6303 - DNA, 447 bp, Chlorella protothecoides
atggaccgccaaggtcctggtgggatataccgtcgatgcccaggtgaggcatcccggggcgctgggagggtgcctgccatccagatcgatactccacttcccgagcacccgtacccgacctgcgacatgagcctcccctgggatctcgactacccgcagacaaagtcgggaaagacatatagcggaatattgagctcgatcagcagcgacaagggcgcactggtggcccacctgagcatgaccaccctggtgcgggatgccaaggtgcagggcgagctcccggtggtccgccccacgcccaccctggccctgccatggctggacatcgtgtctatcaccgccaagggcgtggcattgggagcggaggatgtgagcacggcctccacacacaacggcatcgagggattgggcaccgacgccgacatctcacgcggccgcggcgggtga

SEQ ID NO: 6304 - DNA, 384 bp, Chlorella protothecoides
atggtggagatcctggagacgcggctcaaggccctgctgcacatctcggagctggcggccacccgcgtgcgcgccgtggaggatgagctcgccctgaaccagacggtccaggtgctgtgcctgggccgggatgaggcagggaacgtggtcatctcgcgcaaggccctgctggcccgggaggctggcagcggggagggcgcggcgggggccggggagcccaaggctgcgggctccgacggggaggcgtcgccggccaggagcccgggccgggaagcgcacaggagcgccagccgggagggcacccggccctctgggcgggagggttcttcgccgagtaggagccgaacgcttcccagagactccggccccaggcggaggggctga

SEQ ID NO: 6305 - DNA, 213 bp, Chlorella protothecoides
atggtggggcacgtcaaggtgcacccgcgcatgctgggccgcatcatcggcccctcggggtccaacctgcgcggcatcgaggaggccactggggcccgggtccaggacgacgggcgagtgcacgtgtttgggccctctgccgcggcgtacgagtcggccgccgctcgggtgctggacaccgccggcgacagcatggaggtgagtggagagtag

SEQ ID NO: 6306 - DNA, 354 bp, Chlorella protothecoides
atgacctctccagtcctccactttgtaatcgtgggccaaaacgaccaccccatcttcgaggcagacctcagcagcaaggcgggcgatgccagtcatagagaggaacggccccagtacctctaccattttgtcctgcacgccgcgctagacgccgtggaggaacaggaatgggcctccccgtccatgcacctgggggtggtggatcgattcaacaacttccaggtctctgcatactctacagcagcgcacatccgtttcatgctgctccatgatgggcgcagcgatgatgccatcaagagcttcttcaaggacgtccatgagctgtacctcaaggtgggagctgtggggatgtag

SEQ ID NO: 6307 - DNA, 744 bp, Chlorella protothecoides
atgtcccctggggcctcccatcccgtcacctccctcccctcccgcctcctcatccacaggcgcgcagaccgcgagctgcagcgctgggtccccaccgccgacgaggcggacctggggtccctggagggactggagggtgcccgcggcggcggccgcggcggcggcaggcctagcgcgtcgcacggcagccgcggcggctccggctccaactccggctgggatcagttcgcactgaacgaggccaagtttggcgtgcgcaccgactacgccgaggagttgtacaccacggccctggacccgcgcgcctccaccatcagcgcggcggaggcggaccgcatcgcgcgcgagatcgagggcggcggcgcgcatggcaaggccggcggcctggcgagccgccacgtgctggaggagcggggcttggccgtgctggacgacagcgggctagacgaggaggacctgtacggcgccgtgctgcgaaccgatggcccgggcggcgcggccgccggccggcccgcggccagcggcgagcgcaacggtgcggggtctggcgggtccgcccgcccgggcgcctccgcggccgtgccggtgcccaaacccgcgacctcccgctctgcgcccatcgacatcgatgcgcggcgagagaccaacaagctgcgcgcgcagatgatggagggcaagaagacgtcgccctacggcacgcccaagagcctcaagtcgccgctggcctcgcccctgatcaagtga

SEQ ID NO: 6308 - DNA, 552 bp, Chlorella protothecoides
atgagcgctgcgcttgcctggctgccggctgcgcctccccacactgatcaattgatcccgtgggagcatcatggcgtccccattcacctgcctgcccgtaacccttccgtccctttccgtgtacgggcggacggctccgtcatcctgaacaaccacctgtccttcaccatcctgtaccactcggacccggccagcggcaccgcccgcatcgtcggcttcgaggtggtgccccagtcggtgcaccacaagtatgagggcaagtggcagggcgccgacaccaagctgaccacctgcagcagcaccaagggctcctccgtggccgcgggggcagaggcccagctggtgaagcaggggcaggaggtcgtgttcacctacgatgtcaactatagggtgcgtggctgtgcctgctactgggagggggggcggggggagcaagggtgttgcagatggcgcgtgagtttgtgtggtagtggggactgttcactgaaggaggggagggttgcaggtgctgattcttggcgctcagtcggcgccggggcttggaggccctga

SEQ ID NO: 6309 - DNA, 816 bp, Chlorella protothecoides
  modified_base (206)..(215): a, c, t, g, unknown or other
atgttcacctcatgtaccgagcgccgctgcccctccgagcgtgagtggcagtgtgggggcgatgtggcatgcggtggggttgatttttgtggtgcttggcacatgcgggtcactgccgcgcgcatgccaccctgggatggctgtgcgcagatgcctgccctggcacgcaggcgctggttgaggggtctgcccgtgcttgccctgcnnnnnnnnnngcacatgcgggtcactgccgcgcgcatgccgccctgggatgactgtgcgcagaagcctgcccaggcacgcaggcgctggtggaggggtctgcctgtgctcgccctggcacgcgcagaacaccacagttttcctctgccaggaaggtttgacgacgagtgccgctcggcggtggcggagaacctggagctgcgtggcattcatgtgcactccgagtgcaaccccactagcatcgagaaggagggggaggggcggtacgtgctgcactaccgcgacggcagcgggcaggagcacagcctgcgctgcggcaaggtcatgatggccaccggccgccgggccaacacccgcagcatcggtctggaggtgcgccaagttgcgaggggctgcgggggggcaagggggagagtggccgctgcagcaccgtccatgcgcccgccgaccctgctgcggcgggcgccgacaggcagtgtgggtggcgggcgtgggcgctccccctggagcagcggagccagtattgatgcagcctctttgagattgttctggtggctggggctcccggacacccggatgcctgttccatcaccgcacccccctccttccccc

SEQ ID NO: 6310 - DNA, 3402 bp, Chlorella protothecoides
  modified_base (159)..(168): a, c, t, g, unknown or other
  modified_base (301)..(310): a, c, t, g, unknown or other
  modified_base (608)..(617): a, c, t, g, unknown or other
  modified_base (963)..(972): a, c, t, g, unknown or other
  modified_base (2020)..(2029): a, c, t, g, unknown or other
atgataggggcactttcggcgatggggttaatacagtgtgtgagggagcctgtggtcccgccctttccgctttttccgacagctcagtctctgcccccgacgccactcaggcgcatcgccacatccagtccggctcctaggcaaccgtggggactgttnnnnnnnnnncgtgagggagcctgtggtcccgcccttcccgattttccgacagctcagtctctggccccgacgcctctgaggcgcatcgccacatcaaatccggctcctaggcaaccgtggggactgttgctcagtccgaatnnnnnnnnnncattactcaggaagggttacattgggttgcgttgctgggtgtcatacggcctcaaccctgcagctgtttggtttcgagaacaggctcagtccgaatccgggtaccctcttgcccctttcagcataccggatcaagtccggaacggacgaatgctcgagaatgaaagtcttggggacgcaatggcgaggttggcggacgtcttagatcgatggatgcgctgcccccacatcgctgacgtcctccacctggacagaggcatgcccatctactggcttgaacgcatggccaggcgtatgannnnnnnnnnttgcccccatatcgctggcgtcctccacctcgacagagacatgcccatcaactggcttgaacgcatggccaggcgtatgaacatggcggtgctggacgatgagccgacgcgcctccagtattacgccatcaacctgcggggccctgtctatggatgggcctcatcccttttaagagggaatgccttcacaccagcagtgaccatgtgtgcggagtttgaaaggaaatttctggatttctttagacccatctactgccacaggcggggacgtgtggatctgtatcagctccagcagcggggtagcgtggcagaatatgcccgagagcaccagtccatcgtgtcgagnnnnnnnnnngatcagctccagcagtggggcagcggggcagaatctgcccgagagcaccagtccatcgtgtcgagcatcgaggacctgacgccagacgagtgccttgcgacattcacctcaggtctcaagccagagctgcagagggagaacagcgtgcactttgccagcagctatgaggaggccttggtgaaggcgcagtggcaggagcagaatacccgccgcagaagacagcgtaaccacacgctccctgcccaaaaggggcagcgtgcggcctatggaccctgccttttgaatggagctgttgcagggagtccaccgcagcgtgggccacagtggactgcggcgcaacccaagcggacatgcagtgtaactggccaggagaagacatggacgtgtgacagttcgtttacacctgcggcgcctgccagcacaaggtttgcgttagagcctcatgcaggaccactccagcccctcccaacgctcattcgttccccggcagcaaatgcccctgagatgcagcattgcgagtccgccacaaagaagatcacagcgagggcgctggtcaagatgttcctcgattgcgtctgcaatctacccggctcacctggcattatggtcggcaactgcgacccttacttcaccattgggttctgggcccagctgtctggtgtgatgcacttgcatgactcatcatggtggtggagctcaatttggggctcagtgaaccccagccgccctttcgtttcagaaactctcactcggtctataagcaaatcatgtccaatctcgtttggaagtctggggtctggaatcctcacggccgggctaaaacgtgatgcgttgaggaggttgagtcttcgagcttcccatgcgagggcctccctgcccagcacaggggaaggtctaactgcgtggcaccacactgtcccaagtgcgtgtttgccagtgctagggatcatgattgtatatatggcacatggtggagcacccaggggtagctgtgggcttcgctggctcaatgataggagcaggcatgaagcccaccctggccgaatcnnnnnnnnnnggcacagcacaggggaaggtgtaactgtgtggcaccacactgtcccaagtgcgtatttgccagtgctagggatcatgactgtatatatggcacatggtggcgcacccaggggcagctgtgggcttcgctggctcaatgatggcagcaggcatgaagcccaccctggccgaatccaattcttaatcggagttaaagaaagcgcgacaggagagggtgggaacgagatcctcttggctgtgctccgtgctgacgaccatcatgctggcgacagctcccacagtgagtcactgggggataagtcccgaagcgtcccgtgcccccaccggtccaggcagggtccatgtggggaagtctaccccgttctccccaatatcacatgccttgattgtccaatgcctcccatgcagaccgcatttgggcaggtggctccaagcagggtctgcggcctgtcgggggcagcccggagggccagcgtcatcgcccgggccgagaacaacaagatccagaaggtgagcgaggagggtgtagatagcttctcaaggagactatcccgaacctccgatggtgagccgtatggggcttgcttgaattgctgcccttgccagttgcttggtgtccagtgcttgcgcctcgtgcttgcctccctgaaccccccccagcaatcctgcctctcccgccgacacttaacaagcctggcacaagccttcctcatctcgctcccttctcctcctcccgctccctcatacgagcaggtagaccgcatccagaagaatggcccgctgtacctgaactttgccagcgaccagtccctgacctacctggacggcacgctccctgccgacttcggcttcgacccccttggcctgtccgaccccgagggcgcggggggcttcgtcacccctgaatggctggcttacggcgaggtgtacaacggccgctgggccatgctgggcgcagcgggtgtgctgattccggacgtgctgtcccacgcgggcctgattccgcagaccccggaggagatcaagtggtggaagacgggggtcatcccgcccgcgggccagtacgacaagctttggctggacccctactccctcttctggatcgaggccattctgatgaacttcgtggagctgcggcggtaccaggactaccgcaacccggggtcaatgggccgccagtacttcctggggctggagggcggcttcaagggctccggcgagcccgcctaccccggcggccctttcttcaacccgcttggcttcggcaccaagagcgccgacgacctcaaggtctggaagaccaaggagctgcggaacgggcgcctggccatgatcgccatgctgggcttcgcggggcaggtgggcaggggttga

SEQ ID NO: 6311 - DNA, 363 bp, Chlorella protothecoides
  modified_base (8)..(17): a, c, t, g, unknown or other
atgcaaannnnnnnnnnttccacagtgattgagggcatggatgtggtctacaagatcgaggccctgggcagccaatcggggcagcccagcaagaaggtcaccatcgccaagagcggcgaggtgacaggggatgagaacaacagcacactcgcctcagagctgccttcagcagagccaggacgtgtcctgcagcgcctggggactaaggcctcttgtggcatgcgaatgctgagacctcaggtgccatgggatgttcaatggcctgggagagctcgcgtcctcacctggaggtgtaaacgtgaacgctgtccgctgcactctcagaagcgtggacactggcgattctcggaagagtatccttga

SEQ ID NO: 6312 - DNA, 708 bp, Chlorella protothecoides
  modified_base (201)..(210): a, c, t, g, unknown or other
atgatgcctgcccttccaccatgcccttgcagcagcactctgacgcttccacatcaggtgctactctgcacaggctcgattcgctcatggactccaggcccatcgctcgtcagggagtggctgccccaaccccagcccgtcccccggcctacacgatccccttccctgcgctcacccctgccgaagacgacatggcggccnnnnnnnnnncgggtagcgggaggagaacttgagaaccatgctacctgcccttccaccatgcccttgcagcagcactctgacgcgtccacatcatgtgctactctgcacaggctcaactcgctcatggactccaggcccatcactcgtcaggaagtggctgccccaaccccagcccgtcccctggcctacacgatccccttccctgcactcacccctgccgaagacgacatggcggccgtccagccaagaggtcttcacggtggtgatgaagaactgggagccgttggagtcgcgccccgagtttgccatggagaggacacccggcccggtgtgcttgagcttgaagttctcatccgcaaacttgggaccgtagatggactcgccgccggtgccgtctccccgggtgaagtcgccgccctgcagcatgaactgggggatgatcctgcgcggtgggatggtgtgtgcggggctgtgaggggcggggcattgggtggagcggctgagtga

SEQ ID NO: 6313 - DNA, 417 bp, Chlorella protothecoides
cccccccaaccccacccacacactccaggagctgccctgcggacacttcatgcactcccactgcttcgcggcctacacacgctacgcctacacctgccccctctgcttcaagagcctgggcaacctggagatgtactggcgcatgatcgaccgcctgctggaggcggagcagctgccggccgaggacgccggccggcgccagtccatcctgtgcaacgactgcggcgcgcgcagcgaggttgccttccacttcgtctaccaccgctgcgcgtcctgcaagggctacaacacgcgcatcgtgtgagtggccttggccgcccagctacaggcacgggtggcggcggcggctggcgggatgcctgcgacgggggcgagacttcctgcatccaatcccacgccttgatattaatcagttga

SEQ ID NO: 6314 - DNA, 381 bp, Chlorella protothecoides
atggcattcctcgggcatgggccgtgccacaccagaaacttcttcaggaccggagtggcctgcccaagcatacaccctcgtgcacgcgcacgcaccgtgctgcagagtctggccagatccgatgcggtggatgcgagtccctttgacgatgtggcggcagcctcgccgggagatgcagcccgtgaggagtctcggaaccccagcccacccaggaggaccctctccgtcaccttcacctgcaacaagacggaacgagctgtgaaccctgtggcgtggactaggggcttggtcatcgcccagtgtggagagtgtgacgcttggcataagctggcagatgctgcaaatctggtggacgagattcggtactctgacgaagtatag

SEQ ID NO: 6315 - DNA, 582 bp, Chlorella protothecoides
  modified_base (188)..(197): a, c, t, g, unknown or other
atggcgggggagaacaccgacgcccaggtctccgccatcctcgcagacgccgacgctttcctcgcgcaggtgcgccggggaggctctgagtgcagcgagcggtccagggtcaggggcgggtggggctgtggcctactgacatcgcttgttgctgggaatttggcggcgggattgattggtgagagccnnnnnnnnnngggggcctgtggccctctgacatcgcttgttgtcggggatttggcggcgggattgattggtgagagccgaacagcaccttcccaggtgcagggccgccctcgtcgtccccctcagcactccgccccccctccctctgcgcagctccccgacgtgtacgagtatgtgcaggtgtgctttcccccctcctactccgtgttcgaggtggtgagcgccgagtactgcacccacctggcctccatgctggacttcatcggcctctgcgccgagcagctggcaaacgaggacatcctgcgggtggtgggctgggtgggcggcgcgggcgacgcgctgtgcgcgctgggcctgcccccggatcgcgcctccttcccgggtgagggaatctga

SEQ ID NO: 6316 - DNA, 609 bp, Chlorella protothecoides
atgttggccacgctggaggactacctggtcgacttctccgccatgatccagcctgccctgctgccgcgcgtggcggagggcatgctggaggagaccgtggcgcactactcgggcgccgtgctcgccggtttgaccctggcgggggatgacgaggtggcggccctgcgtcgcgaccacggccgcatcctggagttctttggtcgccacgtcaagccagccaaggtgcgggctggtgtggggagaactgtttgggggagggcagccccctgcaaccaacccctctgcattcaccaacacacacgcacacacaccaaagcactctcccctttgccaggcggctgcggcgtgccagctgatagaggagctgaccgagttcctgggtgccgactccctggacggcttcgtgctttcctacggctccattgtgtccctggccccgggcatcaccccaaccctgctcggggggttgctggccgcgcgtgttgctgcggggaccgagttcagcaaggccgacgccaaggaggtgaggagatgatggtggaaccttgggtggatgggtgggtggatgggtgggtgggtgggaggtcagcagatctcagcccagtgtag

SEQ ID NO: 6317 - DNA, 393 bp, Chlorella protothecoides
atggggtggctgcgccgtgccgatggtgcatgggcatgtcgtgttttgtgtgccagaccatgtctttggggccagaaggtggttgatgtgtcaccggatcaagacgccggcctcgtacccatacattccttcaccacctttcttcacgcccgctcattactcccccgccagcacctggatgtgtggggagcggacgcgaaattcagccgccgcggggccggggacccgctcttccacgtctccgtccaccccgcgggcgcggccccgagtctccaggagatggtcgtgctggaggcggcggcgggcgacatccccgtcaagtttgcggtggtggagaagggcgacatcgggttctacggcttctcccacgttcgcctgcaggacatcctgtga

SEQ ID NO: 6318 - DNA, 2397 bp, Chlorella protothecoides
  modified_base (443)..(452): a, c, t, g, unknown or other
atgacccattctcacttaccaggttgtcatcctggacgaggcgcacgagcgcaccgtggccacagacgtgctgctgggcctgctgaaggccgcggcggcgggcaggcccgagggcgacctgcgcctggtggtcatgtcggccaccctggacacccagaagctgacggcctacttccagggctcccaggcggcatacatcgcacacccatcaccacatcctcgctaccgctgcaccccagcgcaggggaggcagtacccagtgcaggtcatgtacacccccgcgccggaggagagctacgtggacgccgccatcaccaccgccctgcagatccattgcgaggagggccccggcgacgtcctggtcttcctcaccggccaggtggggcgagggtgggattctgtatcgccaccccggctgcatgccgccgcgcactgtgccttgnnnnnnnnnntcctcaccggccaggtggggcgagggtggggttcagtatcgccaccctggctgcatggtgccgcgcactgtgccttttccttcagcgtggcgcatcgagtgtcctcttgttcctgccaaattcccattccgatgtcctggtccgtcacccttattgcccctccaaccccagtgacaagtccccatcccctcccccccttccttctccaaaggatgagatcgaggcgtgcgagcggctgcttaccgaccgcgccgccagcctcccccctgatcccgcccgcctgtccctctgcgtgctgccgctgtacgcggcgctgccccccgaggcccagcttcgcgtcttcgagcgcgccgcgccggggtcgcgccgcgtcgtgctggccaccaacatcgccgagacgagcgtgacggtgccgggcgtgcgcttcgtggtggatagcggcatggtcaaggcgcgggcttactcgccccgtctcggcgccgactgcctccaggtcgtgcccgtcagccaggcgcaggcgcgccagcgcagcggccgtgcaggtgggactggctgggcgtgggtgtgtgcgtgtgtgtgtcagggggaatggacccgggtgcgtccaaatgggcgcgatggatcgaggggctggagcgacagagcgtacgacgctgcaggcggctgcctggcaccctgcgccgctgcctgtccgtgcattgtctctccaccagcagatggatcaccctgtcctctggccccgacgacacactccctctcccctcgtcgactcccccccacccgactcctctttcccccactcacccccaggccgcgagggcccgggcaaggccttccgactttacaccgaggccgccttcgccaagttggcgcccagcacggcgccggagatcctgcgcaccaacctgtccagcgtcgtgctgcagctcaaggcacttggcgtgcgggacgtgctgggcttcgacttcctggacccgccgcctgcgcccgcgctcgtgcgctccctggagctcctgctggcgctgggggcgctgacgcgggagggggacctggcgcaccccatcgcgtggcgccgtggggggctgagggatggggggaaggttggggaggaggagagagcggtgagagggagggggtggaattaaggtacctgccggtgatcaccagcggtgactcatccacccagatcctttcaccctttctctccctacctgtaggcacctccctggcccgcctgccggtggaccccatgtttggccgggtgctgatggcctcggcggagctggggtgcagcgaagaggcgctggctgtcatcgccatggcctccaccgaccccgtcttccagttccccaggtgggtttgggtgtgttgcatctcccgttctgggagggaggtgaagggcgccggggtttgggtccagagttgtcctgttcgccctctgctcctctccaagacactggactctgccggctgcactcatccactcccccccacagcactcccacaaccccccttccagggaaaagcgggaggaggcggcggccgcccacgcccgcttcgcctccagggagggcgaccatctcaccgccctggcggtcttccagcgcttcgtggcccagccgcgcaagcaggcggccgcctggtgccgggagggcttcctgaacgcgcggtcgctggccaaggcgcgcgacatccacgcccagcttcgcggccactttcaggccctgggcctgaggctggcctcctgcggcgacgacgccacgccgctgcgccaggccctggtcatgggcctgttttcccacgccgcgcgccggcagccgggcggtgggtgggggactggtgttgggcgggggaatgggctctactgcatggctcgcagttgtctaacagtgatcaaacaacctctgcctggaacactgagccacccaccgacccatgcgtctga

SEQ ID NO: 6319 - DNA, 396 bp, Chlorella protothecoides
atggtcgttgaacccccccccacccaaccattcctaccccagacggactacagcgagccgcccaaggtgacggcggagggtcgggtttggacccccggccccgtcgacttcttccgtatcctgaacgagcagctgggcgtggctgccggcgtagacgacggcccgctgctggcggccaccgcccgcgccgcgatggaggcaatggcctcctaccaggcctcccagcgcgccgcggtggcctccgggcggctgggtctggacctgctctgcgcggcggtgaacaacaacatgcgctgctacgacgagagcctgcagtttgcggagcggctgcagaagtcgctggagcggcggcgcaggggtgggtggttttgggaggaaggggaccttcctgggtga

SEQ ID NO: 6320 - DNA, 864 bp, Chlorella protothecoides
  modified_base (104)..(113): a, c, t, g, unknown or other
  modified_base (619)..(628): a, c, t, g, unknown or other
cgcgcgggcgcagctcgcggcctctctcttcggcggccggggggcccaggccgacacaggcgccggcggcgcaggggtgggcaggggcgtggggaggagccctnnnnnnnnnntggcggcgggggggcccaggccggcacaggcgccgccggcgccggggtgggcaggggcgtggggaggagccctgcggcggcgcggggggcacgtgctcagccggcccaggctcccgccgcgcctgcgcccgacctgttgggcgatctgctgggagaggaccctgtcgacctgggatcccagcagccatcgggcaacgggcatgccaacgagacagacctcttctttgggggcggggtggtgggtctggagagcgtggcgcaccagccagagcgtgagcagcagcagacccccctcaatgcccccagcgacccctttgccatgctggaggggctgcagacgagcgggcagtccgccccagtgcaggactacgacccgtttggcggagccttcctcggacccacgcccgttgcatctgcggccgacggcgcccgaccgccgccggggctggcctccccatcgccggccacctcgtcgcccaactggaacctggggggcgtgggcatgnnnnnnnnnnacccgaccgctgccggggctggcctccccaccgccggccacctcgtcacccaactggaacctggggggcgtgggcatgcgggcgatggcgggcggtgccatgcagaaagcgcagtcgcccccgcctgccaagaaggctgcagacccctttgccgatctgctggggtagcgcccgcttgcttgctgcctgtgaacgctctcctgagcgcgctgatgcttgggccaaattttcaatag

SEQ ID NO: 6321 - DNA, 1515 bp, Chlorella protothecoides
atgggagcgaggagcgaggtcgggagaccggtatggggtgcaggcccggctccgacaccaatgatggtacaaggagaggcgcgcgtccctcgcacaagcgtcccggtctatagcattgcacatttcactactttcgcacatcgattccatcccagattcgaagttcgcatcggatctgacactctgattctggggctaaacaccatggacgatgacctcgagttcctcatggacaccgtctccgaggaggaggaatccgatggagtgagcctccccgggcagctgacatgttttagacagtgcatgaaatttcacccatcatctcgaattgcgtgccggatgctgccctcgtgcggcggtactcgggattgtagtcccttccgaaaccctccctctgaccggtccgtggcctgccagtacattggtattggcagttgtcccacaagacctctttcccttcccgcctcccaggagcctgctggccagccagttcagaggacacaagccaaccgcctccccctgcaccagtttctgcgcttgatagcgggcgggcgcatggtcgaccatgggacggcggcgagcaacgatgaccttgtggccgccttgaagcgcggaggggtgatccaaaggttgctcccctgtgtctccatcgccagaactccatcatgtgctccctgcagtgacctggtggcacgagccatgagggcctgcccccgcgacgcctttgtccccgaagagtaccgctacgaggccctggcagactcgcccatacggctggagagcatggagttcaacgtttcggcccctcacatgcacgccacctgcatcgaggccctcgacatcaagcccggccacagggtgtcactgggacatcattctgcggacggccaacccgcgagtgcgctgacactcccctgtgctcgggacccgagcagccatccgccacatcccgacctggtcgaccccgcccccctcaccttaggtcctggatgtcgggtgcgggtgcggcatcctggccgcctgcgccgccttcatggtgggcagggctggctccgtggtgggcatcgacgtccggcgccaagcggtgcgcctgagccgcgacaacgtgcggcggctggcggcggccggcaccgaatacgcggccacggcctgcgaggtcgacttccgagcgcgcgacgtcttcctgccctccgcgcgtctgcgcgcccgcttcgaccgcgtgcacgtcggcgcgtcctgtccgccggagcggctggggcccctgctggccctgttggggccgggggggggccgcatcgtggtgcccgtggcgcccagcgacctgcgtgtcatcacccgcgcgcccgacggcgccgtcacccagcgcgtgttgagccaggtgcgattcagcgagctggaggtgccgggggacgcgcgcatgctgctggccatgctgagggcggatcgcaaggcgcgcaccacgcccgcggccctgcccagcacctacctggccgacctggcgggcatgcagggtga

SEQ ID NO: 6322 - DNA, 900 bp, Chlorella protothecoides
atgatgctggacctgctctggctgctgcgccacggcgactactacggcgccggcgtggcggcggcggccctcagccaggccgacgccgccatgcgtgtgggcgaggatgtgcgccacctgctggccacgctgggcgcgctgccggcggcgcgcctgctgcacgccaccgacgtgtatgcgcagcactcggcagcgcgcttcctgtccatcatgcgcggcctgctgggcggcgagctggccgcgcacgtggcgggggcgggcgcgctgagcgcgctgtgccgccagctgcagcccggcttcccctacgtgcgctgctccgcggccgtagccatcgtgggcatcatggagcaccagcccaaccgcaccgagctgaggcgcgtcggcggggtgcaggccctgcgccgcatggtggtcgaggtctatgaagcggggcttcgcatgggtgcggggcctcaagagcctcataaaactgtaccccctttgatgccgccccgcaaaattatttcccgccacccctcccgcatcaccctctggcccgcagaggatgcgggccccaccaagcagatgcacgcgcggtacgactgccgcgacgcggcgcacgcgctgatcgccgcgtgtgcgacggacgaggagctggccggccaggttccggacagcttcgtggaccacgagggcgtcctggagctcaccgccgacatgctgcgcgtgtttcgcagctgcggccaggcctggatcgagggccgggtcccccggcccggtcaggggctggatccgcaggaggaggaggagctgacctcctctgacgaggaggcggcagaggcaggggaggaggcggaggaggaggaggcgcacgcgagggcagatgagagcgagtgggaaaccgacgaagagggggcgtga

SEQ ID NO: 6323 - DNA, 540 bp, Chlorella protothecoides
atgtcggtgcacgagcaagtgggctggctctctctggccgcggcagcgggattcggcgctgcaggctggtggtggctggtgcagcaccggcccccccgggaaatcatcctgctttccctggacggccacgccgtcgcgcaccccattcccactgatggaacccagctccctgtttcctacctcttgacgggccccgcggccctggcgcgggtgcaggcggcccccccagcccaggctccccaggtagctcccaggctggtggaggacccccccgccgccccgcaggcggaggaggagccggaggtaccagaggccttcctggaccccatctccctgggcatagcccatgaccctgtcgtcctggtgggcacaggcgccatctacagccgggagtccctcttccagtggctggccacgggatcccgcgtctgccccaagaccaacatactgctcaaggacatcgaggttgggatgcagaggatgtgtgggggaggtggtgctgaggattgggagggggagcgcttgctgcgtgtgatttga

SEQ ID NO: 6324 - DNA, 1212 bp, Chlorella protothecoides
  modified_base (261)..(417): a, c, t, g, unknown or other
  modified_base (740)..(749): a, c, t, g, unknown or other
atggaaacatcaaggtggtgcagatttttggagctggaatggttggtggcaaatccagatccgcaccctcttgcattgccttgctgcacccatctcaccgcggtgtccctccctcccatccctctgcagtacgccgcctacatgctgaaggtatcatccagaggagccatgcgttggtgtcttgatgcggtgttgcgtgatgaacacgaggttgtgaaagttgggaactcaatggtatgcgccccctggtccagggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccgcggcttcgacaagatgaaggcggaggagatcccctggggcgaggccggcgtggacatcgtctgcgagtccaccggcgtcttcaccgacgtggccaaggccggcgcgcacctgaagggcggcgccaagcgcgtggtcatctctgctccctcccccgacgcgcccatgtacgtgatgggcgtcaaccacaccgagttcgacgcggccaacgacaccgtggtgtccaacgcctcctgcaccaccaactgcctggcccccctggccaaggtcatccacgacaagtttggcatcaaggaggggctgatgaccacggtgcatnnnnnnnnnncaccaccgccacccagaagacggtggacgggccgtccaagaaggactggcgcggcgggcgtgcggtggggaacaacatcatcccctcctccaccggcgccgccaaggccgtgggcaaggtgctgcccgcgctcaacggcaagctgacgggcatggccttccgcgtgcccaccctggacgtctccgtggtcgacctgaccgtggtgctggagaagccggccaagtacgccgacatcctggccgcgctgaaggctgcctccgagggcgagctgaagggtatcctggggtacaccgaggacgcggtggtgtcctccgacttcatcggcaacccgctgtcctccatcgtggacgcgcaggcgggcatccagctcaacgatacctttgtcaagatcgtgtcctggtacgacaacgagtggggctactccaaccgcctggtcgacctcgtcgcacacattggcgcctga

SEQ ID NO: 6325 - DNA, 1854 bp, Chlorella protothecoides
  modified_base (266)..(275): a, c, t, g, unknown or other
  modified_base (454)..(463): a, c, t, g, unknown or other
  modified_base (950)..(959): a, c, t, g, unknown or other
  modified_base (1770)..(1779): a, c, t, g, unknown or other
atgatgcgccttgcgtcacgttgctggagcagggtgggtgagcgtgggctctccacaggccagttgcaggtggccctggaacccctggatggctccatcttcatgctcaccctgaaccggcctgatgcccggaacgccatcgggcgccagttcctgagggagctgaaggagagcctagacaatctggtcctggagaggtccacccgttgcgtcatcatcaagagctcggtgtcccgagtgttttgcgcgggtgccgatctgaaggnnnnnnnnnnaagcctagacaatctggtccaggagaggtccacccgatgcgtcatcatcaagagctcggtgtccagagtgttttgcgcgggtgccgatctgaaggtgggcatgtgtgctggggggccaggggagcccagggctttccctggaaactggtttgcaggagagggcaaacatgaccaggcannnnnnnnnnctgtgctgggggggcgggggagcccaggggtttgggagctaggatgtccagcgggggcaggggccaagaattcaaagtggaggcctccgcattcgtgcgtgacttgcgcggcactttctctgccttggaggccctccccatgcccaccatcgcctgtgttgatgggtgagtgcctggaccatcgatgcgaagggttcaagtgggcgtctgtttgctggagggtttgcagctggctgcacatgtttaatgacaagcgttgcctggctgcaggccggggcatctttggcaagggtggatgtacgcatcatcattctcctcaatctcaattttgcaggtatgcgctaggtggtggtgcagagctggcactcgcctgtgacttcagggtttgtggtgagtcgttggggttcaaagcgacgacgtgcttccttcggcagggcattcctgtcgaggcccagcgcagcgggggtgcgacatcctcggcaatcgnnnnnnnnnnattggggttcaaagcgacaacttgcttccctcggcagggcattcctgccaaggcccaaagcagcgggggtgcgacatcctcggcaatcgctgcagtggctgccttgatggggttcatgcttgctgtctgcgttgcagatgcgctgtccccacccagcactgagtggttagtgaatgttccaactgcttgtgtgctcctttccattccagggactggcgcccagtttgcgttccccgagactcgcctgggcatcattcctgggtcagtcgaggactggaggcggggttttggacgatcaatggacagtacagcagcagtcacgggcagccatggtcactccgggcctcttcccatgtccccgccctcaacactctccctgcagggcggggggcacgcagaggctgccgcgtgtggtcgggactcccagggccaaggagctcatctacacggggcgcaggatatctgcgcaggaggccctggacatcggtgggggcccgcaaggggcagctggctgaggattgggtggcgcggggacctgggtgcggggtccttccctccctgtgctcctgcctgtgacagcggctgccccttctcccccctctctcctttgagatatcaaatccaaccttcccttctcccaggtctggccgaccacctggctgactccgtgtctgctgaggaccgggcgctgcgcctcgcccgcgacatcgctcaggtgagggggggtgccgggggtgccgtgccggaggccacagtttggaaggccgggagtttcatgctgcagtcgactggtgaggggcaaggttcaggnnnnnnnnnncttcttccccccctctcctttagaatatcaaatccaacctccccctctcccaggcctggccgaccacctggctga

SEQ ID NO: 6326 - DNA, 750 bp, Chlorella protothecoides
atgcggcagtcgactggtgaggggcaaggttcaggggcaactggccctccatgcctggccggtgtcagccggctgaccatgtacagaacgagggctcgtccattctcagtgagcaatcccagtctgcacacatcagcacccacatcccaacctggcgcacgggggacctgtggccctccgcatggccaagcaggccataggcctaggcatggaggtggacctggccagcgggctgctggtggaggaggcgtgctacgcccaggtcatcccaacccaggaccgactggaaggcctgaaggcctttgcagagaagcggccacccgtgttcaagggggagtgattgggcacttgcagggcggcctctctgtatctgttctacaaccccttcccaaccgcatcccccaccccttgtccatgtggcaaggctctgtgagggtagagcatgggagtttgccagacccaggggcgaccttgctgtcgcctccacgactatttaatatcagtcacaacagtacagatccggagtgtccagtgtacatctacaattccaatgatgctcggcgtccttgggccccacacccatggcctggccctcaccaggcgccttcctttccacctgctcctccagctcatcaggggggtggaagggctctgcagcggcgtgcggacccgcgtccgccgccgccagcagcgcgcccctgccctctggggacaggtacgccgatgtggcgtacgccacctggcgcatga

SEQ ID NO: 6327 - DNA, 294 bp, Chlorella protothecoides
atgccctgggaggacatcatggtggcggcgctgctgcgcggcagcggcgcgcgcgtgcaccaccacgacggcttcaaggccgcctggaacgactgcggcccggggacggtgctcaagcatctggacaacgacgcgccgctgctgcaggcgggcctgcacgcccaggaggccagcggcctctgggcgcggcgcggcgtgacctgtgccacgggcgacttcacgcccaacgactacgacggctggcgcgcctggcgcaactccctgccggacaaccagctgaatgggttcatgtag

SEQ ID NO: 6328 - DNA, 1320 bp, Chlorella protothecoides
atgcacacaatcacggccccccctccccatcccgacgccccccccctggtggccatccccgggtacgctgcggggtctgggcatgccttccgcatcgtggacgggctggcctccgccttccacttccacgccgtggacctgctgggcacggggctgtccgggcggccgcgcttcccggcccgctccacggaggaggcggtggccttcttcgtggagtcgttggaggcgtggcgcgccgcggcggggctggaccgcatgctgctcatggggcacagcatgggcgggtacctgtccacctgctacgccgcgcggtacccagagcgcgtgcagcacctgctgctggtgtcgcctgtgggcgtggggcgccagcccccggactggcgcccgcccgccgcgctagcggggcgctggacgctgcgcgggcagctggcgcgcgccgccatcgcggcctgggaccacgacctgaccccgggcagggtcatccgcgggctggggccctttggccctggcctggtggcacgctacgcgcgcggccgcttccagcagggcctggccttcaacgacgacgaggtggcgcgcttcgaatcgtacttctaccacatcctggcggcgcgcgggtcgggcgagttcgcgctgcgccacatcctggctccctacgcctggccacgctcggcgctggaggagcgctgcgccgacctcagcgtgcccgtcactttcttctacggtgcgtgtgtctgggatcgtgcccgtcaccttcttctacggtgcgtgtgtctgggacgtgggagaggcgggggggcgggaggggacggctggcgatgggagcggccccttctccggccttggccatccaaactggtcggcgcaccggcttggcacccctcctccagaccttgcacaccgacgcatgctccctgcaaaccgatgcatgacccaggtgacaaggactggatggacccggcgggcgccaagcgcatggtggcagccctggcgcagcagcgcagccccgcctgtgagtccgatctgcagatcctgaccacccccagcgcggggcactacctcttcatcgacaaccccagcgagttcatgcgccaggtggcgtacgccacatcggcgtacctgtccccagagggcaggggcgcgctgctggcggcggcggacgcgggtccgcacgccgctgcagagcccttccacccccctgatgagctggaggagcaggtggaaaggaaggcgcctggtgagggccaggccatgggtgtggggcccaaggacgctgctgtcagggagggcaagagcgtcgcagcagagggcagcggctag

SEQ ID NO: 6329 - DNA, 2025 bp, Chlorella protothecoides
  modified_base (261)..(270): a, c, t, g, unknown or other
  modified_base (823)..(832): a, c, t, g, unknown or other
atgaccctctccaatggacaggtgaccaactgcacctttcagcttcccctcctgtctcactcaggcatcaagaaggcggtggaggaggtacgccccaagatcctgttcctcacctcccccaacaacccagatgggagcattgtgtcagacgaggatcttttggtaggtgggggactgtggaagggctgcacagagggaggatacctgtacatgggtccacgtgtgaccggggagggactcagaaccccagattgcacaagnnnnnnnnnntccagatgggagcattgtgtcagacgaggatattttggtaggttgaggactgtggaagggcttcacaaacggaggatacctgtacatgggtccacatgtgaccgtggagggactcagaaccccagattgcacaagcagccccgtgcatgctgccctcccccatgtcccaatccgcaggagctgctggagctcccggtgctggtggtatttgacgaggcgtacattgagttctccgacgagccctcaaagatgggctgggtgcagcagtatgagaacctcattgttttgcggaccttcagcaaatgtgccgcgctggctggcatgcggctcggctacggcgccttccccctgagcctcatagaggtgctgtggcgggcgaagcagccctacaacgtcacggtggccacccaggtggccggcctggcggccatgcgcaacgtcccctacatagaggggcagggaagctgctgcccatcctcactccccacccaccaacaccgcacatcctcgtccatgcccccgccccctttcgtcccagcgcgtgcgcgacctnnnnnnnnnnttgcacatcctcatccatgcccccgcccccctttcgtcccagcgcgtgcgcgacctgctggtggtggagagggagcggctgagcgcagccctgctggagcaggtgccctacctgcgccccttccccagccacgccaacttcttgctgtgccgcgtgaccgacgggcgcgacgcggcggcgctgagggagcgcctggcgcgggagtacggcgtcatgatccgccactacagcaccccggacctgcaggactgcgtgcgcatcagcgtggggaaaccggagcacacggacaagctgatcgctgcgttggtggcgctgcaatgacggcccgaggccgcggggttgcttggcacacctgccccttctcaggtagcctgagggggcacaggagtgcgtgcgtcaagaggcctgtgttgggggccctgcatggcccttcccctccaggacccctctgcacgagagacaagccttgtgggcaccaagacctgccgctcggccttgcatccttgtgtcagtggtgccacatgaactgtcacagtactgagaatttacacttgcgccgtggccatacagacagacaagggggagggcgaatctgggttaatgttgtacacggcaaaaggctggacaggaagcttgaatgctcccaggctgcggacactgcatgcggggaggatcatcggtcgaggcctgcaaggggtgcctcaccccaggcgtggcacgcgaacaacgctaccctcattattgtggaagatgcggacgcggtcgcggcggtagtccatggtgaccacccgatcctgccccacggtgaagaccttgaggtttgggaaggcgcgctccagcttggccttggcttcgtccttgtccatgcccacctgtggggggagctagcttgtcaaaattctgagggtccgcaccaggtcaggccacgcctccgtctcctcggtgctggccatcctgctgaagagcgacgagaatcctggcaaggggaaggagggggtgctgagcagaactggctggagggcggttggtgggattatatcacccaaacgatacagcgccacgatccctgcactctttcacacaccttggtcgctatcgagggcctggactgttacctgcgagcatcggtcggcaattccaaagagggtactcagcacaagaaaaagacccagtccgcacgcggtaatcagtag

SEQ ID NO: 6330 - DNA, 1911 bp, Chlorella protothecoides
atgcaatgcatcctgattggccctcctccatgcccccagatcgtgcgcgcggaggccaaggacatcctgttcgacaatgactcccgtcgcaagatgcagatcggcatcaacaagattgccgatgccgtggccgtgaccctcggccctcgtggtacgtgtaaagttgggaacatggagtcgtagttgggaacatggagtcgtgtatggcttgaggttttgctcatgcatgtggaggacaggggtgagggatggcactgcctttctcacagcaccttgctccagcgctcatcatgcacccctcgcatacctgagcccagctccaccacccccctggccaacacccccactcacaattctgcaggtcgcaatgtggttctggagcagtcgtacggcactccccaggtgatcaacgacggcgtgtccatcgcgcgcgccatcgagctggaggacccagtggagaacgcgggggcgcagctgatcaaggaggtggcggggaagaccaacgacaccgccggggacggcaccaccacggccacggtcctggcgcgggagatgatccacctgggcctgcagagcgtgacggcgggggccaacccggtgagcatcaagcgcggcatcgacaaggcctgcgcgcacctggtggcggagctggccaggcgctcgcgtccggtcaaggggtcggacgacatccgcgccgtggcggccatctccgcgggaaacgacgagagcatcgggcacatgatcgccgaggccctggacaaggtgggcgccgacggcgtgctgtccatcgagtccagcgccagcatggagaccacggtggaggtgcaggagggcatgggcatcgaccgcggctacgtctcgccccagttcgtcaacgtgcctgagcgccagctggtccagtttgacaacgcgctggtcctggtcaccgacgccaagctggaggccatcaaggacatcatccccctgctggagcaggtgtcgcgcctgtcgcgccccctcctcatcgtggccgaggacgtgaccggcgaggccctggccacgctggtggtgaacaagctgcgcggcgtcatccaggtggtggccatcaaggcgcccggcttcggcgagcggcgcaaggccctgctgcaggacatcgccatcgtcaccggtgcggagtttgtggccaaggacctgggcatgaaggtggagagcgtgaccgcggagcagctgggcacggcgcgcaagctcaccgtggcggcgacgagcaccacgctgatcgccgacgcggccaaccgcgatgagattgcggcgcgcgtggcccaggtcaagcgcgagctggcggagacggacagcacctacgactcgcagaagctggcggagcgcatcgccaagctggcgggcggcgtggcggtgatcaaggtcggcgccgccactgaggcagagctggaggaccgcaagctgcgcgtggaggacgccaagaacgccacctttgccgcggtggaggaggggatcgtgcctggcggcggcgccgcgctgctgcacctctccgagctggtgcccgactttgtcgccaccctggagcaccccgaggagcgccagggcgcggccatcctgggccaggccctgcgcgcgccctgccgcatcatcgcgcagaacgcgggcgtggagggcgaggtcatcgtccagcggctgctgggcaaggactttggcgtgggctacaacgccatgcacgaccgcgtggaggacctgctggacgccggcatcctggacccggccaaggtcacgcggtcggggctgatcaacgcctgctccatcgcgggcatcatgctcaccacccaggccgtcatgaccgagcggccgcgcaagggcgggaaggccccgccccccggcggcatgagcgccgcgggcatgcccgccggcatgaccatgtag

SEQ ID NO: 6331 - DNA, 2058 bp, Chlorella protothecoides
  modified_base (798)..(807): a, c, t, g, unknown or other
atgtctgtgatcgtggggcgcgccttgcccgacgtgcgcgacggcctcaagccggtgcaccgccgcatcctgtttgccatgcacgagctgggcatgacgcagggcaagcccttccgcaagtgcgcgcgtgtggtgggcgaggtgctgggcaagttccacccgcacggcgacaccgcggtgtatgatgcgctggtgcgcatgtcgcagccctttgccatgcagtccccgctcgtagacgggcacggcaactttgggtcgctggacgacgacccccccgcggccatgaggtacctgggggatcagaaaggggtggctgcttgcttttatggagggtgtgtgcgtatgtgggtatgtggtgaggggacaatgaagtggcttggccgagtcgcagtacaccgagtgccggctgcaggcgtacaccggcgcagcgctgcttgcggacctggaggccgagaccgtggacttcgtgccaaacttcgacgggtcggtgccggagccgaccgtgctgccggcgcggctgcccaaccttctggtcaacggctcctcgggcatcgcggtgggcatcgccaccaagatcccctctcacaacatgcgcgaggcgggcgggatggatgggatgggccaaggaagatttgtgttgaagggagggctgtcaaatgccgtgtcgcctttgtgggtctctctctgcaccaccgtgtccgtgcagtgcagtcacgctcagcattcgttcgacccctcctccctgcgcgcccaccgttgcctcaacccagcctgtgtgcagccctctctccacgcttnnnnnnnnnntgtccgtgcagtgcagtcacgctcagcattagttcgacccctcctccctgcgcgcccacccttgcctcaacccagcttgtgtgcagccctctctccacgctcgaaacccctccctccctcccacgtccaggcggggagatcctgctgtcgcccgccatggccgacacgtatgccacggggcgcggcaccttcaccgtgcgtgccaagctgcggatcgaggacgcggccaaggcccccgctgcaggccgccgcgccggcgctcggcacgctggcagcggccgcgccgcggtggtgctggaggagctgccgtaccagaccaacaaggcggcgctggtggagcagatcgcgcgcctggtggacgcgggcacgctcatcggcgtgtctgacgtacgggacgagtccgaccgcgacggcatgcgcgtggtcgtggaggtcaagcgaggccttgggctggccctgccggagcgcgcgtgtgcgacgaccagacgccctccaaaatggcctcaccccaccgtccaaaacctccactgcaggcttcgagccggtgctggtggtgaaccagctgtacaagcacacggcggtgcagggccggttcagctgcaacatggtggccctggtggggtccatgccccgcacgctgggcctgcgcgccttcctgcaggagtggctggacttccgggcgacggtggtggcggcgcgcgcgcgcgcggcgctgggccgtgcccgccgccgcctgcacctggtggacggcttcctgctggccctgcgcgacatcgagggcgtggtgcgcagcgtgcgcgatgcggccgacggccccgccgccgccgcggcgctggtggcgcgccatgggctcagccgcgagcaggcagacggcgtgctgggcctggcgctgcgccgcctgacctcgctggaaagcgggaacctggaggaggaggcggccagcctgagggccaggcatgtgtgtgtgctgggggtggggtggggattgggagggggtttgactgctccagggccctgagaacaaggggtatgtacacattcaaatgctgtctgaagcaaccccccaccctcagggttgctgagctggaggccttgctggccagtcaggataaggtgctggacgtggtggtggccgaggcggaggagatcgccgagaagtttggccgcccacgccgcacggccctggtctcggaggacccgggtgagtggggttttgtgggtcgggtttgggtggaaatgcagtctgtatga

SEQ ID NO: 6332 - DNA, 585 bp, Chlorella protothecoides
atgaggtgccgtcacttcacaccctgccaggcagcggagaccaggctggcccaccctcccccagccaggccgtctgtcaaggatgccagggtattcatacgccctcaccttcgtaatctggccccttacaaacccatcgtaccgctggacgtcatctccgcacggctgggctttgcggagaaggacatcgtgaagctggacgccaatgagaatccctatgggcctcccccagaggtcacggctgcacttgccagcttggagtatcccaacatatacccagacccggagtcaagggccttgtgcgagggtctgtctcggtggcatggaatccctgtggagcacctcatggtagggctccgagccggagcaatgcatgccgccctcccatgccgccgcacgcaggtcggcgccggtgctgacgagctgctggacttcatcatgaggtgtgtgctcgagccgggggagtacatcgtggactgcccccccacattcaccatgtatgcttacgatgcggcggtgaacgccgcgcgtgtctgcaccgtcccccgtctggacggcttcaggctcgacatcaagggtgcgtag

SEQ ID NO: 6333 - DNA, 627 bp, Chlorella protothecoides
atgaaagatcgatcggtgggcacgagtacaggccccgccctgttggctctcgggcagtcctgcgaggcccaaggatgctactgtgctgccgcccggtgctacgctgccatacctggcaccactcagacagctcctgtgtatgcacaggcagctcttcacctggctcgtctgctcttggcgagatttgagaatgtcccggaggccctgtcggcgctccacaccgcaacactgcacctgagggcatccaatgaagaaaccacaaccatttcctgccagctgcacgactgcctggcagactgccaccgagcgcagggcgagcccgagttggagctgaaggctctccgcgctgggctcgaagcatgcgcacgcgccagtccaaaggccgataggcccacaatcgcacgctggcgttcctacttcctgtttcgtgccctggagtgcgcggccgcgggcgaggacgagcctgcgctgacccaggccctgggggaactacagggcacgagggctgatctgactgccgtggagcaggcctctgttgtggccatgcagatgggcctggagcgtcacgagcaagcgagcgtggttcctatccaagggggtgcttgtttcccccacgggttcctctga

SEQ ID NO: 6334 - DNA, 624 bp, Chlorella protothecoides
atggacccgacgctgaggaagctgcgtctgttggaccgcacctcctcggaccccagtatcagccccagcagcgctgccgctgctgctgcccaggaactacaggccgtgatcaacgaccctggcaatgccaactcgtgggtggcctggccatttgcctcttcatcgtacgagggtgatgggcctcccccgtcgctgcctccagatcaataccccaatgtgtggcagtgtagaggatggcattggagggcgatgatgcaggcggtgatgctgtcgctgtccacaatctcctcattacgcagcaacatcacggaactgctgcttcacccacagatcaccatccgtgactttgaggtctacctgcggagcttggagacggggtatgccccccgccgtgaatcccatgccgcttcctcgccgcagccgctgtctcttgaggagatgcagtcgctgacaggggagggcctggccaccgccctgcgtgacgtccccgcctttttcttcgacgagggctttgacttcgattcgccggacctctggcgggccgtgcctgaccccgccgaccccgtggcaggggtgcagtttctggagaccctggcgcagtacctggtgagggggcatgtgtag

SEQ ID NO: 6335 - DNA, 1005 bp, Chlorella protothecoides
atggacaaggacgaagccaaggccaagctggagcgcgccttcccaaacctcaaggtcttcaccgtggggcaggatcgggtggtcaccatggactaccgccgcgaccgcgtccgcatcttccacaataatgagggtagcgttgttcgcgtgccacgcctggggtgtgccaagcaaccccgcggcctcgggccgtcattgcagcgccaccaacgcagcgatcagcttgtccgtgtgctccggtttccccacgctgatgcgcacgcagtcctgcaggtccggggtgctgtagtggcggatcatgacgccgtactcccgcgccaggcgctccctcagcgccgccgcgtcgcgcccgtcggtcacgcggcacagcaagaagttggcgtggctggggaaggggcgcaggtagggcacctgctccagcagggctgcgctcagccgctccctctccaccaccagcaggtcgcgcacgcgctgggacgaaaggggggcgggggcatggatgaggatggggcgggggcatggacgaggatgtgcggtgttggtgggtggggagtgaggatgggcagcagcttccctgcccctgccaggtgcagacatgggagacgactcacagagtgcccaagaccggcccgaagcccggctgctgcagccctgccccagcataacccccctcgcagctacctctatgtaggggacgttgcgcatggccgccaggccggccacctgggtggccaccgtgacgttgtagggctgcttcgcccgccacagcacctctatgaggctcagggggaaggcgccgtagccgagcctgggagggagcagttacatttgagggatgagggtgagtgctatctgctcgcatgccagctccatcccctagtgagacaacaaaccacacaagtccccactcagtcccgctcaccgcatgccagccagcgcggcacatttgctgaaggtccgcaaaacaatgaggttctcatactgctgcacccagcccatctttga

SEQ ID NO: 6336 - DNA, 1128 bp, Chlorella protothecoides
atgcgcaccgacgccttctcggtccagcgcctgcgcggccgcggcaagcgcaccaccggcctgcgcgatgatgacagcgtggaggacgtggtggccgtcaacgaccacgaccgcctgctcctcttcaccgccgcagggaagatgcacgcgctgcgcgcctatgaggtgcccgaggcctcccgcccctccggcggcaccgccatcaagtccctgtttccccgcatcggcgcgctggcggcagtgctccccttgccgggcgagcctgtggctgttccaggcggcaacagtagcagtgccgaggacgcagacaccggaccccccccgccgaacgacgacgtcgtgttactgaccagcaagggcctggccaagcgcgtgccgctggcgcgcttcggccgcatgtcgcgccacggcaagctggccatgggcctcagcgagggcgacagcgtcaggtttgtctgcaccgcgggggacaccgactccattctcctggccgccagcaccggctacgtcatccacttcaggacctccctcctccggccctccagccggggggcgggcggcgtgaagacaatgctgctgcgtggcgacgcccacctggtgggcatgggcgtgctgccctgcggcgtggcggccgaggaggaacccgaggccaatgggcccgaggaggaggccgaggcctccagcggtgaggaggagtacgagggcgaggacgacgaggagggccccgcggcggccgccgaggagacgcccggcccctggctcctgctgctcacgcggcggggcctggggaagcgcgtcgcgctggccgacttccggctgcagggccgcgtggggcgcgggctgaaggccatcaagctgaaccccggcgacgcgctggcggcggcggtggtggtgggtggcgagggcggcggggcggtggccatcgaccgcgacggcagcgtggatggggccgaggcggagtctggcgacggcactgatgtcctggtgtccaccgagaacggcctgtcggtgcgcctggcgctgggcgacatccgggtgcttggccgggccgggaccaagggccaccgcgttctcaaagtccagccgggcgacgccgtggccagcgccaccctggtgggccgcgggtag

SEQ ID NO: 6337 - DNA, 957 bp, Chlorella protothecoides
atgcaggatctgtctaagagaaacgcatggcggtacagagcagcccatttctacatgagactgcagcacctaggtgcataccctctccaacactcctcctgtgcacagctggaggagaagaggatcccgtacaccattgagaagatcaacatgcagtgctatggggacaagcctgccgagttcttggcaaaggtgggtggtgcagatgcctccaggttctgtcatgctacttggacgggcgtttgtgttcttgggcaaccttggaacggggacaaggatcctatcgtatttcaactcagtcattgtctccttgttatcgcagcccatgccctgcccatcccttccttcccaagcccaggaagtgctggagcagctctaccccgagattcccctcctgccccagcctgggacccaggagcatggccgggccgccgggctcatgcgcttggagcggcgcctcttctccgactggctccagtggctctgccgcggcgggtggtgggtttgctgggaaggcgaggggagggtggggtggggatgacttttagaaagctctgtctcagccatgccctcccagggaaatcgcgaagttcgggcacctccccaatgaaccgccggtgtgctgaaaccctcgcctgccatgcgcaggcaataccagaggaggccagagcgtccgtgcagacagcccagccacacacgtcactccctcctattctcacaaatctcaggaacgtacagggcaaccgcagggccttctgcaagaccatggaggcagtggatgatgcgctgcgttccacgcccggccccttcttcctggagtcgggcctgagcctggtggacctaacctttgcgcccttcctggagcgcatcgccgcctctatggtctactacaagggtttcgtggtcaggggacaggtgatattacagggacgggcagagtttcgggttctgtggtga

SEQ ID NO: 6338 - DNA, 249 bp, Chlorella protothecoides
atgcgagccgcagagaccacggccagacctctcaccaccgttcccagctggtctgatctggaatcaggggtcgagagggctagagagcagctgagcttcccggaacccgactatgaaaatgggccggcaaactcgtacgccgtgaggcgcctgttcggacagcctggccctccagagatcaagctctaccgggaccatgctgcctggtgcccgtactgtcacaagattgtgctgcaggcgagagcctga

SEQ ID NO: 6339 - DNA, 1140 bp, Chlorella protothecoides
atggcattgaacagcagcttcccatcgggcatcgacgcacgtcacagcaggggatcagtacaaagggaaatattagaattcttgagaccctgtgctgttaggcatggcttggaaaggaccaaagaccccagcagccccgacccatggagcccttacacatgggcgccgcacgcgaccgtcgtaaccctggccggaaaagctagatgctcacgagggcctatggacctatacggcggcgtccggcgccgcaggatcttcgcgtgcggaattcttctcttagcgtgcacctatgtcttctacatgaccctaccccgtctactggtggtcgaggagtataattcgctccaacaggcccgcgattcgattgtgagcgggggaaactggaagtgcggggtggacctgcgctggactcgatccacctacttcctccctgcctcatcaccggcgcaggcgctggggtacaggagggtgtccacagccgtggagtcgctctccttgacctttgggcgggctgatggggacacgggctacagcgcaccctgtgccctgttgaagggccgcggctgccctgcataccactcccaggagcccattccttccggcgccctccccagagggaacaagtcatgcattctggactgcaaccatgtcgggacctgcgtggcgacggccggcttctgccagtgccccatgggtgagtgggtgggggactggcagccggctgagcctgcgagatgcaggtgctccatacctccctgccgctcaaccagcagatcctccacctggaccggtgctgcctccccgcaccccctccccaaacctccaggctggaccggagatggctgccacatccgcctgcgccgcccctgcaccaacaagccgcgtagctggggtctggagcagattgaccctggaccggagaacctgacggcctatcgtccgcccaacaaccccttctggtccagcaaggcagccatgtgctccggcgcctgcgacaaggacatggggatgtgctactgcccctcccacacgccctttggccacatcccagcaggggagggctccttacctggtaaatatgtgcttgccagaaggttcagatgggagaaaacggagcccaggccagtgtttcggctgtga

SEQ ID NO: 6340 - DNA, 1311 bp, Chlorella protothecoides
atgctgggaagcggcccggccaggtgtaggacccatggaatgccaggcttcctcccattcaagctcccactttcccccgccaggtcacggagagtgtcagcaggggtactgcaagtgccaggatggctggtttggccaggactgcgcctaccgggtgcagggcgtgccggactcgccaggcacgctggcttgcatgctcggagcctggcgcaccctgatgcacagccgtgggccgcatcgatgtgggcgccaggccatgcaggattgaacactacatccactcccccctccagcctcttgccccatcaccccacaagtgcaggcatggataattccacccggccctggatcaaacagtttgtccacacccctgccgcacgagaaccaggggcgcggggaccccgcctccggcccctcatctgggtgtacgagctacccaccgactactccagcctcatgctgcagtacagggtcgagaggtgggcgctgggttggctgccagccatgctgcgaggggtggggcacttgatttgggcgggcctgccctgctcagcgctcactgtgcgggcatgcccggacatgcatgggctccagagccgggtatctatctgcaaaggccgtgctctcagtgacttggccctgactttggtctcggattcctttcccccttgccctgctccctcacgcgatgacaactcgaccgtggaggctgtgagggtataccagctggagatggggctgcatgagatgatgctgcagagctcccatcgcaccctagaccctgaggctgctaacaacccaccaccccccctctctgctccacgatatcaggaagccgatttcttctacgtcccgctctacaccgcatgttatattcagccggtggtgacctggggggacggccccttctattatggcccaagtgagctgggctgggtttcgacgggattgtctgtattcttcatcatgttctggagagggatgggcgtgcagatatgccctgggcgtgggccacacgtcgccaggtctcagcccaccttcattctcagcccagcatcccaccgctgcgcaccacagtcccgggccggacgatccaggccacaggcttcatggaggaggcgtaccaccagctccggtcacgctacccctactgggaccggaagggcgggagggaccacatcattgtgcgtgccggggagggggaggattgatcacatgccgtgctggagggccagcctgcggctccccggctgtccctatggacctgggcaatcgcgcgggcacagtggcatgggcaggcaggagatctag

SEQ ID NO: 6341 - DNA, 1125 bp, Chlorella protothecoides
atgctgttgcacacgcgcggaggcatgcaatccggttccctctcccgggcccgcttcaccccatgccagcccaaccgtctgaacacgattcctctgcgcagacctggtactgccggacctgcacaactcgcacttccatgcccactcccccctcatgggcaaccccacggtgcacaggaagtggctggcactgttcaagggccggctgcaggcgtgctgcaaggggtgaggcgcgccactccgccttcctggcactgcagagccggccctgccgagggacgagccctactcagcactcgccctcccccggcgcagatgaaaaatctgccctactcccagggggtacgacagaaaatcgcacttgtgtcccgcgaggaggactggcttaacaatcatggcatcctgtatggcgaccacgaggcttttgatggactgccatcgtacagccagctaatgagtgagagcaccttctgcctcgccatcatagcgctctacctggggtacattgcctatcctcacgccccaattcccccctacccaagatgttcctgccagatggcaatcctcctcgaacaccagcttccaactcaccccatcctctccaatgcccaggcgatgggtacacttcaaggtacgaggatgccatcacccatggctgcattcccgtcgtcatcatggacaatgtgtcgcctacccttggcaccatcatcaacgaggccgacatatcgggctcaaggttgccattgccctgttgattgtcattgtcaagcatcagccccagtctgccagcaatcatcctcttccacattgccccacacgtcaaccctcacagtgcgtgtggcattcaaggacgtggagaggctgccacagatactgaaggccattccacgggatgaaatcgagcgtctgcagcgcaacattggacgggtgtggcgccgcttcctctggagctcgtaccctctgacagggccgctgctgcaggcccagctggacgccaatctggctaggttcaacggcacagaggacccctccctgctcccggcccgggatactgcccacgacatgagccagggggacgccttccaaacactgatggagtggctgtatggcaggatggacccatga

SEQ ID NO: 6342 - DNA, 396 bp, Chlorella protothecoides
atgaccgcggcgcgcgacgtgccgtccttcgccgcctacttctgcaccttcgaggcggtgcgcagggcctgcgagtcctcgggcagcgtggcggcgccgcctacatccaccgcagacgctctgcccggccacggctgcgtgctcgccgccggcgcggcggccggcctcgcggcctggctcgccgtgtacccgctggacgtggtcaagtcgcggctgcaggcgcacgccgacgcgtcggtgccgggcgcctggcgcatcgccgccgacatggccgcccgcgagggaccgcgcgctttcttccggggcctgccggccacgctgggccgggcactgctcgtcaacgccgtcatcttctctgtgtatgagggcgcgcacacccgtctcgccgccgtctga

SEQ ID NO: 6343 - DNA, 696 bp, Chlorella protothecoides
atggaggagacgctgcaacccgcagctctgacgctgagtgcttccactcgtgacttcctggcgggtgagcctggccagtcccggtgggacccttgctctgcgtgcaaatccttgatctctggtgccctacacactgcaaaagacctgggagctgcgcgcccaccccgttcaatccccttcccactctcaggtggggtttcgggcctcagcggcgtggtggccggccagcccctggacgttgtccgcatccgccagcagcagcgccagggtggcggcggggcgggcgccgcgccgcccacccgaggtcgccagatcctggctggcgaggggccccgcgcgctgttccgcggcatggcctaccccctgctcaccagcgccctgcaaaacgcactggtgttccagacgtacggggcggcctgccggtgcctgggggccgaagcagacggtgtcgaccccggtgcggagagtgcgctgccgctgggccgagtggcggccgccggcgctgccgcgggttttctgcagaccgcggtgtgcacccccgtggagctgctcaagatccgactgcagctccagaccgccgcgcgcgggagccccggctacgtgggggccctggaccaggcgctccgcatctggcgaggccagggcatatcgggtgggtgccttgggaaccctgcgcgactccttgccggggactga

SEQ ID NO: 6344 - DNA, 462 bp, Chlorella protothecoides
atgcgccatggccattccctcatccatgacaggtatttgcatcagaactcgctgcgcagccttgccgacttccccgccctcccctccctgcgggtcctcagcctctgctgcaaccacctgacctccctttctgggctggaggggagcaacgcccgcctcgaaaccctgacgctgtccggcaaccacttggccggagacctggatgccctagctaccttccccggcctcaccaccctcgacctctccagcaaccgcctggatgacatggaccacctcctgtgcatcctgaggcagctacccctgctcagggctctgtacctgagcggcaacccctgtgtgaccaaggctgctgcgtacaggaagagggtggtggggaacctgccacacttggcctacctggataagcgacccatcacgcccctggagcgagcaactgcggaggcatggtgcggtggaagctga

SEQ ID NO: 6345 - DNA, 681 bp, Chlorella protothecoides
atgggagaccaaggccttggcctgaggcaccggggctccggttccactgaatatcaagggaaaggctggggctggaggcaagacgctcggcgcatgcgggctgccctcggacgcccaaatgaggaggttgttctcttcaaccccagtccatctcctcctcaccagccccccccttgcgcacccccttcgcagaagcacgagatcctcatcaacggctttggctgggccacccagcgccatttccagaagaatgtgctcccagacgtcaggccctccccgctcgcattcttcgactaccgctgccacgcggctggcggggcggtgggcacggccttccccggcgctctgcctacctgcctggcgaagctcggggggaaggacggcctccgtaacgcgctggacctgggcttcagccgccgccacgcggagcacctggccgccagggctgccctgctggtcgagcaggggctggagggcgccatcgccagcctagcggaggcgaggcccgccgccgaccgcatcccgctgcagcccgcctgctgtgcggtgaattcacaggggttctgcgccaccgagtttcggcccgacctcggcaacggcacgctgcgggagtggcagaaggaagcgcggccccccccggccccgcttcgcaggagcgctctgaggctcggcgaagagtga

SEQ ID NO: 6346 - DNA, 1338 bp, Chlorella protothecoides
  modified_base (1249)..(1267): a, c, t, g, unknown or other
atggagtgcgtcaaggcttccacaaaaccccgagccttctcaccacttccaggcgccaaggttgcgcctcccaaagcatcgtcgccatctggagccatggagcgtgggggcaagcccggccgaccgagcagagcggcagccactccagcctcctgtgcctcgcccgctgggtcaaatgacagcggctctgtgagtgactacgcctcggacggtgaagatgctgccagcgacctgggctctgacgccagtggcagcgaggacggtcacctctcagatggcctggccgactctgatggtgccagcggcagcgaggaggacagccttttggatggcctcgcagactctggagccagcggtagcgaggaggatgactcggtcctggcggggatgagtgactcagaggaggaaggatctgaccctgagggttcggatctcagtggtgcaggcgacagcagtgcggcaaatgggggaacaagcagcgatgaagcagttggggcttcaggctcggaggacggcgaggacaccgagcgctccgctgggaaaccccaggagccagccgccaccagacccgcacctgctcgtccctcaccgccggctgcggtgggaaggtacctgcctcctgcggcgcgggcggcggccgcgggcagcgaccccaccatccaagactcccgcgtggcgcgcgcggtgcgcggccagctcaaccgcctggccgagtccaacctgcagggcattgtgggcgagctggcgcgcatgcaccgtgacgaggcccgccgtgcggtgaccgacgcggtcgtgcacgagctgacggccgcggcggccgagggcccacgcgccagcgaggcctttgcggccgtcgccgccgccgccgtggcggggttggcggccagcgtgcgctccgccggcgtgatcgcggccttcctatctgcgctgggagcgcggctggaggcctcgctgcgcgacgacggtgacgccctggcggcgcgcaacctggcgctggtggtagcgcagctgcacgccctgggcgcgctgcgcgccgacctggtgatgtccctgctggacgcctggcggcgccggttcggggaggccgacgtggccgccacctcccacttactgggcgcggcggggctgagcctgcgtgccgccgacccgcaggccatgcgcgattacatagtggcagtgacggaggccgcagccgacgcgcgcgcgcgcggcgcgctgtcggccaggggccaggcgctcctggacctgnnnnnnnnnnnnnnnnnnntggggtctgggtgtgctgcaatgggaagcggtatcgaggatgagtggcccgtacaacgtggtgctgcatga

SEQ ID NO: 6347 - DNA, 1434 bp, Chlorella protothecoides
  modified_base (26)..(35): a, c, t, g, unknown or other
  modified_base (775)..(784): a, c, t, g, unknown or other
  modified_base (1375)..(1384): a, c, t, g, unknown or other
atgcctctggcatctcagcgcaggannnnnnnnnntgctttggctcgatgctcaaacgtgctcatcattatgctggacacccatcacatcaacatgcctctggcatctcagcgcaggaacccccgccagatcgaatactatgcatgcacttccgccggtcgactcagcccaaaactgcactggggtctgcacctaccgaaagcagctgcgacggcaaagccaatcatggcagaccgcccagccagccgctcaaaagctgatgactgtgcctgcaatcatcagataaatgttgagctgggtcagcttggaggggattggaaagcagagggtgagcgattggttgcgcacgctgccttgttaaagggctgtttgagtgtcttgggcagcaccggtgaaggagagaggatgctccgacatgagtactgcatgctgtttcaagtttcccggccccttgtgttagagaggtgctgtggcttcggcgccttccgcacggctgacctgccgtcgagtcggagcacgcgcggcacgccgggtccccgagccccgaaccctgccactccatcgcctggccggatgagccagggggtgggcatgctcaacaacccagtagctcgtaatcgtactatccgacatacatggcgatctcgcattagaggcaagtacgtggtgccttggcctgacgggccgaccggatgtcatgcccagaatcatacgtacgcttgtcattcgtctggtctggaggacagagtatctcctcagcatgctaggcagggcnnnnnnnnnnaaagcacaatgtggggaccatcagtagatgtgccactgccttcaacggcccgccaaggctcctctcccaccccgccctactccccatcgcagatctgcctcgtcggctcgaataggttcaatgcctttgggagtcatggttcagatgcccacgtggacttcggctggcatgccagcatcgaggcctgctgccaggagctgcgggaggagaagggcgcacagatcgtgggcgtggagatcatgccatctgccctccccgtgcactccttccccttccgcggtcccaccgccttcatgctggggaacgaggtgcgtaagctgtatgtcgtcggccgcgtggacgtctcccagccggccatagccggcccacccatgcccctcccccctgcctctgcctcgcagggtcagggcctaagcgagcggcagatacggaactgtgatgccttcatctacatccctcagtacggcgcaggcacggcaagcctgaacgtggccgtggctgcatccatcgtgctccaccactttgcgctctgggctgggttcccggagcgtggtcgtgagggccagaagttcattgtagcgccccggcccnnnnnnnnnnttgggctggcttcccggagcggggccgtgatggccagaagttcattgtag

SEQ ID NO: 6348 - DNA, 606 bp, Chlorella protothecoides
atggaccccccctcccccccccttcaattcacatccccgggtctccgaaacacgcagggcacccaggagcaagagattgtacgggtcatcgtgctatgctgcttgcaggagggcgcctacaacccctactacgcgctgctcctggggcggctgggcgccaccagccgcacgcaccagaccacgctgcgctacgcctgctgggacgcgctgggagaggtgggccccgacatggacctgcgccggctgaccaacctggcgcggctgtgcgcggacgcggtggcccagggcgcgatgagccccgctttcctgaagaagggggactggcggggggcgcagtccgcgcgccatgtcgtcttctggcgcctcttcttcgagcacctgctgctgcgctgcgacgacccggccgccctcttcaagccctggagggagcggcccgccctccaagagctgcgtcggggcctcaggcactacctccggcacagcctggggccctgggccgccaagcaggagccggggcagcgcgggcgcagcgccagcgacctggagaccctgctgcacagggtgcatgccgtggagagggctctgggaggtggaagcgcagactga

SEQ ID NO: 6349 - DNA, 594 bp, Chlorella protothecoides
atggcgtgctgcggaggatgggccgcacctggctcaagcaccgcttccccgccctttggggtttacccgaagcacacccccaccccatccacacccacacccgcgcgcaggaagcgggacggcgggcggcacgcggtgctctcccccaccaccctcaagtggcttcgcggcctgggtgtggaggaggtggcggtggggggcatcccctggtcaaaggtgctgagccctgtcaaggtgggtttctggtggcagcccagcgccgccgatgcggcggccgcggggcgcctgccctccctgcgcggcgccagcctggcggcggcggaggccctggaggataccccgggagcggggggccagaccccggcgcagctcctgcgcctcgccgcgcggcatggcatgaacacggaggtgcgccgcaccgtcttctgcctggtcatgggcagcgaggactacgtggacgcctttgagaagcttgtgcgcctgggcctgaaggtgagtgggtggggacagggaaggtggaggggaaggacaggtcttcattccaggggttccggggagtgtgggggctgcattcaagcgggtggggcggaatga

SEQ ID NO: 6350 - DNA, 585 bp, Chlorella protothecoides
atgaaccggccgccggcggaccacacgctgcgcctgctgggcacgctgcgggattgcatcccggatctcgcgcttcgcaccaccttcatttccgggttccccggggagagcaagggggcgcacgaggagctggcagagttttccgactcatttgggttccagaggggcggcgcctttgcctacagcgaggaggatggcccccccgccgctggctttcctgagcaggaggaggggcatgcacgtcacggccagggattgacactgtcattgccctctttgagaccctctcctggcgctccatgtgtcgacgtcagatctgttgctccgtttagatcggcctcactcctccactctcttgcacccccccttgtcatgcagatcccccaggaagtcagagaggagcggcgggatgagctcatgtccatccagcagaggaacagcattgcgtttgccgagagccttgtgggcaaggaggtgcgcagcgacagatgcctccgttgggaagggacatgggctaagaccacatgctgtgatagaggtgctttggacctaccgagtgaagcaggacatggatacaggatctaa

SEQ ID NO: 6351 - DNA, 2130 bp, Chlorella protothecoides
  modified_base (222)..(231): a, c, t, g, unknown or other
  modified_base (414)..(423): a, c, t, g, unknown or other
  modified_base (573)..(582): a, c, t, g, unknown or other
  modified_base (634)..(643): a, c, t, g, unknown or other
  modified_base (1949)..(1958): a, c, t, g, unknown or other
atggtgcaatgcggtatcgtaagtgcacgtctgcaccatgaaaacagctccaatcggtcctcaccagggacactcggggcttggaggtttccagcggggggctggtcgcggcccttgtcctctgatgcagggctgcaaaacgaggaggccgaggccccacacgaaagcagtccccatttcggaggtgggtgccagagggcgacggcgacagccacagccctnnnnnnnnnnggagtgcagggggtgagggacagagtagggacactcggggcttggaggtttccagcggggggctggtcgcggcccttgtcctctggtgcagggctgcaacacgaggaggtcgaggccccgcacgaaagcagtccccattgcggagtggggtaccagagggcgacggcgacagccacagccctnnnnnnnnnntcaacaaatgaattagaatccaccgttcaatatatgtggcacgatgtccatgccatggacttgccccatgtaacggtgctggacgtgttccagcccatgcagcgtcagagtagattgactgccccgccaaaatactcgcgccctgaagcnnnnnnnnnnattgtccaaaagcgaatcttatttgcgaggggacaacaggcgtctttgatannnnnnnnnngttccgggcgtccgagtagattgagtgccccgccaaaatactcgcgccctgaagcgaaggcgccttgccttgccaggtcgccggatgcagtctgctcatcggcgcggcaagaagcggaaaccagaggccgacctggaggcagaacggtccctgtacgcttctttcgctaccgcggcaaactctgtgtcccagctctattccttggccctcggacagcaggcccgttaccgcgacgagggcgctcgccaaagcctggtaggctgtgtcgcgctcgaactagtcatattggtgctgccctactcatgttccacgtgccgtatgtcctgcccgaacgtgtgtatgaatggctctgcaaagagcacggcaacagctccaccctacccactgcggctctcatggactttctgaggcaggaggccttgctgctcgggacccctggcgagtgcagcgccacgcccgttcccgtcctgcccctggcgccccccgccgtcttctcctcagcagccgcagcagccaaagaggacgagggcgtggaagggggagacaagggcccggcagctgtggtgcggcgactgcagcagcagcagctgcatcaacagcagcagcagcacgaagagcagcaacagtctgggtgatggtgtggtgcagctcggacatgccccagggtagaggtgaggatcatacacacacgcagcgcacgtggcgatgcacaggacacacctacgcttgcgggatacactgcgtcggtttcgatggtcttgtcagatcgatttgaagatatcgagaccggtgcttgcccgggcatcctcagtactgaggggcctataactcttgccgatcccctacataatctctatcgcgcgtgcacgatgccctcgcggcgtgcgggctcgtccaggaattcgggtgaccctcctgcccaacccaacgagagcctggagctgatgtacgaaaccccggaggaaacaggctcccggttgagcagcgggacccgctcatcctcttgggacagcaggagctccagcagcgtaaccagtgacggtgggacctgcagccccaccccggcctcccccttccccacgcgctcctcctccgggactcctcagcgcgacagcccaggccccccccccaggacccgcacgcagcgttggagggtcctggacgtgaggcgccggtccacgaagcgcccctgtcacccaggcgccgagttcaacgcccccgacctgctcagctacaacccggcctcctcgctagccaggaggacatggctgggatgcagaggtctgaccacggcgctttgtatctnnnnnnnnnnaaaaaaggggcagagcgtgctccaggaggaattggctggggcgcagaggtctgaccacggcgctttgtatctgatgcgagcccggcgcaccgaccctcgaggcaggcggacccttgggcgcaccctcgaccatgtcagccaccccacccccgcagggctgcctgcgaggtga

SEQ ID NO: 6352 - DNA, 318 bp, Chlorella protothecoides
atgctggcccctgcgcttcgccggcacggcatgcaggcctggctggtgaacacggggtggaccgggggcggcgcaggggcaggcgccaggcacgacccgcggcacatccaagcagtggtgcacgcaatcctgtcggatgcgctgcggggcgccgacctcgtcaagctcccggtcctgggactagagatgccgcgctgtgtgccgggggtgccagcgcccctgatggacccacggggttgctggcccaacggcgaggcctacgatgatggtatacgccggctggccgggctctttgcacaggtagagagttggttgtaa

SEQ ID NO: 6353 - DNA, 516 bp, Chlorella protothecoides
atggtgcagacgtgcacttacgataccgcattgcaccatgggctggggagcaccatacctgctctatccatcactccctgcactcgacccgacgcccgcccgcaggtgtctctgggctgcccgaagaacacggtggacagtgaggtgatgctgggcaacctggagcgctcgggcttctccgtcgtggacgaccacgagtcggccgacgccatcgtcatcaacacctgtgcctttgtcgaggacgccaaggcagagtccctggatgccgggagtgcctcctttgcaccgttgatttcccgtgccggttgtgctgggcaccccttgtccccattaagatcgggcaggtgcctcccggtgtgctgcaccacccactgttggcccctggattcccctgtccaggccatcatggaggccacccagctcaaggcggagggcggcgctgtccagcgagtcgtcgtgactggctgcctggcccagcggtacgccgatgacctggcaggtacagactggtggtaa

SEQ ID NO: 6354 - DNA, 825 bp, Chlorella protothecoides
atggcggcaggggacgtgctggggggctgcctggcttctggccggcttccgctcgtatttgacctggacgagacgctgctcgtggccaagagccagagccagctgcagcgtgagctggccgagctccgcgacgtcagattatggtatcccccagcttgccagcacccgactaaaggagcaactcctttgtcttgtgcgccgtcccaagaaccctcctgggggcctttgcgtggtcgggtgctcgatctttccccacttgagccctccctcaaaaaccaacaacacccccccaggcgcccggcgctgactcagcagcccagttcaaacgacagggcgctgggcctggccgcgctgcggcgcgaggaggagctgctggcggccgacctctccctcctccagcagtttgcggagcacgacgcggtggagtggggcggggcgcgcctggccgcaaccctggagcccgctgcgggcccggcgctgcagccactgcaccgccccgtcgtgcgcctgcgccgcgacggcgcctccgtcgtgctcacgcgcatcgaccccgccctgcccgccacctccatgatcttccacgtgcggccggggtgggaggcggcgcgccctgcgctggcggccgccgcctcccacgacgtctacgtgtgcaccgccgcccggcaggactacgcgctggaggcctggcgggtgctggacccgggcgagcacctcatgtccctgcagcagcgtgcgtgcttgttttttgttcttgggggggggggagagatgaagaggggaggaggtggagaggtggaggggtggggaagggaatctgcctgctga

SEQ ID NO: 6355 - DNA, 969 bp, Chlorella protothecoides
  modified_base (644)..(653): a, c, t, g, unknown or other
atgtcggccgaattgctcagggtggcttgtgtcaccctcttggatatggagatacttgtcaggtgtaggttcccttgccaccgccctcgcatctttcggcagcctgggcgcgccttggaaacaattttgatgatcatgcgcactcagccgcagatactctgcgggcatggcctcgcaagtgccaccccggctcctggcatgctgggtgatcttgctggctgtgctgcttcgcgtgatcctgggccttcactcttattctggtgtgtggcttggagatgggatagctcgggaagcgaggctgaagtgaccattctccgcgagatcggatgtctcccttgtccccttgcaggtgcgggtgtcccacccaagtatggggactacgaggcccagaggcattggatggagatcaccatcaaccttccactgagccaatggtacacgaattccacacagaatgaccttgcatactggggtctggactaccctcccctctctgcctaccaggtgggttgccctggcatgtgtcacatgataacaaggtcggcgggacaccgcctcccaccaagcaaacccactctcctgcaatgccgcacagagttgggtgcatggaaaggtgctgcagcggtgggtgcccgaagccgtgnnnnnnnnnncgcataccgcacagagctgggtgcatggcaaagtgctgcagcggtgggtgcccgaagccgtggccctggggtcctcgcgcggcatcgagaccccccggagcaagctggcgctgcgtcagacggtgctcgcctcggacctggccgtctacttcccggctgccgccttcctagccctgaccctgcatggcgccagaccgtcgcggcaggccgtcaccacgctggcccagctgctgcttggcccaggcctcatcctgatcgaccacgggcacttccagttcaactgcatcaatctgggcctgacggtgaggcagtttga

SEQ ID NO: 6356 - DNA, 1464 bp, Chlorella protothecoides
  modified_base (1347)..(1356): a, c, t, g, unknown or other
atgttcttcacaagtcccatgcttattgtccagccctgctttcccctggatctcctccattttcaaccctgcccgttcacccagattgtgctgggagtccctctgatcacttccctatccaacctggagttctggctgttcctcatcggggcaggggcgggggatgaggaggccgcacagctcctggctgacttcccggccagtcaggatgcggagggagtcagagcatggaacgccgacctcattcggcgggtgaggctcggcaggctggacgggacctggggaggagggtttccttgccacaccacaggcagacagccgacccctcctcatccctccacaccatccacagacgctcgaccttcctggcgtgggggggctgcatgtcatgccgctgaccaaacgggcgcggcagctgacgcaaggcttcctgcaggatgggaccctgcccaagagctgtcccggagtggaggcctgacgaagcttgattttgggcgacctggcacaccaggctctgcacctcatcccttagcaacccctaaacgccagcgggcgcctgccaaccctcgtctcgcggctgacataccttactgcattggctcatacctatcaccaatggcccattacccatacagaatgaatgtgatgcaaggttccacgacaactgttgcaactcagcaatcgacaagcggggaactggactctgggtaccggggagggaggtcgctgatctttgggatgtcccctttggcccgagcatcggccacagcggcgtcgggatctttctgctccgccgtcgcagctgccttctggatggccacacctgtaccacatcgagggttggtgtggcgtggaggaggtgcattggcacgagcaggggtggcaccggatcctctatctgactggccctgcgtcccacaactcccctacctggggccaggcgaggatggtgtaggcgctgaggagcagggccttctcgtccacggtggggtccccgacgtactgcctgcccagcttacgctcgttgggcccgaaggagagcagcagatcctccgcggtcacgctgccccccagcgcagcagcggtcttggacttgagatcgtgcacggagtcgctgccatcggaggcaaggctgactttcgcgctctgcaccgtggccccctcccggacggcatgtccgaaagcgaccttgaccgtgacttccacgctgtccttcccacccatgctgaaatcgggtgggcctatctggagtggggcacttttgcctgctcgtctgctgcgctgctgaaccacgtgcactccccccccggatccacttccttttcacacaattcgcatggcaacatnnnnnnnnnntgcgctgctgaaccacgtgcactcccccccaggatccattcactcttcacacaattcgcatggcaacaggcaccacagcacgcgcctgcaaggactttctggaggtag

SEQ ID NO: 6357 - DNA, 633 bp, Chlorella protothecoides
  modified_base (454)..(463): a, c, t, g, unknown or other
atgttgagagatgcaggcacagcccggtccagaggtgagctgcccgccgacacccgtctctgggcggtggccaaccctgggtccgagacgctgcaccgcctggccgccaaggtggaggcgggggcaagcaccgtgctgacccagcccccgctgctctggcggcggagccgggagtggatggaaagcgcggcagagaaaggcctcacgcaccgagctcgggtgggatttgaacgtactgcaggcggccggcctttgacaccgcgggccgttcccagaccatcttgtcttgggcgccttgacatcttcttcacgagtttcatgctaattgtccagccctgcttccccctggatctcctccatgtccaaccctgcccgttcacccagatcgtgctgggagtccctctgatcacttcccgatccaacctggagttttggctgttcctcatcggggcgnnnnnnnnnnctggcggcggagccgggagtggatggaaagagcggcggagaatggcctcacgcaccgagctcgggtggggtgatgagctttggtactgggattttgtgaatgggtctggagggtcgaaaccttgcctgcggcgggcagatttgaacgtaccgcaggcggccggcctttga

SEQ ID NO: 6358 - DNA, 231 bp, Chlorella protothecoides
atgggcgacaagcacgggaacgtggtgttcttccccgagcgcgagtgctccatccagcgccgcaaccagaaggtgatcgaggaggcgcccagcccctttgttccccccgagctccgtgaagccatggggaagcaggcggttgcgctgtgccacgccgtcggctaccactcggccggcacctgcgagttcctggtcgacaagcaccgcaacttctacttcctgggtgggtga

SEQ ID NO: 6359 - DNA, 432 bp, Chlorella protothecoides
atgctggccgtcacccgcgccttcggggacccggaattcaagggcgagggcctgcagaagctgctgcgccgcggtgtggaggagggcttctggacccaggaggaagccgatcagaggctgtgggttttcatcatcatcaattccccaccgcccgggcatccccctccagcctgcacctcgatgtcagaccagctcccctcccgtcccacccacacgacgaacccccacaggcacttcagcgcagaccccgtgacggcgctgccggacgtgacggcgctggtgcgcactcctgacgacgaattcctggtggtggccagcgacgggctgtgggatgtgctgagcagcgcggaggtgctcaaggcagcgcggcagggcctgcggaagggcctgtccttgcaggtgctggttgggagcggggggacacggctctag

SEQ ID NO: 6360 - DNA, 363 bp, Chlorella protothecoides
atggccctgcctggcctggttgctcccgcccgaggcctggtagaaggcggcctgtggctggagtggctggcctgccgcctgccgcagaccacgtacgagtccaacgtgctctacgccctgcgcttcatggtggacaccggcatcgtgggtgggaactgggtggagctgcccgcgggcaagtacgtgctcaccccgggcccctcccagctctcgcactgccagctggaggcgcacatcgccgccgcggacctcgtcagccacgcgcccgagggcgcgtgggccaagctcgcgcccttccgcatcctgtcggtggacatcgagtgccagggacgcaaggtgggcaggctgcataacagggagtga

SEQ ID NO: 6361 - DNA, 462 bp, Chlorella protothecoides
atgcgctggcgcgacctgatcatcgagaccgaccccgacgtcatcatcgggtacaacatcatcggcttcgacctgccctacctgctggaccgcgccaccgccctgggagtgccgcagttctgggcgtggggcaagctgcgcaaccgggatgaggtggacctcgatctatcacctttaccagcaggagtagaaattgaggcactgcatgcagaacctgcacttgggacccaggtgcacacagttctccatcaacccgttggcgatggcccccacggacccaagccgaacagcacccctccccctccactccacccctccccacgtccaccccaggcggtgcaaggtcaaggacgcgcgcttcagctccaaggcctacggcacgcacgagtacaaggaggtgggtatcgaggggcgagtgcagttcgacctgctccaagccatccgccgggaccacaaccttag

SEQ ID NO: 6362 - DNA, 537 bp, Chlorella protothecoides
atggtcaaacttcgggtcaagtgtcacggaaggccggagctgccctacgaggcgtctgtctgggagaatgctggagcagcgcttaggtccatcgttgccctgctgaatacggcggcgcctggcgatgaggcccgcatcagtccaaccaaatcccagcctgttcatccacccgcgctccccgaccccaaacgagagactggacccatcgcatcagcgccaatcgatccagatgcagttcaccttttctttgctggcaagacactggaccctgctctccccctctccacagccctgggcaccaatgaaaagacatctgccatcgtctgggtgcaccccaaggcctccggcaggccgccgcgtgagccggctctgggacccgatgagcaaaagcagctgatggcctggcagtttgcccggcaggaggctcagcgggccgcccaggaggcggctgagcccgaggatggcggcctcggctgggcagacccgggcacgctgcattgttccctccaaggtctgactgccgtacgtctgcgctga

SEQ ID NO: 6363 - DNA, 738 bp, Chlorella protothecoides
atgatgggcagcgtcccccgcctgtggcgctccatctcccaaagaatgggcttgagcaccctggttctggccgagcaaaagggggggaggctggaccccagcaccgcacaggccgtctccgctgcccgcgccttgggcgggcccgtcaccctcctcttctccggcaggggcctggggggggcacccagcgccggcgcggctctggagggcgtgaccgccgtgctgacggcggatgacgaggccctggatcaccagctggccgagcctgcgggagccctgatcgtggcggtgcagcagaggtggggtgttctgtcagggcgactgcatcgggggtgctcgcagtttccagggcagagggtgccgctgcagatcgtgaaggaagcagggggaccagggggagtgatcggtataggtacgctgcctgctgcacccctgcgcgtgtacagcaccatgccaccctcccgctccttgaacccacgacacaagcaggaggtccttcacgcacatcctggcgcccagcagcacgcatggcaggaacctgctgccacgcgctgctgccaagctggacgtgcaagcggtggccgacgtggtggaggtccaggggccatgcacctttgtgcgccccatctacgccggcaacgccctcgccacggtggagacgcccgcggaggggctgcagatgctcacggtgagaggaggggctgggggtgggaggcgggttggtgtcttctggagtaa

SEQ ID NO: 6364 - DNA, 714 bp, Chlorella protothecoides
atgacaacccaccccctgcgcggcacaccacactgcctcaggctgggggctgtgcccatgcacgcctcgctgacgcagaccgccgtgggcatcggcttcgccttcctgccagagaacgccaagcgcgaaggccacattccccagatctggctccaggagtttgcctggagcgaggagacgaagccggcgtgcctggccaggcgggacgcccacatgcgcgaccatgccgacctgggcaagcagcccatgttctgcatggagacctgcctcaagctgctgtactggtcaaacctgatctacgacctggagtcggtggtgggcgggctggcgaccctggagacagccacgtccctctactcccagcactcgcacgagctgctctgggacctggagacagacaccaaggcggtggttgcctggggcacatcgcatgttgttgtcgcctttgctggcacctccagcatggccaatgtgctgacaaacctcaaggtgaaagctgggaggcggcgtggtatgtgccagtggggaggaggagccgttttggggggtaagatacacatgtctctctgcagtcttgagaagcagccatcaggaacccaaggtctgccagtatggataccaccgcagttggccaccacgctgcatcctccaaagagaaagaaggaaggaactcgatttggtggatacatgagggtacaccagggtgagttgtaa

SEQ ID NO: 6365 - DNA, 1215 bp, Chlorella protothecoides
atgccctcgactctcactcccgccgccaggcaaaaggtgatgtcgaccttcaacaaggccaacgggtatccagcagacgccgacgtcatctatggcgacaccgactcggtcatggtcaactttggggtgccggacacggccaccgccatggctctcggccaggaggccgcggatctggtgtccaagacctttgtgcagcccatcaagctggaattcgagaaggtgtacaacccctacctgttgatcagcaagaagcggtatgcgggcctgctgtggacccgggccgaggcctgggacaagatcgacaccaagggcatcgagacggttcgccgcgataactgcctgctggtgcgcaatgtgatcaccacctgcctggacatgatcctggtgcagcgcagtccggaaagggcggcggagtacgtcaagggcgtcatcgccgacctactcatgaacaagctggacctgagcttgctggtggtgtccaagggcctgacccaggacgcggccgactacgagaccaaggccgcgcacgtggagctggcgaagaaaatgaagaagcgcgacccggcgacggcccccgccatgggcgaccgcgtgccctacgtcatcatcaaggcggcgcgaggggccaaggcttacgagaaggcggaggacccgctgtacgtgctgcgcaacaacctgcccatcgactcgcagcactacctggaccactacctggcccagccgctgatgcgcctgttcgaacccatcctgcggaacccgcgcgacctgctctgcggcgcccacactcgcgccatcctggtgtccacccccagctcaggatcgggggggatcatgcgatttgcgcagaagaaggtcacctgcctgggctgcaaggccgcgctggggcctggggagaagacggtgtgcaagcactgccagcccaaggaatgcatcgcacctggcacccaccattcccgatcaacgcactctggaccccaaccgaataacatctgcaatcaggagggcgaggtgtactgcaagacggtggcggcggtgaacgacctggagatgcagtttgccgcgctgtggacgcagtgccagcggtgccaggggtcgctgcaccaggatgttctctgccgctcccgcgactgccccatcttctaccgccgcatgaaggtgcagaaggaggtaggggaggccgcggcctccctggccaggtttgacgagtggtga

SEQ ID NO: 6366 - DNA, 891 bp, Chlorella protothecoides
atgaccccaaccgagctgccgcgttgccagatgcctttcctcaggcttgcgcccgcctccccgcggccacccgcgcaccctccctccgaactccgacctccaccccgcccacaccagctgttcctgctggcgtccatcggcggcgtcgtgctggcctcctttggcgtcgtgtgggtccccttcctcgcaaccccagggggggccctccccgtcctgcgccgcatcttccccaccgcgcgaggtctgttcgaggactacgtggccaacctgtggtgtgcaagctcgctggcgatcaagtggcgccgcctgctggccccctcccagctgctgcgcctctgcgcggccggcacgctggccgccgtcctgcccgccatggcctgccagctgcgccggcccacgcgccgcgccttcttgctgggcctggccaactcctccttggccttcttcctgctggcctaccaggtgcacgagaagtcggtgctgctgcccctggccgcgctgggcacactgggcgggcccgccgcagagctggcgcagtatgttggggtgtactccatgctgcccctgctgcgcaaggacggcctggccaccgcggccgcggccgtcgccgtcgcgtacgccgccgtgctgggcacgctgcgccccgccttgcccccggcctggcgcgcggcgcgggcggtcttcctggcgggggcagccgccatcacggttggcttctgggcggtgccgccgccgccgaggtaccctttcctggaggacgccgcctgcatggcgtggtgctgcaccgccctggtctgcctcttcggctacaccaacgtactacaggtacaggagtgctgggggccaggggcggcgcggcgcggccgccacggcaaaagaaagggcgcgtag

SEQ ID NO: 6367 - DNA, 1506 bp, Chlorella protothecoides
  modified_base (147)..(156): a, c, t, g, unknown or other
  modified_base (521)..(530): a, c, t, g, unknown or other
  modified_base (1381)..(1390): a, c, t, g, unknown or other
atggcaacagtagccgagcatcaccgccccctccgcccatccccccttgcagactcccggcctgggtcgcttcgacttctcctcctccaagttggggcggggcggagagccgcagcggggcgccgccttcatgtttgtcctgcacgnnnnnnnnnnctcgggcggggcggtgagccgcagaggggcgccgccttcatgtttgtcctgcacgtctctgaggaactgcagagctggccggagtcggaggagcgcgtgcgtgagtgggtccccctgaagctggctcctgccaggtgccggtacgcctggatgcgcgatgccctggagtgctgggttgcggccaggggctggcccccgcttgaccccggcaggcactccccctcccttgtgtggacggtggggggcaaggaggttgccacatggccgcctcagcttgtcactctgcacgccggggagacccaggccttcattgtgcacttttggaccatcattgctggaaggcgcgagcaccacccagccctgcnnnnnnnnnngaagcatgcccaccggacgggggtgcaaggaggatgtcgacctcaatacgaatcaaggagggaaggcgcgagcaccacccagccctgcggaatatgcggcaaagatcgtgtgcaatcaggaacattgcttgatcgcaattgtcgtctagattttgaaccgagggacccgcgtttgaaagagttgcgggacacgatgtccggcaagcggccaactgaccacctcgagccctcggcgaagaaacggggatctgaaaaacagatcaccaaggacgagggagaggagtctgccgaggagcatgtgtgtggggattgggtgcctggggctgtcgcggaggagcccggaacattccagcgagcatcggatgaggtcctgaagcagcgcaagatcatcaaggcacgacgaccagcccagggccctgcaggcgctgcagtcacagcatcccctgcgaaccccttcgctggcatccagctggccccagctactgagaacccttttgcaggaattcagctagccccagcacctgttccagcccagacagcggccccttcggtgggctctggcgaggacacccaggttcagggtgatgtggaaggagccgaggatgtggcaacagcagtacccgacagtgcgcttgcagaggcacctgttaccactgcagaggcatctggtaccaaggaaaccacgtctgggagtgcagccccagaagctcctgccgtggagacagcccctgtcgacgcagtggcttctgctgcaccgacgccggaggcccaggctgcgccctccctggcggccccgacacccgcagtgtcctccatttttggaggaggattggcatcagcaagcgcgggcnnnnnnnnnncggcagccccgacccccgcagtgtcctccattttcggaggaggattggcatcagcaagcgcgggcggcggttttggctcgcttggtgagcgggagtgttgcgcggaaattgagtag

SEQ ID NO: 6368 - DNA, 1704 bp, Chlorella protothecoides
  modified_base (122)..(131): a, c, t, g, unknown or other
  modified_base (285)..(294): a, c, t, g, unknown or other
  modified_base (1253)..(1262): a, c, t, g, unknown or other
  modified_base (1420)..(1429): a, c, t, g, unknown or other
atgccggcaccgaggatgttccaggagtggggtggcgatttgagatccagcgtgaatagggaggcgcagcatccatgctcaccccccggggggtggccgaaggcgcccttctcgatgaacannnnnnnnnngagggaggcgcagcacccatgctcaccccccggagtaccttccttccgatccaagatccaaatgaatgcaatgagtcagaagcttgtgatgactgggaggccgctggggctcaccacccggccatgccagcagcgcagggctgccaggatggcnnnnnnnnnnacctcgcgatttgaaaactcaaatccttgtttacacatccatcaggctgccaggatggcgcccagggctgcgcacgagctgccgccgctccccttccccatcgattccctggagtccaagggcatgagcaaggtgaggggagatggagctgggtaccagctatccctttcgtcatggaggatgctgcatggaaagatcctgacatggctgcagggcccattgctgccaatcatcatagatcccaagtcttctcataaacgtgcaggaaaccttcgagttccactggggcaagcaccacagggcatatgcgcaccagcaagcaagcaccccgcccactccacacagctcatccacaagtcctggaacaatggggagcccactcccgtgttcaacaatgccgcccagaccctgaaccacaccttcttctgggagtccctctcccccaatggcggaggtgagccgtctggcaagctggcggaggccatcaagaaggagtttggcagcctggacaagttcaaggaggagtttggggccgccggcgccacccagttcgggagcggctgggcgtggctggtggaggctggcgggaagctggccatccgcaagacgcccaacgccgtcaaccccatcgtgaacggcgagaagccgttgctgaccctggacgtctgggagcacgcctactacctggacttccagaaccgcaggtcagacgagggtgcgaggagcagggatgggaggactggttgcatcacgcgtggaaaaggggcagggggctggggacaggagaagaggatgggcgcaggagcacttgttgggggggtcaggcctgacttcatcaagaacttctggaacctggtcaactgggacaaggtgcgtctggggtcgccgagcgctacggagcctgaggtcgacacctcctgccaccacttttgtttgggtcagcagagtcggttgaattnnnnnnnnnngtctgcctggtgcaggcagcaaaagtctttctctgatcgaaggcttctcttcccaatccaatgtaacacgtgtggatgcccttgtgcctggtgcaggtggttggcaccgaaccgttcctgggcgactcccgtcctcaataatcgggaccagggccagnnnnnnnnnnttcttatttgttctggtcgaattcgacattggctcatcatcgaatgggctggcgcatgctgtgtactcttgaatcaacatttgcgtgcggttacccagcagtccgtaccagggaagtttgcggtgggctcgccccttcgtgcgcggccctcgtctctagaaaggtctcatgatcatattcagcaagccgagtcaggaggaccgccgaatgatagggtgagggtgggaggtacgcgcctgagacctgtctgtcgaggctgtgacgtggcctcctga

SEQ ID NO: 6369 - DNA, 2631 bp, Chlorella protothecoides
  modified_base (126)..(135): a, c, t, g, unknown or other
  modified_base (1762)..(1771): a, c, t, g, unknown or other
  modified_base (2042)..(2051): a, c, t, g, unknown or other
  modified_base (2528)..(2537): a, c, t, g, unknown or other
atgttacgccttgtgagagtgatatcaaagctgaaggtaggtaaacttacaaggagctcacagagcagtgggcttctgggggagcttgcgggggttcttcctcgccacactgccgggaggggaacnnnnnnnnnngcaacatgtgccatcctgctaaatgagcgattgacggcataccatgacagaggaagcctaactctggtgaaagttagcgcctcgggaactcacttcacatccttgggattttgcaacaccccagtggacatgttacgccttgtgagggtgatgtcaaaagctgaagttgtgccgtggccgtacctcggtggactcagggcgcgacatcaaacttcagatgcacgaacgtgtttgcttccttacaacggtgggtcctcgcctggcgacactgggaacgtgtcgccatgtccaacgtctacaaccttgagccccccaccaagggaaaggttggtgcctgaggatcgcaatgccattggatcgcaatgccgttggcatcccctggtgatgaaattgactttttcgtcctatctccaatccaccagcgctcctcacatcccgcaggcggtgctgagaaccagcctgggtgatcttgacatagagctgtgggccaaggaggccccaaaggcggtgcacaactttgtccagctctgcttggaaggttattatgacggcaccattttccacagggtgctcaaagacttcatggctcaagagtgtggctcctccaggcgcttgagctccaggcagcttcaccccaactccaacaaattcacaggcggcgaccccaccggcacgggccagggtggcgaatccatctacggccgccccttcaaggatgaggtgcacagtaggctgcgcttcacccaccgcgggctgctggcctgcgccaaccagaacaagccggacacgaacggctcgcaattcttcattaccctggatgccacgccccaactggagcgcaagtacaccatatttggacgcgtggcgggcgacaccctgtacaacctgctgcgctttaacgacctagaggtgggcgaggacgaccggccggagcaccccccggtcctgaagagggcagacgtgctgtggaaccctttcgatgacattgtgcctcgagtggacagggaggccagggaggctgaggccgccgaggcagcagcaacggcggcggccagggccaagaccttgcagcgcaaggccgccaagaacttcagcctgatctcattcggggacgaggccgaggcggaggaggaggccgccgtggaggcggctgcctccctgaagatcgcctcggcgcacgacgccctgcacgacgcccacctgtccaaggaggcggccctggacgtggatctgaacaggcgagtcgcgggctgtggatgtgggtgcttccagctgctatggctggtggtagctgctgtggctggtggtaggagtgagaccctgtggctgtgtgcgggaggccttgcggtccgccaggcagcggcaggaggaggaggctcccccctcgaccagcgccgcgcctgccccccagccgtccgacctggagtcacgcatgcgcgagcgggtgcaggcccggcgtgcagccaaggcgagcgagggggaggggcggcccggccaaaatcagtcgcccagcgggagtggcggcgaggaggacgaggaggacggggacgcatccgaggaggacgggcggccgcgcaggagggcggcgcgctccctggcagggacggggcagggcaagcgctccacnnnnnnnnnnaggaggacgaggacgcatccgaggaggacgggcggccgtgcaggaaggcggcgcgctccctggcggggacggggcagggcaagcgctccatggccgccgtggtggtgccctccaggcagattgccgtggccgatgccaacctgctgagcagctgggagaagcggaggaaggtgggcggggtcgcgggtggagagggggcgcggcctgtggtgttgctctccgcagcctgcgccgtccaccacgattgcacccacgcacccagccctcccgnnnnnnnnnnttgctggaggcagcctgtggtgttgctctctgcagcctgtgccgtccaccacgattgcatccacacacccagccctcccactcgcccgcgacaggagtacctggagcggaaaaggatcggcggcagccgacagagggacacgctgagcaagctgcagcgcttcacgtccaacctccggtcagctgcagggcccggctccagcgccggagccgaggcagggcccagcacagatggagtagaagccgcagggcccggcccagacggcgcagctgcggcagcaccggcctctcaggaccgcagcggagcgccagagggcgccacgccagaccccgacttccaaggttcgatttggatcattctggcattatgccccccgggagcagtggatgccaaatgcaggcgttcaaagggtctcgtgccgcgcgcgcgatgcgatgatgcatgcctgggggctgtcgctcatgtgatgactacacnnnnnnnnnnggagcagtggatgccaaatgcaggcgttcagagggtctcgcgccgcacgcgcgatgcgatgatgcgtgcctgggggctgtcgctcatgtgctga

SEQ ID NO: 6370 - DNA, 1353 bp, Chlorella protothecoides
atggtggcacgactgtcgagcatcgaccccgccgaccgcctcgtggctactcgtgcgctgaagaacgagtccatcgtcaacccgaggcgcaagctgaccctgctgcgggcgggggcggtgcccgccctgctttcccagctcgtgcaggggccctcccccaagcaagcgacgcagagcctgtccgccctggccagcctcctgctcgtccagcagggctgtgcctgcctggtcgaggagggcggcaccgaagtcctcctcatggcgctctgcagccaggacgcgggggtggcagcagcctctgcatccgccctccgagccctgtgcgtgcaccgccccctccgtgaccttcccccggcctgctgcttggcactgtgccgcctggtggcgcaggctggggcggactctgtggcccccgcccacgtcatggccgccgtggccagcagtcccggccccgcgcgggcgctggtcgccgccggcgcggtgccgcaccttgccggcctgctgggcatgcgcggcgcgggcctggcgcgcacgccagtgctccaggcgctggcggggctggcagcgggcgacccggaggccgcgcggcagctggcggccgcgaagcccgcggtggatgcgctggccctggcggcgcggaacggggccgaggcggcggcttcgcggtacaacgccgcggcctgcctcctatactgctgccccgtactacaggagcggcagggggaggctgagaagcaggccctgtatggagtacccctggtgcggcacgatcatcctatagtagcaagggtcacatgccatgctgtccgcgtccccgcacctgaccctgccccactccccggcccaatcccacagagcttgcgctgctgcgtgctgtccacgctggtcgccctgcttgactgcaaggagcctctgggctgcgagcgcgcgctcctcctcctcctgggcacggatgcctcgctgctggccgccgccgtggatgccggcgcggtggcgcggctggcgggcaaggtagcgcgctgcgactgccccccgcagcacctgaaccgcattcattctcgctggagtgcggactcgatggcctgggccatttcccgcccccctgaatgcgaccctggccgacccaccggctcacgctttccacctccaacccgcctccagcccgacgccctgcggctgctgagcgagctgtgctcggatgaggaggcccagcgtcgtgtggtggaggaggcgggggccctgccccgcatcgcggcctcccttgccccggacagggagcaggaagagcgagcagcagccgtgcacctggtccgggtcctgtcccgcagcaccaagctcctcaggtgtgtgtga

SEQ ID NO: 6371 - DNA, 402 bp, Chlorella protothecoides
atgccccgcacggaggtggcaaggggggaggccctggtccgcgccgcagtgtttgacctggtggacacactggcgcccggcctgggtgccgacggagtggccaggacctacgcctgggccacgggcagcttccggcgaggcgccccggagtccagcgacatggacatgctggtcggcctgccgcccggcacggagcacgtggactgcgtgcacttcctggagcaggttggaaaggaggggtgggttgcctcatgtgggacgctggcggagcgatggacgtggacgtacaaagggcggctggcctgtatccacaggggcggtgctcccttgcaggctcaatgtgatgaaccacttacgtgttcaatcagaaaagctgcagtgcagtataaccagaccaagtag

SEQ ID NO: 6372 - DNA, 384 bp, Chlorella protothecoides
atgctcatacattcgtttgcagagagtcaagctcaaccaccacctccccttgcgaaaccccttcaaccagccttcactccagtggcgtccctcccggctgaggtgccacaagcgaccggggaggaggatgagaccacggtcttttctggggatggcgttctctttgagttcgatgcctccaagcagtggcgggagcggggctccggggagatgcgggtcaacctcggcaaggagagcaagcagggccggctggtgatgcgccagcgaggcaaccttcgtctgctgatgaacgcaaatctctggccggacatgccggcggcgcgcatggagggcggaaaggtgggtggcggggatgggtgcagggggggtctggcagtttgttga

SEQ ID NO: 6373 - DNA, 234 bp, Chlorella protothecoides
atgccgcgcggtgtttcggctctggagccatggaagccatcagcctgcagggggtgcgagggttcgcccgtctaccacttcctgcaggcgcttttgacaaatgacataacgcccctggaggctcccgacgccaagcccttgtacgcctgcctgctcagcgcccagggcaggcacttgcatgacatgatcatccacaagatgccaggtggggatgtggggacggggcttcagtga

SEQ ID NO: 6374 - DNA, 903 bp, Chlorella protothecoides
atggaggccgatgtgggtaccgaaaattccgggctgccccgggcggttcagctgcacatcgcggacctggagagccatgtcagcgggctcacccagcagctggccatcgaggccaagatccatgaagcacatgctgctcggtatgaaaagctgaaggcccgccaagaaacccagacaaggactgcgagtcgcctccatgcacgggcgctggacgaggtgggggacagggcagacctggcctccttccagctgtccaagtccaaggtggagctgtaccgctggcgccagcgcagtgccctgctcaaggtccggcactccagcgcggtggaggacgcggaccgctacgaccgcctctgcgcctccacctcgaggctcagtgcggtcggggcgatggccgccgcgcgccactcggaggcgcggcgggaggcgacgcgctcaggcgccgccctgcgcgcccagctgcagcaggcgcaggagctgacccgtgcggcgcgccaggaggccgcccgccaggaggcccaggccgctgggttcaggtccgaggccgcctcggagcgcgagtggctagcccaggcgaagcgggaggccgactcggagcgcgagcggcgcgcgctggcggaggagatcgccgcgtccgcgcgctcgcgcgcggaggccgccgaggcgcgagcgacgcgcgctggcggaggagatcgccgcatccgcgcgctcgcgggcggaggccgccgagggtgccctgcgagcgcgggagggcctggcggccgagaaggagagcttggcggcgggcgtggcggccctcgtagggcgggggcggcggaggctgaggggcggtcgctgcgtgcacggctggagacgctgcaggcacaggtgggagaatgcttgagtgggggtttaggggggtga

SEQ ID NO: 6375 - DNA, 225 bp, Chlorella protothecoides
atgcccctggagtacaacctggatgcgctgcggggcgtggcttacgacaagggctgctacgtggggcaggagctggtggcccgaacccattacaagggggtcatccggaagcggctcatgcccgtgcgcttcggcgtcgggggcgagggcggcgcggaggccgcgagatcgcggcgggcggcgctggctccggagggcgggccgcgggcgtcgtgcgggccgtag

SEQ ID NO: 6376 - DNA, 423 bp, Chlorella protothecoides
atgctgcatgcagcagggtatgacggcagggtgaggcaggacatcgcgcacgaggcctacatgccggctgcctggagggtggacgcctacttgggaaaggacggcgaggacgagagcgacgacgacctcgccagcttgaggaagcacagggtcctgggaccttcaagcagtctgctgttccacggaaaggtccaatggatttcccctgcctgtcggcgtccccaacaaggtctcccctcctactcccacgacatcaggctcgcatttgtcaaggacgcccgggatgccatggccaggaaggaaagcgtggaggattacaccgtgcacgacccgctgctcgaggcgggcaaggccaagttcaacaagaagtcgcaggccgaacgaaaacgcggcaatcagtgggcagggcgggcgaacaactag

SEQ ID NO: 6377 - DNA, 402 bp, Chlorella protothecoides
atggccctcaaacatgtgttcgagggctgccgcctggtgttctggcacaagtcccacatgtcccgcatgaaggatcgggtggtcgacaggggtggctccatagcagcggcactggacaaggacaccacccacgtggtatcgggcgcgaataccagcctggtcacagcggcagctcacctggccaaagcggagcatgtcaggcatgtggctgtggtcgtgagttggttgggagccgacggggggagccctgccaccagcgcagcatcggaactatggggccgccaagtggccccgtcagccttgcacaccgggcatcacatgaacctcctccaacccaagccccagacccccatccatcacccaggccctccctgtcgctcgacatcgactcgatgcgtgtag

SEQ ID NO: 6378 - DNA, 705 bp, Chlorella protothecoides
atgagcagggcgacccgcgagaagctgcggcaccactggtaccgcaccgccagggcagcgacggcgccccccaccggcaaggaccaggggggaaaggccccccgcgtcaacaccgtgtgcaggcacgctgcctgcgccccgcaccccttctgcatcgtggagaagctggcggagtaccgctccgtctacgtggagggcagggaccagtaccgcatcaaggtgtgtgtgtgtgggcgggggtcacggtggctgggtcgcggcgtggggagcacaggggtccctcagtatggtggtgcccagctgggcaccggctgccagcactccatgtggctgtgcgaggagctgctccatgggtgttcaaccctgcttgccaagctgctcagaagccatcccaggagccgctcccatgtccccgcaaccccccttgctttccaggctctggagcgggcgatccagcaggtggccggccatggctcgccgctggaggaggatgcggacgtggaccacgtaggcctgggccccaagagcgcccagaaggtcagggacgtcctgcgcagcggggagttcatccgcgtcgctgccgtcgccggggacaagcggctacaggtgcggggccgtggacatcctgcgcagcggggagtccatccgcgtcgccgccgtcgccggggacaagcggctgcaggtgcggggccgtgtgtgggttag

SEQ ID NO: 6379 - DNA, 1251 bp, Chlorella protothecoides
  modified_base (90)..(99): a, c, t, g, unknown or other
  modified_base (236)..(245): a, c, t, g, unknown or other
atggtagaggatctcctgctgctgtgcgcagctcactctcatgcagtcctgcagcctcctgtcactcttcgcacccatgcagaggtgctnnnnnnnnnnagatctcctgctgcagtgcaaagctcactctcatgcagtcctgcagcctcatgtcactcttcgcacccatgcagagcatgttgtgctccgcctggccggctggaccatgctggtgctgcacatcgccggcatgccgnnnnnnnnnncgggaacgtggatgatgggccagacgttgacctgccgcagcatgtcgtgctccgcctggccggctggactatgctggtgctgcacatcgccggcatgccgcccaaaggtgggaccctcttggatggggatacgctgggcccttccccgctcggcatggcgctgatcgctctccatgacccagagattgtggtgaccgggcacagccacaagtactcagtggagaagtgcccggcaggccgcctcttcatcaaccctggctcagcgggacccgcccgcttcaagctgcctcgctccgccgccatcctggccctcacagagacacaaggcgaggcaaaaactgattggaagaagttcttggcggcctggcaccgcaagggtagcctcttcattccatgctggcctcattgtgtagtggtgccaccaatcgcttcacgtccctgtacattgcactccccgcaaaagggccagcccgggccacaggcgcgacccgtggcgccaagcggaaaggcatggggcagcaggcgcagcaggcgcagcaggcgcagcaggcgctgcgcccccctacgcggccccggccacggccgccctcttgaagtggaggggggccctgaggaaggccggggtgtcggggacgctgagcgcgcagcccacgccctcccaggcaccgccctggcgccccgcccgccgccccgcgtagtagagccgccagcgccccgccgccatggacacgggccaaggcgcgcccacgcccccctcgtcccaggcgccctcgccgcccgctcggaggatggggtccggggtacgctgccagtcgcccagaccgtcgggcgacaccgccaagccgatggagcgggtgttgtcggcggccacggcctcgtagaacatgaagaaagcgcgggaatccaggtcctggactacgcagtgcgccgtcgcccccgcggcgtcatggccctctcctccctggcgtggaaaggggggaatcaaggtgcagatcggactggctga

SEQ ID NO: 6380 - DNA, 1296 bp, Chlorella protothecoides
atggcggcgatcacagtgccctcgagcatgagtttgtctgtaagatcatggagccattcacatgagcacaggcttgtcagccatgggcgccatggacggccccagccgcgtccaagtcgcctcgctccacgtgcaagcatctacagagcccaacacctcgctcgtctcgcatctcccgcaggagacccgggagcgtgggacgatggagggcttggcacccccgtcgtgcgattttacctgtcagagggcagggagcagtggtacatgtggcacagcgggcatagcaccgaggatgaccctggcgtggacgccctcttccctggatccggcagcgtcggtgaggcttggctctgtgttcatgcatgctctatgccgatacgactccgggctttcagtaggagtaggtgtataattgttccttgttggggatgcgcatgggtcgtggcatgcagtccgggcacggtgtgtcgtcatgggttgaggttctctcatcccagcgacgccagcctgctcctggcacccccaacggctgctgccagctttgttgaaccctcccgccacccctctcacaggcctggcggtctcccaggatggtctgcgctggcagcggagcatggaggccgtgacgggggagaggggcgcccccgcgacgtcggacgtcggccgagtgctgggccccaacgccgaggactggtggtccttcgacacgcgccacatcagcgtctccgacgtccagatcctgggcgacagccaggggggcaggagcgatgcgggcgtgtactggatgttcacggccggagggtcgcaggaggaggcgccgctgccgccgcgcctggcgcggctcctgggcgccggcgccggcgagctgaccaagggctggcggacgcagccggggctggccatgtcgccaaacgcgcgggtgtgggccaggatagagacctccgacgagcccagcgggaccgtgctccccgagctcattgtggctccttgcagcttgtaggaggcacgggatggcatgttccaaggctgccgcaaaatttccgcctcccacgccacgggtgcgccccgccgtcgcaggtggtggcggctggcccgaacgacctgaggatgtactactattcgtgggacgagggctcgggccgctttgtgattggcctggctcgctccgaggacgggtttcggtggaagaagacgggtcccatcttccaggtaccgtggggtgggagtggtggtggtagggatgatgggccagcagcttgcttgcagaagcttggtctgtggcctcctcgggcgtga

SEQ ID NO: 6381 - DNA, 1629 bp, Chlorella protothecoides
  modified_base (290)..(299): a, c, t, g, unknown or other
  modified_base (946)..(955): a, c, t, g, unknown or other
  modified_base (1210)..(1219): a, c, t, g, unknown or other
atgggagtctggagcagctgctcaccattcctcccatgcaggttgacgctggtgggcaccggcctagtgagggatgagcgggtcgtggcggccatgagccgtaccggggacaagtccgagttgctgagggggcccctcttctacgtcctcgtcctgtttgctgtcaccctggcatgctggcgcaactccccaatcggtgaggggctgggggaggcagcccaggcagttttcaatgcagagatggggggaggcaatccaccccaggcagagggagggtccctccagcatcnnnnnnnnnncttttcaatgcagagatgggggggggaggcaatccaacccaggcagagggagggtccctccagcatccataggacactgacagtcatccggcttagttcctctacatctccttcccatatcgatactttgcccaaaacccaccccatctccctttttacaggcctggttgtcatagctgtgctgtgcggaggggatgggctggcggacatctttgggaggaggtttggagggggcgcccgccttccctggaatcaggccaagagctgggcgggatctgcggccatgctgggaggcagcctcatggtagctgcctcgctaatctccttctatcacttgctgggccttgttccacacagtttgcaagattctctgggaccaggcaaggagggtgcctggtatgtgcccttgcaggggcatgctgatgcagcagtagcttacaggcctgcagtcgatttgtgtgaagatccttgctgcagaccctggagtgcccgcagtggccctcctcctgggcagcacactgttgccttaaccgcggcctgggaggacatatggggattcgttcagctcgaagctgttggtggcaaggagcaaaaggagcagagaaagagaaagcccccacccctgccacctcagggcttcaccccgnnnnnnnnnnctcagggaggctgttggtggcaaggagcagaaggagcagagaaagagaaagcctccacccctgccacctcagggcttcaccccgggccacttggtgtagccagagataacggcagacaggaggcccgctgcggcttgcagcgccggattctgcagcagcttcccactcttctgaatgtcggccagggccaggaaggaatctgaagcctcaggtctctcctcacaaaaagcacctgctgcgtcctggaggatgctnnnnnnnnnnactcatggtttgagcatgcggattgtctacagccccctcccgaatacacacgaggaagcctcaggtccctcctcacgaaaagcacctgctgcgtcctggaggatgctcagcgtgcggagcgtgcgcacagcgcgcaactcgctcagccgcgcctggaccttgcgctcgtcttggggaccccaactctcatccgtctgccggctgcgggccaggtcgtccaggatcttcagctccagctccaggctctcctgctgcagcagtgtggcgagcgtgatggagccgcagtagcccaccagctcaaaccaggccgagacgtaggacagcgagtcagcgtggcgcttgctcagcagccccaccttgatcatcctgtgcgaatggagggggggcgggcagagcgtgggtgcagctag

SEQ ID NO: 6382 - DNA, 1608 bp, Chlorella protothecoides
atgtttggcgagatcgcggagaacaaggacgactacgccaagttctacgaggccttctccaagaacctgaagctgggtgtgcacgaggattctgccaaccgcggcaagctggcggacctgctgcgctacaactccaccaagtcgggcgacgacgcgacgagcctgaaggactacgtgacgcgcatgcgcgacggccagtccgccatctactacatcaccggcgagtcgcgcagggcggtggagaactcgcccttcctggagaagctgaagcgcaaggggtacgaggtgctgttcatggtggaccccatcgacgagtacgtggtgcagcagctgaaggagtacgacggcaagaagctggtgtcggtgaccaaggagggcctggagttcgacgacagcgaggaggagaagaagaagcgggaggagaccaaggccgcgttcgagccgctgtgccgcctgatgaaggacgtgctgggggaccgcgtggagaaggtggtggtgggcgagcgcatcgtggactcgccctgcgtcctggtcaccggcgagtacggctggtcggccaacatggagcgcatcatgaaggcccaggccctgcgcgactcctccatggcggggtacatgtccagcaagaagacgctggagatcaacgccgccaaccccgtcatcgcggagctgcgcacgcgggccgaggccgacaagggggacaagaccgtgcgcgacctggtgcagctgctgttcgagaccgcgctgctggcgtccggcttctccctggacgaccccaacacctttgcctcccgcatccaccgcatggtcaagctgggcctgagcatcgacgaggaggagggcgcgggggagggcgcaggcgacgacctgcccgagctggaggagaacgcggacgaggggggaaaataccagtctctgcttccaggtgctccggcaagcacagcgctgcagggcgagcgggcacgtccctatacacacactgtaagcgcgcgggcctcccaaagagggcaagggctcacccagaccagcggggcgacaggaatgtcgctgacgctgaataatgccacagacttccttgccaagcgcgatgggatcgacaaggtagggagggggcaatgtgtcatgggaagcacccggagagtcgagtgtggtgcccccttcctcatgccaatgccacccagctccatctcccccgttccatgcccacccgtagaccctcaaggtgatccggtacacctcgaggctgctgctggcggggtccctcccgcgatatgccccggagctgggggcccagctcaaggccctggaggggtccctgggcaccacacgcaaggccctcaagctgggcaagttcctgggaggggtgaagaacctgcgcagcatcacgcccaggacctcccacgccgctctcaagctggtggcgggggtcggggacaccgtctacctcttcatggagcagctccagtggtgggcatcctgagtggatctcggcagggctccgcatggcaccccaacactggcgatgctgtcctcagatggaggatgaccagtttctggctcggtacagggcttggcagtcgctcaaaagcatgctctccccacccctga

SEQ ID NO: 6383 - DNA, 852 bp, Chlorella protothecoides
atgatatccgtgtatacattttaccctgggggagtgggtgacgggggctggagggagccagtaggaccagtcgcgggagtcgttttccgggccgtgctcgaggcagcgcagatggggacagttcatatggggtggcgggaaaggccaatcctccatgcctaccacgcatgctcattgccgctccaagaacacatcaccaggtccgctccgccctccatcctgcctacctccctttttgcagctggcacggggggccatgcatgtcaccgcgactccgtcacccctggtggcgccccctcgggggttcccaccggggctgtgcttccgtgggcaccagagtgtgacactgcgcacatggacacgtccccgtcgcaccccccttcatcgatcggctgcgattaccgccgttcaggagtctgcagccccctccctggtggtgccgatcgcgaacgcatcgaggtccttgcctgggtgtcgggagggcctgtgcatgggatacgccccctcgtgtctgctcgggcatatgcatggggtgcgccgggctgcgcaccggcctcgcgccgcctgcaccactcgatgtattgcttgtgtcgacaagcatacctccagactatctatcccgtctccgacattggtcgctcgtctctcgcgcaggtgaagggccacatcattcaggttgaccagaagggtgcccatgtggacgtcggcgggaagtctgcagccttcgtgcccaatgtcgagatggcgttgggcctcgtcccacgggtgtgtgggctggcgcttgttgttgggctggtgcttgttgttggtctggctgtgtgcatgcgagatggtggtggagcacagtggtga

SEQ ID NO: 6384 - DNA, 720 bp, Chlorella protothecoides
  modified_base (611)..(620): a, c, t, g, unknown or other
atgctgcgcatgcagcgtcacactgggtgctgtgaagtcgcacagagcagcttgccagtttatcgtcgtgcaaaggctggcagcattgcatgtgcatgcccatgggggtttatcgtgccgctgttggatcctgtgtccgtggttcagagccttcccagacattcagtagtcctgtgcccgctgggaccctcccttcccatcctgacaccccgacataaaccccgttcccattttccacgccgcccacagtccaacgacctgctggatgctggcacgtcccgcgagtttgtgattgtgcggcaggaccaccgcggcgacatcatcctgtcgctcaagcgaatacagctatcggtcgcctggcagcgcctgcgccagatcgcggagtccgacgccgcggtgacgggcgtggtggcggccaccaaccgcgggggcctgctggtggatgtggagggcgtgcgcggcttcaacccctcctcccaaataggcattgtgcgtgtgtggaagcgggaggggtggggggcatttgggtcgagggagccgtgtgtctgccgacggggggcgtgtctctggaaggcgtgcatggtgttttcaacatgggtgacacaggggannnnnnnnnngaacgggaggagtggggggcattcgggtcgaggaagccgtgtgtctgccgacagggggcgtgtctctggaaggcgtgcgtggtgttttcaacatgggtga

SEQ ID NO: 6385 - DNA, 1977 bp, Chlorella protothecoides
  modified_base (1502)..(1511): a, c, t, g, unknown or other
  modified_base (1675)..(1684): a, c, t, g, unknown or other
gagttgccgcggcctggccgcgctgggacccgcgctgggccgcctgcgccacctgcgcctgggctcctgcggcgcgggcgccgcgggcgaggccgacgccgtgttgcgcctgctgggctccgcctgcgcccgcctgaccgacctggacctggcggggtttgcgctcaccggcgcaggcctcctcgcgctggcgcctctgggcgccagcctggagacgctgggcctgtggaactgcgccaccgtgcccgacgccgagctgggcgcgctggccgcgctgcccaggctcgccgacctctcgctgcgcggctggcaccagctgaccgacgcgggggcggaggcgctgggcgcgctgcccaggctcgcgcgcctcgacctccgcgcctgcgagcagctgcgcggcgagggcctggccgcgctggccgccgcccgcggcctgcacaccctggacctgcgccgctgccacgcgctgaccgacgcgggcgtggccgcggtcgggcgcctggcctccctccgctccctcctcctggacggctgctggcaggtgacgggcccggggctggccgggctggcaggcttgaggaacctggagcgcctgtctctgcagggctgccgcggggtctacatgccagacggcggcgcactgcccgggctgggcgcctgcgccgcgctccagtccctcagtctgcgcctgtgcgaccgcctggcgggcggcgcgctgggcttcctggcctccctccccgacctccgctcgctggacctcagcagctgtcgcctgctcaccggcgaggacctgggccccctggccggcgccgccaagctcaccaccctccgcgccgagcactgcctggggctggagggccgcagcgcgctggccgcgctgggcgcctgccccgccctccagtccctcttcctctgcggctgccgcaagctggatggcgccgcgctgggcgcgctgcgcccgctgcgcgacctgcgcctcctctccctccacggctgccacggcgtgcccgggctggatgcggggctggacgccatgctggccgccgcgccgccctcccacccgtgcctggccacgctctccctgcagggctgcgacagcgtgggcgcgggttcggggcctggggcgccgccggcgacgatggcaccgccccccccctcgccgaactccacctccagaactgcggcgcggtgagcgatgcgggcgctgcggccgtcgcgcggctggcctcgctgcgcgagctgcgcctcaaggcctgccgcgcgctgacggagcaggggctggccagcctggccgccgggctttccaacctgaccacgctgtccctgcagaacatgacgctgacggacggcggcgtgcggcccctggcccgccttgccaagctggagtccctggagctccagttctgctggcagatcaccgacgcgggtgtgtgtgtgtgtggtttgggatggagtgggcggcataggtggggtgcggaagatagaggaagaggttcaactcnnnnnnnnnncaagctggagtccctggagctccagttctgttggcagatcaccgacgcgggtgggtggctcggggtctgctcgctttcgggggatgtagacacggcagtgcatggtgcagagcaaaaggcgaccgactccccactaccaagccacagtttctcactttccgtgnnnnnnnnnngtgcagagcaaaaggcgaccgactccccacccccaagccacactttctcactttccgtccaacaccacaggggtcacggcgctgacggtgttgaaggagctgacgcggctggacctgctgtacagctggcaggtcacggacagcgtgctggccgacctggcggccatgccaaatctgcggcgcctgaacctgacgggatgccaccgcatctcacgggcggggcgggagtccatcgcccacctgctccccaccgatcgccaggaactgtcctgacgagagccatggctccttag

SEQ ID NO: 6386 - DNA, 417 bp, Chlorella protothecoides
atgcccctcatcgtcaggcatcccccgctgcgacctggacttcccggtcacgacccaaggcatctgccccggcggtgcctggcacgtgggctgccctctctcatcagtgacgccatcagcccctcttccccaacccgagacctcctggcagcagcctttgcaatcacaggctccaagctcatcgtccagatcttcgacaggctggaggctgccgccatcattgacagggcatggacacgagaccctggtctcaacccgtaccagtgcgaccccttcctctgtccccagaatttgagccgcaagctggtgcacacgttggcagggcccctcttcctcgtcagctggccgttgtttgcgtccaatccagagtccaaactcattgccgctgccgtgccattcttgaatgttatacggtga

SEQ ID NO: 6387 - DNA, 339 bp, Chlorella protothecoides
atgatcaaggtggggctgctgagcaagcgccacgctgactcgctgtcctacgtctcggcctggtttgagctggtgggctactgcggctccatcacgctcgccacactgctgcagcaggagagcctggagctggagctgaagatcctggacgacctggcccgcagccggcagacggatgagagttggggtccccaagacgagcgcaaggtccaggcgcggctgagcgagttgcgcgctgtgcgcacgctccgcacgctgagcatcctccaggacgcagcaggtgcttttcgtgaggagggacctgaggcttcctcgtgtgtattcgggagggggctgtag

SEQ ID NO: 6388 - DNA, 2478 bp, Chlorella protothecoides
atgtcaccggggagaagcagcgcaggggaacaggggtcaggggagcagggtcgccaggacctagtcgacctcctccatgcgcgacccctcgtccgcgttctcctccagctcgggcaggtcgtcgcctgcgccctcccccgcgccctcctcctcgtcgatgctcaggcccagcttgaccatgcggtggatgcgggaggcaaaggtgttggggtcgtccagggagaagccggacgccagcagcgcggtctcgaacagcagctgcaccaggtcgcgcacggtcttgtcccccttgtcggcctcggcccgcgtgcgcagctccgcgatgacggggttggcggcgttgatctccagcgtcttcttgctggacatgtaccccgccatggaggagtcgcgcagggcctgggccttcatgatgcgctccatgttggccgaccagccgtactcgccggtgaccaggacgcagggcgagtccacgatgcgctcgcccaccaccaccttctccacgcggtcccccagcacgtccttcatcaggcggcacagcggctcgaacgcggccttggtctcctcccgcttcttcttctcctcctcgctgtcgtcgaactccaggccctccttggtcaccgacaccagcttcttgccgtcgtactccttcagctgctgcaccacgtactcgtcgatggggtccaccatgaacagcacctcgtaccccttgcgcttcagcttctccaggaagggcgagttctccaccgccctgcgcgactcgccggtgatgtagtagatggcggactggccgtcgcgcatgcgcgtcacgtagtccttcaggctcgtcgcgtcgtcgcccgacttggtggagttgtagcgcagcaggtccgccagcttgccgcggttggcagaatcctcgtgcacacccagcttcaggttcttggagaaggcctcgtagaacttggcgtagtcgtccttgttctccgcgatctcgccaaacatctcgatcaccttcttgatgatgttcttgcggatcacctgtgggtgcgagggggtgggggaggggaggccgagtgtgatgctggtgggcaggggggagtggaggtgcactggtggctgccgcacacaccaggacggggcctacgcggggcaagacccccaccggggggcggagaaccccccttcccttctcctcccccctaccttgaggatcttgttctgctgcagcatctcgcgggagatgttgaggggcaggtcctcggagtcgaccacgcccttgacaaaggacatccactcggggcacagctcctcgcagttgtccatgatgaacacgcgacgcacgtacagcttgatgttgttctgcttcttgcgggtgtcgaagaggtcgaagggcgcgcgcttggggcagaagagcaccgccttgaactccagctgcccctccacggagaagtgcttgtaggccagcgcgtcctcccagtcgttgctcagcgccttgtagaaggcgttgtactcctcgcggctgatctcgtcggggttgcgcatccaaatcggcttctgcttgttcaccagctcccagtcgtgggacacctccttcaccttcttggtcttgcgctccttggccgccgccgcctcgtccgtcacctcctcaatctcgccctccttggcctcgctggtcgcctccgcctcctcctcgtcgtcggacacctccttctccgtggtcttctcggtccacagcgagatggggtaggagatgaactcagagtgcttcttcaccaggtccttcagccgccgctcctccaggtactccagctggtcctccttcaggtgcagggtcatgcgcgtgcctcggcccagcggctcgccctccacgtcgcgggtgatggtgaaggagccgccggcctgcgactcccacaggtactgctcgtcgtcgttgtgcttggtcaccaccgtcacgcggtcggcgacgaggtaggcggagtagaagcccacgccaaactggccgatcatggagatgtcggcgccggcggacagcgcctccatgaaggacttggtgccggagcgggcgatggtgcccaggttgttcaccaggtcggccttggtcatgccgatgccggagtcggtgatggtcagggtgcggttggtcttgtcggggacgacgtggatgtacagctccgggttggactccagcaccgacttgtcggtcagggactggtaccggatcttgtccagggcatcggaggagttggagatcagttcgcgaaggaagatctccttgttggagtagaaggtgttgatgatcagggagagcaactggttgatctcggcctctgcggggcggggggagggaaggggggtcagcacgcgggttctagaagggggagggaaaaggggagcggggcgggtccacgggcacacatgcattcctcagcactcacggaaggcatatgtctcagtttctgcggccatgatgtagctcttgtgggtgggagtggctag

SEQ ID NO: 6389 - DNA, 1092 bp, Chlorella protothecoides
atggctgtggaaaccgtcaagcccatgcttgatctcgtaaagtcagctttggatgcctccaaggagcttgaggctcaccccagcggccccacggagccggcgctgcaggcgctggaggccctgcaagcgcgccgcgtcaccgccgcccagctggcctcctcccaggctggcaagctgctccggcccctgctcaagcatgcctctcccgccgtctcccaggccgccgcgtctgtcatcgctgcctggaaggagtgcgtgcgccgggaggcggaggagggccggggtgggtcaggcgacgctccatccgagcaaccctcctcgacggcccgccacccctcggcggcagccgccggagtgcctgtgaaggtggagggtgcgcagagaccggccggcgcaggcgctgcggcggccgctccaccctcgctcaagcgcaccgcgcccggggtgggcacgtgtgagccgccggggtccacacctgcgtcctcgaggccagcgcccaagcggccggcggttgcagcaaccgggggcggcggcggctcgacggcgaccccggcccccgtcccctccaccggggacaaggtgcgcgacctgtgccgcacgacctttgccgccgcgctgtgcctggcggtcgaggagctgagggcggcgccctcgccggacgaggaggcctgcgccacgcccggtgccctggccgtggccatggaggaggagctgcggcgccagcacggcggcgtgaccgaggggtacaaggccaagttcaggtctctgtccttcaacctgaaggacaggaagaaccccgacctgaggcgcaaggtgctgacggggcgcatcgcgcccgacctgctggtcacgctggcgccggaggcgctggccagcgacgcgcagcgggaggagaacgcgcggatccgcgagaagaagctgttcgacagcgcgcccagcgcggccaagcagcccaccaccgaccagttccagtgcggcaagtgccggcagcgcaagacgacgtactaccagatgcagacccggagcgcggacgagccgatgaccaccttcgtcacctgcctcaactgcaacaaccgatggaagttctgctga

SEQ ID NO: 6390 - DNA, 828 bp, Chlorella protothecoides
  modified_base (794)..(803): a, c, t, g, unknown or other
atggagtccccactgctgggtcccagcggcgctcccaatgtgatcctcaggatcgtgaacatcgagtactacctggcaccaccaattcccgaggtggatgcctgctggtcatctctggagggtagccctgtgactcatgtgccggtggtgaggatttacggatccacaccccagggccagaaggcgtgcctccacgttcatcaggtgggcatggaaccagctgaaggtgaagatgttgccacggcatcaaaccttccccaggatgcagatggaggtggggaacagggtttgagactttcaaacggtccttgccatgatgcagcccacctggcccgcaggcaagtagcacccggcactgtaccatgggcatgcccgagtacagaccttccccttcccacacgccctggtcctgcagcgggaacccagctgcgcaggctggggatggcgctggaagcggtcctgagcatgtccaccgcccaggccatggccggagggcaggccgtcaccggggaccaggggtccgcgaagaggcgccagcacatctttgacctgaccctggttgccgccaaggcgttttacgggtaccatgcccaggacagggcgtgggtcaagatctccctgtacaatccgcaggacgtcaggcgcgcagctaccctgctgcaggtggggtggtgctccgtacatctgcagcagccgtcctgcatgcaggtggagcggtctggtgcagggccatgtgggccacaggcccccctcattcccttgtccgcagacaggcgccgtcctgggcagagtgnnnnnnnnnngaccatcggcatccctgtctgctga

SEQ ID NO: 6391 - DNA, 504 bp, Chlorella protothecoides
atgcgtgtggggctgttcaccgcccgccaagtcccggcgggcgaggagctggtgtacaactacaacttccagcagttccagggtgggacggagcgaggggagtacgcctgccgctgcggcgcccccaactgcaagggctccatggacctgcgggctctggcacgcgaccctggcgcgagggagtccggggctgctggcgagcggggaggggccgagggagagatgcaatcccctgccggccgccgtgccggcgccaaggaggccgcggcggcccgccaagcggaggcgcgggcccagccgcccgagggagcggccgtcgtctccgagtcgcaaggagaacgagcctggcggcctcccggcagccgtcagtctgccaccagcgccaggtggcggcgtggaggtcggagccgggaccttctgcgccccgccggcggcaggaccctggcacgcggtgcccggcacgccggccgaggcgtcgccgcgctcgggagcgaggctctgtag

SEQ ID NO: 6392 - DNA, 1284 bp, Chlorella protothecoides
cccgacgagaagctggtgggtgagctgcgcgatcgcctgctggcgctgctgcccagcctggaccgcggcgtggctgcgggccccgaggtcgcggcgcgggtggagagcctggccgcacagctgggtgctgctggcggccccgtcattctcagccgcgccggcgggtacggctctgccggcgggtatggggcctccccctccgactccaccctgcagcagctgggtggccggtggcgcctggtctactcctccgcctttgccaaggcggggcgcctgacgctgcccctgccccttcccgcaaatgtgggccagatctaccaggacatcttcaccgacaccaatgagctggacaatgtcctcgagctgctctcgcccatcagcctcgcctcggttgtgccagggcaaggagaaggggtgttattggctgtggctgggagccggggttacccggactggatggtcagtgtgccctgctcacccttcttgccgccctttcacatgtctcgagtcccttattccccgcgctctcagccctggcacatgattcctcgtcgtccccacaaacaagcgcaggcctgtctggaagccggcccacggccacggttgccatccttccttttatgcttggacgagctgagattcgcggtgccctgcaaccctcacacgccggaaatccctaatcctccaccgctgatgcagggatctgccagctttgagatcctgtatctcaaggatgatctgcgcatcagcaggcgggtgcgcgctcctgttgtgaccctcatgccgccccacccgctctgcaccactccctgtgcctggcatgtcgtgagtcccaatgagttaatcggtgcaacagagatgcagtgcaggaggcgtctgcagcaggggccgcatgcccacacagtgaaaaagacggcaacaccagccgcgcaggggccaggagctgcggggtctcgttccgaggggatatcagcgacagcgtggaaggggaaggcgcgtctcaccctcgagttctttgggtcagactccggcgggaaggggtacggggaggaagcacagggcagcagcgtaagcggagctgggcatcaaggggattggaaagcgcggacgtggccggcggctgggggttggggttgccctcaggcgaaccggtcgacacgcaccgagacgacgcggccgccgatggacgcgttgttcatcctttccaccgcgcggtccgcctcctccttgacggggaagcgcacgatgccaaagcctctgcgttgggcggcgggcacaaggtga

SEQ ID NO: 6393 - DNA, 1440 bp, Chlorella protothecoides
atggagaggcctcagtccgttgaaggagaccggcaggagccttcgggcagcccagagattgcgccggaggtgcctgagtcacccacctcgcagcagccgggggagggaggcaccgaccccgagcgcaccatgcccgcacaggaacggcacagggggactgtcaaatggttcaactcctccaaaggtaggtttaggggacctgggggtcggataaagacgggatcatgtgccaaggacctgtacccatgccggtccgagcccgacccgcacacaggattcggattcattaccctggacgggtcggaggaagagatcttcgtccaccaggtgggggtccccatccttaccttgatgagaggggacgggggtggcagaggggacgcgcctggagggtgcctgttgggtgtccagaccgggcaggggtcccaggggaaagcggggcgcagtgacatgagcgacgaccgtctgcccagaccccgcccctcgccagctcccaccccgtccccgctccgagccccattcccgctccccctccccctgcagagcaacatcgaggccgaggggtttcgcagcctgcgggagggggaggaggtggagtttgagctggcagagggggaggatggcaagaagaaagcgtttcaggtcaccggtcctgagggggccccgccccaggtaggccgggtgcgccgactgctccgcgctgggtgccctgccctgggcacagtggctgcccgcgccgcgacgtcacccaggcgatccgctcaccctcctccccgccggccccgccccgttccacagggcaccacgccatccatgcgcatcatgtacgggggcccccggggagtgggcccccggcccctgtacgatccctacaaccccgcggcagtcggctccatgccaggccccgccggcggcttcgtccccggcgggtacatgtctccggtgggcgacatcatccctggcgggcggggcaggggcctgggcccccccatccccggcggggccccgccggggccccccgggtcgacgccgggctatagctggccgcccaacgcgtacatggggtactacatgccgccgccgggggcgccgccggggtactacccgccgggcgcgcaggggtcgtattacccccggggccgcggcggcttcttccccggcggcaggaactgggcaggggcgcggccgccgccgcccggccagccgggcttcagctccggcctgcaggtggtggtgcacaacctgccctgggactgcacctggcagcagctgcgggacgccttccaggagtgtggggagattgagcgggcggacgtcgtcttcgacagcagggggcggtcaaggtggggcctgcggggtgtcgagagggaagacggctgttcaggccagctacagtatgaggatgcatgggggggttgcaggcaatttgtggtgctctga

SEQ ID NO: 6394 - DNA, 222 bp, Chlorella protothecoides
atgtcctccgcgaagctgccggtggtgagcacgttcaccagggaggtctttcccgcgttctgtagccccaccagggagagctccatctccttggtgaagaagaggctggggggagggatgggagaggcaaggggggaggggaggggtgggatctcaggcggccaaggttgtgtcaccctagagccccatcaagccgtgatcggtgcatggaggacgctgtga

SEQ ID NO: 6395 - DNA, 414 bp, Chlorella protothecoides
atggcttcggggacgcccgttgtggcagtggaggctgggggcatcccggacatcctctgcaagcctggggtgacagggttcttgtaccgatctggggacgtggcagcggctgtggcggctgtgcagaagctagtggctaacgaccagctcaggtgcgggccttgtgggccacgtgtagggaatgtgcggtgcccgcaaaggggtggacagggtggggcaaactgtgatggtgaggagatgagggcccaggtggccgccgccgccagggaggaggtgggcctgtgggattggagggcagccacgcagtacctgctacagtatcagtaccccatggccatcgccgctgcggcagcggcgggcctggggcggaaacaagccgcgctggctgcgggcccgacgcccgcactcgcttga

SEQ ID NO: 6396 - DNA, 1683 bp, Chlorella protothecoides
  modified_base (1240)..(1249): a, c, t, g, unknown or other
  modified_base (1578)..(1587): a, c, t, g, unknown or other
atgaaagctcagatcgacatcacaggacgcctgatcggtgcagtcgtacatctagccagacagcgggctccccgtgtcgtaacatcccacccgcggtctccttcgtcaagacccatccacagccgaacccagattctactctttgcagctcagtcaccactctcttccacagaatccacgtcatctgtgccaatgggaaagagggcagcctctgtggagcactccacccagtctaactacgaggctgtcactgtgacgcacgctgacctcggtgcgctggcaaagggcaaggctgttgtgagccgattgatccggtcattgcatgaagcgaaaccaagagggctatatgcgctcagcgatgcgccgtgccctgcccatgccacagatttggtggtcgatttctctgccaagaccatcagtggcactgcccaggctattcctcttgggagcaaaagggtccctgcttactccccatcccaccccatgtcgatccctgtgcagctcaagtacgaggtcaagcgttcaggctgcgatgcgctgattttggacacacgggacttggccatccaggaagtctccgtggacggagctgcctgccagttcaccctggcctcgcctcacaaggtgggtggtgcttcgggaggcactggccccttctacacacattggattggtcggcagcccagcgcttcatccgaaaacctgcccgccactgtctgctggacaccctccctgaggactccatccccccccgcttcatctgaaaacctgcccgcactgtctgctggacacccctccctgagtactccatccgttccccctgccttcaattcgccctggcaccccgcccacccccccccaacgcaggcgctgggctcggcgctgagcatcccgctccccgccggcgccggcgccggctcccagggctccgcccgggtccgctttgccacctcccccgcctccaccgcgctccagtggctgtcccccgcccagaccgcgggtggcaagcacccctacctcttcacgcagtgccaggccatccacgcccgctcgctggtgccctgccaggacacgcccggtgccaagctgacctacgccgcgcgcgtgcgcgtgccagaggtcatgacggcgctgatgagcgccgtgcccgtggacgaggcggggcgcacgggccaggaaagtggggacggcacgcgcatgttcagcttcgcgcagcaagtgcccatccccagctacctgnnnnnnnnnngcgctgatgagcgccgtgcccgtggacgagccagggcgcacgggccaggaaagcggggacggcacgcgcacgttcagcttcgcacagcaagtgcccatccccagctacctcctggcgctggcggtggggcagctggaaagcagggagctgggccccgtgtcgcgcgtctactccgagcccagcatggtggctgccggggcgtacgagttctcggagaccgacgccttcctgcaggccgccgcctcggtggcggggccctacgtctgggggcggtacgatctcctcctcctgcccccctcttttccctatggtatgggtgctggggtttnnnnnnnnnnggggccctacgtctgggggcggtacgatctgctcctcctgcccccctctttcccctacggtatgggtgctggggttacctgtgcatgccttcgtag

SEQ ID NO: 6397 - DNA, 693 bp, Chlorella protothecoides
atgctgcgagccctcaccttcctgcccctggaggagattgacgccctgctggcgcccggccagccgcccgcggcggctcagcgagcgctggcggcggaggtcacccgcttcgtgcacggcgaggagggactgcgggacgcgctggccgccacccgggccctcgcccccgggtccagcgagggcagtgtggacctacagaccctggaggcggcggtggcgggcggggcgcccaagttcgccgtggaccgtgaggcggcgctgggggggccgctgatagacctgctggtgcgcgtgggagcgcagcccagcaaaggcgccgcgcgcaggctggtccaggtgcggtcgatggggggggggttctggtgtggtgtggacgcggccgtcggagggggtgtggacgcggccatgtgggggcgggggcgggcacgaggtggccttattcccactgcgaggctttggaggtgggggcaggggcgggcacaaggtggccttattcccactgcgaggttttggaggttcgggtggaggggcttgaggaccttgagatgctcccggacgcattgcacccgcccggtgcagtgcgcttgtcggtcgcctgccgcgcgccagcatcccccaggcgcacccacccctctccctctttggactgcagggcaggggcctacgcgtgaacaacaaggttgtcacggatga

SEQ ID NO: 6398 - DNA, 1581 bp, Chlorella protothecoides
  modified_base (210)..(219): a, c, t, g, unknown or other
  modified_base (692)..(701): a, c, t, g, unknown or other
atgcgcgatgcacagaggtcagggggcaactttatcccggggcccacagcttgttcgaggatttttttggcatggcgcgctcgaaacgacactgtggggcggatcgcgactggcacttcagcagactgcaacgggcattgtttcgatcgtatatcatatgcatgcttatgcagtgatatgtgttgtctctatttgaattgggcgctcgannnnnnnnnncggatcgcgactggcacttcagcagactgcgccgagcattgtttcgatcgttggcctcggctggagggcctcaggctcggtgatggaggcgcagcgccgagccaggcagcaggctcaggagctgcaagcctacatgaaagatctcctcaagtgggagaaagacgtggaggtcaaaccaagggtacgcaccacccctgctgccgagctgccccccgtgcgtgggagtgtgccgggaggagcaggagcccgcaatggctctactggtggcgccagcacgaggcacacgccccccacatgctctaccgagggcttgagggaggagggaaacgagcatttcaggaagggacgcctggacgaggctgcggccagctacaccgccagcctcaagctgaagcccacgccagccgcctttgccaatcgagctgctgtatatctgaagaggagggagtgggaccgagcagaggcagactgcnnnnnnnnnngcccacgccagccgcctttgccaatcgagccgctgtatatctgaagacgagggagtggggccgagcagaggcagactgtagcgcttgcctggagctggatgccgggtttgtcaaggcgtaccatcgcagggccacggcgcgagaggccctgggggacatgcacggcgcagcggcagactttgagcaggtcttctgccatgacccctcgtccacccaagccgtggaaagcagggcccgctgcctgcgcgcgttcctggattcccagccgtcgaatggggcgccgagtcccggcagtcagggccctagcgggcctcttcgagtttccgtgtccctggagggctgcgaaccaggccccagcccaggtgtcagcctgctactggagcaggaggccggcggcagcgcggccgctctgggtctggaagggaggggtgcggagatggtcccgctttccaccagctacaagccagcaggagggatgcagcaggttgaggctcgtttgagtcccgggtccggcagcccccccgccctcgacgacgagctgcctggcagccacgcgccgcctggtccggattccgtggagactgccacagggttgcctcgatcgctggtgacagtggttgacgatgacaggggtgtgaggaatgggacagccgctcaggagggcggcactcaggcagacgggcaagaggagcagggaaggagagtcatcacaaccgcggaaaagctgctgagagaaggcgccgcaggcccagaggcggcttcctcatgtcctgcccctgggctgcaaaatgaaactcgtgaccctagtacggtagagaagcaatcccttggcgccctgccttcctaccagggccgggtgccatcctcaggtatgggttga

SEQ ID NO: 6399 - DNA, 762 bp, Chlorella protothecoides
  modified_base (724)..(733): a, c, t, g, unknown or other
atgcatgcgagttcgctcgctcatgccgggtctccagctcctccatgtcatgcgcctggcaggcagccatgccagaccccaccccacgccacccgccggatgatgctgctcctgccatgccccctcctcctggcgcgcacacccatggcatgggctttcggtcctgagcaggcgacccagggaaggcccgctccctctgggacctcaatcaccgcaacaccgacgatcacgacagacggcggatcatggcctcgattcactgggcgggcttactactttagctaccctccaaccctgcaggcccgtgtcctgcctgcccctgtccgccccaggccaggtcagacagcatccagcggcgtgatcaaggcctccttcttccgtccagacaccaagcagcagctggtggtgttggaacgagcaacctcagagatcaagcagtccctcctgcagccaaccaccatggatgagctgggcagtccggccgacacggcccgcctgctcctgccccggaacaccctcctgagccgtgcctggtcccagacgtatgagcagccagcccccgccacccccggcctacccttgataggggccctcctcaagagggagccgctggtcattcaccggcacgaggcacggctcaccgacggcacccggctgtcctctgcgtcgggcatcatgtcagggctagtcatcagtctgatcgccagcggcagcgatgggaatnnnnnnnnnnttctgcgtctggcatcatgtcggggctag

SEQ ID NO: 6400 - DNA, 1440 bp, Chlorella protothecoides
  modified_base (922)..(931): a, c, t, g, unknown or other
atgccggtagatatacggcatggaaggcatgcatggcgtttgaaatacccttctacatacgcatggaggctgcagggtatttactgggataaagatcggcaatcctcggtggatcgcgttatgccgggcgccttcaccatgcagacgcatggcatgtgcggtgcctctccacagtccttgccgtgcgttccactcgccaagcctttcgtcgcacacacgtctgtgcatcgcggcgcctcaggccggagacccgggtctccccgcgcccatcgcccccgccgtggggctcgcccccagtgctccgcacacagccccaccctcgcgcccgacgcgacgccccagcccagccccacgacccccggccccaccggccaggactgggagctggacttctgctcccgccccatgctggatgagcgcgggaagcgggtgtgggagctgctcatctgcgagccgggccccgggggctggcgccacgtccaggtgttccccaacaacaagatcaacagcggggagctagggcgggtgctgcaggccctgctcaccgcccctggcgcgcgcaagccggagcgcgcgcgcttcttccgcggccagatgcagaccatcatcagccgcgctctggcggaccaggacatagtccccctgcccagccgccgctgctacacgctgtatgactggctggcgcagcgcgccaaggaggtgtaccccgcccacccgcgcttctccccgctcaaggctggtacccgcctgcgctccgactggggccccgtggcggagctgccgccggcgctacgtggcgaggcatggtcctttgtgcagctgcccatggacgtcctgctcaaggcatgcgggctttctttttgtgggagtcctctttggttgtgtgggtgtgggtggggtggggtgggagaacagcattggnnnnnnnnnngaaatctgagtgagcagcagaaggttggtgccccatctgggtatttcagacctgagaacagcattgggattggctgccctccacagttcgatgcgatgggggagcttgttgcccaggttcccagtcgccacgatcacccattcaccaccctcacccgctcaggagtacgaggacgtggacgcggggcgcgcctttggcagccgcgcgccggtgccggagggcacggggcaggacacgctcgtccccggcgtggcggtgtacagccgccgggcggggcccctggcagcctggaccgcgggcctggagctgtgcggcgtggtggccgacaccgagcgcgcgggactggtgctgcaagccggggtgagccaacagtggcggtacgggcggtatggccggagcgaggagaccagcgccgaagcagaggcctggcaggccgccaaggcggacgcggggtgagtgctggggggtctgcgggcgcggcggaacgcttgtgcaggagattggcgtag

SEQ ID NO: 6401 - DNA, 525 bp, Chlorella protothecoides
atgaaccccatgcccccggagatgtggctcctgccctactccaagtggacggggatcggctgggcacacccggggcgcttctggtgccactgcaggatggtgcgcgctgaggcctgtgcccgggcgggggtgtgcactgggatgcgtgttgagctggctgctggaacgtctcttggcccagaccagccatgcactggcgcagcctgcggggcgattggcacgcgctgggcctgcaccagtcagaggatacagaaatccactcttctcgagctcagcatcaatccctgtgccatgtccatgcccctcgcaggtctacctgccgatgagctatctgtatggcaggcgtgccaccgggaagctcacccccctggtcatgtccctgagggacgagctgtaccccggcccctatgccagcatcgactggaatgcagccaggtgattgctgtcttaatgttttggataattctggtctcggatggccgggatcgagggttggtgagggtgagctggctcaactttggatga

SEQ ID NO: 6402 - DNA, 960 bp, Chlorella protothecoides
atgctgcgcaggaaccaggttgcagcagaggatctgtactacccccaccctctcatccaggacgtgttgtggtggaccttgtacaaggctgagcgtgagtcatctaagaggggtcacggcttacgatatgtgacctggatcacagaagagaagtgctggggtgtcttgcttgttacttcctccagtacactgttctcttgcccatctccccagtgtgcaaccccgcataccacgcagccctgtatttcaaccatgggtcagagaactcagaccggagcctcctctccgcatccctcctgttgcacacaattacttgccgcacaacctcaacacccgactgcacccgaccccaggatgagaacaccagatacattgacattggaccggtcaacaagatcctcaatatggtgtgctgctggtttgagaacccggacagccaggagttcaagctccatctgccgagcaagtgcactgacgaggacagcgcccagccgccaagcagctgctggtgttaggctgaagtgttgccagtgcctcatgagtgccaagtcaggtgatctaggtgaggtgaacaaacaatgctacagatttgcaatctctgtccacccccatccctcccaacacaaactcccccccatcaggctgtacgactacctgtgggtggccgaggacggcatgaagatgcagggctacaacggcagccaactgtgggacactgcctttgccgtgcaggccgtcgcctccaccggcctggcgggggaggccggcgcgtgcctgcaggcggcggcgcgcttcatcgacgccaaccaggtggcgcaggaggcgcagcagccgctggaggagtactaccgccacatcagcaggggggcgtggcctttctccacgggggaccatggctggcccatctccgactgcaggtgggatggaaagagagtggggggtctacgtttgggggggtga

SEQ ID NO: 6403 - DNA, 435 bp, Chlorella protothecoides
atggcattgtctatgtatgttggaaacgccatgaaggacctggtgtgcggaccccgtcccatcgggcttgtgcaccgggactccacgattcgcttcctggggaaggggcatgaggaagccgagcagaatgccaaggtgggcttgcagggccagctggttgtcgtccattcaaccggctcttgcagggatgggacactccatcccgccatcttgttgcttggggtcctccaccaccaccaacacagtttatctactgcccacatgccagcaagcttggcaatgccaatgaccccgatgagatcacacccctgcgtgcaggagtatggcctcccctcgtcgcatgtcatgaattctgtgtgcttcaacttcttcactgtgcactacctcttggagaatgatgtggtcggccctgaaacggcaggtgtgcccccgtga

SEQ ID NO: 6404 - DNA, 930 bp, Chlorella protothecoides
  modified_base (287)..(296): a, c, t, g, unknown or other
  modified_base (468)..(477): a, c, t, g, unknown or other
atggctacatttctcgatctgtgccgtatgggcagtcaagtgctagacgcacgcaagatcgcgatgcatgacatgcagggacgcgctgcccatacaatgcagccggctggtggaacgccagcgagaagcagagctgcccttcaccacttcattgggtgtggcttcgtgtatgtgtccttgcaataccacggcagcgtgcatcaaatgatccccatgcaatttgtagaaattcatggtgcagaaatcgtgcagttttccccagacccgcaacagtggcgtgcagtcgnnnnnnnnnntcaggatcaggacagtgctccacgcttttcagagatcgtgcagtttcccccagacccgcaacagtggcgtgcagtcgctgtcgctccagcagagggacctgccgtcatgccggtggtgtccgtcaaccgtgaccggctgttcgaagccctgggccaagtgtactccgatgannnnnnnnnnggatgtggtgtgccgcagggatgtgccgacacaggtctgagaacctatactgcctcacttctccctgcagccgatgaggagtttgacaagctatgcttcgagtacggcattgagctcgacgatgtgggcttctcctcacaacgggggttgagctcaggccacccacccctcccccgtccccagacctccgagaaggagatgctgcgcaaggagcaggctatcaaggccgactcggcggcgctggcggaggccagcgaggaagtcatctacaagatcgacattcccgccaaccggtacgacatgctgtgcctggagggcatcgcccgcgccctcaacatcttccgggagcggctgccggcccccacctacacgctggctaacaacggtgtgctgcacctgcatgtggtgtgctgttcgggggcggcgttgaagagcgcgggactcggctcttga

SEQ ID NO: 6405 - DNA, 1536 bp, Chlorella protothecoides
atgccgcagtcccactcctcactcctcctccccccccgcagtctgtgccatgttctccgagtattgcgccgtaccctacgagatcgagccggtggaggtggtggacgcctttggaaagtccacaggtgcatggcggggggtcaggctgggtgtgtggggatggggtgcagggccaggcgcatgcgctacgcgctattcgaacgcacacccctcctcgttctgaaggaggaagtctctcctggccatgatcaagctgtccttggcgcccatcgagcatggcagcaccccgacgcatggaacacccgcgctcgatgcccgccacccagctcatctcatccaccccttccccaccctctgtcagtgacacctgacgtgtcgccccgggagatgcaagtggagctggcctacatccgcagcaccacggggttgaccctggacgccgagcaggcctccgcttacctccgccgcatgcagctggaggtcagggctctgcccggcggccaggcactcggcatccgcgtgcccgtcacccggtccgacatcctgcatcgtgagcatggggattggttgtcgttggaaagctctgaacaagaagggaatgtcgtccctgtccgtgcctcacacctcccacacgggcccccatctgcttcccttccctcctggccagcctgtgacgtggtggaagacgtcgccattgcccacggctacaacaacctgaggataacccagcccagcgacgcgacgacggggcgggagctaccgctgaacgcgctgtgcgagctgctgcgcggcgacgtggctgccgccggctggactgagatcctgacgtgggcactctgctcgcgggaggagaattttggcgcgctgcggcgtggcgacggcgcgggcggcgcggtgaccattggcaaccctgctaccgcggagttcgaggtggtgcgcaccagcctgttgccgggcgcactcaagaccatcggtgggttgggttcaggctttgggccgggtgggtgggtggaaagggggaggatgggaggggggaggcatgtatgcacatggcagtctgcagatgggagcgtctgcacttgccgggacctgtggtcgattcggatcacccctcgattgagccccctcctccctctgtatctgcggtccctcgttgcaggtgccaaccgcgacgcgccgctgcccataaagctgttcgaggtgtcggacgtggtgctgccgtccgactccgccgcctgcggcgccgtcaaccgccgccggctggtggccgtgcactgcgacaagacctcgggcttcgaagtcacccacggcctgctcaaccgcgtgatggagagcctgagggtgcccctggtcgcccgcctgggcggggaggagggcgagcgggcgcgtgcagcctacggcggcggctatgagtggaaggcagaggacgacgccaccttcttcccaggccgttgcgctgccggtgaggcgtggcattgtggactgtgggaggccagggggtttaagagtgggtatgggaggcgcgggggacgttga

SEQ ID NO: 6406 - DNA, 981 bp, Chlorella protothecoides
  modified_base (310)..(319): a, c, t, g, unknown or other
  modified_base (766)..(775): a, c, t, g, unknown or other
atggcaactatccgagcccccaaaccccatacccgcacccaggacaatggactggctctgaagaacgagtggaaaggattctacatcctgctgaatcctcccttccactcacagatgcagtggcggtttgtcaaccgggccatcgatgccgtcgagcgtggcgaggtgagcagttccttgcatgaggggccttcacaatttctcgagggctatgtgttgccagatgggaagggagtcgagggaggtgggacaccggcagctgtacctgccctttcagaagtgttggagccctgcgaaagggagggattannnnnnnnnnggacaccggcagctgtacctgccctttcaggagcgttggagccctgtgaaagggagggattcctgcggggccccactcaccgccgccgccacatgcgcccgacacgatcgaaggtccctggcgtgctgctggtgtgccgcaacagcaccgatgcaaactattttcagcgactgcggccctaccccagggtcctgctggggaggaagtgcgccctgttcaaggactatgacaagtccggtgctcttcacctcctgcctagatgtccgctccagctccaacttccgtcctcctttcccagaccaaacggcttcggcatcgcagctgtcatgctggccaagcgggagcgcactgacctgtacctcaggttctacgatgcattcgaggtggggcagtctgcaagggagctggggctgccctgcagtgaaggggggtttgggaccatgtttnnnnnnnnnntcgaggtggggcagtctgcaagggagctggagctgccctgcagtgaaggggggttttggtaccatgttcgtctgaaagaatgcatccagcatgccgcagccgacctccaatgctccctttccccactccgggaccccaccgcagaggtttggggagccctccatccccatcgaccgtacattcctgctttccggggagttctctga

SEQ ID NO: 6407 - DNA, 1044 bp, Chlorella protothecoides
  modified_base (562)..(571): a, c, t, g, unknown or other
atgggtggggggcctttgaaggctagtgccaggctgggagctgtccagccaggtgcgccctgtgtcctgtccagacggcaacccagtcaccgcccttttcttgaaggacctcgggtgctggagcacattgtggacgtggtgctgtacatggagggtgggcgccaatcccccgtccgcctggtgggttcctggaggactgacgggggggtgggtggtggggtttcaggacgaaccttggcactgaccacaccaccatgtgtggggtggacatgtcgacccgagatacggggcgtgaagaatcggtacggcgccacagaggaggtcggcgtcttccagatgtttgacgacggcatgcaggtggtggcggacccatcctccctcttcctgaccagcaggcgagcaggatgtggggctggctgcggtgtgggcctgcttgagcagtcgcgctgcaggggccactgtgcaacacccggtgcaccacacagaccttccccatgtgtgcacactcatggactcacaccaccagtaccccctgcaccaccggcaagcttgcagggagatnnnnnnnnnnaacagcccttcccatgtgtgcacactcatagactcacaccaccagcacttcctgcaccaccggcaagcttgcagggagatctccctcgacgtcagctccgccgtcaccgtgaccatggagggctcccgccccatgctcatggaggtccaggccctttgtaccagggcctcccaggtgggcacaggttcgagaggggagggggaggtggctgcctgggcgcatggtctggagcgggtcaggctgggcagtctttcctgtcgtgcccagtcgcgccacaccattcaccatccagtcattccccctcccaccacccccacggccccacagggcccaggcctgcctcccacccgagtcccttccggggtcaagcgggagcgcatgcagctcatcctggccgtgttgagcaagcacacagacatgaagcccttcatgcacgacatccacctgaacgtaaccggaggtgtgggagctga

SEQ ID NO: 6408 - DNA, 420 bp, Chlorella protothecoides
atgcctgctctgaccactggcatcacaggccccctcgtcctcagcacttcctacagcttaaatgacccaccaccgcaccccagaaaaaaaactccccttcatccacatgaaggtctaatcatggcggagccggccaccgacctcgcggtggcactggccatagcctccagctactacgaccgcgccatcccgcgcgagctggcgctgatcggcgaggtggggctgggtggcgagctgcgccaggtgccgcagacggagcggcggctggcggaggcggccaagctgggcttcacgcgggccgtcgtaccgccagggggcagcgccggctccggacgccagctggcaaagatgcaggtgcaggagtgccgcacgctggcggccgccatctcggcggtgctcgggggcggcctggcaaagtag

SEQ ID NO: 6409 - DNA, 1320 bp, Chlorella protothecoides
  modified_base (348)..(357): a, c, t, g, unknown or other
  modified_base (1175)..(1184): a, c, t, g, unknown or other
atgagtgccatggagcggcaggtcttgccggtgcctgggtgcggctgtgtcggtggaacgcaattgagtatcctgtcctgcgtcacagctgccgaggcaacgccgagcaaggcgacacatgccagcgcccacgccgctccagtcatcggaatcggtctgataggtggttggagcaggtatagagcaagctcgttggcaacacgtttacgcccacgggccagactcgagcatcggggtgtcacgaatggatttgcgtcccacagtaactgtcatgcagaatttggacgccgagtacgattccggggtacttgctcactcctcgatgtggtggtaccacgcgacgcgatnnnnnnnnnntccaccttaatacaagagcatgcgttgaaaggagcaaactttgctttcagacacgagcatcggggtgtcacgaacggatttgcgtcccacagtaactgtcatgcaaaatttggacgccgagtacgattccggggtcctggtcccaagagagcggcactagtgactgccgggcgtggtcagcatggccgatttcctgggcaagcccttcatggggccagccagcacaccccatgtcgcaccgggaatgttttcggggttcttcatcggtgcacatgtgagttgggcgcttgtgcaggggttgccctgttcgccgcagcgatgccgggacgtttcctgggaacagaagttcgcccgaggaagttcaagtgcgttgctgggtggtccgggtgccacgtgattgatgggcagtgggcaagccgtgagtacatcatctcctgctgcaacgaggccgcacagcggagagatgtgctgcgaggccaggcgcctcgtgcctgggtcccagtgttggctgcagaggtacctctgtttgcccctcgtctcgtggacacaggagcgcatgggccccaaccatcagccctcctaggtatggagatggtgtcagggagtgccagccccagcggcagcactctgcgcacatcccctgtgctgtgcgcaggactgcccacacccctcaaccctcttatctctgtaaactccctccaaatctcccctgttgctgctgttgtaaaggatttctcacactcagtttgttcacttggcggtgggatgtcgacctcgcggcctgcacctcctcagtacgccagtgatgcagcaatgtnnnnnnnnnngtgtggtttgttgggtgtgagggtgaggtggatgggtggggcccagaggatctctcacactcagtttgttcacttagcggtgggatgtcggcctcgcggccagcacttcctcggtacgccagtgatgcagcaatga

SEQ ID NO: 6410 - DNA, 936 bp, Chlorella protothecoides
atggctgacggccttattttcctgcagtccctcaccctcccatccccaccccctccccaccctcacccagctgctgcgcggctccccctgcacccgcccgacaccgtgatggcttctgccacgggctgcgccacgcgcctgggcccgcgggtggctgaggagacgctggctagtctgcagcgccgcttcgtgacggcgcagaccctggccacgccgcgcctgggcgcgcccgtgctgaccctggacctgggccgcctgcccgccgcgggcgccgacctcagccccggcggtgagtctgggagcgagggcgaggagagcgaggacggcttcacgctgcactcccagcccgcctacgagcgcagcctgagccaggcgcactgcgcgccggggccgccctcctgccgcaccccctccgacgagggcggctccacccgcttcagctttggctgcacccaggacgcgcccatgcccctctccgccccgggccagggtcccgccccagaggcagccgcggggaacacccccctcctagacctggcggcacccatcggctgcgtctccgactccacccagaagctgttccccatcttcaagcccaagaaggactacaagcacctgtacatcgtgcgacacggggaatcggagtacaacgctgccacggcggcggcggggacggggtgggacgaccccctcatcttcgacgcgccgctgacggcgcgagggcgggcgcaggcctgcgagctgcgcaacacgctggccgcgctgggcctccccgccgacgcgtgctgggtgacctcgccgctgcagcgcgccatcgagaccctggtgctggcctgcaccggcaaggagcgggggggtgggggcgaggtccgcctccccgccagcctgcacatcaggaggtgggtgagaggaccctctggtgctcgggtgtactga

SEQ ID NO: 6411 - DNA, 345 bp, Chlorella protothecoides
atgcagctgctggtccccgcgctgtggcgggtgctgcagtacttccaccgagcagcggcgctgaccctggtgacctccggcgtgatgaagggggtgctggagcgggctgcggtggcgccccccgccgccatccaggtgtggaagaagggcgtctgctgcgacaccttcaacccgcgctttgccagcgaagaagcccgccgaaagatgctgggaagccatggcgaggggcccctcctgctctgcgtgggccggctgggtgtggagaagaacctcaccttcctcaaggtgggctcccatgttgaggggcaagggagggggtggggagagggggatgagcgctggtga

SEQ ID NO: 6412 - DNA, 351 bp, Chlorella protothecoides
atgccaggggtggagtttgagagggcatggcgtggctccaagcgcgatcccgcggcgcaggccgccctgctctgcgccataccccctgcccgcctgccgcacctgctgactcacgtcctgacccctgagctgctggccgaggtcgcgatgcgcgtgctggaaagcgtggcgcgcaggcagccctcgctcgccctggacctgctgcgggcgctgcgctccgttccccgctttcccatgctggccatgggtctggcgccgcggcagtgtgccgcgctgcggaacgccttggacggctgtggcggcctgcccggggccgagccggagctgctgaaggcttttggtctgcagtga

SEQ ID NO: 6413 - DNA, 897 bp, Chlorella protothecoides
atgcagggcctgacaggctccgtgcccagcttccaggcggcttccaggctgacccacctggacctgcagcacaaccggctggaggggcccctgcccgcactgccccccagcctcctctcgctctcgctgcagggcaacatgctcagcggctccattggcgaggggtgggtggccggcctgccggccctgcagtcccttgacctgggcgccaactccctcaccggcgggctgccggagggcctggccgccgccccccacctgcgcaagctgcgcctcgcccgcaacgtgctgtccggcccgctgcccggcgcctggcgcgcctggcgcctggcggcgctcgatgtgagcggcaaccgcctggccggcgagctgcccatgggcctggcccgcctccccgccctgcgctccctggcgctggccagcaaccgcggcctctgcggcgacgtcgcgcgcttcctgtcggccgcgctggcggcgcgcagcccgctgcgcgccctggatgcgtcctggacgggggtggggtgcggcgaggagggcctgcccccctccctcgcggccctggccatgttcaggggcggggaggcggcccagggcctggctgtggtgggcggggatccggccgacgcggccgacgcgttcgatgcgaccgacgcagaggccccggccagcccgcccgggcgcctgagtctgcgcggcacccgcgtgcggggccctttccccgtttgggtgctgtctgccctggccagggcgggggaggggcagggcgtgcagatcgacctcgcggccacaaggtgtgtgcttgggtcgaggacagaggatgcaggccgggccctgtgtgcaagcgtgcatggcggccggggcaggctccctgccctgcaccaggcacgggctgaatga

SEQ ID NO: 6414 - DNA, 636 bp, Chlorella protothecoides
atgcctccctcgctgctcagctgcccccatcggaccattcgcagagtcggcggcagccgaagctgtgctggcggcctcccacgccgcactccctcctcccaagctctgccggcaggcatgggagaggacgactgcatcagggatgcccacttccggtccagagctcacgaagttcctcgagacgctgtatgggaaggtgggcagcggaggccggttgctctcatgtctggcactgacaggggaaggcgtcatttggtgagaggctgctgccaagccccgccctcttttcaaccccttgaacgcctcccctgcactgcacaggagtcgggctcctacccccccggaacgcggctatgggtatctggcaagtggcccggtgtcgcttggagcctttccctctgcaataagggcgtggcggccgccctggtgctgagtcgcccggcggccaccacgacagtactggtgaggtactacggggagcacaccaccgcctgggtgacagcagggcgatgccagccctttgcaagctgcgaggatgaggaacgtgcgcagcatgcggctctggcggcctggtgccagaagacgggaaggcgagtgtccagctggacctggctgggtgccatgcatctcagctaa

SEQ ID NO: 6415 - DNA, 843 bp, Chlorella protothecoides
atgacacgccacagacccctcaccagcctgagggccgtcggggtgggcgcccagggcctgcaggtgcgggacggcggcagcaccccctcccccggccccactgacgctgccgcggagcggcggtccagcctgctcagcgtgctgcgctcacggggtctgctggccgacgtggcgggcggcgccgagggcctcacggcggctgcggcggccggccctttgcgtgtgtactgcggcttcgaccccaccgcccagtcgctgcacctgggtaacctgctctgcctcatggtgctggcctggttccagcgctgcggccaccaggccgtggcgctcatgggcggcgcgacggggcgcatcggggatccctcaggtgggcggttgagggcgttggaggggggtttccctggggcgcctgctggcatggagctcggggcgtgcttttgcgatgctcaggccaccgtgggctcgggcgacccgccccaccgcgcaccgcccacccccctcctcgtgcgcaggcaagggggatccctggggtgcctgctggcgtgcggctcggagcgtgcttttgcgatgctcaggccaccgtgggctcgggcggcccgccccaccccgcaccgccccaccccctccccgtgcgcaggcaagtccagcgagcggccggtgctggacgaggccgaggtggcggccaatgcggccagcatcgcgcgcaacgtcgaggccctgctgcagcgggtgccagggtccacgggcgaggcgcccctggtcctggacaattacgagtggtggtctggcatgggcttgctcgatttcctccgggacgtgggtgaggcgcatgggggctggtga

SEQ ID NO: 6416 - DNA, 711 bp, Chlorella protothecoides
atggctgagcctgctccatggagcgagcttgcacgaggccagcctggtggctcggtggagacggtgatcggcccggcaggcactccatgcgccgcccgaggattcgtgggacaccatcgccggtgtctttgcgagctggctccccagccctgctctgccctcccccctcccctgcccaggtctgcgacagctggagctgcccgccagtgccgaaggcagcctggacccccggctgggagccctgggtgggctgcaggacctgaccgtgcacaggctgtgcctggacgacaacaccctggccgccctggcccagctgccggggctgcgatccctcaccctccccggcgtcgagctggaggggctgggcgcttccgtccccggatgcctggccctgcccgacctggagtgcctggatgtgtactcctggcacgcgcggcaccgcctccccgacgcgtccctggccttcctgcgccgactgccctccctccgctcgctcaccctgcgaggctgcgggctggagcaggtgccgggggcggtgcgcgacctgcccctgcgccggctgctctgcggcggcaaccgcatgcacgccgccgacttcatccccgccgggcggtaccttgccacgctgcacatgctgggcttcagcagccaggggcggtaccagcgctccagggccgcacccgcggccgccgccgattccgactcggatga

SEQ ID NO: 6417 - DNA, 606 bp, Chlorella protothecoides
atgccacgaaaccccagccttgccctccaccctgcaggtgatgcgcacaggtacacataccacgcagaatctcccggatcccaggacatcctcatcaccgtggccagtcccaaagctgacatcactgtgctcagcgcactcggcacaccgcttgtcgcctctggcgtgctgggggacaaccagttcatgctcagcagggccgcgcaggagtcggacccaggcccttatgagctgatagtccgcggcgtcgtaccagagactcagtacactgtctccaccacggtgcacgagcggcgccgctgcctggctggccgggaccgcagcgccctccagtccgtcctggaaggccctggctgctgctccgcacccggctcctgcgcccggctgagggccgcgctgtccgctgatcctgcccaggacatgtgcgaccagcctggcagcctgtgcgacgatgcgggccagctggtcaagctggacctgtctgatcaggcaggcgcgggggggtttgggaagacggtctgggaattgtatgcagggctcacagccgcggcagccgacgtggcgaattggaaatcgcaatgcagtaggctgcctcccttgctgtag

SEQ ID NO: 6418 - DNA, 636 bp, Chlorella protothecoides
atgtggaagttccgaccctccacggactttgacggcctgggccggtccagcccgctgctgcgcagcgtgaacaagcactgcgggcgtcaggtctggtgctgggaggagaatgccggcactccggatgagagggaggccgtcgaaaaggcccgccaagtattcacagagaaccgacagcaccagaagcatgctgccgacgagctgctcaggcgctcccgcggccccttccccgtggacaagcgcggcctgtctggatcgggcgcgccggcctcggctgccacggtggaggcgagcctgcgcaacggcatctccttcttcgagtccctgcagtgcgacgatgggcactggcccggggactacggggggcccatgttcctcatgcctggcatgctcattggcttgtacgtcacctccgcccttgactccgtgctgaggtggggcgggagtggcacggccggtctgggggtttgtgggggagcggagggtgctggctggctgggcgctgccccagaggtctgtgggccatcatcgggaagtcctaccgtagcccgggtcgcctcttcgtcgctctgtagcattgagattcttgggccacgccacccccgcgcagtccgcagcacaaggctgagatggtga

SEQ ID NO: 6419 - DNA, 1035 bp, Chlorella protothecoides
atgcgcagtgctgaggggctgaaggcggccctgacgttgacgagtcttggccgcgagctgggcgggcccccgctccccgccgagcggctgcacgactgcgtcaacgtcctgctttcctaccagaacccggacggcgggtgggcgacatacgagaaccagcgctcctaccccatcctggaggtgtggggatggctgggcgccgtggatcggaacgatgagtgctgctttcgagagcacgagcctttgtctcgacagcacctcgccacaccaacaccacacacgccaccctgccagctcatcaacccgtcagagacgtttggggacatcgtcatcgactacaactacgtggagtgctcgtcggcatgcatcaccgccctgctatcctttgcggcccagcacccggagcaccgcaccaacgaaatcgagatgtcggtgcaccggggcgtgcggtacatcaagaggtacgcatgggcacccatagctttgctgtgtggagcccaggatggcgtcgctagcgatggcgtcgctggcgtggggccttgggggtgccacggtgtgcaggtgggccgctggactgcacaccagccaccgccaccagcccacgcaccaaactcccacccctctcccccgctggcgcacagcatccaacgccccgacgggtcctggtacggcaactgggcggtgtccttcacctacggcacctggtttggcgcggtcgcgctggccgccgcgggcgaggacgtgcacggctcggcgtgcctgcgccgggcctgcgcgttcctgctttccaagcagcgccaggacggcgggtggggggagagctacctgagcagccagaccaaggagtatcaccagtcggagggagaggcgagccacgtggtgaacaccggctgggcgctgctggccctgctggcggccaagtatcatgagatcgacgccgcgccctgccacgcggccgcccgctgtctcatcctcgctcaggcaagggtgtcagaagtgaagagggaatgggaggtgcacgcccctgctgagtag

SEQ ID NO: 6420 - DNA, 471 bp, Chlorella protothecoides
atgcagccagctctcgtcagttggaccgatgatcttcatgcaggccggcacgcgcgagtgggcaccatgctggccaaggacagcgtgcggacccggctggaaagcgagaccggcatctccttcaccgaattctcctaccagctgctccaggggcaggactttgtgcacctgcgcaagacgcatggcgtccgggtgggcggcagcgaccagtggggcaacatcacggcggggacggagctcatccgcaagaccatggatgccgacgcatttgggctgacggtgcccctcctgctcaagtccgacggcaccaagtttggaaagtcggagggcggcgcggtgcgtgtaaggggcggtgtggggggttcaggggcgggggggttgaaatcgtttgtgatggatccatacggacttagtagcctgccatggggtctccagcgcaatcctgaaagggggcgcaagtctggaccctga

SEQ ID NO: 6421 - DNA, 432 bp, Chlorella protothecoides
atggagctctccctggtggggctacagaacgcgggaaagacctccctggtgaacgtgctcaccaccggcagcttcgcggaggacatggtgcccaccgtcggcttcaacatgcgcaaggtcacacgcggcggcatcaccatcaagctatgggacctgggtggccagacccggttcaggtccatgtgggagcgctactgccgtggcgtgcaggccatcgtctttgtcgtcgactcgggcgacgtggatgggctggaggcggcgcgcgtggagctgcacgagctgctgggccggcccagcctggccggcatcccgctcctagtcctgggcaacaagaacgacctgccggaggccctgtccgcagcagagctcaccgccaagctggaactggaggaaggggagagaaatcttgcagcaaggcttcagggctcctga

SEQ ID NO: 6422 - DNA, 222 bp, Chlorella protothecoides
atggtgaggtacctgaacaaccattccaacccggatggagggtttggcctgcacatcgagggtccctccaccatgtttggcacggtcttctcctacgtgtccctgcgcctcctgggtgtctcgcccgacgacgccaccgctgcggcggcccgtgcctgggtgagtgcgcccggtcagggcattgatgtcaggtcgctgtgggttggaaagagcccaggctga

SEQ ID NO: 6423 - DNA, 675 bp, Chlorella protothecoides
ctgcaccaagcggcgagcagcctgcgactgggcttgaacagcgcggcgatcaacggtgccgtcaacctgctcatccacccgagcaccacggccatgctgcagaaggctggcatgctggcggccgacgggcgctgcaagacgctgagccctgatgccgacggctacgcgcgctctgacgctgcgggcatggcactggtcaccgtacccgaggcggcgacgggcgtgagcgggcgcctggttgccgtgcccttggccctcatccgcggcacggcggtgaaccaggacggccgctcctccacgctcaccgctcccaatggccccgcgcagcaggaggtcatgcgcggcgcgctgcgctgggctttggccgccgcggccgaggtcaccgcccttcagatgcacggcacggggacgccgctgggcgaccccattgagatcggcgctgccgcggccgcgctggtggaaggccgcgcggagggtaaccccctcctcctccaggcggccaaatcatggacagggcacgccgagccggcggcgggcatggtgggcctgatgcacacccacgccgcgctgtcggcgcgcgccgccctccccatcatgcacctgggcaacgtcaacgcctatgtggaaggtgaaatgttgtgctgtgggtgtgggtgtggggccatagtgaggact

SEQ ID NO: 6424 - DNA, 309 bp, Chlorella protothecoides
atgcagcgcctggccgcccgcttccagtttctacgtgggatctaccgcgcccactccctgtctggtgagggaagcaggatggggagaggcaggcatgcaacgcagtgcgtaccacaagtggagtcccgtggctggtcgccgacgcaagaggacgaggtggtattccccgcactggaaggaaagaaggtcctgcgcaacgtcagccacgcctacaccctggaccacgagcaggaggagatgcagttccagacctgcagcgaggtgcgggatgggtgggggagtgaggttgagctgagtttgacgctgtga

SEQ ID NO: 6425 - DNA, 552 bp, Chlorella protothecoides
atggtcaggctcctggctgcgccaggctcggcggacgtcatgcggtccagccaggtggacgcctcccgtctggacgaggaattgagcctgatgctgcgtgagcagttcctgggagccttctccctctttccacggggcacagtgaccgcacacctgcccgagatccagctggcgttggatgccctgatcttctacctgtctgtctggaaggacgcccccctccccggcatggccctcatgaacctacgcttccgggacgagcgcgccgtgccccactccgcctctggagtcgggggacccggcctggccaggtcccagaaggcgatgtacggcctgggagcggtactcctgcggtacgcctgggcccgcaccggtcacgccgcggcgtcgggcggctcggacggggacggcggctggcgggcgacagcctggcaggtgatgcgccgcgccgagaccgcataccgcctcgcagccctcgtcaacgccattgcgttcctgagggcgggcaaatacaggtacagggtttgtggtacgtcattgtggttgggttga

SEQ ID NO: 6426 - DNA, 486 bp, Chlorella protothecoides
gaggaggaggagcaggagcaggaggatgagctgccccaggagttcatgtttgaggcggagggcgtgatcctggacccggccctcctggcgctggcccaggcgcagcagcgcgcgcagggccggtccgggcgcgccaagaccctcatcttcagcgaggaccgggggcggtacatcaagcccatgctgcccaagggcgacaaggtgcggcgcctggcggtggacgccacgctgcgatccgcggcgccctaccagctgtcgcgccgcgcgcgggccaaggccgccgccgcgccgggggccgccatcaggcccgtgttcgtggagcgcaccgacatgcgggccaagcgcatggcgcgcaaggccggcgcgctgctggtctttgtggtcgatgcaagcggatccatggctctcaaccgtatggccgccgccaaggtgcgtgtgggtgtgggtgatttgggaggtgggagacgaccctgggaggtggtgtaa

SEQ ID NO: 6427 - DNA, 195 bp, Chlorella protothecoides
atggcgcggcgtgtgctggtcagcaacctgcagatgctgctgatcgacaccgagaacaagttcgtgtccaccgggtttgctgaggagattgccaaggcggcgggggccaagtactactacctgcccaatgcctccgacaagtccattgcggcggccaccacgtcggcgatgaacgaggccaagatctcgccctga

SEQ ID NO: 6428 - DNA, 426 bp, Chlorella protothecoides
atgcggctgctgtcggagtcgtatgcgtcgcgtgaccaagtgtgcctcatccccttctatggtgaccaggcccaggtcctgctcccgccgtccaagtccatcgccatggccaagaggcggctggactcgctgccatgcggcggcggctcgcctctggcgcacggtgcggcgctgggtggcatgtccctggccgtgcggaccgccctgcaggcccggcagcggggggaggtgggcagggtgatgctggtgctcatcaccgacggtcgggccaacatcgggctggcgcggtccaacgaggagccggacgccatgggaccggatgctgtcaagcctaccacggtggggagtgggctgacttgggaggcgcgctaccttggggcgcatattgttgggctcagggtcaggcagctgacattcatctgttga

SEQ ID NO: 6429 - DNA, 489 bp, Chlorella protothecoides
atggcgctggacgcgtgcaagggcatgctgtacctgcactcccacgcgccgcccatcgtgcaccgcgacctcaagtcgcccaacctgctggtggaccgccactggcgcgtcaagatctccgacttcaacctgtccaagctgctggatggcagcccggtgatgagcagcctggccgccaccaacccgcgctggctggcgccggagatcctggcggggcacgccgccaccttcgcctccgacgtctacgcctttggcatcgtgctgtgggagatgctgacctgggagctgccctggcccacctccaacccctggcaggtggtcaccgtggtcaccgagggcgggcgcctggcagtgcccgaccgcgccgcgctgccgggccccgacacccaggactgggacgggctggacgcctacgtcgacctcatccgcgcctgctgggcccagaaccccaacgaccgccccaccttcagcgaggtcatccccgtgctc

SEQ ID NO: 6430 - DNA, 951 bp, Chlorella protothecoides
atgcccccggacattgcggctgcccgacgaaagcccccacccatggcttcgcacggggtcaaccctgcgcacaaagcggtcaaagggtgcttcttccccctgcgaccgccgtggccggtcccattttggagaagggcatccgcaatctgtcccgagtgctggagggctcgaccctatccccggcacatggcgccccacacatcgatgaattggccaagtttcccagccaagtgcgcccctatgcggccctggctcgcctcgacaagcccattggtgagcccgggtgggctgcgtgccaagatggattgtttgtcccgggtccgcgtgcccttcacttgcgacatgacgccatggcttcccgcaggtacctggctcctcctctggccctgcttctggtccatcgctttggctgcgccggccgggagtctccccgatgtgggtctcctcatttcttttggcatcggagccaccgtattgcgtggcgcgggctgcactatcaacgatctgtgcgaccgggacctggacggcagcgtcgagcggacccgatcccggccgctggcggcgggtgatgtcagcgtcgcacaagccatcggtgaggcagcggaaaagatggaagggtttgtatttgccccctgccccggtatgcgaccgcgcacatgctcgccattctgcacgattggccgccgagccggtccgaggatttccagacaggcacaccttcctctggccacccttctccccgcctcagccttcctggcgctgcaaaccgccgtcggcgttggatggatggccagcctgaacccctccgccctccagctgggactgtcgtccctgggcctggtggcggcctaccccctcatgaagcgcatcaccgactggccccaggtgagcgaggggagtgtgtccctctggaagcttggagccctgggcagtgctgtccctgactcttaa

SEQ ID NO: 6431 - DNA, 564 bp, Chlorella protothecoides
atgatgggctgggcggcggtgcacggggactgtgactggaatgtggtgggacccctgtatgttgcaggcatcttctggaccctggtgtacgacaccatctatgccaaccagtggcatcctgccgtgtcagcacctgccttgccttccatgccgcttgccagcgggttgtgtccactgcctcatgacgcagcatcactcctgcaaccctcctggccagcctccacgcacacaccgaccctccccccaccgcggctgcaggacaaggaggacgaccgcgagatcggggtgcgttcctccgccctggctctgggttcggccaaccgagctgccatgtcggcctttgctgccgcctcggtggccgggctggccgccaccggggtgatggcggggtgcagcggcccctactttggcggggtggccgccgccggcgcgcacctggcctggcagctgggcaccgtcgacctgggcgaccgcgccgactgcggcgacaagttccggagcaacacctgggtcggcgccgcggtgttcgcgggtatcgtcctggaccgcctcgccatcttctga

SEQ ID NO: 6432 - DNA, 474 bp, Chlorella protothecoides
atggccttcaactggggagccttgctggggtgggcagcaatccacggagcatgcgattggtcagtggtcctgccgctgtacggggctggcatcctgtggaccctggtgtacgacaccatttatgcgcaccagtcaccagatcctcggacccccctcacccctcctcatcaggaccaggaggacgatgccaagattggcatcaggtccaccgccctgaccctgggaagacacagcagggcagcaatgtggagctttgcggccggcacagtgggactgctggggttcacgggcttccaagccgggtgtggactcccctacttccttggggtggcctctgccgggggtcacctggcctggcagctgggcacagtgaatctggacgaccgagcggactgtggcgccaaatttgacagcaacaagtgggtcggggccgcggtatttgccggcacggtggcggacagggtgctggggtag

SEQ ID NO: 6433 - DNA, 900 bp, Chlorella protothecoides
atgaggcggagagcagggtgcctcctgcgaccggtcgtgaggctgctctccgcaaagccctccctccagaccgagaccctcgccctgcccgccgtgcatgaccggtcctggacctgggagccgcccgcctgggccccgagtcgcacgcctcgggaaggactgacacccttcctcgccctgcccttcggcgtcggcgccctgcccatcactggctccgcctggcagccagaccatgcggccaaggaaagcggggcgaaggctgactgtcgatcctgggagacgggttccgccactccaagtcaggagccaagtggcgaggagcatcgcacgcggcaggggcctgccgggccaggtgaggccacggccgtcaccccaccccagccagcggcgacgtgggtggacagggcccctccctccctccagccctacctccacctcatccgcatcgacaaaccaatagggacctggttgctggcgtggccctgcttctggtccatagcgctggcggcgccccccggcgccgcccccgatctccggatgctggccctgtttgggacgggggccgtcctgctgcgcggtgccggctgcaccatcaacgacctgtgggaccgcgacctggacggccaagtcgcacgcacgcggcgccgaccgctggcggcggggctcctcaccccgcgccaggccgtagctttcctgggcctgcagctgtcggcggggctggccatcctgctgcagctcaacacatacagccaggtgctgggcgcgtcctcgctctccctcgtcgtcgtatacccactcatgaagcgggtgtttggctggccgcaggtggggacattcatgggttgtgctctgcacgagcggctcatggccgcttgcgagtggagggcaggcggagcctga

SEQ ID NO: 6434 - DNA, 618 bp, Chlorella protothecoides
atgcagcacatgtggcgggagtatctggcgcagagggcggcctccggccgcccggcccaggaccagcatggcggccgccccgacccggggtcgaacatgggctcggcgcgcatgatggggggcatgcccgccggcgaggctgccgcgctggcggcggcggccaagcacggggcgggcgtcgacccggccgccacaggccagaatccgtcgaaacggcgaggcaagggggagctcgagaggaggggcgcccgcgcccccgagaacctggcccgcagcctggcggtgcgagtgacgcgggggtcgtttgatgtggcggaggccggacccgggagcctggaggcggctggcggcgacgaggatgaggacgccgtcccaccagggactgagagcgagcgccagccgcgcgcgtcaggggagggcgcggtctcaggcgtggcgctggccgacctgcccggcttcccgccgggcgcgcggggcagggtggatttcctggtcttggaggagcacgacgagcgcctggtctgggagcgcgcgcccggcagcgtcatcatgtatgacccggacgtcgcgctgacgcggcagctggagctgtacaacgccatgcagacgaggtgctga

SEQ ID NO: 6435 - DNA, 615 bp, Chlorella protothecoides
atgcctctttgtcaccacccgcatcctggtggtggacttcctgggcgggcggctggcgggccgggacctggcgggcctgctgatcctcaacgcccaccgcgtcagcgacgcctgcggcgaggccttcgccgcgcggctcttccgcgccaccaaccgcgccggcagcgtgcgcgggttgaccgacgcggcgccggccctggccgccgacttcaaccgcgcggagaaggtgctcaaggccctctttgtgcgccgcgtccacctctggcccaggttccagtcccaggtcagggcagacctggagacggcgccgccagaggtgaggggcggggtcacttgggaggcttggaggggtgggatgatgggtgtggcacgcacactgcccgagtccacgagggactgacggtgggcatggcggccatgtatgatgccctggcccagctgatggatgcctgcgtcaaggaggttcgcaagtccaacaagatcgatgccaccgacctgaccctggagcaggtgagggggagtttcctttcttccctgcttgtggggacacgctggcttccgcgactgcctgggagcctggggtgcggtttccgtcggaggacaggagcctcatga

SEQ ID NO: 6436 - DNA, 1425 bp, Chlorella protothecoides
atgcttcacttcacattcctcaccgcagttcctggacgggttgtctgtgaccgccatttctcgtcgactcgacaaacgcaagctgcagctagagctcgacacacagagactctttctcctcacgacccactaccgatcaccagacctccaaggtcagcaaaagagccatgtctgcccgcaataactcgtgaacgtgcatccccagaggcttacgccgaggagctggcccgtcggggcaccgcacttgcctttgagactgtgggtcgtcttccctctccactacctgacacacctctgccttgtcctcagggcatgtgtagggcagtggctgacaatctccagacccagctagagacactgacagcaggcctgcatgctgtaaaccccgactctgcggcagcagccaggctgagcttgccacaagaacaaggatctggtgcaggaaggcccaagagatttggtctgggctccctcagtcatgatgcccagccgcatgagcatacacaaggacccccctcccccatccttgaccctccgactcccacatttgcgctggaaattgctcccagcagcatccagcatgcatccgcgggccgaggcgtgtggctgcgtggccatgctgccactggacagccgccaatgcggtggtctcgccggcaagttcgacccgaggcggccactcttcaatgcaaatatccctcacaaccttggtcccctcagatagtggcgctgtatcccggcgtagcgtacaggccgcttcatcatcgtgcaattcccggctaccccatggtgggtcgggacaacgaattcctcctctcacgctttgacggtgtggcgttggacggcaagccatggggccttggggctgcgcttgaaagacggtggccccccctcccgcctcacaacctcgctgaggaggcacttggctgcctagaggcaagacctgggagcaacccaaggcctgatctttcggcattatggctcttacccacaattcccttgtcaaactgccatcgtcgaaccctcccccacatccgcgcagggtgggaacaacctcgcggccgggcacctggtgaggctagtctggcaacgacaatcttacggggctggaatgggagagccctgccacagaaagggcaagtaccgggacacagcttcaccgagtctattaatcttccgttcttcatgctcacctccctagcagggtcacagtcttatcttcgagcatacatccccaacatcgagtacacctcccgcccagcactacagacacttggctcggtgcctggcctggcacttgttgccctgcgggacattgctgaagaggagctatttctgaactaccgactgaaccccaacttgcccaacctgccggagtggtacacagccgtggatgcagacgaggatgctcgcaggtggaattga

SEQ ID NO: 6437 - DNA, 657 bp, Chlorella protothecoides
atgaatcgcacagataccttacatgagttccctcagctagcattgagactcgtcatgcctctggatgattgggagctctgtgccatgagcgcacgggatcatcgtgagatggggcccgggggtactgcttgcgaggcaagggatcagggcactcagcctgacgggtctgaggcacccccgttgcacattgcgcgccttgagtccccttcccacccacccttgttgctggtccagtcaggtctgggagcagtcagggggatgcgatcaaggcatcgaggtcatagatctatacattctacccaacagacatctggaatggcatctgaggcggatgtcgaggaggaggatgtatcggcgacagcagaaaatgtttccgacgaaatcctcatgtgggaggaggacgcgctacagcgactctgggacgaaatcccccttcatgggtacctcggaggtgggcagagtgggtgcatgaggcaacatcttgctcctcattcgcgcactcctgcatgcgcctgctctggcgcgggttgtctgacgggtgctcaacaggcttgccccccgtgtcttcatcctgccatgacatctccggacgtgcttcactccagagcttcaagaccaggtgtgcgagagacctctcctcccgtaccgcgagtttga

SEQ ID NO: 6438 - DNA, 1413 bp, Chlorella protothecoides
atgccacctgggtcatcattccagcgcaaaggaacagttgcagtatcgggtgagcacgggtggcgccctggatccacgcacccgtcccggtcagcatggtcagacagtcatatcaagcggcttggcagatgtggatgccatctttggaggtggctaccccctaggctccttgatcctgttgctagaagatggctccacccacctacatcacttactggtgcaatacttccttgcagaaggcgtcgtcagtggacaggtggccatgggtgggcgcctggcatctgggtaggctatgctgctccagagatcccgccgcatgactgccgcaacatgataaatcccatcaccacacagagggtgctgctgggccacggagagcaagggccagccccatccctggctacctggctgcccgctcagcttcagaccaaggacaaggcaagcccgcctcacgctggcccgacacctgaccactcccccgcatccccgcgtcccctgcaggagccgccgggcgtcgaagcggagggcgatgccggcctgcgcatcgcctggcagtaccgacggtacatcaccaaggcccagcagcagcaggagggtattgggacggcggtgggacgcgggagcggattggggccatccagcagcggcgccattgccacggcaggcagggcagcccctcccagcaagccccggccctgggccaccgcctttgacctcaggaaagcagcgggcgccgaggcgctggatgcccacaggcaccgcgtcgtgagtctgtgctgcgaggaaggcacagcgccaggcacccatgagcccgtcgaccccgctcgtgcattgctcagggaggctggaagcttcgttgccgacctgcgcgacgcgtccgcggcccctgctcccggcgggccgaccggcgctggccctgcgccgccgggaggggagtgcagtgcgtcaggcctggcgacccccaccccaagcggcgcgcctctagccctgcccgcccccagcaccccgacggcgccccgcgcccccctgcccccgcgcagcgcggaggccgtggggcgcctggtcttcacgggactggccggaggcagctggccggaaggtgccgaggcgggcttggcccccttgttgtcaggcatccgggcccgggtccgcgctgcggccgcggtggcgctggtcacgctgtcgccggcaggcctggcgccggccgtgctcgcccaggcacagcatgctgcggacgctgtgctggcgctggaaaccgtggccagcgacgctgagctggtgcgcatggtccctgaccccggctccattgcgggtttgctgtgcgtcaggcggcttccgctgggttcggccttgcagccgccggtccccgatgcccccctgcacctcatcaggtcggtgctttgggttggatag

SEQ ID NO: 6439 - DNA, 2526 bp, Chlorella protothecoides
  modified_base (1725)..(1765): a, c, t, g, unknown or other
atggaggactggggtcgctacagaagcttatgcagcaggagggttgagcactgcttgtggcgaaggatttgcgagagtgacgtcacgatctgcgactcaagaggatcactcaattcccagctccgaattttagatattctatctttgatcgagggtcaagtgaaagactgcacaatgttcaggacgcgcgtatcagacatggaggcgagttgcgatagcttctgggagattctcgaccatcatctggggagtggtgggcggtgtcctcctcccggatggtctagctcgcccaacattcccgcacgcggcgtagaggggcaatggcgccctgggcagcatatggacgatagaaactatcggcaagaatacagcgcgcttgatgagcataaagcatcggcatataattgcgtcggtactggaataagtctctctggtatacatagagcaatgacgtctgcggaggtggccacttctgagcacgacttggcaccgaagcatgagctgcggctggaggtcggctgggagaacagtgtcaccctcacggtgggtcctggcctccacactggcaagatcgctgctgcaattgatctagccattggccatgccatagtgcgtaataccaggccagtcatcgcttccctgaggtgtactacctatgcagctcaaacgaggggaggcagaggtgtttgggacggcgctgggcagccagacatactgttgagtgacgttgctggtgtctcggctgggcaggttctgctctgggctgtcaataggtacacatcggaagacacccccatgcagagctatgtgaacgtccacgatgttctagaggctcgccggcagcaggctctgaccgagcagcggcgcggacccacgaccgtgcgcagtgcatgtgcaacctgctgggcctctgtccccggcatccagatcgttgggcctaccgacgccgggaagagcacgctgtgcaagattctgatcaactatgccatccggtgccgctggactccagcgttggtcgacctggacataggcatgcactccagaggcagggtgccgtccatactggctcaagtttcatcgctcgctccccatgactcacccctctggtccacaggtcaaggcagcatcacagtcccaggctgcatcgctgcgacctccgtggaggcgcccatcgacgtagaggagggcttccccgtggatgccccgctggtctactatgcaggaacggtggccggcggagagaacattgccctgtatcagcatctcgtggaacgggtggctgatgccctggagcgaagagctgggacggatgccaaggtgatcaggaaccctaagtccctcagtgccagagccgcgcctcctcacccttcacatgcccaggtcgctgcctccggcatgatggtcaacaccatgggctggatagagggcgatggctacagcctgttgcgacacaccattgcatctctggcggccgatgttgtgcttgtggtgggcagcgatcgcctgcactcccagctctcttctgacctggccaccagctcgccaggtgtagtgtggggagctcacgcctgctgcacagctgtggtgactgagctgggcggcaatgggttcatagactgcttcaggttctttgggtgcatgggaagcagtcacaaagtttttgaacccagcatacacccagcatgtcctctccctacaacccccgccccccccccccccccccannnnnnnnnnnnnnnnnnnnnnnnnnnnnnnnnnnnnnnnngcagccatttcggtggtgaagcttgccaagtcgggcggggtggtgacgcggacgcgcgagctccgccaggaagcgcgcaaggtgggggcgggttcaagaggagccagcggctgcgcattcgtcccctggctgccctgccatcccagccaggtattgatgcctcaccccccgccaagccccctgcaacccctcgtgcaggtccgggtggaggagtacttttacgggcccacccgctctctggcccccgcgtcccagacgctgaagctggagggggtggaggtgtaccgggtgggcggcggccccaaggccccaccctccgccctgcccatcggcgcgacctccgtggccgaccccctgaagctggcgcgggtgaccaacccccaggagctgctctacacggtgctgggggtgagtcatgcacccggcccggacctcctcctctccgcctccgtggcggggtttgtgtatgtccaggatgtggacctggccaagggcagcatgagcgtcctggcaccgcggccggggcccctgcccggctcgctgctgctggccgggaacttcaaggtgtacctggactgaagcgactcccccgccactgtggtttgtacaccagagaaataggagtgggttgggaaagggtggtgtttgggaagggatgcaaggggtgcagcagaagacaaggaggtgccacagggtactacactcgtgggcttgtcccaggagacatgcagaatggggaagcaccagtggagggggtgtga

SEQ ID NO: 6440 - DNA, 1074 bp, Chlorella protothecoides
atgctgggcaccgtcactgtcccatctccttctcgccctttcaacaggggctggggtaatggcgaggaggagtactacaccaccgacaatgtggctgtacagaacggccagctgcaaataaccgcaaagcgcgagaccgtgaatggcttcagttacacctccggccgcatcaacagccagggtctggtgggtttctgcccgggcgtcgcggactcatcggggaagacctacagcaccctcaagctggaggtcttccttcagacccctgcgccaggtctgtcgctggtaatattgggtggtggtatgtcgagggagggtggggggactgcgcctgattgtggttgccagcttgcatgtcaaaggcagccccaagcttgcatggctggtcttcacaattttcagatatcagctccatgtctgagtcttccctgctatcctccacccacagggcaagggcagtggccagcattctggctgcttcccaccaccctcacctacggtgcctggcccatgtcaggagagtctcccatctcagtgctggccaatgaatggccatcaagtgtgtgggtgctggaagagattgatgttctggagtccatcaatgccatgacgagggcaacccagggcttgcactatggcaagggcagctcaggcgcaatcaagaacacattctacacaaaatcagacgctgacaagagctggtcgagcgctttcaacacctttgctgtgacatggacgtctaccagcattacctgtgagcagggcgattcatctgtggatattctagaggaggcatggcatcaacctgcatcctcggcgccttcaagtttcaagggatacatgctggctaaaatcccataccaccccatcctgtgcttcgcagtctccatcaatggcaatgacatcaggacgctgcagagctcgagcgtgagcggtgacggctggtttacctcggcctccaacaaaacccccaatgcaccattcgacgtacccttctacatgatattgtgggtgccaaggtctgggggggagggcgggcctgagaccttgatatgggccctggtgctcctctga

SEQ ID NO: 6441 - DNA, 1719 bp, Chlorella protothecoides
atgccagctcaccagttaccattgccgacatcatactgccaaaagttggagtcgagactgtccccctcaaactcttcccaccacagcgcagtccagcctggaagacaggaggcacatgagagtgagcaaggcctccccccccacccacccgacggcacggtaaaggggacgtcgccagagggagtgggcacgacgtttgaggaggacccggggggcggcgggaagccaggggaaggggatggactcggcgagcctttgcccgggggtggtgggctgtacttcttcccggggggcaatggtggcagcggtggtggtgaaaacgctggggggctcgggggccctgggctggtggaagccgagttggtcttcgtttttagagccatcgtcacagacagtcccaccgccgcaccaaccaggaggattgctccaagggcacacagcgcaagcttgaacttgatgcctagtgtaaactgggaggttgcggtctcatcctgccacgttttgtcgatgcagatctttgggggacctgatggagggatagaggtgacgggaagcgcacccccctgcgccattgctgttgccgcttcgcttgttggtcgcggaggcgacttgcaggcttcaccgcctggtagcgaaagacctcaagtgtcacaagccggtggaagtatacgtcggattacgggcttcgctactcataaagtacccatgtctatgtatttgcaggtcgtgatcatgaaagatgcccgcgtgtcacgaaggtcgctcggcagatctagccacaccactccgcagtccgacaccctaggcgaattagcactgatccaggggggtcagccacccgcttgcttccacccccgcggagttgaatccctgggctcttggaatcccatcatggccgagaaactgggggccttcgcaacagatataaccgacgaagagagagagaaggtcgaacttcttcgggctgaggtgaagcccttcatcaaggtgtgcgcggggtgggtccgtgtacgtagtcaccgtgatcaggggatgcctgagctcattcctcgcctgcctccggccccacgccgaccccgcgtccccttccgcaacagaccgcggcagacgttgccttttgcaccgagggcacctatgcgggcagagtacaaaccctatgagctacgctggtcgagggtgcagcatgatgtcgacaaggggaagctctacatcctgaagggcaccgataacgctggtcgtccggtgatcctcatgcgcccacgcacaccttcatcggctcatcctgcaattgccttgctcaccccggggtccctccacctcccacctctcagattggaaaccattcaggacaacgaggctcgactgcgattcctcgtgtacacccttgaacgggctgcacaactaggcgacagctcacgtaaattttttggagaggacatgggattgctggggtggtccccgacccggccgtggcaaatgagcttccagccgtccgcaggatgtgcctgcatcctcaaggagatgcacaccctgaacatggccgatactcacccatactgcagccgatgggaagatgacatggcttctggacctggaagaatactctcgcaagaactccccacccattcggatggcccttcagaccctgcacatcctgcaaaatcacttcccggagcgtctgggcctggccgtctgctatcagactccgtttgtatttga

SEQ ID NO: 6442 - DNA, 843 bp, Chlorella protothecoides
atgtccctgggtcggctggttccctggcttgattgggcggaatggaggacggtgggcgaccagctatttgcagctgaagattcggagcgggatcttggagtagcaagggtgggagctggtgaacttatctcggttacaatgtggtcgtggagggctcgttggaggccgctgctcactgctgcgcacacacactcaccggatgccttgactgcacatccctccccctccccaggtcgtggcatggagggtgcgcgggcgggtccccctggctgtcgactccaccgccagtctcgtggagactcagctcatgtgcgttgctggatggtctgccggtctgggaagaagcatgtgcagcccctgccctatcccctccctgggccccctcctcccccctttccagcgcctccccgcgccgccacccgccgcagggacgcgcgcggccagggctctgacgccgccctgcgcgcccagttctgcatggtcctggtccgcctggtcaacggcgtggcggactcggcgcagcgcggccgcgtcgcgtcctccgtcgcctccctcgccgccgcagccggcctgccccgtggcctggtggatctgcgccacgaggccgcgcacaacgagctgcccagcctggcggcggcgcgggcgggcgccggcgaagccctcgcttggctccgcgacttctactggctgcgccaggccgaccacctggcggcggggcgggcccaggtgctggtcctggcgcgctcttacctgggcctgcacctggcggcggcggcgggggcagccgccggggcccgcggcgaggacggcgaggaccgaggcggaaccggtgcggcggcgcgc

SEQ ID NO: 6443 - DNA, 447 bp, Chlorella protothecoides
atggcgatgggccaaaccgtggtcaagtggcgcacagaccccgccacgtcagcgctgcgcggcgtggaggttccagaccacctggacgtcctggcccgcatggcctgcggcgcccaggcccacctccttctcagcgccgtggcgggcggcagcgaccgccccgccctggagttctggctgcatggatctcagggggcgctgcacctggacctcaccgccggcgccctgaccctgagccggccggacgtggaggggggggcgccccagccggtgaccctggcgcaccccggggcatggcgggtggaggaggagtttgtgggggccatccgggggaaggagcgggtgcgcctgaccgacttccccaccgccgcccgctacatggagttcaccaccgccgtggcgaggagcctgcgcagcggccacagcgtgggcatgcccctggtgtag

SEQ ID NO: 6444 - DNA, 1200 bp, Chlorella protothecoides
atgcgcctggacgcctacctctccaagatgctgcccggcgccagccgggcgcgcctggtctcctgcatccggtcggggctggtgggcgtcaacggcgcgcccccgcccaagccctccacccccgtccgcgccggcgacgtcatcagctgcgggctggccccgctccctgcctcccgcgccctgccccaggacatcccgctggacatcgtgtacgaggacgcccacctcctcgtcctgaacaaggcggcagggatcgtggtgcacccctccgcgggccacgccgacggcacgctggtcaacgcgctgctgcaccactgcggcgtgcgcggcctggagctggagccggggcacgccgcccccacggccctactgggtggggctgcgggcgcggcagaggacgccgaggacgaggacgacgacagcgacgtggaggacgaggtggcgtccttgctgggggatggggggggagcgctgcggggcaacggtgccggagacacacctggggtgtctctgcaaaaccataccagccatcaaccaggcgtcatccggcccggcatcgtgcatcggctggacaagggcaccaccggcctcctggttgtcgccaagacagaggcggcacgagtgggcctggtcgagcaggcgagtggggaggtggtgatgggtacgttccgcgctcgcacggtgcagcggctgtacctgtcggtaacgctcaacaccccccacccggcccggggccggctggagaccaacgtcgggcgcgactgcgcgagccgcatgcgcatggccacctttgccgcggcctcctcgcgcggccgcctggccatcagcacctgggccgtggagcgcgagctggcggggggcggcgcggcgctgacgcgctggcggctgggcacggggcgcacacaccagatcagggtgcatgcgcgacacctgggctgcccgctgctgggcgacgaggcctacggcggcggcgcgggcgccagcggcgcggcgctgggcagggggcgccgcttcctgacggagcgcggcgcggcggtggcgcgcgcgctgggccgccccgcgctgcatgccgcgacgctgggcttcacacacccagccacgggcgaggcgctggccttccaggcggccctgccacgggactttgaggagctgctggcgcggctggaggacccggtctggcaggaggcggcgaggcggtga

SEQ ID NO: 6445 - DNA, 255 bp, Chlorella protothecoides
atgctggaagagtcgcgcaggcgcccaccccaggttgcgcagatcgtcccttcgcccctaacccttcgctatgatgccgccatccaggaaacaatcaagtctggggtcctggggcagctgacctacatcacggtgaggggggtgtcgggctggcccgaggccaacggcgcccccatgaccttccgccaggacgcagagctgtccggggacaacatcctcttcctgggcatcatgtacgaggccctggccaggtga

SEQ ID NO: 6446 - DNA, 993 bp, Chlorella protothecoides
atggcgtcccccaatcccctgctggtggtggagcttcagggaccagatggatccagcgccaagattcacgcacaaggagccaccctgacctcctggatcacgccagacggagtagagaggctttttgtcagcagcaaggccaagtaccaggcgggttcagccattcgtgggggtgttcccatctgttggccccagtttgcgatgcggggaccgcttacccagcagcatggattcgcacgaacatccacatggacccttgccagctgcgagaccgcttccgtggtcttctccctggacgagacgtccgcggcacttcctgccgactggacagctgccttccacctggagatggaggtcagactggggcataagacaatgacccaggagctgagagttacgaatcgcggcgactcaaatctcaccttcaccaccgccctgcacacctacctcgccgtgcgcgacatcagagccgcgggggtgcggggcctcagggccctccagtaccaggacaacacgcgcccgggccaggcccttaccgaggaggaggaggtggttgtgatccaggccgagttcacatgccctttgctgcaagccctcagctggacaatccctacaccccccgccggttcgccgtgtggcccatcagggctgctggtgcacatgctatcccgagcggtctggccgtccaagctgcccatcaccctccccaccaatccttccccctgccaggtggacaggctgtatgtccaggcccccgaccggctggtcctggaggatggggctgatggccgccgcaccctgacactggccaagcagggcttccccgacgtcgtggtgtggaacccggatggggccaaggcctcgggcatggcggacctcagcgactggcacggtttcttgtgcatcgaggtggcgcatgccgcgcgggaccctgttgttttgaagcccggggagacgtgggccgggcgccaggtcctcggcgcggaagggtga

SEQ ID NO: 6447 - DNA, 657 bp, Chlorella protothecoides
atgccctttccctgcgccctctggacctccccagggtcggtgggcactgtcgtggggggcctcctgctggatgccatcggggccagcctcaggaatgccctcctcgtctgtgccacggccgtcttcctgggctccagcatcgtgatggccggctttgcgtttgtgtccaaccttcctgctttcttcatcacccttactgccggcaacctcctcctcttcatcatcggggaaggtggggtcgcctcggatatcaacaacggtggctcgcagctcccagtcaatactgtcaccctgctcttctccgaccaggccccctccctgggcgtgctcctgtggagctgccctccccaaatgcggccctttgtcctcagcgcgagcgaggtggcgcagcacgtgctgggggacgtgccgacgccgcccctcatgggcgccctgcagcagtggaagggcgactggcggctgaccatggtcgctagcacgggcctgatctgggtcagcaccttcttgtatgtcgcgggggtgttcctcgttcgcagggcgcccctgcagcccaaaaccgtggaaggcctggatggcagcgagggcgaggacgagcagctggcacaagggctgttggaggtcgttgacgcacgcctcgtcggcgtcctccctgtgtaa

SEQ ID NO: 6448 - DNA, 462 bp, Chlorella protothecoides
atgcaggagtttgagtttggcacagtggcggacgcgggtgtgagccaggctgagctgttcgaggaggtggcgccgctggtgcggtcggtggcagacgggcacaacgtctgcatcttcgcctacggccagacgggttctggcaagacgcacaccgtcaccggcccggcgcatgacccggggctggcggcgcgcgccgccgacgcgctgtgcgcgctggcctcggccgagggcgccgagcgccgtgcgctggaggtgggcatgctggaggtgtacggcgacgtggtgcgggacctgcttgcggggcctgacggggccgccggcgccgcgctggaggtgtcgggcctggggccgggccaggtggccgactgccgggcgcgggtgccgggtctgggctggcggcccgtggccgggcgcgaggacgtgctggcgctgctgcgcgaaggctgcacggcgcgcgccacc

SEQ ID NO: 6449 - DNA, 3105 bp, Chlorella protothecoides
  modified_base (182)..(191): a, c, t, g, unknown or other
  modified_base (1291)..(1300): a, c, t, g, unknown or other
  modified_base (2050)..(2059): a, c, t, g, unknown or other
  modified_base (2176)..(2185): a, c, t, g, unknown or other
  modified_base (3022)..(3031): a, c, t, g, unknown or other
atgcacatcacactctgcgttataagtggatggatgtcaaagtggcacaggcatttccacagcaagcttgaaagcgttgttcatagccctttggtttgctttggcatacagtcagctcgatctgcaccaatctttaatgtcgctcgtgctcagaggcacgaaaaggattgcattcaccctgnnnnnnnnnnctcacgacttcttcatgctctacattacgcgtacatacgagaggggcggtgttacagaagtctctgcgttataagtgggtggctgtcaaagtggcacaggcgtttccacagcaaccctgaaagcgttgtccatagcactttggtttgctttggcatacagtctgctcgatctgcaccaatcttgaatgtcgctcgtgctcagaggcacgaaaagaattgcatttacccttttgtcctgctgatggtggagtccccactggggatcagggtggtagatgcaggaagagtgaattgcgtggctcctccatggcaaaacatgctgggaggggttttgtcaacaagtgaagaaagggtgttgtcggaagtcgcagggagagtgaatcgcaaacagtacagctcgtatgtactcaagcaagccgatcagactgtcgcaaataaactagcaatacgcctggccctctttgctggtttgtacccaccaccatgtttgacttgcagtgagagtcaagacgcgaggggaaggcgatgccagacccccccggacccctccctggcgcagcttgacgatgtggatggcacggcttgctacacggcgctgggtctggacaagcggtgcagccaggaagacgtaaaaaaggccagaccccaccccaatcctcaacccgacccgcacttgtctccccaggcctaccggcgactggcgcgcacgctgcacccagacaagggtgggcggcccgaggccttctcagccctgcagcacgcctttgaggtcctgatcgaccccaagcggcgggcggtgtacgacacctgggcggcccagctgcagtaccgcagcgtgcgcagcgtggcacagcaagcggtgcgctgggtgctgggcgcggcggcgaggacattctactggatgagtttgatgcgctggggctgcactgcgagccggccacccagctggttgtcacctgcgaggtgtgcggccggcccgccaccaagcagtgctggacgtgtggcatgcccatctgcgagttctgcaccctcaagcagcactggaaggtggggtgggagtagggatggggtcaggtgggtgcactggtggacccagcggnnnnnnnnnnctcaagcagcactggaaggtggggtgggagcaggaatgggtccagggtgggggatgcactctacaccatgggtggagcacagccttactttcaacccatcctcgagtgtgttgtcgaggacggctggtcacccctgacaacttcccgctgcactggccactcatcaactcggaccacatgcgggagcgcctggctcggagggagctggagaagaagcggctggaggatgcgagccaagcagcgctggagggccccaaccaccgctcggagcgggagctgagggacgtgcgggccttcaaggccgccgcgcaggcggcgctggcggggcccgacccccgcgggactcctgtgcagggcctcacccgcttctacatgtgggcccagaccgagcggaccgttctcatcgcggcgcgcgtgcccacaggtggggatgggcccggggggaggctgcagcgaagggggagagggtcgggagcccgcgcatgccttcgtccttgagcggatggtatgcggatcgggagctggtggtggaggcgagtgccgccggcctactgatccagagtgaggagtcgcccgccctcatagaccgcgactgggccttccccgtgctggcaggtgcccccgtggaggtctccagaaacggcgatggctttccattcggcctagcccatgcactcccttgggaggcagcgctgtttgatgcagagtatgcttggcaccaacgcacgctttctcaaacccccgcgcgcnnnnnnnnnngcaggtgcccccgtggaggtctccaggtattgcccagatctgcgggggtggggggggggtccgattcagagcatgacgcatgtgagcgggtccttcctaaaacttgggtgtgctctnnnnnnnnnncagcgctgtttgatgcagagtatgcttggcgccaacgcacgctttctcagccccccgcgcgcaaaactgcaggaccgtggacaaccggttctgcacagtcagcgtcacgaaggctgaatacggccaattctggacgcggctgttcaggggggactctgacggcctgcggtgcctggagcccccctaccgcctcacaggtgcgccccgctctcgacacgggggcatggggcgtcgatggtggagggcagcgccgcctttctgggggtcttgaggtgcgaatgcccgccactcccgtcggtgaccctgcccttctggatcgagcctgccgacgtcggggtcgtgttctcggagaccggcgtcgatgtgatggtccgcaacacgctgcacgtctcgcgcacgttctggaggaacgagtgagcctgcgatggggggggaagggtgtagcggcgtggtgcggatcagccccatggggcttcccgctgagtgtgcagccaaggcccttggacctcctccacccacctgctgtccacgacagggaggaggcaggccggcgcagggcctacgctgctgtggacgtggatgagtgcctgtggtccctggacgaggaggagctgggcggggaggcggtgcgcatcctcatggtcaccttggcccggcccgagctgacggaggaggagatcacgtggaagaaaggtcagggcatggatcagcaggttgtgcgggtggcactcacgaggctgccgggagaggtgcacgaccttgcggccatgggaggcccatggccgatgcaagctggtctgaagctctcccttccatcgaggtacctccgtttcttannnnnnnnnnggttgtgcgggtggcactcacgaggctgccaagagaggtgcacgaccttgcggccatgggcctcccatggctga

SEQ ID NO: 6450 - DNA, 456 bp, Chlorella protothecoides
atgcgtaatgtagagcatgaagaagtcgtgaggattgtaaggcgccatgcccctgctttcgctgctgggcgtggggttggtcatcgtaaccctcaccgttgggctggagttcatcctgctggcagcgtccctgctcctactggtcctgggtgtgctggttgtgctgttcaagatctggaccctctacaactcgtcccaaaggctgaccagactctatgttcaatcgctaaccctcccccatctcgtcaggatcttctcgtcccaaaggctgaccagacgctatgttcaatcgctagccctcccccacctcgtcaggatcttgtgggcttcttccatccctttgcagacgctggagggggaggagagcgtgtgctatggtgggctgggttatgtgcttctcagattgcgccatcctcatgttgtggtttggcagtgagtgatgatcatcaagtctga

SEQ ID NO: 6451 - DNA, 852 bp, Chlorella protothecoides
  modified_base (182)..(191): a, c, t, g, unknown or other
atgtgtgtatggcgtatgtttccttctcaccgtatgcaacgcacgcgagagcgtcccccttcacagcatgcatccacagtcatcagctctttcaatcacctcgaccaccccgcggccaaggtccaccttctccgcctttccctctcactcaaccccgtgcggactgcaggtcatcaggctgnnnnnnnnnngcttggctgcgtcctatgtgtgtatgcgtatgcttccttctcaccgtatccaacgcactcgagagcgtctcctctggcagcatgcatccacagtcgtcagctctttcaatcacctcgaccaccccacggccaagcttcaccttctccgcctttccctcctcactccaccccgtgcggactgcaggtcatcaggctggagtcgcgtgaggagctgctgcctgcccgctacccccgattcaccatgctgcggcaggccctggcctcggtgcgggtggcctttgcgggcctgcgccgccgcgtccccgccgtctggctggacaccaccggctgggccttcccctacccgctggcttcactgctcggctgccgcgtcgcggcctacgtccactaccccaccgtctccagcgacatgctggcgcgggtggcggggcgggaggccgccttcaacaacgacgtcggcgccagcacgcccgcaacgctggccaaggtggcctactacggcgcgctggcggcggcctacagcctctgcggcctctgcgcccacaccgtcatggtcaactccagctggaccaagcgccacatcagcctgctttggctaggccaccgggaccccttcctcgtctacccgccctgcaacaccgaggcgctccaggttgattga

SEQ ID NO: 6452 - DNA, 732 bp, Chlorella protothecoides
  modified_base (485)..(494): a, c, t, g, unknown or other
atgtacgggcggggtgcggtgcagggcagtcgatatctgacaggcgatacctgtgtgattccaagtcccagccataccctccggtccttgctgggcccgatctcgcttttggttgccagtttcctccccctcccccagtgcatcccacccattcacctcccctcctcacaccacaccccatcctcccatcaggagctgccactgagccggcgactcaagcggctctacatcgtctccgtgtcccagttccgaccagagaagcagcacgctctgcagctgcgcgcctttgcccgcgcgcggcgtgatgccgagcgcctggagtccgacgccggcgatgccgtgctggcggcacggctggagttggtcggcggctgccggaatgcggaggacgccgcccggatcgaggagctcaaaggttggtgctgggtttggatggacgagacgggcagggggaaggagtggttgaatgatggcaggggttctgnnnnnnnnnnaggatcgaggagctcaaaggtaggtgctgggtttggatggacgagacgggcaaggggggaggagtggttgaatgatggcaggggttctgaaggtgggtggagggcgctgaaatcgagtacgcgcgggatgcttgctgcaggaggaagcctgtacctggcagggggcgacagagggctcaaagatgctcgcctgtatcagaagtcagccgttcgattgatgcagtgtgcgtcatcctga

SEQ ID NO: 6453 - DNA, 1119 bp, Chlorella protothecoides
  modified_base (72)..(81): a, c, t, g, unknown or other
  modified_base (908)..(917): a, c, t, g, unknown or other
atgatccccacggtgccctctccaccgctccgttccctggcggtccactccccagcaccctcccggcacccnnnnnnnnnnggcccaaagggcaggggtgaggctgggcacctgccaggcatagccacatgtggaggggggtgcactcaggatgatccccaaggtgccctctccaccgctccgttccccggcggtccaccccccaccaccctcccggcacctcctcgagcagattgtggtggtgctgagcgggagcatggagccgggattctacaggggcgacatcctgttcctggaccagcccaagggccccatcgaaaccggaaacatcatcgtgttcaacgccggggaccgcgaaatccccatcgtccaccgcatcatcaaggtgcacgagcggcacaacaacatcagcgccgtcgacatcctcaccaaggtgtgggtcggcacggtgaatctgagatgctctgccatgctggtgtcacgagggctggaggcatgaagcgggcctcgcgatgtccccctccatttcgtcgccccaattccccccaaatcccaacaatcaatccccagggtgacaacaactggggcgacgatcggtcgctgtatccccggggcgtgcggtggctgggcaggcaccacatcatgggccgtgtgattggctacctgccctacataggccaggtgaccatcatcatgaatgactaccccattgtcaaagtgctgctcatcgcggctctgggcctctttgtcatcaccagcaaggagcccttccaggacagaggacggttcgctcagctggcagcattgagtattcatttcattacagtgggtgacccgacaggcacagagaggattgagtgggatgaatatggttccggtaatttgggagggaggctgatagcatgtcnnnnnnnnnnagtgggtgacccgacaggcacagagaggatcaagtgggatgaatatggttcagggggtgctgaatcagtacagggacgccagggtttgatgcgtgcattctacatgctctcgagacggtacatcccgaggctgagtcgtctacccggccccacccaccgccagggcaccctcactcccagggcgcccggatgtgcgccaccg

SEQ ID NO: 6454 - DNA, 291 bp, Chlorella protothecoides
  modified_base (147)..(160): a, c, t, g, unknown or other
atgaagagactggcgctcccagcgattgaagtttatatacaggcgctggtgggagtggtcacccaaccaccgctccgtgatgcaactaatacgatcggctgtggccgaggtgaagaagatgcagaagaggcagctcctgctacaagnnnnnnnnnnnnnnaactcctccaggctgctcccacccacccccatcctgcaggcctcatcatcacatctgccctcatgatctggaagttccttgtccttgtcactggcagcgagtctccggtgaggcccagagggcaggggtga

SEQ ID NO: 6455 - DNA, 684 bp, Chlorella protothecoides
atgaaggtcgcgcccgaggtgcctgaggccggtgaacctggcagcgaggcctccctgtcccccctggccctcaccgcgggcacgcccttcatgctcagcgtgcacgcctccctcctgatctacattgcgcggcggctggccaacccacgcaatcggggcctcgtcttcgagttctccgactccacagtccagggcgagggcgagctgaagttgctggccaagctgcaggaccagggtggcgggcgcggcgcccccaccccgggcgacacccacgtgatcctgggcggggacagcgacctgtacctgatcgcgctggtggcgccgcgcccgtccgtcttcatcgcagccgacgccgacatcccgcacctgggggcgccggcggaccagctcaccgtcttctcccgcgccgcgctggccaacgtctgggggccccacgccgatgtggcgcggctgggcctggacctgtgcctgctggcagtgctgacctccggcaatgactacctgcccgccatccaggcgagcctgggttgggtagggggaaaccaggagcgggttcgactctggaccgaccaagggtcccgccccgcagcccggtccgctgtcacgcccacatgcctgcgcatcggtgcaccacccctccatcgacacatccacaacccacctcaagacagggcctggtgctga

SEQ ID NO: 6456 - DNA, 327 bp, Chlorella protothecoides
atgggcatcccaggattcaattcctgggtcaggaaggagtaccctgaggctttcgtccctttcgagcggggcaggagggtggaccacctgtacgtggacctggcctccaccctccacacggtgctccgcaagtcccgcacccctgcacagctgcatcgccgcctgcacaaccgcctcgacaactatctagccagattgcgtccatgcaagagggtggtgctggccctggatgggcccgggccccttgcaaagctcctggagcagaggtcagatcgctgggatggggtggcctgggatcaggactgtggcgtgctggtgaggccctga

SEQ ID NO: 6457 - DNA, 2628 bp, Chlorella protothecoides
  modified_base (239)..(248): a, c, t, g, unknown or other
  modified_base (410)..(502): a, c, t, g, unknown or other
  modified_base (1137)..(1146): a, c, t, g, unknown or other
atgcacgacctctggaaccatggcgccgacctggaagcctatgaccaccacctgttccctggcgtggtgcccaggacctttctgggtgggtggagcggttgtttactgttgccagagagcagggacgccctgcctgtcacggcgtgctgtttgaattgctgtgcgctccagcctcagccactgacccatcgcaggtgccatgagtatcgtggccctggccagcccggccctgaccgcannnnnnnnnnttttctgggtgggtggagcggttgttcactattgccaaagagcagggacgccctgcctgtcacggcgtgctgtttgaattggtgtgcgccccagcctcagccactgacttatcgcaggtgccatgagtattgtggccctggccagcccggccctgaccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaaggctcatagaattgtatgatgaaggcacgcttggtgtccatactcagtcattagtgctatggggcgtatgctgcccactaggatgccaactgtggtcccttaaacgtccccggatgccagggagcgctgtctgtggcatccctgcattccatccagtccgcgctggctgtcaggtttgggcggctggcagctctgctcttctgcctgctcacaaccgtgcagtttcacacaccattctacgcgtcccgccccctgcccaacgtcttggcgtgtgtgctgaccaactggggcctggccgcatggctgggctctgcctctccggcgcgcgtcatcgggctctttgcggcagcagtgaaggtggcccggatcccttagagctccacacgggcctcccgctctctgacgcaccaggcaagccctcacggcatacagctgccacagcagtggcgcctgtaggagccggagtgcgcagaggtctctgttggcaggattcgacgctccctctaggagggcacgatagagtctcaagccctccagagtgcctttgtgtgaaattcatggtgctcatcaagggttgtgatcccctccacacccgccacaggtcatcttcaggtcggatgcggcgctgnnnnnnnnnngtctattggcaggatccgacgctccctcgggaaggcacgatagagtctcaagccctccagagtgcctttgtgtcggatgcggcgctgctggccgcccccatcggctcgcacctgcttctctcaaagcaggtcacgttcccgcgggcagtctccttggccgccggcgcggcgctcgccagcctggcgctcaccgtcgcggtggattcgctgatgtggcgccgcctggtctggccagagggcgaagtgtttgccttcaacacctggcacaacaagtgcgcccggtttggtaggggggtctgctgccgagaccaggcatgggtgtggacaggaggtcacaggatatggcaccagtgccctgtatctagctatttgacccccttagctttcctcctcccctcctctacactcttacacaggagctctgagtggggaacgcagtcctggcactggtactgcaccagcgccctgcccagggccctgcacggcggcttccccctggccgcgctgggcgccacctgggaccggagggcgcgacccctcctggccgtgggtctggcctttgtgggcctgtactccttcctgccccacaaggaggtgggccggggaaaaggagccggcggcatcctaggggcttgcatggcgctgccatgtaccttgggaggctgcattcttggcttcctatccctggcaagcccagcccggacccacactcagcctttccccctccccctcccccatgcacaggcccgcttcctcttccctgccctgccgctgttcacggcgtgcgccgccgtggccctgcagcgcatcctgcacaatgcatggcacgcaaagcacgggtggcgcctcgccgccgcggggaccctggggatcttcctcgccggcgcaggcgttacggcactgacgacggccgtcagtcgagccaattatcccggcggggtggccatccggcggctgcacgagctgggcggcgggtccaagggcgcgggggctcacccgacgcgcgtgcacgtcgggacgctggcggccatgactggcgtctcaaggttcaccgagctgccggggggcgcttggatgtactccaaggtggacatgcaggaaggggatccgatggcatgcatggggcactctgaaggaaatgagatggaggtccatgtggggggcggggacatcaactcccaaaccatagcacacccagatacccgcctgatgacactcacggacaccatccccaggaggagggactgcctcccaaggcgctggcagggcgaggctggccaggccgctcctgctcacgaggctccccctgcgcattgcattggcagccaaggtttggattcagaaatgcacggctctgtgactctgacgacttatcatgagggcattccctcggtgttcgcacctcccatcgtccctcccataccaaagaacgatgtgggcttgactgagactgacatcgggttgccgctgggacaagagtga

SEQ ID NO: 6458 - DNA, 900 bp, Chlorella protothecoides
tcgttcattgaccgcggcgagctggtgcccgacgctctggtcctggacgccctgctcaacgcggtgctgaacccggagatcaacgacggcgcgggtttggtgatcgacggcttcccgcgcaccgcgctgcaggtggactttgtcaagctgctgcacgaccgcctgctggcgctgagcgggcgccacgcggacacggccgaggcctggcgcttcccccgcccctccttcaaggtggtcatcctgtacgtggacgaggcggagtcgatgcggcgccagatgcggcgcgcgcagatcgcggacctgcataacaagcgcgtggccgacgcggggacgggcgaggtctgggacgtgcgcaccactgacatcaacgagcagctgtgccgcaggcgctaccaggtgttcaagatgcactaccagaccatcctgcggctgaagcagttcttccccttctcgctgatcgacgccatgggcacgcccgaggagtgccgccagcagatcatgcgcgagctgcggtaccaatcctcgctggacctggatgcggcgacctatggcgccatccggcacctgcccctggcccgcgatctggtgcgtgtcgctcgccagcgcctcgtcttccgcctcgactcctacgccaagcgcgccgcggagacgttcggcgccgtcatcagcctgatcgaggcggagctcatcccgctgctgaagacctgcagcctggctgggcacgcggtgtaccgctcccgctcccccgtcctgctgggcgacgcgcgcgcggtggacatgatgatagacatcctgtcggaccgcggcttctcggtggcgcactcggaggaggagcgtgtggtccccctgcgcgtcgacctgggcagcggggagatcgagagccgggcagaaatcgtgcac

SEQ ID NO: 6459 - DNA, 543 bp, Chlorella protothecoides
atgtgcatagcactgcggacgccagtgtgggctgcgggaagcgcccgattcgcgcagacccatcagccggcggcgatgtgcccggggccccaaacgcccagactggcccctgcctccccgcaattaccccgcaacccaccactacctccccacgccgccgctccgcaggaggcgcagaagctgaaggaggcgcacgacgccctggcagagcagctggcggagcgcgctcttgaggaccgcgtggggcgggctgtggcagagaccaatcgcctggcctccctggccgacgacttcgaccgggagctggcgccagggcggggcgaggaggttgagcgcgccaagcgcgaggccgaggccctccgcgcccgggttggcgacctggaagcggagcgtgccgacctggagcggcggctggcggcggccgagcgtcgggcgcaggaggccgagcgccgggcccaggaggccgagcgccgggcccaggacgctgccgcgagtgcggcggtgggcgtggctgctggtgcgggcgtggtcgccgggacgggc

SEQ ID NO: 6460 - DNA, 300 bp, Chlorella protothecoides
atggagctcaagggcgcacacatcacgcagctcatgtgtccccactttctgcaggagcgcctgttgctgaagaagttcaaagggataggggacggcggcgtcgacatcttcttccgcgaagcacagcttgtctgggacgagatctatccttttgcggacaagaaagcgctcaaggccgcacgcctcgtgggctttcgtgagcacccaaaggtgaggtcctgtgcatgggacgaggtgcaggaagagctctggatgggccggggctggctgaatgtgggtgcttatgcaaactctctgtaa

SEQ ID NO: 6461 - DNA, 222 bp, Chlorella protothecoides
agctccgggcacgagaagtgcggggcggggtcgggccccgcaccctcgccgtcccctgggcccgacgccctgcggctgatgcacgaggcgctgacccgcggcgccgcgcgggcggcgctggcctccatcgtcgtcccggatgcgcggcggctggagggcgcggagggctgggcgggccgcctgcgcctggagcgggcgcgggagggcacgggcatcaggtga

SEQ ID NO: 6462 - DNA, 873 bp, Chlorella protothecoides
  modified_base (104)..(113): a, c, t, g, unknown or other
  modified_base (667)..(676): a, c, t, g, unknown or other
ggcgctcggcgcgccggcctcgccgcggcgcgcggccgcgcctttccggccctacagcctgcagatcagcgcgcgcgcggcgtcgctgaccgcggtgctgtgcnnnnnnnnnngccgcgacgcgcggccgcgcccttccggccctacagcctgcagatcagcgcacgcgcggcgtcgctgaccgcggtgctgtgcaacgacaagccggagacgtttggcgcgccggacgtgctgctggcgggggtgagcgaggtggaggccgggtacgacacggccctggtcctgccagaccgcccgcccaacaaggcggggcagctgtccctcagctcctccgccgccttcctcaactcctccacctcgcgctgggaggcggtgtacgagccctggccgctgcgcctggaggtggtggacgtcgtgtccccgctctacctctccgaccgccgcaccaacctctgggtcacctccgaccagcacctggacgcggccttcaaccccgccagcctcatgtcctttggcgacgcgctggcgttttacaacacgttgctcaggcccgagccggagccggagggtgagccgcgatttgggcggagcggggtgctgggggggccggggaggggttttggagccagggagccagggagtggcgtgctgcagggggtgcaggtgnnnnnnnnnnttttggcgacgcgctggcgttttacaatacgctcctcaggcccgagccggagccggagggtgagccgggccttgggcggagcggggtgttggggggggccggggaggggtttttggagccggggagtggcgtgctgcagggggtgcaggtggtcggtgaaggggggatgggggggaggcggtcgtagcggggcttga

SEQ ID NO: 6463 - DNA, 1086 bp, Chlorella protothecoides
  modified_base (670)..(679): a, c, t, g, unknown or other
cccaccgtcctggccgacgcgggggcggtgctggccgcccacgcggccgcggcggccgagctgcgcggctccccgaccctgcacgccctgctcgccagggtgctggccctgggcaacgttctcaaccacggcgggcgcctgggcgccgcgccaggcttccgcctgcgcggcctagccaagctcaacgacacccgcgccctggacggcaaggccacgctgctctcctggctggcaggccagggcgcggcccaggagccgtgtgtggggcgcagccggggtggcgggggcgacggcctgggtggcggcggcgtgggtggcgacggcgtccagcgtcctggcgatggcggtggtgcagcggcaggaacaggagaccgtggaatgtgtgcgcccccgcccgccacgtcacctggaggagagctgcagcagcgccgggccgcgccgcccactctcctggctgcccgcctccccgcgctggcgtcgccccgcctgcgcgtccccctggctgacgtggcagagcagctgggggagctggaccgccagctggccgccgcgcgggtggaggtggagcgcgcgcgctgcggcgcggcggcggcggactccggtgcgcacaaaggtgccgtcgcaccaaaccccgacgcggtcttcctccaggccgtggaggcgcgagtgnnnnnnnnnntcgcggcggggaactccggtgcgcacgaaggtgccgtcgcaccaaaccccgacgccgtcttcctccaggccgtggaggcgcgagtgaccgagctgagcgccgcgaccgcggctgcgctggcacagttggaggccgtgcgcggtgtggtggctgccgccgccgccttcttcggcgagaacgccgccgccgtcgcggcgtcggagcaggagttgtgggccgacctgcaggccttcatctccgcctacacggccgccgagaaggcctgccacgcgcgggcagccgccgccagccccagcccgaggcgggggagcggcgccttggggcggagcgcgcggcgcgccagtggcctcgatggtggcacaggggcgcgagacctgtctgcggcgctggatgcggccgccgcttag

SEQ ID NO: 6464 - DNA, 2373 bp, Chlorella protothecoides
  modified_base (2009)..(2018): a, c, t, g, unknown or other
  modified_base (2100)..(2109): a, c, t, g, unknown or other
atgaacgaatccatccataattttgcaatgtacaagggcgtcaggtcgtttgcgatcttattgattcctcatgaccaggggggtcgttcaccccttgcttgcaatacgtcgcatgcgagctatacccaggaggctcttgaagaaattcgtcagggagcaagaacgggccccacccgtggtgcgaagatttcaagattctcaacagaaaaaagattgcgtcgtacgccgagcacggggctgttgtctgctcccaacacacacgtacccagtaaatacaatatgatgcatcattctttatccccgcgtccgatgcatgtctcgagtgctgattgctcgaggcgccatatctccgacatgagtttggccttaggcaccctgaaccatgtttctttcgtcgtcgcagatgtcgcgattgcagctcagttctacagctgcgggaccccacagggacgtgctgggattcaccttggaagcagacctcacggggccggttcggctcgtttcatcagggcagacctaatgcctctccgcccaacccgactgcgtgacaggctctggcggcatggcctgggcgtacacctgatcagggggactccagtcaacaaggacaagagcagcatcgtacctcagtcgaatcatctgagcttcctcgctcaagacctggacaccgtcgagcgccagctggacgacttcaggatcaaatacgtcgtgcagcgatgttgtgaggacggggtagagatgaggcagctcttcttccatgaccctggtaggctgatggtgctggatgacgggatgggggaagcctgtgcctgggttctatgcaaggttcatgctcgctgcggcaggtggaggagcctgaaagcctgtttgttgagtagtatgagtggccacctcttccacactctcagcgcattacgtgcttgccctcgtacaaaccttactcacactgcatgcatcgggacccagaatgtaacacgagaggatctagaggggattgtctgtggcggaccacatcgcaacgtacaagcggaagtggccacgtgctgcgaggtgcaaggcaacgcacagtccccattcatctccatggcgctcgatgggaggggtgtgggagcgttggcagggccaagagtgctgggcaggctgacgccagagctcatccttcgcagcccgcagtatatgaactgcgtgggacagtacgagctggacatgcgtgccaaccgcatcaacgtgattgagaatctcggggcgacggaggtgcgtcgagagtgtgctccttgctgggcgggatccgggttgggctattcccatcacccacgctcccccccaaccttgtcacccgttcagaaccaattcgacagcatcgacctctcggataatggcattgtgcgcctggagggcttccccaagctcctgcgtctcaaggtgctgcacctgaacagcaatcgtgtcatcaagattggccgcggcctggaaggtgggtgggatgccagagcagccctgccagaatctccatcgtctgtgcctgccctggaatggctcctcctgaccaacaataagttgacaaatctgacggtgagggtggaagatgcctgtgttagggcaagatctctgccttgcaaccagctgggagggcgcccgtgcattcaggagtatggcctctgtttccatcggcttcccatgactgggagggagcccgtgcattcaggagtatgtcctctgtttccatcggcttctcatgagttcccctccattccactgactattgttcaggacattgagccccttcggactttgccacgattgaagtacctgagcctcttggagaatcccatcacaaagcagaaggggtacaggtgcgaggatgtgcgcttgagtgcatgcccgagcatggctgtttgggtgcgaggatgtgcgcgtgagtgcatgcccgagcaaggctgtttgctgtgccaaggttgttacaagaaagtatggcttgtgcctcgttggcctgccctctacacccctannnnnnnnnntctgagggtagccggcgctgctggatggctgggggccgcgcaaactggctaccctgcacgttgcccccgccccctcacgtgnnnnnnnnnncccctcgattcccttgccttcaggctgtatgtgatcagtcgattgccccacctcaaggtcttggacttccgaaaagtgaagcagacagagcggcaggaagctgtgcggcagtaccccatgggtcttgcgccggctccggcggctacctttgagcctgatgaagacctggcagaggtgaggggtctgagggtagccggcgctgctggatggcttggggcctcgcaaactggctgccctgcacgttgcccccgcccccttacgtag

SEQ ID NO: 6465 - DNA, 897 bp, Chlorella protothecoides
  modified_base (431)..(477): a, c, t, g, unknown or other
  modified_base (855)..(864): a, c, t, g, unknown or other
atgctgaggcgtcgcgtgctcctcatcccctcgcagaccgagttgcgcgagaagctcgccaagctgtacgacgtgaaggacgacaagctgatctccgtcttcggtctgcgcacccaggtgtggggtgactggcgcttgaagggagctatgacgccaacggccattcctttatccttttcccagttcggtggcggcaagtccactggctttggcctgatctacgacagcctggaggctttcaagaagtttgagcccacccaccgcatcgtcagggcatctcatcacctgcctgatcccgcacccccaacccaatgccctcctcagaacggtctggccgaggctgtctccaagtcaaggaagcagaggaaggagaggaagaacaggctgaagaaggtccgcggaaccaagaaggcaggcatggctggcgccannnnnnnnnnnnnnnnnnnnnnnnnnnnnnnnnnnnnnnnnnnnnnngagggaccaagcaggggcaggctctcttgtggtgagcatgtttgctgcctgcatcagatgctgtactcaggcagagtcaccacttctttgcaggctgccacatgtttgtccctccagcttggatgtaacagaggcaatcacaggtcgcagttgcaagggggtgagggcagagtgggcatctcatttttggaaaacatgactgtgcacgatgacaaccacaggcgtcgctgcctcagtgggctgttctctgtgttgcgcttgcaagtcttggtgactccccgccttcatgcacaaggtcaatccagagcttcaaggcagagcttaccctccaaaaaggggaataaacggccgattgcggaaagctcgcttgctccccannnnnnnnnngaggcaatcacaggtcgcagttgcaaggggtga

SEQ ID NO: 6466 - DNA, 663 bp, Chlorella protothecoides
atgcgagccttgctgtccgggctgcgactcggttggggaccagcaccctgccgtgcccgcctgtgcgcaggctcccaccagccgggccgtgccgtgccgaggcgcgtgccagccagggccatgtccgaggcggctggcgaggcggggcggggtgaggccgtcgtcgagtccctttccccaccacccctcccccctcagctcctgagtgtggcgcccatgatggactggaccgacctccactaccgtcagctggcccgcatgatctcccgccacacctggctgtacacggaaatggtggtggacaagaccctgatccacaaccccgaccacgaccgcttcctctggtttccccccgagcagcaccccatcgtgtgccagctggggggcagcgaccccgacgaactagcggccgcggcgcgcatcgtcgccggctacggctacgacgagatcaatctcaatgtcggctgccccagcgaccgcgtggctggtgcgggctgcttcggcgcggccctcatgctccggcctgagctcgtcgctcgctgctgcgccgccatcgccgccgccgtggacatccccgtcaccgtgaaatgccgccttggtgagcgtgtgtgtggggggggtgattctgagggccagggatcttgtattcaattggaactgtga

SEQ ID NO: 6467 - DNA, 549 bp, Chlorella protothecoides
atgaagagcggcatgctggcggcagaggcggctgctgcagagctggccaaggaacccaccgccgcaggccgggccctcgacctgggcgcctacgagaccgcgatgcatgactcttgggtgcacacggagctacaccgggaacgaaacatccgaccctccttcgggctgggtgccgggatctggggcgggcttctgggctccgcgctggaagcgtatgtcctcaggggaaaggcgccctggaccctgcggcacaggcggccggaccacgaggcgctggcgcctgccgcgcaggcggcgccgagggagtaccccaagccggacggcagcctcaccttcgacctgaacacctccttgttccggagcgggaccaaccacgagcacgaccagccgccccacctgcgcctgcgcaacgccaagctgcccgaggccatcaacctgccgcggtatggcgggcccgaggcgaggtactgcccggcaggtaggagtgcgaggggggttgatttgggaattcaacagggcgtaagctccgcgtgcgtgtgtgtatcatag

SEQ ID NO: 6468 - DNA, 1341 bp, Chlorella protothecoides
  modified_base (34)..(57): a, c, t, g, unknown or other
  modified_base (115)..(124): a, c, t, g, unknown or other
atgtcatcgcctagcctccctgctttccaaaatnnnnnnnnnnnnnnnnnnnnnnnngtattgtccttcgttcagggcatgtgtatccattgtaagaggactggacactcgaggnnnnnnnnnngtattgtccttcgttcagggcatgtgtatcgattacgaacaattgcaaggcttggtatcccgtgtgcatcctttagatctcgcaatctgagcaagcgcggtagagggtcccgacaccgacgacttccctgcgcacagctacagcctgtgtcggcacgatccgggcctgatctcgcagacgccatgagtggaacccgccctagacccaagcattggacagctgggacttcaggccccgtgccgtacgtccatcagcccctgccattggcgttcgtcaatgggtcggtggtgggtgaggccggccccatcctgcaggacctaccctccaccgcacgcgggtccgagctggaggggggcgtgctcctctccctggccagccctgacggaccagtgtcaagcacatccttccgtctgggaaaggtgggcagagggctccccgccccctcccgcttcctcgccctgggcctcaccagcgtgtggtggatgacgcccgcatggggctcctgtgcctccagggtccccctggagacgcagttcctgctcctggaactcccagagggtgccggctgtgcggtcctgctccccctcctcagcaaccacggcaccttccgagcgtccctggccggctcgggcccggggtcagaggaccctgccctccacctccacgtcgacagtggcgacgccggggtcatgacgcagacttggacggacgttctttacatcgcggctggaaaggaggtgtaccccctggtggatgcagcggtggcgacggccgggcgactgagcggcggggcacggccgcggacatccaaagccgtccctgacttcgtggacacctttggatggtgcacctgggacgccttctactacgacgtaacaccggcaggtgtgaggattgcacccgattgctgcattgtatgcgtcaggcatgcagggagggccccggggactgcgctgcaagtgggcggcatcaaccctggattcgtgatcattgacgatggtgagtctggggcaagggctggtgagcatcctgggtggcaacacacggatgtggatgttccttaccgcggccaaggtacgctggtctgtcgggggtggctggagggacttgctgaacccacaggtgtcggagtgggacctggcaagtttccagcaggcacagggtgcaagattgcggggtctgccctgaaagatccgtccaactccgtccccagatga

SEQ ID NO: 6469 - DNA, 3084 bp, Chlorella protothecoides
  modified_base (829)..(838): a, c, t, g, unknown or other
  modified_base (1358)..(1367): a, c, t, g, unknown or other
  modified_base (2447)..(2456): a, c, t, g, unknown or other
  modified_base (2963)..(2972): a, c, t, g, unknown or other
gctgtggcgcgcgcggcgggggtaaccgcgccgctgcgcctgctcacccactgcaacacgggcagcctggcgacggcggggtacggcaccgcgctgggcgtggcgcgcgcgctgtggggctcggggcgcctggcgcgcgtcacctgcaccgagacgcggccctacaaccagggcgcgcggctgacggcctacgagctggcggccgacggcgtgccggccacgctgatcgtggacggcgcggccgccgcgcgcatggccgcgggcgaggtggacgccgtggtggtgggcgcggatcgcgtggctgccaacggcgacacggccaacaagatcgggacctacgcgctggcggtggccgccgcgcaccacggcctgcctttcttcgtggctgcgcccacaaccacgctggaccccgccacgcgcgccggcgccgacatcgccatcgagcagcgcgacccgcaggaggctttgccactcacgactccaatgagcaaggaagcagcacccgcccgaagacccctcctcatccctcctgcctccacatgcctgcagatcacccacttccggggggtcagggtggcagcggaggtccccgtctggaacccctccttcgatgtgacccccgccgcgctcatcaccggcattatcacggaggccggggtcatctctccgtcgcgcccggggggtgagtacgatgtgcccgctttcctggccgcgcggagagacaaggccggggtcgagcaagcagctgccgctgagaatgggcacggcaggcaagcgcaatccgccagggatcctgagaagggtgtggtggcagccgctgagcagcctnnnnnnnnnntggccgcgcggagagacaaggccggggtcgggcaggcagctgccgctgagaatgagcatggcagtcaagcgcaattcgccagggatcctgagaagggtgaggtggcagccgctgagcagcccgcaaagggcacacaggcacgaggcgtagactcaggcgacagcaggccaacaggcgccgcggcaccgcaaggaagcagcccggcgcagcccctgggaaggcagggcgtgcgaggggttggtgggcgcgtgagctcctggcttcccgagcggtgtgaggggggcttggtggcctggggaggggtggcagcgcggtggtgtgcagacggaggatggcgtgacgctcaggctgcggcgtcacagtggccatcccggcagacagctggatggaccgtccacaaacattcatgttcctgctgcgtcgtcatccagaccggccgtgctctgctccgctgtctctatacaccccttcacccccatccctccccctccccctcccaacccccacccccttccaccgnnnnnnnnnntcatccagaccggccgtgctctgctccgctttctctatacacccctacacccccatccctccctctccccctcccaacccccaaccccttccaccatttccagggaggttggggacggcaacatcaacttcgtgtacattgtcaccgggcccgcaggcgcgctgtgcctgaagcagtcgctgccctacgtgcgcatggtgggggcgggctggcccttgacccaggcgcggctggcggtggaggtggaggccctgcgcacccaggcccggctctgcccgcgccacgtccccgccgtctacaccttcgaccgcgccctggcggtggtgggcatgcagtgcgtgccgccgcctcacaccatcctgcgcggcgcgctggtcaggggggaggtcttcccccggctcagcgagcacgtcgcccgtttcctcgcagccacgctgttcaacacctccttcctggcgctcagcccccaggccttccagtgagttatctgtttgtgggtgggaggggagaaagaagggccccacccaaaatagtgccccaccggcatgcgggggcagggcggctgcctcgaggccaggatcgggagcagacagagcgctttgttaaccgcgggatgtgcgagctgacggagcaggtgatcttcaccgacccctaccacggcgcgccgcacaaccgcgccgccagcccccacctcgcggcgctcgtcggcgagctgcggcggccgcgggcgcggctggccgccacgcggctcaagcagaccttcatgcaccaaccccaggccctgctgcacggcgacttccacaccggctccctcatggtcgcccaggacagcacctacgtgatagacgccgagtttgccttctgcgggcccatcgcctttgagctgggcaagtgggtggcaaacctgctcctagccttcttcggcgcgacggggcacggacacgtgatggtttcatgccacatgagctattgggatggtcgcccaccttcccgcgaagggaccctattgcgtcatgatcgctgggccttgctccgagccgccccccatgatgcacaagctcatgcgatctacattaatcnnnnnnnnnnagccttcttcggcgcgacggggcacggacatgacacagcaaaggcgcgcaggcaagaggagtggctgctgcagacggctcgcgagagcatcgacggcttcctcgcggggttccagactctctggctccagcatggcgccagcgaggatggcggcgtcgcctccgccagcctcttcgagggccccgacgagctcgtccccgtgatcgaggcattcctccaggacgtgacgcgcgacgcggcgcgcttcgccggggcggtcatgatcaggcgcatcgtgggcatcgcccgtgtggcggacctggagaccatccaagatccccagctcaactgcctgcgtgtgtcaatcacaaagtctgctgcttgctggacagcttgctctgctatgaggaagctccacaccctcaccggctgtttcatgcagggagaggctggaggagcgggccctgagttttgccctgccgctgttatatggcacgatctccttaaaggcagctttggaggggctgnnnnnnnnnncagggagaggctggaggagcgggccctgagctttgccctgccgctgttgtatggcacgatctccttggaggcggctttggaggggcttcaagaggaactgcgctcggcttga

SEQ ID NO: 6470 - DNA, 693 bp, Chlorella protothecoides
atgcaagccagcacttctggcctaggcggcctgctttccgtccaccgagtagtgaggaagatccagggggcggcgagtgccgtccccggcgcactgttcaggggcctgaagaaagcagtggacgcctccagtgccgattcatggttcgtaagagccgtcatttggctggtcaggggcccactccggccggcgctgctggcattctacgcaaaggccaccaaccacggacagcggctgctgactgtgaaggccaactcgaagttccggggcctgggcaagccacgctccctggccctgaacgaggccgggggcaagttgggccccgtcgtcgacaagatcaaggacatgggggtgcgccacgtcatcgcctggcacgcgctgtgtggcttctggggcggcctgtctgacgagctgggcgagcagtatgaggcggagctcatcatgcccgagccccccgcgaatcttctggtgcggccacatggtggttgggcgctgaacccggagaccgcctggatcccgccctcggtggccggggtccgcatcccgcgcgaccccaccgccttgcacacagacatgcacgcctacctggctggctgcggcgtggatggcgtcaaggtggacgtccaggtaggaaggggtgtgttgcaagggccagcagtgggccatcagcaaggaggggtgtgccttctgtag

SEQ ID NO: 6471 - DNA, 378 bp, Chlorella protothecoides
ccctcgccgccgctcgcagaggagacggacggcgagatggagctgcgcgcggcgctggtggccaaggccgagtacctggccgacacgggggacgcggccggcgcggccgccgccttcgacgccgcggagcggaagacggcgggggcgggccccaagctggacctcgtcctggcccgggccaggctggagctggggctcgaactgagggcggagctgcggcggacgctggaccgggcacgcgcgctgagcgcggcggggggcgactgggagcgccggaacaagctcaaggtgtacgaggccgtggaggccatggccacgcgcagattcgacgtggcggccaagctcctgctcgactgcatcgccaccttctctgcgtga

SEQ ID NO: 6472 - DNA, 369 bp, Chlorella protothecoides
atgggaggagggttggagggggggcctggggagggccagggatgcccggcccttgggggatgcgtttcagtagtgtgcagaggtgccatggcagctctgggaggctctctgtggccacaagctgaagaatcccaagaccgagctgcgtcacaaggccacaagctgaagaatccaaagaccgagctgcgtcagaagtgtgatcacatcccggctcggtcccgacttgtcatcaccggcactcccattcaggtggagggggaggcaagacgctgcattacccattgcatggttcttgacgtgccttgtagactctcggcaacggcaggttgcgtcagctccaaaacactcccatctgcactccccacctga

SEQ ID NO: 6473 - DNA, 999 bp, Chlorella protothecoides
atggtggacgaggaagactaccacttcttcggcgctcccctcgtcgacgagtcagacgtccagccttttcagcgatccgatccggctgccacacggagtctccccttgcaccaacagggagctcgatcagtccccatcgtagacgctcgtcggagctcctcgccagggagtgctgccccacacccagcccatatcgtggagtcacctcacatcccacacgcctgcgagcaggaggtgaaggacgaccagggtcgtcggcgattccatggcgcgttcacggggggatacagcgccggctacttcaacagcgtgggctccaaggagggctggacgcccgccaccttctccagctcccagggcgcccgcgccggtgtgcggcagagcgtcgagcagttcctggacgaggacgagctggagcagtaccgcaaacagcacctccaggtgcgtgcattcatgagcaccgactgtctttgccctgccgtgggctccccttggtttcgcccggcagcctcaggacggccttccctcgtccactcccacgctaccacacattcaaccagccccccatggcccctgccacagaccacggcggcgtacgacacctttggcgcgacagccgccgaggccagccgccgcgccgtgtgggagcaggcggccatccgcccccaggccgtgcccggccttctgcccgaggatgtcatcgcgccggtggccgacagcgtcggcatccagctgctgcgcaggatggggtggcgtcagggccggggcctgggcggcaggcccgatgctgccggctcgaggggcgccgctggatctgaggtcatttcgggaaccgcacgtgaaaccggcgccgcactcgcctccctcctccctccggcgcccaagacggatctgcacggcattgggtacgaccccttcaggatctgcgtgtattgcgctcgtgagctggggagggtgagcaggtggctgcgctggacgaccggcacaatccacccctga

SEQ ID NO: 6474 - DNA, 1293 bp, Chlorella protothecoides
  modified_base (90)..(99): a, c, t, g, unknown or other
  modified_base (774)..(787): a, c, t, g, unknown or other
  modified_base (873)..(882): a, c, t, g, unknown or other
atgcaaattcacgactgtgctcaatccaccaattctcccttttctccaactccaggaagcaaggcttcagcaaagcaggatcattcaggnnnnnnnnnncatgcaaattcacgactgtgctcattccaccaattttcccttttctccaactccaggaatcaaggcttcagcaaagcaggatcattcagggactccacgctcgagatcatgggtctgtccgtgagtgccgtgtccatcgaacccttcaaggttctgctgccgaggtcgactcagatcattctgacagtggaatgcctgaagcccggccagactgcctgcaaagctgacagtaagggcaacattggcactggtaacgatggaaagaacaactttggggactacaacatcggcgacaacaacattggtgggcgctgggggaacgggatagattgggtgggagggaagtgcctgtgcaccggaattgctggggtggggtttaaatcaaaattgccgtacgtctcacactcgtaccgcactgaactcctatcccgtgcagggaggtacaataaggggaactcaaattggggcttcagaaacaatgggaacaacaaccgttgcaaccatgccgtgggcaatcggggaacggtgaacaactgcgacttgatggagctcaggaagaacgccgatctgaactacaacccaccgcctcctcccatcaagccacctcctccaccaccatccaggaagccccccccacctccctccaagccacctcctccaccaccatctaaaaannnnnnnnnnnnnntcccccaaaatgtctgcaccgcctcctccgtccaagaagtcaccccctccttcccccaagtcgcctcctccctccaccaagtcacnnnnnnnnnnccccccaaaacgtctgcaccgcctcctccatccaagaagtcaccccctccctccaccaaatcaccaccacccccctccaccaagacaccacctcctcccaccaagccaccaccacctccctccaccaagtcaccacctccttccaccaagtcgccacctcccttcatcaagccaccacctcccctcaccaagtcgccaccaccaccatctttcaagtcaccaccaccaccatccatcaagtcaccatcccctgtccacaggccgccgccttccccacttgctgtgcaacccccacctccaccctccccacctcccagtccccgtcccatcagctttccccctcccagctccccccctcccagcccacctcctgcctcgcctcctcccagcccacctcctcccagcccccag

SEQ ID NO: 6475 - DNA, 660 bp, Chlorella protothecoides
atgctggccgatccacacctgcctgcatggcagcgcaatcagaacgtcacccctccccctttctctcaatcgccccttgtcgcgcagggcgctcgcgagttcgaggccgccaagcgtgcccggctggaggcggggcggcggcagagcggagcggcgggccctgtaccccggcgccacccgggggtggcctttgggacgggggtgctggaagaggacgacgccgaggggatcatggatgattacgtcgtgcacggggacgtggggggcgaggtggaaagcgtgaacgccgatgcgcgtggcctgccagcccggcggggcccgggcgtccagcgggtggggcttggggacaggctgttggccggcggctactcctttgagatccaggtgctgtgcttgaaagggctttgggggctggaagggggggggaggtgtggatactgggcgcgctggggaccaagtcatgggtgcctgcccgcgttcggggaggagacgccaggcttgctggaagctgccgctggtcatacggaggaggaggaggacgaggacgaggaggagggaagagcccccctccttgcactgactggagctcgcggaccggccatgctgactgggcggccggcgccggcggccatcaagagcagggtgagcggggaggtctag

SEQ ID NO: 6476 - DNA, 1170 bp, Chlorella protothecoides
atgcatgcggccaaagagggggagaacgctgcgccgggggcagcaaccattcctgccgagacagagcgtgcccttccccaatggacacacaagtctgactttatcatatggctgcagctgaagcctctccagctaagcctgtaccaggtgtgtgggtggctgggtaagagggggggggagggccttggccctccatgccctgcatcaatccccttcaaccatggcggggtgtgctctgggatcaaacagcagacaacacgatgcctgctcagcatctccctcaccccaccgccaccccacctcatccctccccaggccttcctcagctcccccctgatcaagtcggtgctaaacagctctcgctctgccctaggcgccctcaccgtgctgaagaagatctgtgaccacccggcgctggtctcggaacgagcacagcgggagatgatggccgcgtcagcgacagatgaagccgggcaggcggccgatgcagatgtggaaaccagtgaggaagtcgcggcgctgacagaggactgcccgacgtggctgggcgccagggaggaggagggcctgcgccgcctgctggctgcagtggacgagagcacgttcctggcctcctgcaagaccgagtttgtgctgggcctcctgaggcatctcgtaggctcaggccacaagaccctggtcttctcgcagtccaccaagatgggacgggcgagaagggtccggcagaggccaggtcgaagaagtggcttggcatgccgccaggtcgaagaagtggcttggcatgccgccaggtcggctgtgccctggcatgcaggtccccggctgacccaccgcagcgaccctgtggcaacgaggcatccggtgcccgccctccgaacctggcccaggctgccgctgcttgactgtttgagggtacttttgccaaacagtcccatcgtatcgcgcgcccccctccacaggctcaccatcctggagacggccataagaaaggagggcgtgcgcatggtgcgcatcgacggccaggtggccagcgtggatgagcgtgcggcgcgcgtgcatgccttccaaacctgcccagacatcctcgtattcctgctttccagcgcggtgggggggctgggcctcaccctgaccgctgccgaccgggtgatcatgtgcgtgcctgggtag

SEQ ID NO: 6477 - DNA, 387 bp, Chlorella protothecoides
atgcacatgggcgtccggatgcattccctccccccagcagcggggctcttcgctccgccccccctcccatcctcaaaccccgacgggcgcccccccccctcctccccccaggacggaggtgatgagctacgagcagtgcgtcttctacaccgtcctcaccgccgtgctcaccctggaccggcccagcctgaaggccaagggagtacccgttccagggcggagcattggcgccccgcccaggtcatgtggctcagcgggcttgccgtggtcatctcctcccccgaggtcctgtctgtaatcgacaccatcccgcacctgagctccttcctcaatgccctgcacgactgcaagtatgccgaattcttccgggtacgtgatggaggatag

SEQ ID NO: 6478 - DNA, 522 bp, Chlorella protothecoides
atgggcgcatttgacatggtgcactgcgctgtgcttcaacgcctggccacacactggccccttgcgacgcatccctcaggtgttcaaggccggcctgtcgaggacgggcaccgaggatggcgagcagcacaagtactttgcccagcaggtgggttgatgcattgggtagagctgacattgcttgggttgaagcgctgcagcagggctgccaggttgttgtggtggggattgagcccatgtaccgcctacgtggcccttgcgtaccactgcgatgccccaccccaacccctgcaggagctccgagacctgttgaagctggacctggcggaggtgcatgcctctcccaccctgcgcatcctcaacgagatgcacgccggccagaggcggctcaccccccagctgtcggagcacctgcagttcctggagaccctggcgggggcagggagagatgaagaatgtcgtaaggcttggtcggggggcaagcaaagccacgaggctgggaggggtccaggcgctacgtga

SEQ ID NO: 6479 - DNA, 1272 bp, Chlorella protothecoides
atggcgcccgggcagactggaagggaccagggcccctccgccggcccgccggcggcccccgagcgcaaagccgccttcacgtcggcggaggagcgcgggcgggcgctgggcgagaccccgttgccgtcgcagcctggagccgtcgacacagcggcagtctcaggcgcagagtcttcaagaggtggccccccagcaccgcgtcgggacgtgctgctcagcgtcgcggccgccgaccggctgcggctcgcggggatgctgtcccgcagcttcgtgagcgggagcgccgagtgcggcgacgccggggcctcggaggttcccgctggcctccgccccggagcgcggcccgaacggccgccgggatcgcagcagggaccgccccccgcggccctcggcccggcgcccgcgcctgtcggcgcagttccccgggccgcggggcacatcgtgaccgccgccgacctgagcagggcaggtgggtttggcggcgaagacaagcaggccccaggcgcggcgccacggctccccattcgccgcagcaaggagtggcgtccggcggccctgctctgcaagcgcttcaacgtgccggacccgttccacggccggccgcgcgaggtggagccgtcccgcttcaagaccgacttcctggccctgcccgacacggccgccgcggccgtcgcacaggccgccgcgaagctgggcccgggggccgccgagctgctggcgccgcccgcgccccgtggcggcgcggccgaggcgaccgcggtcggagacgccgccgccgatgctgagctggccgccgagcgattcctggccgacctgcttggccaggcggcggagccggaggagctgcccccgctgccgcccgcaccccccatggacctcttcaaggccatttttgaagacgacgaggaggaggaagaagaggaaatggaggagggagcgagaaagcctggcggcctagaggctggggggggcggaggagatgcctctgtggtgctggagagaagcgtggaccagggcagggatgctcatccaagcggcggggcttctgagaggagggagccgcaggcggactttggcttttccaagctgcgcagcgagcgagggagtgttcgtggagcaggtgcggaggattctgcgggcccgaggctggccgaggaccctgcgcctgccgcgggcggcatccacggcctggacccggccctgcgtcagcgcgtggaaagcaccctgaagagcctggggaagcgggagcgcaaagagaataagcggaggtga

SEQ ID NO: 6480 - DNA, 453 bp, Chlorella protothecoides
atgaccggctccgacacagggcctctgcccctgggctgtcgacggcaagtcccagacacactgcctcccctcaaccctgctccccaaccccccacgctggacccccaggtccacgcagggaacactccagtggcccggaagcccacgctcttcttcctggcacactgcggcgcggacctcaccgattccctgctttccagcaaccgtgcggccggcacgctgcacaacctggtgctgctgggcaacagcctgtcggccatcgccgccgcctggcagcacaggggacctgcggctgggcacgccgcgatttccaccatcctggacctggtccaacccggctcctgcatgcgggaggtggcgctgccggagtacgccttccccgtgatctccgcgttcaacgacatcagcatccacaccttctgggcggccccgcccctgaagcaaagcgactag

SEQ ID NO: 6481 - DNA, 618 bp, Chlorella protothecoides
  modified_base (419)..(428): a, c, t, g, unknown or other
atgcagcctcgactcccccaggcccatgcgtcctctgtcacgcaggcaacgaactcttccgaaaccccggccatcgatgtctcggcgcatgaagttccttgcagcaagagcctgtcggtgaccgccccccgagcgccctcctcggccagggcccagacctccctggggcccatcgtgttggtggccaagcccctggcaagagtgctcctcctgcacaccgggggcaccctggggatggacagtcacgcctcctacgaggaggatgtggatgggcaccacgtgctggtgtctgggacggggggcaagtaccacgcccagaaaagccagagcttgaagccaggcaacatgctgaacaacctgctcgggatcgtgcctgagctgcgccagcttgccaacctggacctcaaggtggtcttcannnnnnnnnnagagtgtggtgctcaaatgcccttgcatgcgccggagctctttgctgattgcactgcttccccactcaaaggtggtcttcaaccgcgattcctgcaacatcggacccaaagaatgactgctgctagcatgcttgtgcgcttgtgcagaggcaggcttctgcctgctctgttgggtctgtcagggtcatag

SEQ ID NO: 6482 - DNA, 1002 bp, Chlorella protothecoides
  modified_base (971)..(980): a, c, t, g, unknown or other
atgtccgagatgtcggcgatggaaagggtgatgtactgcagcatggcgtccatggacaggctggggtaccagcgctgcacgccaaaggaccacagcgcattgcacaagccctggctggtgaagccctccagccggtttatgggcaggccggagaatccggggcgctgggccacgatctcgcgctcaatggcgctcagcatgggcgggctggccagccctgcgcgcgagaagcagagcagcaggttggtgaggtcctgtgccgagaactcctcggcctgcgaggggcgtgccagcctgcacattgggtggtatggggaaagcgatcccccatccccaaaccacgcgcctgctgacgacctccttggaaagcgcggcgcagagcctgacgggcgtgtactccagcacggagcacgaccaggcgatgttggcgatggactgcgtcctcatctcggtcagcagggccatggtccgccgctcgatggccgccaggaattcggggtcacggtggcgcagcaccgcacaggcccacacgatgttgctcaggccctgggtgctgaagtcatcgatgtgggtagggccaacattgcccggccacctcgcgcgacaaaccatgagtcaggatcacagtgcacccctctgtgcggcccagctcacttgaccacaccctcttgcactacccaccttcagtttgactttgccgccgacatcgtgaacaacgacgagctggcgcgcgccgcgcgggcggaggcggcctccgcctcgccgcgttgccagccctccttcgagccgctgcagcacggtccggagctggaccgccaggccgcggtgatcgaccgcctggacgcgggcgcgcacgaggagagcggcgtgaaccaggcgctggcggcgctgatgcagcggcggctggccgccgcgcgcagcgcctcggagcgcacgctgggcgcgctgcgcgcgctggctggcgcggagcnnnnnnnnnngggggggggggggggggggtga

SEQ ID NO: 6483 - DNA, 1401 bp, Chlorella protothecoides
  modified_base (1335)..(1344): a, c, t, g, unknown or other
atggtagtatcgcatcttgtgttgagggttgcgcgagctgggatgcttgtcgcgatgctggtatgcatatcgggggggtgggcccacgtgcctcggatgctcctcctggaagggggtcgacaactggcactccccggagctgaattccctcacgcgttgatagacgctcctctctcctcctccttctatttccgagtttcgcttgatcgctgccttcttccggttacgttatttctccgtttaggcacagtctgcacgacgctctcgccccgagcctgtcgtgtttccctttcctcaaccgatcgctgcagtactttcctcaactttgaaggtgattttacattcactcgttctccatcgtccccccccccttccccgttgcggtcgcggcccacgtcaaccctgctggcgggggggtgcggtccccctcctgcacgtgctccatttgatttccccaaccgggggagcaaatccccctcttcccctccgcagcccttccctcccagcggtccctatttgtcatccccgcagactgccatggatttagagctgtgcaccccccaggacatggaccaccggcacccccccgtggactccaacaccagctccacctccgaggccgacgtggctagtctgctggacggcgcagaccagcggtcgcaccacctgctcaagcactgcctgtcccacggccagcgcgacggcgcgttggcccactttaccaccgctgacgtgaaggaggcggcacgcgaggtgtcgcgcatgggccagcgcgacctgcaggcccggttcaaggccgtgtacggcacgaccacgcacagcaacaacaacgactggctgcggcggaagctgtacgaggccatcggggccgcgcccatgaaggcggcggtgaagagcaagccacgcaaggccgccgcaaaggcgcgcagccgtggcgcgagcctgccggcctcaccggtggcagcgcggggggcgctggccggcgctcaccgcgcctcctgcgacctgggctccgggaaggcgcaggatggggacgccgcgctgctgggcatggagtcggacctgtcgctcaccgaggacggcagcgaggaggggtccttcacgcacgcccccggcgctgcacacgaggccaaggcagccagccaggtgggggagtcaggctcggagcttgccgaaggggtttggctgcatgtgctgggtagcgacaggtgtgcatctgcccttgtgtctcgggtatggttgtgccgcaaactgctatcacaggacgcttgctctgatgcgacggctctgatgtgcctactctacaaaccatgccttgcactgtacagaccttgnnnnnnnnnnccttgtgtctcgggtatggttgtgccgcaagctgctatcacagggcgcttgctctga

SEQ ID NO: 6484 - DNA, 252 bp, Chlorella protothecoides
atgcccactgaactcctcctcaagcagcgcctgtgcaccactgcaggctctgctttccttggcgccctggccattgcccccgcaattgtggagggccttacgggcatgacggccctgcgtggcttcgcggggacctcagtcctcattctggtgggcgtggccaccgacacggcgcgcaagttcagggctgagctggcgatgggcaagtacaaggacattgatgccctttacgacaaccttgacgacctatag

SEQ ID NO: 6485 - DNA, 828 bp, Chlorella protothecoides
atggacagatctggatttttgaattcgcaaggtgaatcacgaccctacgtggcggacccaagctgtcgatccgaaccagagggcaggacgtgcggccaagccagggaagaagaagcaagcggaaactactctgcccgcttccgtagctgcacacttgagataggccagccctcgcgagggatccacaagtacaatgcgtgcagtaccatctgcgctgccagcccccactctaaaccaagcaacttcctctgtcatgagcaggcttatctggccatcaagcacagcatggctgcaccagaaggcccttcacagccagctggaagtgtccgcagagactttctatgcatccaacgtctgggatgcccatccctttacagcgtcagctatggccagccacccactctctcagctgccgggttgggagcccagccattctctgatgtgccacccagtctggtgccctcttcacccacccgttgctgtgccaaacattccacacagcgtctgctgaagctggcgagccgtgggacaccccggccacggatcctgtgtagagcagcaagcaaggatgagggtaacattgtctcccagttcttcagcggcgacctgcccaagaacaccgccatcctgctggcgctacttgttttctcccgcctcggcgtctatatccggctgcccggcgtggatgtggacgcctttgccgccagcatgcagggcgggggcctgctggggtacatcgacacgttgtcgggcgggtccatcagccgcgtcggcgtcttctcccttggcaagtggtcgtggcctgccagggaggcgggaggcccctga

SEQ ID NO: 6486 - DNA, 525 bp, Chlorella protothecoides
atgccaagtggcagaggaggtgaggggaggggactggagcgtggaggagtggtgtggtcgtgcatctcatgcccaatcatggcggtctgcactgcaccattgagttaccgcacgcacacccttcgcagctttgacgttcggcttcagcagcgagggaacaacatgtacctgcatgtcatgtggcgcttcctagagcagaaatccttccctctgacagacgaggagtaccaggagcagctcaatgccgtggcagcatttgtcgacgcgtggggcgtggctgacatggtccgtcaaggcattgcaggggcatctaggaaaggtccagggcatacaggtgagactcctcccccggtgagactggtggcatggcctgctcttcgatgtcacaattgctcagcatgccagcaaggaccatcgcctgccgtgctgcctgtgccactcacaggaggaggtggtgctcgggcaatatctatccccttgaggatcagcagcgacgtactgaagtccagcgagtggaatatttaa

SEQ ID NO: 6487 - DNA, 2010 bp, Chlorella protothecoides
atgcaggaagcgcaaatcatgatgccgcttccagaggtacgctggcccaccaactctggctgctctgtcaggagatggtgctcatgtgtagatgtcttggtgattgcttatcgccaggatcgacggcccagcttcacacatccaatggcacaggcaagtgcagctgttatgagtaagcagcaggagatcatgcaagagctggagttgcggcgaaggatgaagactgtagtggttcccaccaatgatggggaagtccggcgtcttctgagagagcttggagagcccatcaccctgccacggatcattttccgggacactgtccacctacagatggaacgctctgaccgtctgcggaagatctatgccctgaatgattatgctgcgcccagtggccttacgttggagccagcggctcagctagtgtctcagaaagaaatcttctacacagaagggagtgatcagctgaagtctgcacgccttcagccaggcgcctgcattccgagcgccagagaatggaagcaaacgggcatggtgaccaagaaggtgtggtccaagctgcttggcttagccaggtggcggcagctttgggcatgccatcgctgcccctacctcgccgatgtccgaccccattctcctcgccgccctcattgcgtagaattaccccttcggcatctcatcaatcaagtgtctgagatcggggacgaccgaccaatcgtggggtgtgtcttctcaccggacgggtcacagctgctgactggctcttggagtggtgcagtcaaaatctgggattctgccagctgccgtgtggtgacgagcatcaaggctcacacggaccgcgtcacaggagttgcatggaatccaaatgtggcaggtgtgtggcggctgcttttgagattgagcctgattgggggaagagttgatctatatcataacaagttgctccagtttgctagccaggacagatgccaacaggtctgttttgcaatgcctggtgcaggaacatccacagaaggagtggcgtttgtgtcaggagccacagacggcacagcctgtctgtggtccaaggagggccgttgccaagccacactttccggccatactgaccggcttggaagggtggcattccatccttttggtagacatgtgggcacagctagctttgacaccacctggcgcttctgggacatcgcaacgagtacctgcttgcaggagcaggagggtcacagtcgggctgtgtatgccatcgccttccagggggatggcgcccttgtggcgacgggcggcatggatgccactggcaggctctgggatttgcggacaggtcgcaacatcatgaaactcgagggacacgtgaagtccatcctagcggcagatttcagcccaaatgggtaccatgtggcgacaggatccgaggacaacaccgcacatgtgtttgacctgcggaaaaagggtaccctcaccatcctcccaggtcacacgtcgctgatctctactgtccgctttgagccgatcacgggtagctaccttttgacgtgtgggtacgataaggtcagcaagctgtgggccgggcgcactctgcggctggccaagactctggcaggccacgatgggaaggtcatggccggcgacatcagcccagatggggcctgcctcattgcaaccgcagtactccatgagaaggaagatcttctgagccgagcgaatgccaagcgtaagccggacagaaaacatcatcatcgtggcctggagcaggaggaagtgggcgtgcgtttgcagctcaggatttcggaaacgttgctcttgattgctcgactgagaccgaggatgcatcttgccactgcatgcacacagtgccgtccagttctgttgacgggcaggaccacagcgccagtgcccacaagtcggagaacaaatcgggcgttacataggaggagatacatcccagttcattcatcaacgacagaaggaggtgatccgggtgcgatccgggaaggcatgccgtcttcatga

SEQ ID NO: 6488 - DNA, 2067 bp, Chlorella protothecoides
  modified_base (633)..(642): a, c, t, g, unknown or other
atgctctctgctgtcaaacggataggccgagttttgcacgacaaggggaactccccagtggatgcattcctggactgtgtgctgagcttgtccagcaagattcctctatactccctcatcgtgggcctgctcaacgttgatgacgagccatttgtcagcacgctgctcgagaaagttggacatcgccttgcccagtcgcttgcgagcggcgccgaatcatccaagggtcggattctccttcagttcctggcctcgctctgcaatgtcaatgtcgtggacacaggatccttcctggcattcatcctcgagcagatgcagcaagtgacaagtgtcgctgagcagaggaaagatgacgctccagaggagtggcagccgcatctagactcgttggtgtactcgtacctggtggcactcccttttgtcgaggaaggggcgccatcccacttcggagatcagctgcaggcaatactgagagtctgcagagactaccttggtctgaggaggctgcgtggcaagagtctccatccgttcctgatggcattatcagaagaagataccatttcacagatggcagtcctcgttgccaaccactgcaacaggtttgaatgcccgattagacgcagcagatctgannnnnnnnnncggcggattttgcaatataggatggcagtcctcgttgccaaccgctgcaacaggtccgacatgggcagagcatccttcataccagatcttactgaagccctcgatcagatcatcagtcttggtgcgtttgacatctcgagcatccctagactccatgcgaaatacgagatagatctggcgaatgggaagattcgcagccttcccgacatcgctgtacccttggatggaggaaacagctacccttctggagcttcaccaagtgtgagagcagcattgcagctggagaagtaccctccgagacggacccttcaattgctggataaacagcacaccgatggagagcgacccgccttggaaaggatcatcgttgaggactatgttctcgacgtcctgatggcttttgagggagacagaattgagtgcgcgcggcgccttgttcaaggactacccatcacattcccttacgagcctcttctgtgtcaagtactgttcggccaaatgctgggcttgccccattcgaagttccggccggtaatgtacgccaccctgatggtggatctctgcaaactctgcaagacctttcccagagcaatgagtgcctgtgtacgggagtgctttgcccggatgaatacgatggatatgaatcttcgcttcagattggcagaatggctggcatatcatttatcctgctttgagtacgtctggccgtggtccaagtgggagcacgtcctcacgaaaccagagcacgatggtcaaaggtaccagggactggcaattctgcgggctggtcctggacaagctggtccggctgtcgtattgggagaggatccacagtgtggtgccgcctcagttccaggtcttgctgccaccaaaacctgttccggcaaaaatcgagttcgagcaaagacctctgctgaagatctggacgtttggttggaatctatctctgaaacgaatgaattgtcggcctttgatctgtgcaacctgcttgtgcgagtcatcctggacgccggttcaaagtcctacacacacatgctcactctcttggagcggtacactggccctctggttgtcagggtgactgcgctgggcagacagagcgagatgagtctcatcgatggagtgatggaagtctggaaggaagcgccccaacgtgttgtgatggctgtggaccgccttatgacgcttcgcctggtctcaggtgagcatttattggaccatccgcttcacaaaccatacacaactcgtggtactcacgagagaacaacactttcctacgcagcggaagctgtgatatcgtggatattccatagaaaccccttcaaggctgcaaacgattccctgagctttgctaccgtctgggaagttctccattgcgctctcgacaaaaccgtagcccgagtgcaggtgagattccccgcttaa

SEQ ID NO: 6489 - DNA, 795 bp, Chlorella protothecoides
atgcaggctggcgcaccagccgggggacctcatgctccgctttctcgacgagctggtcaagcgtgcggccagcctggacctccaggcctgctgcaacgggctctggagcatcggcgtgctgcaggtgggagtggggagggaaatcccggctatggagcgtcgcaggatccaggctgccgctcacatgtcgcacatcaagcatcctcccggacccctcccccacagtccaccgagtccgaggccttcctgcgtcttctggcgcgtttcatcgagctggaggagcgggagaggctgagcgtgctgcagtgcaaccaggtgcgcagcgggccgccagggtcggtggtggtcggtgcccgtcgtggctgggctgctttcgctgtgctgcagagcgtgaccctggcgctgtgcgagcagcgcgcgcagcgttccgactcgccctggcgcctgggcaagcacttcacccccgccgtgctcaaggcctgcctgcagcgctggtcggccaaggtgcagagcgagcgcagctccaccaccctctcccgcttccacctcgtggtcagcaccctgctccagcagctgggcatcgagcaccagctggagcactgcgtgatcaagcccggggtgcacgtagacatcgccatcctgcgcccctccggcgagcgcctggccgtggaggtggatggaccgcaccactaccccttcaactccttcgccccgctggggcacacctgggtgcggcgcagggtgctgcgcgcctgcggctggaaggtgctctccgtccccttctgggcgtggtga

SEQ ID NO: 6490 - DNA, 720 bp, Chlorella protothecoides
atgactgagaagatcatcgccaaccactcagacagctccgtggtcaggcccggctccaacatctggacccgggtggacaagctgatgacccacgatgtgtgtggcccaggcacctttggcatcttccagaaggagtttggcgagaatgcagaggtctgggaccgcgagcgcgtggtgctcatgccggaccactacatcttcacctccgacgagcgtgccaaccgcaacgtggacatcctgcgcgacatggcgaagcgttacaacatcaaatacttttatgacatcactgaccgctcggacttccgggccaacccggactacaagggcgtgtgccacgtggccctggcccaggagggccactgcaagccgggggaggtcatgtttggcacagactcccacacctgcaacgccggggcgttcggccaattcgccacgggtgtggggaataccgacgctggcttcatcctggggacaggaaagctgctgatcaaggtgccgcccaccatgcgcttcgagatggtgggccagatgccgccgtacctgctggccaaggacctcatcctgcacatcatcggcgagatctcggtggccggcggcacgtaccgggccatggagttcagcggggaggccatctccaacatgagcatggaggagcgcatgaccatctgcaacatggtgatcgaggccggcggcaagaacggtgagggagctggagggtag

SEQ ID NO: 6491 - DNA, 444 bp, Chlorella protothecoides
atgtgcaggctggcacgcccctcgcaggccgaggagttctcggcacaggacctcaccaacctgctgctctgcttctcgcgcgcagggctggccagcccgcccatgctgagcgccattgagcgcgagatcgtggcccagcgccccggattctccggcctgcccataaaccggctggagggcttcaccagccagggcttgtgcaatgcgctgtggtcctttggcgtgcagcgctggtaccccagcctgtccatggacgccatgctgcagtacatcaccctttccatcgccgacatctcggacatggagctggtgctcaccttgtgggcctgtgccaggcaaggaagggtcgtggggaaggggtcgggaggggaggttctactcgtcgtgagggggagggtttttctcgcgctggaggatcggcgcgcctgggcaaacaatgcatga

SEQ ID NO: 6492 - DNA, 453 bp, Chlorella protothecoides
atgctgacgagtctgcggcgggacgggggccacagcgccgcccgcgccgccctcctgtcctcccccgccgccccctcaggccccgcggccccgggccggggccgcgagagcgaggccaccgcccccctcacctcggcggggctgctggagctgcagcgcgacgtgatgagccagcaggaccgggagctggagcagctggagaggggggtggcctctaccaagcacgtggccctgcgcattaacgaggaggccacgctgcacaaccggctgctggaggggctggaggaggatgtggacgtctcccggtcgcgcctggcagccgcacagcgccggctcaagggcgtcatgcacagggcccggtcctgcaaaacgcagctggtgatcctcctcctcctcatcgtgctggtgattgtggtggtcgtgggtttcaagctcgtcctgagctggttctga

SEQ ID NO: 6493 - DNA, 621 bp, Chlorella protothecoides
atgtgccccccggacgagacaacattcgactatgtcacccagaggacctccgagccctttgagcccgtgtatgctgacagcgcagcgcagtacgtggagagcttcaggttcgacgtgtccaaactggagccgacggtggcggcgccccactcccctgacaaccggaagcttgcaagagagtgccgccacgtcaagatcgaccgcgtctacatcggctcgtgcactggcgggaagacagaagacttcatggcggcagcaaagctgtttcatgccgcggggcagcaggtgaaagtgcccaccttcctcgtaccagccacccagaaggtctgggcagatgtatatgccctgccagtccctgggtgtggtggcaagaccgcagcccagatcttcgaggcggcgggctgcatcaccccagcggcgccctcgtgcgcggcctgcttggggggcccacgcgacacctttgcacgcatgaacgaggcccaggtctgcgtgtcgacgaccaatcgcaacttcccggggcggatggggcacaaggatgggcaggtgtacctggcctcacccttcacagcagcagcctcggccctggctgggcatgtggctgacccgcgagactacatgtga

SEQ ID NO: 6494 - DNA, 726 bp, Chlorella protothecoides
atggcccctgaactcggttctcaccatgtgcaggcctactggcccttccaccgcctgcactgcaaacgaaacgagtttgcagatgcaatggaggaggctgatccgaagtttgccacttggatgaggggccacggtaagctcgctgtcctgaaggacgatgaagtagaccggctggaaagggcggcacaggccgcatcgggccccagccgggcagaggtcatggactccatgtatgggagactggagccgaagccagctggtgcgaggcgggggagggaggggtgcgccgctgtgcatgaggaagtggaggtcttcttcctgttaggaatggtccatggccccagcttctcggccgaggagctggagcgcatgtccgaggcagcggaggcagtcaaggcgagcgctcgtcgcgcactgccctgcagcaaagcgtatgcagccatcgatgtccccgagggcatggggagcgacgccggcggctacaagtggcggcagagccagacgcacgtcgaggtgttcgtgagcctccctcctggcaccagccggcgcgccgtgcacgtcagcctcacgtcggtgagcctggaagtcagcgtagaggagcggcccgtcctgggtggcaccctgtggcgcgaggtcaaggctgatgagagcacctggtacatccaggtgggatgtcttgatggcccgtgccaggcgctctcggtgggagttgagggctttgcatag

SEQ ID NO: 6495 - DNA, 495 bp, Chlorella protothecoides
atggtgcactccaccgatatcgtagagctggagctgaacagcaagaagttcaagttgacggtgaagaagcgcgaggcgctggaggtcgcggagccgaccatccagtacctacctggccccggccacatgcaggctccgacccagcagcagcagtcctacgcacctccccctccccccgcggctgcagcgccggcgcctgctgccgcccccgccgcaccggccgcccctgccgcccctgcaccccccgcggccgtggatggcatcgaggttgtctcgcccatgacaggaaccttctaccagtcgccggcccccggggagccccacttctgcaaggtcggggacacagtgaagaagggacagaccgtgtgcatcattgaggccatgaagctcatgaatgagatcgaggcagaggtctctggcactgtggtcaagattgtcgcggagcacggcaagcccgtcacccccggctcggtgttgttcatcatcaagccatga

SEQ ID NO: 6496 - DNA, 981 bp, Chlorella protothecoides
atgctggactccgtgcttgtggcccggaacaagttcctcaagccaggcggcgccctgtacccctcccacgctcgcatgttcctggcgcccatcaccaccaaccagacgcagcgccgccaggcggagctggaggtggggtcgcagggcatggaaccgttgcttcaaggccatgggtcccgtacgctgcccctgtccccttgctcccccgccatccccccacttttccacctttccacgccacaggccgccgtggacggctggtccgacttcgtgcgggaggtcaagcagtactacgacgtcgacatgtcctgcctcaccgaggcctaccaggaggagcaggccgattacttctcgcgcacagcggcctgggcggacgtgcacccctcccaggccctgggcccccctgcctgcctgaagtcgtacgacctgctcatgctgaccttggaggagctgaaggcggacctgcaggccagcttcaagctgcgcctcctccagcccggccccgtggaggcgctggcgggatactttgatgtccagttcaggggcagccccgagaacccagcagactccccggtcaccctgaccaccgcgcccgaccccacaggtgtgcgcttgggggccagggggtgcatcagggagttcaaggggcgatgtcctttccccttgctcctgctgggtggctggcatccaatagtgttcttcatgcaccctggcattcaggcggatgagggtaccaccatcgagggcagcctgagcatgagccggcggagcgacaaccaccgcctgatggacgtcgtggtgaagcacaaggtgggcggggctgggcctgaggcatggaggtgccgggggttgccttgtgctgtcttgcagtggaacctggctgcaggggcaagggacgtcaacatgacaccaccctgcgcatccatgaagatgtcctgtcgggttgcgacccccgccggcctacatggcgccgatcaatga

SEQ ID NO: 6497 - DNA, 1584 bp, Chlorella protothecoides
atggcgtccgctgctccccttccccccaacagtgccgtcgctgccgcgcgcgaggcgttcgaccacggcccctggccccgcatgtccggccgcgcccgcggccgcatcatctacaagctggccgacctgatcgagcgcgacctggacatgctggccactgttgagtcgctggacaacggcaagcccctgtccgtcgccaaggccgccgacatcacgctgaccatcgaccacctgcgctactttgccggctgggccgacaagctggagggcaagaccatccccaccgacggcaaccactttgcctacaccctggtggagcccaagggcgtggtgggccagatcgtgccctggaacttccccgccctcatgatggcctggaagatcgcccccgccctggcctgcggtaacgccatcgtgctgaagccagcggagcagacccccatgtccgccctcatcatcggtgcgtggccgtcctggatggtgtggggtgtcgcggcggtgtcatttcgtggagtggtgcgaccatctggacccccttgtttgcacattcaccctcatggggagccctttcctcggttgaacatacaaggatgtgcacacatcctcagccccagcactctacccattctctctgccatgttccacttcctccgaccacatccccctcctcattccaactccacatcaacaggcaagcttgccctggaggccggcctccccccgggcgtgctcaacatcctgcccggctttggccccaccgcgggcgcccgcctgaccagccaccccgccgtcgacaaggtggccttcaccggctccaccgaggtggggcgcatcatcatgaagtcctgcgcagagcacatcaaggacgtgaccctggagctgggtggcaagtctgccatgatcatcggccccaccaaggacatcgacaacgcggtggacatcgcgcactttgcccttttcttcaaccagggccaggtgtgcacggccgcctcccgcctcttcgtccacgagtcggtgtacgacgagttctgcgccaaggctgccgagtacgcgcgcaagcgcaaggtgggcgacccctttgaggccgagacggagcagggcccccagatcgacaacgagcagttcgagaagatcctgggctacatcgagtcggggaaggagcagggcgcgcgcctgttgaccggcggcgcccgcgtgggcaagaagggcttctacattcagccaaccgtcttcgccgacgtgaaggacgagatgaagatcgcgcgggaggagatcttcggccccgtccagtccatcctgaagtggagcaccactgaggaggtgctgcgccgcgccaacgcctccgagtacggcctggcggccggcattgtctgcgacgacatccacttggtcaacacgctgtcccgcggcctgcgcgccggcaccatctgggtgaacacctatcacgtgtacgaccacggcgtgccgtttggtggctacaagatgtccggggtggggcgcgacaagggctccgcagcgctggcccactacaccaacaccaaggctgtggtgcacaagctggagggcgagcaggcgtggctgtga

SEQ ID NO: 6498 - DNA, 690 bp, Chlorella protothecoides
atgactcgtccggtcgggaggcgtgctcggacctcatcccccaatcagccatgggggccccgcgcgcagcgcgcccagcgtgcgctccgaggcgctgcgcgcggcggccagccgccgctgcatcagcgccgccagcgcctggttcacgccgctctcctcgtgcgcgcccgcgtccaggcggtcgatcaccgcggcctggcggtccagctccggaccgtgctgcagcggctcgaaggagggctggcaacgcggcgaggcggaggccgcctccgcccgcgcggcgcgcgccagctcgtcgttgttcacgatgtcggcggcaaagtcaaactgaagctgtggggcacggtgaagctgaagatgaacgacccccgggtgtttgcccacatgctgaagcaggtgacgctcaccatcgatgacttcagcacccagggcctgagcaacatcgtgtgggcctgtgcggtgctgcgccaccgtgaccccgaattcctggcggccatcgagcggcggaccatggccctgctgaccgagatgaggacgcagtccatcgccaacatcgcctggtcgtgctccgtgctggagtacacgcccgtcaggctctgcgccgcgctttccaaggaggtcgtcagcaggcgcgtggtttggggatgggggatctcattcttgaagggagggtatggtgggcaggcgtga

SEQ ID NO: 6499 - DNA, 723 bp, Chlorella protothecoides
atggcctacaccgcctcggccatgtccctcatgctggccggcttccggaaacccatcgtgttcaccggcagccagctgccgctggccatgccgcgttcggacgcgcgccagaacctgatagactccctgacctgcgccacatccagcttcaacccgccgcatgtccacctccaggaggtggccctgtgcttcgggggcaagctgctgcgcggcaaccgcgcgcgcaaggtgcacagcaacgtgtacgaggcgttcgcctcgccgtcttaccccaacctggcgcgcatgggcgtggatgtcgagtggaacacgggagccatgctgcagcccgagggcgtgtaccgcccccgcctgcgcctcgaccccgccgtcctgcgcgtgccgatcgtccccggcgtcgacccccgcgtggcgtatggtgacctggtcgggcgcggagtgcggggcgtggtgctggagtcctttggagtgggcaacatgccctcctccgcctggctgccctggctgcgcgcgcagcgcaaggcgggtctcctggtgtccatggtgtcgcagtgcgcgggcggggcgctgcagccggagctgtacgcctctggctccgccgcgctggccctgggcgtggaggcggggccgcagatgacggcggagaccgcggcggtgaagatgatgctgtgcctgcagtacccggacctgccgctgggcgtgccgctggcgggggagatgtga

SEQ ID NO: 6500 - DNA, 1218 bp, Chlorella protothecoides
atgaaccccatccatcggctgtctgtcccaagacatatgacacacagccctcaaactcactccccaccccccgttcggcctcgtcgcgcgcaggacgacgcggagatcgccaagctgacggcgcgcatgaagtcgctgctgggcccctttgtcctgcgccggctgaagacggaggtgaagagccagctgacggagaaggcgcacaagagcgagttcatccccatggccccggagcagcaggcgctgtacgaggcggcggtggcggcctaccggcgccagctgtcggcacgtgccatcagcgccgacgcgggcgcggcggggatcgagaaatggtgcaagtcggtgggcgcgcgcaagatctcccacatcttctcccacctgcgcaagatcgcgcagcacccgctgctggtgcgccaccactacgacgatgcgcgggtggaggagattgcggcgctggcgcacgagcgccagctcttctccggcaacgccacgctgaaaaaggtgcaggcggagctggcagggtactccgactacgcgctgcacgtcttctgctacaacgccggccctgagttcgacgcgtaccgcctgtcctcggagcacctctggtcttcctccaagttccgcctgctcaggaccatgctgcccaagctgaaggccgcgggctcgcgccccctcatcttctcacagtggacctcggtgctggacgtcatggagtggctcatgagcgagctgcagctgccctacgtgcgcctagatgggtccacagccgtggaggagcgcctggccaccgtggacaagtgcgtgggggtgggtgtggggatgctgttgatcgggggagggaaggaacgggacgccaggctgggccctggatcctttggaaaggatcgggacgccaggctgggcccgggatcctttggtccggggggtcccaaccaggccacaggattcacggctccctggtctgcaggctggcgcgcaggcctatgggcccctcgccacaccgccattggacgcgatcaccccacaccacccacacgcgcgcgcacacactcacacatgcacaggttcaatgggagcgaggaggtgttcgcattcctcctctccacgcgggcagggggccagggcctgaatctgactggtgcggacacggtcatcctgcacgactccgacttcaacccccagacagaccgtcaggcagaggaccgctgccacaggtga

SEQ ID NO: 6501 - DNA, 537 bp, Chlorella protothecoides
atgtccctggggtacgccgagaagctctcctttaaggaggacgtcgggggcagcttgggcgcaccggaggttttcgatactgcgaccgaacttgcccagagcatagagaaactcatccagctcgtgagtggacccaatcctgcacgacagggaactgccctgtcgatgattcattgggtgtcggaggcaaggagcatcatcgccttcacaggggctgggatcagcaccagcacgggcatcccggacttcaggggtccaaacggtgtctggacggcgcagaagttgggaagggccctcccaaaagccacagttgaatttgccaatgctgcgccatcgctgacacatcaggctctgctggccttgcatggcaccggcaaacttaagtaccttgtcagtcagaatgtggatggcctgcaccgacggagtgggttccctgccgcggccttggcggagctgcatggcaactgctttctggagcgctgcagcacatgtggagcaaccttcactcgtgactttgaggtcgaaacggtgagttga

SEQ ID NO: 6502 - DNA, 381 bp, Chlorella protothecoides
atgctcctctaccgccagcgcatcggcggcgccatcctggcggacgagatggggctgggcaagacggcacaggtcatctcctacctgggtgccatccgcagcctggacggcgacgccgggccgcacctggtcatcgtcaccgcgtcgctgctggagaactggcagcgcgagtttgcgcgctggtgcccgggtatgcgcgtggtaccctactacggcaagcaccgcaagatcgtgcgggcccgcctgaatacactcaggtgccaggaaggaagggagggggggggaaggttgagggatttcggtgtgatgggtggggggtcccgaggaaggggtccggcagggcctggttgcctgttgggaggtgcccgaggcctcgtgtga

SEQ ID NO: 6503 - DNA, 1215 bp, Chlorella protothecoides
  modified_base (691)..(700): a, c, t, g, unknown or other
gggggggggaggaggccgccttgccttgcatgggccctgggcagccagaccccttctctgcacctccctggcaaaccccagcagaacctacccccttgttcccaaccccacccacttccacaccgaaacccaggaccgcatcatcggcgcgcacttcttctcccccgcccacatcatgccgctgctggagatcgtgcgctccgacgtcacctccccccaggtgatcctggacacgctggactacggatcgcgcatccagaagacgcccgtggtggtgggcaactgcacagggtttgcggtcaaccgcgtcttcttcccatactccatggccgcggccatgctggtggactcggggctggacccgtaccgcgtggatgccgccgtcgccgcctttggcatgcccatggggcccttccgcctcggcgacctcgtcggcttggacgtcagcctgttcgtgggcaagtcctacctggaggccttcccggagcgcatctaccgctccgccctggtcccgctgctcaacgaggcggggcgcctgggcgagaaggccaagaaggggtggggggggtccccaggatttggggctatgaatcgtggtggggtggaagagggagcctaggagggagcgggtttgctggaccctttgcacgatgcgatcctcgccctcaccaccacaaccctgccaaacacnnnnnnnnnnaagtcgcgcaaggtgcgggggttgtttggggggcgctggagtgggggggaggcaggagttgggactatggatcttggtggggtgaaagagggagcctaggagggagcgggtcggggctgtctgggaatgccgcttttgcggccaagctgagcgaccaggacatcgccgagttcgtcttcttcccggtcatcaatgaagcatgccgtgtcgtcgcagaaggtgcggggctggagtgtgtaaactggggtcccaccctgactcaccccctggatgttcccttctccatttcgcccacctcaaccccacacttgtctgcaggcatcgtggacaagcccgcggatctggacgtcgccaccgtcatgtccatgggcttcccagcctaccggggcggagttgtcttttacggcgacatcgtcggcgcaggtttgtacgggacgatggaggggaaagagtgtttgggagtgtgctggtggtattgtacagggatggcctctctgtctttagatgctccatga

SEQ ID NO: 6504 - DNA, 387 bp, Chlorella protothecoides
  modified_base (355)..(364): a, c, t, g, unknown or other
atgacctcctcggcagctgacacccacctccatcctaaccatgcctgccccattctccgcactcatcaggttggagagttttttgagactgtgggcatcgatgcggtgttgctggttcagcacgccggcctcaatcccatggtgcgcctacagagtggtgcctggacacctgtcctgacttgctcaaggatcacacttggggttgccgctcattggttgccgctcattgtacctgttgcaccccgcacgagggcctgccctgccgaccgctgcattcccgccaggacaggcacccctgctatcgtatgtgatggtggccgctacggccgggctccacggccgcatctgccctccnnnnnnnnnnggcacccctgctatcgtatgtga

SEQ ID NO: 6505 - DNA, 1092 bp, Chlorella protothecoides
atgctgtcctctgctaccccccctttctccccttcgagtagagggatgtactcaggatttgatccctccctccacacttggatgtcatgtaatcggcctcatgcggagaatgtgcccctggaggaaagattgagaggcgcagtccggcaaatcgaccgcaatctcggtcgggttgggagccgcaatggcacccgttctgccggtataacagggccctggggtgggtgggttgcacacccaagcctttcgctggatgattggcttcgtcaagggcttgaccagcggggcttccttcaaagggttgatcggcggccatggcacgccccactccctaatgaggaggtcactagccatgacggcccgcccaagtgggcagtgctgccgcctcgcgtgcaccaaggcatcaggggtggggctgggagaggcacagctgcctacccagacaggcaccaggagatgggcgctgggctccctggcacactggcaccgctccaggctgctctcagacgccatggtggctggaagagcgtcgtgcagggaccatgtcaccatgcaagccagcccaaagtccccacagccagtgtccaagccacttggtaccccgctgccggtcccctgctgcacgcgtgtttgtgcttaaaaggacccccctgccctgcatccatcgcacaggaggttgaggagtactggagctccatactggagggcgtggagaagccggccgccaggaagctggtgaagctgctggaccccaggcagcccatgggactgccggcgcccaaggtggaagaaagcaacgccaaacgctccgggccggggaaagtccccctgctcaggtttttcctggcgaccaaggccaagtaccccatgcatgtgctccttgtgcgggtgtgtgcagcgggggagtggtggattggatggtggggttgcaggagcagggttggctggaggttccagtgggatcagcgacatgtgagggggaccattcctgaaatgcaggtctctgtgtttgggaaaggctatgcaggtggctggggcttcgcgtgcccgccggagatagaggctgagagccagcggtttgagttcgcctga

SEQ ID NO: 6506 - DNA, 321 bp, Chlorella protothecoides
atggccgccttcatccgcaagaacgaggacttccggggcaaggtcaaggccgacaggctgccagcggtgcacacagcggtcatgaatgcaggactgagggtggaaaaggagctgcgggccatctacgagccactcctggaagcctcggtcagggcgggtgacccagtaaaactgcgacccatgctgcgcctggatgaacacaacaatgccgtctggctgaggctccctcgggcctgctctgcactccacctggcagacgagctggggctctggcaccccaaggatcgcatgggaaaggtgcagaagttgttggagtcttga

SEQ ID NO: 6507 - DNA, 1359 bp, Chlorella protothecoides
atgctgtccatgatggcggcggcgctggagggccacgtgcgcgaggcctcccgccgcggctggcagctgcccacccttgcctacggccccgacgccgcggtgcgcgcccgcgccggggacgcgggcctcgcgcccaaccccctccccccggccccgctgagcgtgcgcgatatgtggccctactggctgcagccgcgcggcgccggcgcctccgccgcggtgtttaactcctttgacatggcgggtctcttcctgctcaccggccccaacatggcgggcaagtccacgctgctgcgctccaccgcggccgtcgcgctgctgggcgcctgcgggctggccgtccccgcgcgcgcggcgcgcctgccctacctggacgccttcatgctgcgcaacttcagcgccgactcgccgctggaggggcgcagctccttcgccgtggagatgaccgagatgcggtacgtgctggaggacgcctcgccccactccctcgtcctcgtggacgagctggggaagggcaccgaggcacgcgccggcgccgccctggccggcgcgctgctggaaagcctggacgccacgggctgccgcggcgtgtttgccacgcacctgcacccgctgctggagctgccgctgcgcctgcgcgccacgtgccgcatgcgcatggccacgtgcactgatgccagcggggcgcgccggcccacgctgcgcatggtgccggggtcgagcaccgagtcgctggcgctggaggtggccagggcgcagcgcctgcccgcgcgcgtgctggaaagggcggctgccctctacgccgacgtccaggccttgcacgccgcgccggagggcgggagggggagattggacgacgacgacgacgaggccgcgggccggagtggtgacgctgcggtggccgcaggacggggcattgccacagacctgactgaaacacggggtctcgagcccgccagcgcccctgccactctgaagctgaggtcgctggcagaggccggggagctgctggcacagactgctagcagggtgctggagcagctgggggctcctggtgcggccagcgctggccgatcccccgtgccagccatcgacgctccgtctccgcccgaatccccgggccccaccccggcgccgacgctcagccccctcgccgtcgtcagagcgggccagaccccgcccccgaggacagtcggcctgtcctgcgtctacatcgtcaggcgcaccgacggctggttttatgtcggtgaggagcggagtctctggcggtatgctctgcaaccatgcctgcatcgggccgccatgatggctatgcgttgcgacgatcttatgccctccccccccgggcccgacccctaa

SEQ ID NO: 6508 - DNA, 1509 bp, Chlorella protothecoides
  modified_base (497)..(506): a, c, t, g, unknown or other
  modified_base (923)..(932): a, c, t, g, unknown or other
  modified_base (1041)..(1050): a, c, t, g, unknown or other
  modified_base (1359)..(1368): a, c, t, g, unknown or other
atgcctcgctccctcgacgcagactcgttcatctccatcgtccaaaacaagacgcgggtgttgatcctcgccttcttcatcatctaccagctcttcttctggagctggggttccctctactacctgctggtccgattcaagccgggctgcatctacggcgccgacagcttcgtggaggcctgggtgtttgccgtggtgacgcagatgactataggtgcgcgggtgcatggatcttgctgtggtataggagtctttcccaccgggggggagggggggcagtcaagacagcctgctgggggacgtacagagcctggtggcttatggaacgaggcacgggcgctaccagcgctcaggaagctcacagagacgtttacacataggagccatcaccgagcccctttccctgcctggcaccctccatcttttcctgatgccttcccaattttacctcagtccatctccccacctcgtcgattcccgcctgtgtgtcgctcgcnnnnnnnnnnctttcctgatgccttcccaactttacctcagtccgtctccccaactcgtcgattcccgcctgtgtgtcgctcgcccagccattcactcatgcccaacctccacccacctgaccgcccattccccccctcgcgcaggatatggcaatacgggtcctcagaactgctggcccgtctccgtcatgattgtggtccagggcatcctctcggtcctcctcggcgccatggtcgttggcatcatgtttgcgcgcatctcgcacccgcactaccgcggccgctccatctacatgagcgaccgcgcgtccatagccaggcgggacggcaccctgaagctcatgttccgcatcgccgacatccgacgcacacaggtctgtgggtgtggcgacgaggggttgctggggcatcgggttggtaccctcnnnnnnnnnnccgggggaagggatctttctccaagatcggtgtcttcagggttgctgcaagtcatggggccaggcgctctcagccgccgttgtccctggagcgctctcgagcgggcgcnnnnnnnnnnttatacacctggggctccggccgggtgacagccgagggcgagaagattccaggtgggggccgggacgtgcgcagtcgggggaagggatccttcgctgagattggtgtcttcagggttgctgcaagtcgattctgcatggggccaggtgctctcagccgctgttgtccctggagcgctctcgagcgggcgcacggctgctgcttggggcggcgtgctcacctgaacccagatggttccccatcccatgcaatacacacccaaacgcccccatgcctccgtgcagtacgttgcgaggcgctggacatcggnnnnnnnnnnacggcgtgctcacctgaacctagatggttccccatcccatacaatacacacccaaacgtacccatgcctccatgcagtacgttgcgaggcgctggacatcggatatatcgacggcatgctgctgctgcccctcatcattga

SEQ ID NO: 6509 - DNA, 1311 bp, Chlorella protothecoides
atgggtgacggcataggccgagcactggccggcgaagccgggtaccagcgcctgatccgcctggtaggccgcgccttctatgcgggggagtgtcccccccccgtcgccatcgacccagatgccctcctgccccccaccgtgtcccgcttcagcaagttctccttcgcggggctgggggtgctgctgctggactacctggccacgcgcgcggacgggtactgcgacgaggtcacggtgtgcgaggacacgcgtctgtcccagaagcaggtccgccgcgccctcaagtacctggaggatgcgggcctggtgcgctgcgacgtggtcaagtacagcctggccagggacaaggagccgtccgacgacccagaggtcgccgcgcggcggcgcgtggagacccacgccttctgggcggtggactacccgcgcgtgaaggatgcgctgcgcctgcgcctcgccctcatgcgcgaggcactgcgcaagcaggtgtgtgtgcgccgggttgggcaggcgcctgcgtgggtcgggcgggcacgctgcgtggaggaagaggtgaatcggaggcctggctgcagttgcagtccctacccaaggatgagggccggcggcagcgtgataccctcctgtgtgacccgctgttgggctggccttgccgcctcggcgtcccctctgcaaagcccccctcgccgtgccactgcaggccgaagacacagacgtactacagcagtacatctgtccgcgctgcggcgcgcaggcctcctcgctggacgccgtgcggctgctggacccgagaacggtgagcgcgaggaatggggggaagggggttggggagggggcaatggtgtatcgaagcgatgttcgagtggaggagtccgccttgacatgcccagggaatggagcggcacgttcttgtgcgaggagtgtggcgccgagctggagcagcgggcggccggcgactctcaggccggcggccctgggggatctgcagccgggaacaaagcgcggcaggcggcggccaaggcgctgcaggcggcgttcgagcggcagctggccccgctcatagagcagctggagaggataaaggacgcggaccccccggaccccggcagtctgcaggtgagcacgcggcggggcgatcggatgttgaagggcaggggtgtggaggcggccagcattctttcaaacaggggtgcaggaggcgggtacgagaggatctttggcccccaaggaccggcaccacatgccactgcggaggcgcactgccttgtcttcccctccttcctccccgtcccagctgtttcatcaggttcctga

SEQ ID NO: 6510 - DNA, 1119 bp, Chlorella protothecoides
atgatactgcagcgtgctagagcatgcaactctgcacgagctgttcggatgtttcaagagtggaacgtgctagagcgtgcgactctgcacgagctgttccgatgtttcaacagtggaactgacaggcagccgcggggcctgcccagcccagcatcacccggagaccttctgccgtcctttttccccggaatctcacgccatcccccccttctcttcaacactcaccttgtgcacatcctccatgacgtacttgcccgagggcttgaggtcggcgaggaagggcgtgcggtccgacacggcctggaagtcatcaagggtgagggtgatgccgcaggccgcagccatggcgacgaggtgcagcacggcgttggtgctgccgcccagggccatgaccaggaccatggcgttctcgaaggcggcgcgggtcatgatgtcgcgcggcttgatgtcacggcgcagcaggtccagcaccacgccgcccgccatgcggcactccaaccgcttcagcgggtcctcggcgggggtggaggaggagtggggaagcgtcatgcccagcgcctcgatggcgcaggccatggtgttggcggtgtacatgccgccgcaggcgccggcgccggggcaggcgtggcgcaccacgtcggcacggccgtcctcgctcagcaggcccgcggtgaaggcaccgtaggactggaaggcggagactatgtccagcgtggcgccgtcggcggcggcgtgcccggggcggatggtccccccgtacaccatgagcgtggggcggttgagccgtgcggcggccatgatggtcccgggcatgttcttgtcgcagccggggaggcaaacgttggcgtcgtaccactgcgcgcgcatcaccgtctcgatgctgtcggcgatgaggtcgcgcgactgcagcgagtacgacatgccgtcggtgcccatggagatgccgtccgacacgccaatggtgttgaagcggtagcccaccaggcccgccgcctccacgcccgccttcacctccgccgccaggtcgttcaggtgcatgttgcacgggttgccctcgtaccacatgctggagatgcccacctaacgatcagggcagggaggggggttcagcgcttctag

SEQ ID NO: 6511 - DNA, 873 bp, Chlorella protothecoides
atgtggtacgagggcaacccgtgcaacatgcacctgaacgacctggcggcggaggtgaaggcgggcgtggaggcggcgggcctggtgggctaccgcttcaacaccattggcgtgtcggacggcatctccatgggcaccgacggcatgtcgtactcgctgcagtcgcgcgacctcatcgccgacagcatcgagacggtgatgcgcgcgcagtggtacgacgccaacgtttgcctccccggctgcgacaagaacatgcccgggaccatcatggccgccgcacggctcaaccgccccacgctcatggtgtacggggggaccatccgccccgggcacgccgccgccgacggcgccacgctggacatagtctccgccttccagtcctacggtgccttcaccgcgggcctgctgagcgaggacggccgtgccgacgtggtgcgccacgcctgccccggcgccggcgcctgcggcggcatgtacaccgccaacaccatggcctgcgccatcgaggcgctgggcatgacgcttccccactcctcctccacccccgccgaggacccgctgaagcggttggagtgccgcatggcgggcggcgtggtgctggacctgctgcgccgtgacatcaagccgcgcgacatcatgacccgcgccgccttcgagaacgccatggtcctggtcatggccctgggcggcagcaccaacgccgtgctgcacctcgtcgccatggctgcggcctgcggcatcaccctcacccttgatgacttccaggccgtgtcggaccgcacgcccttcctcgccgacctcaagccctcgggcaagtacgtcatggaggatgtgcacaaggtgagtgttgaagagaagggggggatggcgtga

SEQ ID NO: 6512 - DNA, 756 bp, Chlorella protothecoides
  modified_base (127)..(136): a, c, t, g, unknown or other
  modified_base (546)..(667): a, c, t, g, unknown or other
atgccacccgcagtccttcatctgtcgtggcctgaacttgttcctacatgtgcgtctgcctgggcgccggccaagcattggaatgttggaagtgacggcgacctgtcgagtcccgcacagatcagannnnnnnnnnccatgccacccgcagtccttcatctgtcggggcatgagcttgttcctacatgtgcgtctgcctgggcggcggccaagcatcggaatgttggaagtgatggcgacctggcgcagcctgccatctgccaattcaatgtgctcatgctgggcaaggcctttgtgctggcggggctgctggacagcgagggcctgcaggaagtggtggacagcttcacggtggccctctccggcgccttctccgacgcgatgcggcgcaagctgggcctgcgcgactttgaccccggcctgtacggcgacctcatggcgctgatgatccaggacaagccggactttaccaacacctggcgcgccctatcgagcgtcgcgccgggggacggggcggagggcctgaccccggccctcgccgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgggacgttggcgtggcaggggctgagaggggcccgggcggtgaaggaggggagctggggggcgctggagaaggctgctggacctga

SEQ ID NO: 6513 - DNA, 480 bp, Chlorella protothecoides
  modified_base (90)..(99): a, c, t, g, unknown or other
  modified_base (186)..(195): a, c, t, g, unknown or other
atgccaccctcattttcaccctcccctccccagcttcccgtccctccccttcccgccccacccttcttacacaggagcgggtggaggctnnnnnnnnnntctgggcgaagacctggcacaggtgccgtgtgtgggtgtggaggggtgttatatagtgaacggcctcgtgatgttttacgagctgcnnnnnnnnnntggagtgcgtgggcggccaagtaccgtgccgtgctggccggccaggacctgcccgccgccgagcgccgcgcgatgcaagacgctgccaacccggcgctgatcccgcgtaaccacgtgatggtgagcctgatcgccgaggtggagagcgggaacacgcagggcctggaggcgtacctggaggcgttggcgcgaccgtatgaggatgggctgggggaatccgcctggaaggtgcccgcgccccgacaaatccgcaagggcatcgagctcctgtcctgctcctcctga

SEQ ID NO: 6514 - DNA, 753 bp, Chlorella protothecoides
atgacggccacggctcagacggagcccgccccggcagacgtcaagggccgcagcctggacaacctgaaattcgacaacaggttcaccgaggacctacccgcggatgagaagaagctcaaccgtttgcgcgaggtggaggacgcggtgtacacctgggtggaccccacccccaccgacacggagccacacactctggcggcatcacaggaggtggcccggttgatcggcctggacttgggcgagctccagcgcccagagttcgcagccatcttcagcggaaacgcgccccttccgggggcaaagccctatgcgcagtgctatggcgggcaccagtttgggtactgggcgggccaggtgcgagggtgctcggcgcatctgcgagggctctcaggggtggagccggggcctggtgtcgccctgggcttgggagaggtttcgacgacagggcatctcatgagcacagaagaaagggatgtgagaacgtcagcagagggagctgacgtcgttgcaggattgggagatgggcgcgcgatctgcctgggcgaggtcgtgaacgaggcaggcaagcactgggagctgcagctcaagggtgccgggaagacacccttttcgcgcatggccgacgggcgggcggtcctgcgctcctcgctccgtgagtacgttgcctccgaggccatggcggcgctgggggttcccaccacgcgcgcgctgagcctggtcgcgactggtgccggcatctacagagacatgtag

SEQ ID NO: 6515 - DNA, 825 bp, Chlorella protothecoides
atggtgtcagggcaccatgactcccctcacctcacatgcacagtggtcatcgcggcgaccaacaggaagagcgacctggacccggcgctgctcagccgcttcaccaccagcgtctactttggcctgcccacggaggccgacaggcgagatgaggggctgggtggtggggtacttggactgaggttcgaccatcggtgtgaaaccttgcatgggcgtgggttgcgcacgccgtgcagcggcgggcagcgtcttgtgctggatgtgtggataggcagttgtcctcatgcgcgtagctgcgcgtcctgcctgaccagcgacgccagctggggctccactgccgaccccgctgccgccccactcacacattcacgctgcagggcccacatcctggagcagtatgcgaagcacttgaccccagaagagctagcagagctggccggcgggacgctcggactggcggggcgggacctgagggacgtctgcgagcaggcagagcggcgctgggcctccaaggtgttgtcggggcggtcggcaggggaagggctgcggtctcgcgtgatgtctgtggctcacgggggggcggcctggcggggaagggctgcggtctcgtgtgatgtctgtggctcacggaggggcggcctggcgattgccatgcctgcgccgcgtcgccaacttaaaacgaagacccagcgtccgacgttcttccccgcacaggtcattcgaaaggaggcagacagtagcagcctgcccccgctgcaggagtatgtgcaggcagcacagcagcggttggcggagaagaccacagagccggcctggcttttgtga

SEQ ID NO: 6516 - DNA, 870 bp, Chlorella protothecoides
  modified_base (632)..(641): a, c, t, g, unknown or other
  modified_base (730)..(739): a, c, t, g, unknown or other
atgctgtcgcggggggtgcgggagctggcccggcggtggctcccagccctggaggccacccctgccacggccggtctgcacacagaggctgcgcagatttacagcgagcgactcgccagtccaggggcaggctctggaccaactgctgacaccggcacgatctgcgtggtgcatggcctgctgggggttggccggaacctggccaccctcacccgcaccctgctggcccgggccgagcagcagtccggcaggccctggcaagccgtcctcctggaccagcggtgtcacgggaggtcgggtcacctgggcttgcctcctccgcacatcctggctgcctcggcagaggacatcctgaggctgtttcgcagcggactagagtatgcagatgcccctgatgtcctcatcggccactctcttggagggaaagtgtgcctggaactgacagcccagatgtcgcggctgggcaagcctccttcccaggcaagacatggcaatggggcgctgacctccatgctgagaggaaggcggcgggttctggatggtcgggtgcaccgcacatcagtctccactattgtcgtcgcatctgccaattctcatccacccgtcttctatcctcgagtcacaatcccatnnnnnnnnnntggatggtcgggtgcaccgcacatcagtcttcaggattcgtttggggagctgagggacacggagcgagtgctggacgccgtcgccgccnnnnnnnnnnccccagcccctgcccagccgggaggccttgtaccagcgattgggggagcagggcttcagcgaaggactgcagcagtggctgggcagcaacctgcgccagcgtggcaaggggcagtacgtgtggcagtttga

SEQ ID NO: 6517 - DNA, 1431 bp, Chlorella protothecoides
  modified_base (339)..(348): a, c, t, g, unknown or other
  modified_base (556)..(565): a, c, t, g, unknown or other
  modified_base (763)..(806): a, c, t, g, unknown or other
atgcgcgggcgcgagacggggctgggcaacctgctggcagacgccatgcgcgtggccatgggctgccaggtcgcgttcttcaacgggggcaccgtgcgctccgaccaggtcagcagaggggcgggggttgtcttggaggtggggttgtttgtgttttttgattgcggggaaggggtttcaggggggagtggatctgaggatatgggtcaaggacctctccaccgtcacccccgcgatgccagacgccttgcatcctcaggctccctagacagccggtgccagccccatgcatacgccgcctctcccccatccacccaaccccccctccccccctccgcnnnnnnnnnngtgtcttggaggtggggttgtttgtgttttgagtgcggggaaggggtttcaggggggagtgggtctgaggatatgggtcaaggacctctccaccgtcacgcctgcgatgccagacgccttgcattctcaggctccctagacagctggtgccagccccatggatacaccgcctctccctcatccacctacccaccccctccccccctcnnnnnnnnnnctgacacccaaggtgcacgccgcggggcagctgacgacgcgggacgtggtcaccatgcttcccttcaccgacgagctggtggcggtggagctgacgggcgccgacctgctgcgcgtcctggagactggcgtgggcgcctggcccgagccggagggccggttcctgcaggtgtcgggcctgcgcttcgccttcgacccnnnnnnnnnnnnnnnnnnnnnnnnnnnnnnnnnnnnnnnnnnnnaggcctgcgcttcgccttcgacccggcgcgcccgcccggcacgcgggtcgacgccgcctccgtgcacgtgggcggcgcggcgctcgaccccgctcggcgctactccgcggtgaccaaggcgtacctgcgcgacggccgcgacggctttgcatgcatgcgcgccgcgcggccgctgcgcgtggagctcaacgcgcccagcctggccaccctggtgcgccacctcttcttccgcatccaggccctgaatgagggcctggcgaggggggagggggggaagggtgccagcgcggcggcggcgggaaagcgtggcgacctcgtgggagcacgacaaggagtcagtgcagggccgcagcacggcacacggacctcgggcgacgtgggcagcggcggcgggccacgagcgcccgcagcgggcgctgcacacgtcgccgacccagcagacagccccccttccgaaccagtcagcccgacggggtggtcgccggaggtgctgatgcagccgtacgaggcagggctggagaagctgtactgcttcgaccccggcacggggaagtggggcgtgcgcccaaaggtggaggggcgcatccgctgtgtccccggctgcctgccggagcctggagtgtga

SEQ ID NO: 6518 - DNA, 2571 bp, Chlorella protothecoides
  modified_base (518)..(527): a, c, t, g, unknown or other
  modified_base (1593)..(1602): a, c, t, g, unknown or other
  modified_base (1819)..(1828): a, c, t, g, unknown or other
  modified_base (2142)..(2151): a, c, t, g, unknown or other
atgggtgacggctgcgccaacctgcctccgcccagccgggctgcccccgccctggctgccgcctgcccccggccccttagaaaatcaagtctgtttgggaccattcctctgaacaacatgcagtcaagcaaggtaggaggccagcgcggcgcgcacgtccccgccatgctcccgcaggcgcagctcggcagccttcttgtccacctcaaactcccgcaccagaacctccacgtccgaggcctgaatcttgaccgccgacagcgtcttttccctccagcagaccctatagccccacaagccaaagccgcacagcacatcctacctgagccgggcggcttcatgcttcacacgctgctgctgagcaagctctgccatggctgcctgaatcttggactggtccacattcttcacctcccgctcctcgacctggcgaaggggacggggaactgggtcatgggtttgtcagtgaagagcggggcacagggtgggcgagtggcacagaagcggcaactgtgctnnnnnnnnnntgtcagtgaagagcggggcacagggtgggcaagaggcacagaagcggcaactgtgcctgcctctcaacctccagtagcaccacccagagtcgtatttcaggacacacaagcacacttagaggctcgtccgccatggcgccggtggaccgcgatggcgagggccaaaacggccggtgtggcttatgctttattattgatgggtccactgagcctatatccaatgattagcgaagcatcgtcgagtataccgttgcgacgctcgtccctgggtggaattgctgggccaggcacattggctttcagtactcgaccattgctgcttacaaaatgcctgcatagaagggcgccgtccatgcatgacctccccccctttcccgtgcagtcctcgaggccgtggctcacccccttccagggtcgccaatgcagccgtgcggcgcagcgcggcaccctcgtgatcacggcctccaaggccgtgacgcacaagaagcaggtcatcctgctcaaggacgtgcggggcctgggcaagcagggcgagctctgcgaggcccctgtcggctacgtccgcaactacctcatcccgcaacgccaggcctcccccgcctcccctgccatcctggccaggctgcagtctgagagggacgcggaggcaaagcgggcgcaggaggtgctgggcaaggcgcgggccctggccctggccctgagcaccatcggcaagtttgtgatcaggaagaaagtgggcacctcaggccagctcttcggctccgtcaccaccgccgacgtggtggccgtgatcgagcagcagacagggcggagcctggacaagagggccgtgaacctgcctgagatagctgccctggggagctacccggtctccatccggctgcacccaggtgagagggaagggggggggtgtaatagtggtgcaatgttatccactggggcacgatgcaaggatgatcgtgtgtcacttggaggggcatggcagtttcacatgtcttgggaggctttgcgttgcaaatatcccagcgatgtcttgtgccatcatgcacagaacctcatgctcttnnnnnnnnnngatgatcaacctcatgctctcccactcccatcgtgccccagatgtggtaggggagttccaacttgtgatccagaaggacacctcggcttgacgcacagtcccttccgctgctgcattgctgccccatccagggaggagtgctccatcagtgccgtcgatgcatggcctgtgtcccgctgcgctcattgtatgtctgtaacactgtcggcaccacacnnnnnnnnnnccatccagggaggagtgctccatcagtgccctcgacgcatggcctgtgtcccgctgcgctcactgtatgtctgtaacactgtcggcacctcagaagcggtctcagatgcagcagtgatgatgcaacgctcctcaatcgcagcgatgcactcagcaacgctctttcctgcttgcatggctttcgtgagtgcggcatgggcagcggcatgccgcctcagcagcacgacatcgttgatggccgaccatcgcacctgcgcaatggaagagaccgagcgcattggtgacgccgtcgtgcgacccctcaaacccccctannnnnnnnnngcaatggaagagaccgagcgcattggtgacaccgtcatgcgacccctcaaccccccttcctccctcagcttggcactgaattctgcacaccgccactttgtttacctggtcatcagccttggcctggttgaagttgatccgccgcagcagcgagtccagctgggcaatgtcggccagcccgccctcggaccggccgtagaccacggtctcagcgcacacgccggccagacccaggcaggtgaaggcatcgagactgttggaggacagcttcccgctggctacctctcgctggaagtcgccatcacagaactcggtccccgcctggacacccagccggccctgcctgcagaggacttgggggatgcgcatgcgcctgaggtgccctcaagggtgcaaagtctgctgcttgctgcgcagtga

SEQ ID NO: 6519 - DNA, 3645 bp, Chlorella protothecoides
  modified_base (1957)..(1966): a, c, t, g, unknown or other
  modified_base (3445)..(3454): a, c, t, g, unknown or other
atggaccccggtcgcagggcgcgcggagcgctcggcgtcgtcggagaagtcgcgctccagcaccgccgcggcgcccatgcccgacccaatgcacatggagatgacgccgaagcgtgcggccttgccgcggcgctgcatctcgttgatcagcgtggcggcctggcgcgcgccggtgcagcccagggggtgccccaacgcgatggcgccgccgttggggttcacgcgctccaggtccaggcccagcttcttcaccgtgtacagggcctggctggcaaaggcctcgttgatctcaaacacgtccacgtcatccaggcccagccccgcgcggcgcacggcctcagggatggcagccacggggccgatgcccatgatggcggggggcacgcccacagccgcaaaggagcggaagatggcgaggacggggaggccgcggcgccgcgcctcgcgccgcgtcatcatgagcaccgccgccgcgccgtcggtggtctggctgctggacccggcggtggtggagccgcccttcttgaaagccggcttcagcgccgccagtgtggccagcgtgacctcgggccggatgccgtcgtcctcggagatggtcacgcgccgctcctccccgtttgcatccttgagcaccgtctccacgggcacgatctcgttcttgaacttgcccgccgcgcgcgcggcggccgccagccggtgcgaccgcagcgcaaaggcgtcctgctccgcgcgggtcatgccgaactgggccgacacgttctcgctggtgatgcccatggggatgaggcagtcggcggcctcctggcaggtggccacacgagggttcacagtgccctcccagttcatggggttgctggtcatgtgctccacgccgccggcgatggccatcgtgtagtacccggccttgatggaggcggccaccgaggccatggcctgcaggccggacgagcactgcctgcgacgaggacaggccaggcttgcatggtcattgcaccgatcaagggtcgccaccatgcccggcaccaacattgggcagtcccccagctctccagaaactcacctgttcagggtgtggacagggacggtgtgggggaagccggcgaagagcatggccatgcgcagctcgttagcgcgctggctggaggggcccatgacggagccgaacacgatgtcgcccaccgcctcgggctcgatgccggtgcggcgcagggtgtccttcagcaccgcggcgatcaggtcgtccacgggggtgtccttgaaaccgccccgcctggcgcggcacagggccgtgcggcaggtggagacgatgaccacgtcgtccaggtcgcccgcacggcggtcgtgggactcggcggaggtgggctgaggggccacctcgggcgtgccgtgagcctgggaggggagggcgtggtgactggggtgagatcggggtgcacacgaccacggggagggcttcagacacaccgagatcgtgggacaggaagcatatcacaccgcccacgtaccgatgccagctcccgtccttgctttcagggttatacttccctgtcggaactttgcataagcgttgcagtcacgcctgcggtccgagtcagccggtgtccccgaaacttttcccgcgcgggatcacctccatctccgatcacgcatcttaggcgtggtggtgatccccccgacggcaaactgaggttgcctcagccacttatctgcgacagtccgcttgctactaccactcctttagagcatcaggtgtgggccttacgcttcttgcgatgtattgtgtgcatgcgacccatgtgccgtgaggaggagctgatacccatattctcccaccgcagacccatattctatatccacagctccgctcaggagcgcaccccgcccggcgacccctcctcagcctcacaggaccacatttggcctgaacagtggggtccaggcacccgcttgctggcgnnnnnnnnnncagagcatcaggtgtgggcctcacgcttcttgcgatgtatcgtgtgcatgcgacccatgtgcggtgaggagagcttatacccatattctcacaccgcagacccatattctgtatccagagctccgctcaggagcgcaccccgcctggcgacgccccctcggcctcacaggaccacatttggcctgagcagtggggtccaggcacccgcttgctggcgtcgccgctgcgtgactgcagcagcctcaggcatggcatccctcacgatcgagcgtgtcccttgcctgtcggataactatggtaaggctgtgtgcgccatgctgcacatccctacctccccagttgcaagcgccttgagttccagactctcgcactcccctgccccacagcttggctcctgcatgagccggccagcaacgtggtcgccatcgtggacccctcagagtccaagcctgtggtggctgccctggagaggaggtctgcagagtatgatggggtcgtcctgctttctcatgccatcccttcctgtgcagccttcgatgccccagggtgccgcctcatctcctgcccgcctgttccacccgccatcgtctgtcatcggccgcctgtcacacagtcacacactcccacgcgcccccccgcccagcggtctcaagctgacgcacatcctgaacacccaccaccattgggaccacacggggggtaacgaggagctcaaggcgcggttcggcgccacagtcatcggccccgccgcggaccgggaccgcatcccgggcattgacgtcgcgctgcgggacggggagcggtacagcctgggggccgcggagttcctgaccctggataccccgggccacacccgcgggcacgtgacctactacttccccggtgccaaggccatgttctccggggacaccctcttctccctgggctgcggccgcttcttcgagggcacccccgcccagatgcaggcgagcctggacaagctgcggggcctgccccaggacacctgcgtcttctgcgggcatgagtataccgccggcaacgccaggttcgccgtgagcgtggacccagacaacgagttcctgcgggaatggaaggggcgcatcgacgccgcgcgcgccaagatctggggcatgcgtggctgggcagcctggtctgagcggcctgcccaccgtgcccagcctgctcgaggacgagctggaggccaaccccttcctgcgcccaaacagccccgcgatccgcaagtctctgggcatccccgcgagtgccagctcggcagaggccctgggcgcgattcgcgccgccaaggacaaggcctgagcgggtgtgggtgcgccctggctgcccacaagcctggcgtggactcgtgcgtgcaggattgttgtccgtgtgatcacccacgagtgcgaggtttgctggctgccggtgttcagcagcagatgttcacatgtgtgtgtggaggcagggattggacctcccccnnnnnnnnnncccgtgtgatcacccacgagcgcgaggtttgctggctgccagtgttcagcagcagatgttcacatgagtgtgtggaggcagggattggacctccccctgcccactgtagaagcgagaagaatgcagcgatggcagggacagtgctgaggaaggtgttgggtcatggtgaagtcagagtcgacgcagagtag

SEQ ID NO: 6520 - DNA, 846 bp, Chlorella protothecoides
  modified_base (86)..(95): a, c, t, g, unknown or other
atggggacctgcaccccggcagatcctcgtacaggagctgggctcatggtcaaaccatctgtttcccatcaacaacccccaagccnnnnnnnnnnccaggcgctgccagcatgtttgcagggctgtactgctattgcgggaggggggggaaacgaggcgggcgggggagaggggggaagggggtggcatcgtgttggtggtgttcaggcacccacagtcccatggggtgcaggtcacacatggggacctatcccccggcagatcctcatacaggagttgggctcatggtcaaaccttctgtttcccatcaacagccctccaaacccccacgccaccctccctccaggcgcgcacggtgggcggctggaccacatcctgagcaacctggggtgcctgtatcgttaccgccacctcaacctggtgctggtgggggaggggaacatcacacggctcgttccccgtggccggtccgtcgtgcgcccgcatgcagacctggagggtccggcctgcggcctggttcccctggccgggccagcacgggccagcacccaggggctcaagtgggacatgggtgagtctggggggtgggtgggtggtggagggggaggaggctgggtccagactgggccatggtttgagtatgtcccttcacgggcaaagagggagagcatgcaccgaacctgcctgtgccacccagcacggctgaccctccctgcctctcgatccacagatgacactgagatgaggatgggggggctgctgagcaccagcaacattcttgaagctgaggaggtggtggtggagtcggacagcgacctcatctggaccgtgcagtgcaaaggctga

SEQ ID NO: 6521 - DNA, 408 bp, Chlorella protothecoides
atgtcccggactcagaaaaacaaggccaccgagtatcacatgggccagctgaaggccaaactggccaagctccggaccatgctccaggagcccgccaaggggggtgcctccggggaggggttcgaggtccagaagtttggggatgggcgcgttgccctaatcggcttcccctcggtggggaagtccactctgctgacggagctgacaggaaccaaatcggaggctgcctcctatgagttcaccaccctcacctgcatcccgggcgtcatccactacaacgacgccaagatccagctgctggatctgccggggatcatcgaaggggcggcggagggcaaaggtgatgaagtgggggaggtggaagtgaggcatattggatgggtcatactttatggcgactgctcgtga

SEQ ID NO: 6522 - DNA, 330 bp, Chlorella protothecoides
atgatccgacgcacccttgaacatcctcccgccgcgcagcgcgaagcccctccaatccagtgtccttggcccaatccttgcacagactacactggcctcctgaccacgccgccaccggggaccacaatacacatggtgcgtgctctggagtcggatcgctggaccgaggagagcgtggagacgctgcggggcctggctgcggtgcctggcatggcagaccgaggtgtgctggagtaccacgagctcccagacgccgggcactgggtccatgtggacaacccccagggtctcctggacatgattgcgccctccttatcgaagaacctgtga

SEQ ID NO: 6523 - DNA, 384 bp, Chlorella protothecoides
atgcaggctacaggtctcgcgaggggccacctctccccgcttcatgctgtccccccatgccggcgccatggcatcatctgcaaggggtacgcccgcacccagacaccgctgctcgagtccttgaagcccctgaacagggctctggagtcgggcacgaacgatgaggccgtggctgctgcacaggagctgaaggagagcggggtgctgtgcttgtttggggaggggcgccaggtccccaagcgcccctacaccctggaggaggtccgtctcaacaggatcgaccccgccgccctcctgtcccccgtggatgccaccatgaatggcgtgcgcaccggtctccaggtacgcaagagcttgtgccgacatgtggagggcagctggtag

SEQ ID NO: 6524 - DNA, 399 bp, Chlorella protothecoides
atgcgcatcccccaagtcctctgcaggcagggccggctgggtgtccaggcggggaccgagttctgtgatggcgacttccagcgagaggtagccagcgggaagctgtcctccaacagtctcgatgccttcacctgcctgggtctggccggcgtgtgcgctgagaccgtggtctacggccggtccgagggcgggctggccgacattgcccagctggactcgctgctgcggcggatcaacttcaaccaggccaaggctgatgaccaggtgcgatggtcggccatcaacgatgtcgtgctgctgaggcggcatgccgctgcccatgccgcactcacgaaagccatgcaagcaggaaagagcgttgctgagtgcatcgctgcgattgaggctgctgaggcgtag

SEQ ID NO: 6525 - DNA, 261 bp, Chlorella protothecoides
atgcccaccttccacttccaccatgtgtccctggccaggctaaatcgcaagccgccagacatcttcttcaaaaagaagaaaacgggcgggatcgcgatcaactcgatgggtaccctgacccatctggacgagaagatggtctggcggatcctccaggagtatcggatacacaacgccgacttgctgttcaaggaggattccacggtagacgacctcatcgatgtcatcgagggcaatcggcgctacatcaaatgtgagtga

SEQ ID NO: 6526 - DNA, 447 bp, Chlorella protothecoides
atggagaaggccgctcagcgtcagaaggtcctgctgagccacctggcatcgccctccccgtggtcgtgtgcaccccgatctcaccccagtcaccacgccctcccctcccaggctcacggcacgcccgaggtggcccctcagcccacctccgccgagtcccacgaccgccgtgcgggcgacctggacgacgtggtcatcgtctccacctgccgcacggccctgtgccgcgccaggcggggcggtttcaaggacacccccgtggacgacctgatcgccgcggtgctgaaggacaccctgcgccgcaccggcatcgagcccgaggcggtgggcgacatcgtgttcggctccgtcatgggcccctccagccagcgcgctaacgagctgcgcatggccatgctcttcgccggcttcccccacaccgtccctgtccacaccctgaacaggtga

SEQ ID NO: 6527 - DNA, 1083 bp, Chlorella protothecoides
atgcgatgccatccattgaaccccacaacttccgccactcccagggtggggctgggccacacgctggaagacgaggatgtcgtgcagatcgtgaagaagaaggtgtcggacacggacgatgcgcggggacgcttcaagcagtctggagccgaggcatatgggcatcaggagaggcaccgtgctgtgatcccagcagaggactgtgcccgccggggacttcccctcgagccctcacactccaggctccggcaggcagccggggacacagcggatgcgcccctccacctttgggcgcacgccccacttccccgtgccggggtcgaagcagtacagcttctccagccctgcctcgtacggctgcatcagcacctccggcgaccaccccgtcgggctgactggttcggaaggggggctgtctgctgggtcggcgacgtgtgcagcgcccgctgcgggcgctcgtggcccgccgccgctgcccacgtcgcccgaggtccgtgtgccgtgctgcggccctgcactgactccttgtcgtgctcccacgaggtcgccacgctttcccgccgccgccgcgctggcacccttccccccctcccccctcgccaggccctcattcagggcctggatgcggaagaagaggtggcgcaccagggtggccaggctgggcgcgttgagctccacgcgcagcggccgcgcggcgcgcatgcatgcaaagccgtcgcggccgtcgcgcaggtacgccttggtcaccgcggagtagcgccgagcggggtcgagcgccgcgccgcccacgtgcacggaggcggcgtcgacccgcgtgccgggcgggcgcgccgggcccgacacctgcaggaaccggccctccggctcgggccaggcgcccacgccagtctccaggacgcgcagcaggtcggcgcccgtcagctccaccgccaccagctcgtcggtgaagggaagcatggtgaccacgtcccgcgtcgtcagctgccccgcggcgtggatgagggagaggcggtgtatccatggggctggcaccagctgtctagggagcctgagaatgcaaggcgtctggcatcgcaggcgtga

SEQ ID NO: 6528 - DNA, 363 bp, Chlorella protothecoides
atggagagggcagctggtagctgggcagcgccgagtagcagcccaatcgcccatgcattcccccttgcccaggctgctgcggccagcggtctcctggccctattatatggtggagcggtggatgtgtccggggctgcggtgctcgtgctgttgggggccaccctggcggtggcagaccaggtaggcaccggcggcggggtcgaggccctgctgctggactcggcggcgcggaaggtgagcggaagctatgcgtcccgcgtggccacacacgaggccggccacttcctggtggcctacctgctgggcctgctgccccgcagctacacattgtcgtcctgggacgcctttcaagcgtgcgtttag

SEQ ID NO: 6529 - DNA, 960 bp, Chlorella protothecoides
atggcctcggtggccgcctccatcaaggccgggtactacacgatggccatcgccggcggcgtggagcacatgaccagcaaccccatgaactgggagggcactgtgaaccctcgtgtggccacctgccaggaggccgccgactgcctcatccccatgggcatcaccagcgagaacgtgtcggcccagttcggcatgacccgcgcggagcaggacgcctttgcgctgcggtcgcaccggctggcggccgccgcgcgcgcggcgggcaagttcaagaacgagatcgtgcccgtggagacggtgctcaaggatgcaaacggggaggagcggcgcgtgaccatctccgaggacgacggcatccggcccgaggtcacgctggccacactggcggcgctgaagccggctttcaagaagggcggctccaccaccgccgggtccagcagccagaccaccgacggcgcggcggcggtgctcatgatgacgcggcgcgaggcgcggcgccgcggcctccccgtcctcgccatcttccgctcctttgcggctgtgggcgtgccccccgccatcatgggcatcggccccgtggctgccatccctgaggccgtgcgccgcgcggggctgggcctggatgacgtggacgtgtttgagatcaacgaggcctttgccagccaggccctgtacacggtgaagaagctgggcctggacctggagcgcgtgaaccccaacggcggcgccatcgcgttggggcaccccctgggctgcaccggcgcgcgccaggccgccacgctgatcaacgagatgcagcgccgcggcaaggccgcacgcttcggcgtcatctccatgtgcattgggtcgggcatgggcgccgcggcggtgctggagcgcgacttctccgacgacgccgagcgctccgcgcgccctgcgaccggggtccatgccgggctctcccgccagtttgccggctga

SEQ ID NO: 6530 - DNA, 501 bp, Chlorella protothecoides
atgccacgtaaactttgcactcttgcgggcacgtcccatcacggctgtgaagtggctgatgcctgcccctcccaaccaatcccccaggtggcgggcaagacgttcacccctttggcggaggcccccgcggcggtcaaggccatgaacggcgggaagagcgagctgcacctgcagacgcgcgggtccaagttcgtgcggtaccaggagtgcaaggtgcaggagctgccggaggaggtgccgcagggctccacgccacgcacgctgaccgtgcagctgcgggatgcgctgacgaggcgcgtgaaggccggcgacgcggtcaccgtgtcaggcatcttcctgcctgagccgtacgcgggcccgcgctccgccatgcgcgccaccctactcaccgccacctacgtccaggccatggccgtcacccagaacaagcagagctaccaggtcggtgatgtatgggggacacggagggggaggggcgctgcagtctccaggaccccgtga

SEQ ID NO: 6531 - DNA, 1260 bp, Chlorella protothecoides
  modified_base (1045)..(1054): a, c, t, g, unknown or other
atggcggggggcgaggcccacaagaagcccagcgtcgcggccagtgtgctggcgcagcgctcggtgaggcccggccaggcgaagacgaagcggaaagcaacagtgagctacaagaaccagatacgatcagtggagcggctcctctcaaaggtgccaccccgaccctcctctcctccccaacctccaatgcagttcgaggtggaccccaaactgcgcgcgcggcaggagaagaagctggaggagctgcgggccgcggccgcggctcactcccgtgaggagctggagcgcaagtacgcggtgcgctatcacaaggtcaagttcttcgagcgtgtgaagctggagcggcgcctgcgccagctggaacagcagctggcggccgctggcggggcgggcgaggccgccacagcgctgaccgcccagctggagcaggcccgccgggacctgcagtacgtgctgcactttcccaagggcgagaagtacgtgtcggtgctgaaggacccggagacggaagcggacgcggcccgtgtgcaggcggagcgcgcgcgccttcgggcgctggtggccgccgacctcgcgcgcgccgcgctggtcggcgaggcggacgagggccgcagcctggcggcgaccctgaaacatatgcagggcgccggggcggggcggggcgcggcgcccacgccgacagagctgcccgcggagctggccgccgccgcgtccggcagcgagggcgagggggacgacttcttcctggacgaggcggtggaccccgagctgagcgcgcctggcaggggagtggcggcggagccggcgcggcgccaacccccggccctcctggggcccctgcccaaggaaaaggagaagcggcgggggcgggagagggtaaccctgccggcgaggggcgccgaagcttccacccgcgatggccggggcagcggggcaaagagtcccgccgttacaagagtacccgggccctcacccaagatgaacgaaaagcaaggcaagccggccctcccaagcaggcctgcggcactgcggttgcgaataccgnnnnnnnnnnaaatgaaaagcaaggcaagccggcactcccaaggaggcctgcggcactgcggttgcgaataccggccgagcacaccgcaccggcgccccagcagcgcgcggcccccaagcgcccccctgtgcccgtcgctgtggagcccctgcggacgcgggcagagggcggcaggaaacggcggaagaagtctgcttgactggctgtgtgactga

SEQ ID NO: 6532 - DNA, 507 bp, Chlorella protothecoides
atggcgtcgctcgtgtgggaccagtgcgtagtcgtgaccagcgatgcacgcctccccatgttggctcggcactgtcgctgccatggcgtcgctcatgtgggaccggtgcagtgccccaagatcccactccgtcccaccaccccgcaccgcagtttcctgctccagctcagcctgcttgatcttgaatgcagcgcgtacagcgcctccctccttggggcctccgccctgagcgttgccctccgcttcttcggcaagcccgcctggcctctgagcatgcagcagtacgctgtgtaccgcgcggacgagttggagccgtgtgccgctcgcctcgccttcctccagtcctcctgtgtgagtgaatgtgtgatgcgtggggagggtggctgggttcagggtcacgacctccgggaggcagggcctgctcaggattgcagagcgacccacagcatacacttccgatgggaggatcccaaggccggtcagcttgcagacttgcaaccaccctga

SEQ ID NO: 6533 - DNA, 1326 bp, Chlorella protothecoides
atgaccagcccgttcctccaagcctgcttcttcccctcccatccctaccccccccaccccccttcctccacttccccttccctcccacacctgctccacggagtctgcaaagcgcaggcgcgccagcgcctgcgacaggcgcaggatggagagcagggtgcgtgccgtggtgtaggtgtgcgggatctcggcggccgcctcctcgctgccattgcggtgtggacgcacccctcggggcgacaggggccagcttcacactgtcacactgtcagcagcagcagtcgcaccacaggagccccagctccttcaccagcatgctcctccccctcctcccgcccccacgccatgggcagcaactcgcctcctcatctcggcgtacacggcggccaggtagtcggtgaggcccgcggggaccacgggctcgtggctcttggcggcggcgatgtaggcgcggagcaggggcgcgggcagtggggcggggcccgtggtcgcggggggcgcgccctcccggtgcacggtcagcacgtgctgcgccagggccaggtcggcgtccagccccggccggtcgaggatgagccagaggacgtcgaagcgggagagcagggccgcggggaggttgatgttctccgccggcgagcggcgcacgtcgtagcggccaaaggccgggttggcggcggccagcagcgtggtgcgcgtgttcagcgtggtggcgatgcccgccttggcgatggacacgctctgctgctccatgacctcgtggatggcggtgcggtcgccctcctccatcttgtcgaactcgtcgatgcagcagatgccgcggtcggccatgaccagcgcgccgccctccagcaccatctcgccggtggtggggtcgcgcatgaccgccgcggtcaggcccacgccggaggagcccttgcccgtggtgtacaccgcacgcgggctgacgtggcagacatagcgcaggagctgggacttggccaccccggggtcgcccatcaggcaggcgtgcacgtcgccgcgcagcttcatgccgtcgggcagctggcggctgacgccgcccaccatgcacagcagcagcacgcgcttcacgtcctcgtggccccagatctcgggcgcgatgctggaggccaggcgcccgtacacgtcgccctccgccgtcagcgcctcgatcgcggcccgcgtctccccgtccagccgcatgtcctggggtggttgtttggggatgggggactgtgtttgcggggtggcgccgagggggagagggggcgtgcttcatcacggggtcctggagactgcagtgcccctccccctccgtgtcccccataa

SEQ ID NO: 6534 - DNA, 312 bp, Chlorella protothecoides
atgccgctgccgcccggcatacatgacctcgcacaatctacgcgcatccctgctcttcagcaccgcgcgttggtgctgacctttgttgtccagtggtccagtgccagatgctcatactcctgccaactgctcctccaacattcgctgcccctctcacaggctgtgatggctcttatcaacgacacgaccaaggtcgcccccaaccccaagatgttcctgcgcactttctggtaccgtgccatcttcaagggcgtcgcccgcgccgacgacatgcacgtctacattctagcgaggtatgtggaggctctttga

SEQ ID NO: 6535 - DNA, 348 bp, Chlorella protothecoides
atggggggccacggcgcgctcatcatggccctgaagaacccggggtcgtttaggtctgtcagcgcatttgcgcccattgtgaacccttctgcagtaccctggggccagaaggctttcaaggggtaccttggggacgacaaggaagcttgggcacagtatgatgccacggagctggtgaaggactactctgggcgcaagcaggccatcctcatcgatcagggaactggggacgatttcctgaacaagcagctgcagccagaggttttccaggaggctgctggtgataagctggcgctcgagttgcggatgcaggagggctacgatcactcgtattataccattgcgtaa

SEQ ID NO: 6536 - DNA, 381 bp, Chlorella protothecoides
atgcctctggtgccggagaagttgcgggcccggcaggaggtccgggctgccctgggcagccagttctggggccaggaagcggcctcgccccggtccatcgatggcaagaccgtcctcaacccatgcgaacccgtgcccctggggctcatggccccctctggcctctcccgcacccagcagctgctcgctgcccaggccctaggcatcctggccctgccctcctacctgggcgatcgtggtggactggtgggtctgggtgtggggtgtagtttcgaatcgatgaggacaatgttgccctcgcctcacgcttgggttgtgtgggcacaaccccaggcacctgtagcaggttgtgagcacagggcatggctccccctggcctga

SEQ ID NO: 6537 - DNA, 1302 bp, Chlorella protothecoides
atggaggcccgagacctgcggccgatgcagcgtcggctggacgccgcgctgcagggcgccgcgccgcccgccccgtcgcccggggacgagggggcggcggcccggggcacgctgcacatggcgctgccggggcacgaactgaccgccagcctgacgtccggccaggaggtggtggatgccaccggggtcgcgtgtgtcgtgccactcaccgcctccctggacctctcctccgccttggaccggggggacggcatgcagtaccgcatcggcctccaccaggcgctggcccctgctgacagcgacggcagcggcccgctccgtagcacgcagcatgtgcagggcgcagtggccgtggagggcgaggcgtacttgtggcgcgccggaccccgaggggggaggaaggagcgcgcgggcgccgcgtcggacgcgggtggcgtgatcggccctgaggcgagcacctccacgggcatggaatgttcgtccagagcagaagatgtggtgcaggttcttgaggttgaccctccaagaccagtttcagagtccacacattcctctgcgagtggcccggccggagactttgcgggagaagtcgcaaagggcctggatgttgcacagcccgcattgaattcagttgccgagccggccgctcccatggtcgcggtaaacgcaggtggcccgcagtctccgggcgctcccgtcccccttgaggcctttatcatctccaagcagggattagagcctgaggcgaccacagccccctcaaacagttcccccgcgcccaggcccagccccctggacgcgctcaacgcccaggtcctgtctgcgctgggcacgctgcgacgtgcacagtctgcgctggccgacctccgcgccggcggcgccgaggcctgggacctggacgccttgggccgaggcacgggcgcgggccggcgggcaggggaggcgccacacagcctgctgacgccgggcccccacctcaagctaaacggcgccataggctgcctaggaagggtgcccctccccggcagcaccggcctgccgctgtcacgcagccgaggccagcaggtgggcgaggctgcggccgcgccggcggcgggccagccaggctggcgagcctcctcggccagcctggcatctgcgcgaggcggggacgcatgggagccctacctcaggtctgtcccgtggtggcctggaattggtgcggacctagctcatgcgcagtgcagagggaagtgcaggcgacgctgcagcaggcttggcgctgtgtggaaaggccctgcgtcaaaagcttgggcgcaatag

SEQ ID NO: 6538 - DNA, 237 bp, Chlorella protothecoides
atggctctccctggcctgacctggcacgtacacactcctcccctgccgcagatcctcgacagggtgctggccaggatcgggggccggacgtggtgggccacgctgggctccaggatgcacgcccagcgcgccttccgccagggggcggccctggacgggccagccatgctgcgtcccctgaaagacccccagaactacgccgcctgcctgcgcctccactcccagatcgcacggtga

SEQ ID NO: 6539 - DNA, 447 bp, Chlorella protothecoides
atgaattcgaatgaattgaatgcgctggtgcacatgcagagaggtgtagatcctgcctctgcagagcagtatgggcacccaccatccccaaacatcctcccgcgcacaccacagcaagccatcgtgaatcgcgagcgcgccactctggaggtggacctggatgacgtggcttcctacgtcaaggacggcgacctggtgcaccgaatggagaccaacacccagcagtacctgtccctgctggcctctgctgccgacgaggccatgcctgcccccaccaggtccgacctcccagacgacatcttcgacatcctgctcgaccaggttttgagacggggatggagagaggggattatttggaggggaaggggccctggcggtgggcgtcaatgcccctgtgcacttcctgccggggcagtctgcgctgacgttgagctcacgaggaggtag

SEQ ID NO: 6540 - DNA, 393 bp, Chlorella protothecoides
atggaggtcgacggccgcacggggcagtcggaccccaactttgcgctccccgccgcgctgacgaggcgcttcgaggtctgcatccggccacgctccaccacggagcacgcccgcctgcgccaggtgggcgccgcccagatcgggcacctggtcacctttcgcggcatcgtgacgcaggtcaccgacgtcaggccactgctcaccatcgccacctacctggatgaccagaccgggttcgagatctaccaggaggggatcggtgctgggcgtttgcggtggctgggagggaagcggtcgtgggagggcagtggtcgtgggagggcactgacagtgcgagggcaggcgcagggtggacgggatcatcatggcctaccttgctgcggggaggggtag

SEQ ID NO: 6541 - DNA, 864 bp, Chlorella protothecoides
  modified_base (173)..(182): a, c, t, g, unknown or other
atgcgactccagacccatgctcagacagctgcgtggcctggccgccctgtatttgctgctggggaggagcctgagcagcatcgccctggagctggtgcggcacatcaggcaggcaggcggcatgctcaagagcctgtcccttggcgggcgcctggtgtaccgtggcgtcgagnnnnnnnnnncggcaggctggcggcgtgctcaagagcctgtccctcggcgggcgcctggtgtaccgtggcgtcgagatcaagcgctggcacggcctggcggcagcctacctcgcctacaaggcagcccaggcgctgcagggtatcatcaagtacctggcgcagacggggcagaggagaacgctgcggcgccgcatgcgcagcgcgtcgtcgtatgagtactcaagctctccccctgccatcatggcttcgcagggagtggcaggggctggcgagggagtgggatagattgacgggagccaaggcgaagccgtgcctgacagcctgcgaggcagccgagctccgggagctgtccgggaagctgcgggaagcccgcctggcaggcgatctcaccgccctcaggttcacgctgcgcatggacctgaagcggcggagtgggtacgaggccgtccagagatcgatgtactttcctgacccgtgccccatccctgcgcattctgacaggctcctggacaccggcatccagtgcatcacgctgcctgccgaggtggaggagtacctgagcgaagccatccaggcgctgcagcacatcgtgggcacgcctggtgagacgaagggatgctttggtggagatcatgcggcagagtgctcctgcctggatttcctagcaggcctgagatctggcacaggatga

SEQ ID NO: 6542 - DNA, 1386 bp, Chlorella protothecoides
  modified_base (587)..(596): a, c, t, g, unknown or other
atggtggacgctactgagaatgccttgcgttcctctctgtttcatatgcctttgtcgactgcatctgtttcctcttgccgcgcactgattgcgcgggacgctgctagtcctgtagtgacctttctgaacaccgggacaggggctgggggccctgtccggggggctgggggccctgtccggggtcgaggaaacccgtcccaacctcccgacgcgaaccgacttgggctggagacgtgcggcgctccacctcccagtgacgcaagcactgcttccacggggcagttggtggccatggccgtcgaggagtacgtcccgcgcagcatcctcatcaccggcggagctgggtttattgccagtcatgtaaccatcaagctcgtaaagcgctaccctcatgtcaagcatcggtggggcccctccaaccacccctccgcatctattcgccccacaggtggttgtcctggacaagctcgactactgcgcgacgctggagaacttgaagtccatccgggactgccccaacttcaagttcgtgaagggagagatccagtccacggacctgatcgtgcacattctggagaccgaggagnnnnnnnnnncgacaccgtcatgcactttgccgcccagacccatgtggacaactccttcgggaacagcctggcgttcaccatgaacaacacgaatggatatggtgacgtgatgcatgctcccctgtacgcacaaagcctgtgctcacaatcagcaccctctccctcatgctttggcagctatggcacccatgtcctgctcgagtccgcccgcctgtacggcaagatccgccgcttcctcaacgtctctaccgatgaggtctacggcgagacctcgctggggaaggccgagggcctgagcgaggcctctgccctggagcccaccaacccctactcggcggccaaggccggtgccgagatgatggcgcgcgcttaccacacctcctacaagcttcccgtcatcgtcactcggggaaacaacgtgtacgggccccaccagttcccggagaagatgatccccaagttcattctgagggctcagcgtggcgagaaactgcccatccacggcgacggcatgtcggtgcggtcctacctgtacgtggaggacgtcgcggaggcctacatcatcgtcatgctgaagggcacggtgcgttgtgggtgggtgcgtgggagcaccgtctcagtggtcatgtgcctgccgaccaccacctggacccaaggcacggtgcgttgtgggaaggatgggtgggagcgccgtctcagtggtatgtgcctgccgaccaccacctggaccctagtagagacatgtgctgatgtttcaaagggtggtttgcgagtgcgtggttccctttttggtgcatga

SEQ ID NO: 6543 - DNA, 1362 bp, Chlorella protothecoides
atgatcaccccgccctaccccgcgctcgctcccagatacgacgactcctccagtcgctacgccggggggtccagctacggcggcggtggctacggtggtggcggtggctacggcggtggcggtggctacggcggaggcggtggcttcggcgggggtggcttcggcgggggccgtggccgggacgacatcaacttcacctccctgccccagcaggacttccgggacgtccccgccctggagaagaacttctactacgagcaccccgacgtgacggcgcgcagcgacggcgaggtggagcgttaccgcgcggagcgcgacatccacgtcggcggcgagggcgtgcccaagcctgtgaccaccttcgaggaggcctccttccccgagtacgtgttgcacgaggtggccaaggccgggttcaaggagcccacccccatccaggcccagggctggcccatggcgctgctgggccgcgacctgattggcatcgcggagacggggtcgggcaagaccctggcctacctgctccccgcggtggtgcacatcaacgcgcagccccacctgtcccccggcgacggccccattgtgctggcactggcgcccacgcgtgagctggcggtgcagatccagagcgagtgcctcaagttcggcagctcctcgcgcatcaagagcacctgcgtgtacggcggcgcgcccaagggcccacagggcaatgacctgcggcgcggggtggagatcgtgattgccacccccggccgcctcatcgacttcctggaggggcggaccactaacctgcgccgcgtgacctacctggtgctggacgaggcggaccgcatgctggacatggggttcgagccccagatcaggaagattctcggccagatccggcccgaccgccagaccctgctctggtccgccacctggcccaaggagatccaggccctggcctccgagttcctgaccaagccctaccaggtgaccattgggtccagcgacctcaaggccaaccacaagatcgagcaggccttcgacttcgtgtcagagcacgagaagctgccgcgcctgctacgcctgctggagcgcgagatggacggccgccgcgtcatcgtcttctgcgagaccaagcgcggctgcgacgcggtcacgcgccagctgcgccaggacgggttccccgccctctccatccacggagacaagacgcagcaggagcgcgactgggtgcttgccgagttcaagaatggcaagcaccccatcatgctcgccaccgacgttgcggcgcgaggcctgggtgaggaagcaggggggggcggagtgtatacgcatgcaccgaccccgtacgctggcggggtgcggctgcggctgtag

SEQ ID NO: 6544 - DNA, 1692 bp, Chlorella protothecoides
atgccgggtgccagcgctgtcccaccctttaccttcttctacccccctctactcttgattcctgcagcattggtacaccggggtaaggtatcgttcttccgcgagctgcggcacgcctacggccgcactgccctggtcctgtctggcggcggctccttcggcttcttccactatggcgtgatcaaagtgctgctgaatgcgggcatcttgccgcgcatcgtggcggggagcagcgccggtgcactgggcgcgggcatcctcgcctcgcgccccgtggcccagctcgcggcgctggtcaacatgttccccggcgatctggacatgaacctgctgtccaacaacaccacgccccacatcctgcgccacctggtggtcaagggtgaggctggtgtgggtgtcgcgctgaggagggagccggtggcacggcgggccgcgagcacactcgtcagagggatcccccttgctgtgcgcaccaggctcctcctcctgcacccctcccctcccatcctcacacgccgcttccgctggcgtgctctgccggatgggcgtcgacccattcctccagacctgattcccgctcaccaccccatcccacccctcacccctccaggcacggcacaggacggctcggtgttcgtggagcgactgaagcgcctgtacggcgccgacctgacctttgccgacgcgtacgccgtctcaggccgcatcctgaacgtgtcggtgtgcgcggccgacacgcgcgagcccccccgtgtgctcaactacctgtcggcgcccagcgtgctggtctggagcgcggtggcctgctcctccgccttcccctggctcttcgcgccgcgcgagctgctggcccgcgacccacacggcgccaccgtccccctgggcgcggtggggggcgggggcggcgcggcgctgccgcgccgctggcgcgacggcagcctggagctggacctgcccatgcgcgagctgggcgagaccttcaacgtcaactactccatcgtcagccaggccaacccctggctgctgccggtgatcgccgcgcagcgcctgctccccgccggcctcggccgcgcgctggagaccgagttcaagcaccgctgcggccaggcgctgaccttcttcccccgctcccccctgctgaaaatggtgggccagccctggggcgggcacgtcacgctggccatgcccgccgccgcctttggtgcgggccaggccgcgcgcaacctcagccctgccgacatcgcgcgcgcggtgagggagggccagctccgcgcatggcgtgcgctgccggtcatgcatgccgcctgcgccgtggaggccgccatcgacgccgcgctggcgcagctgctcgcgcccagcgattcgcgggacggcgccgccacggcgcagcaccccctgccacgcaagatcccgcgcgcctcgctgccctcctggctgcacctccccgcgctgggcctgccgtcctccgcctcgctggagcatgagctgggcgcgcacgggtccctggccgcctccttggcctcgttagatgaggaggcgggggaggcgggcgggtcgccgctcgcagacgcggcgcccgacgctccgatgtcctatgcggcgggggatgtggccgccgcggagcacgtctggcgcgacctggcggagctctccacgcgctcccactccgcgctggactgcatcgcgccctga

SEQ ID NO: 6545 - DNA, 567 bp, Chlorella protothecoides
atgcgctcgctgctgaagaacatgtccattgacgaggtggatgcggtggccgcgctgagcgcgcgcgggtcgctggaccgctccggcctctggttcggcgcggggctgggcctgcaccccgccggctccaccatcaccgaggagagctccggcgcggcggagggcgcggcgcgcagcgccagcttcgaggccagcgtgtccgggtcggaggcggcggagccggcgctgcgcttcgccatcgaggacttcatgcccgagaccgcgctcgtcctgggcggcgacaagatgtttgtcacgggcagcgtgcgcagcgcggcgggtctctgggagcgccacgtccacctcaagtttggggaggaggaggtgcctgccgtcgtgctcaacgccaccgtgctcaagtgcaacgtgccgcgtgcccccacccccgggcgcgtgcgcctctgcgtcaccctgggcgacggcgtccccgtcagcaacaccgtggccttcacctaccgccacgtggaggcctggaacggggcgccggcgccgccggcgcccgccgctggcgcagacgtccacgcctga

SEQ ID NO: 6546 - DNA, 963 bp, Chlorella protothecoides
  modified_base (565)..(574): a, c, t, g, unknown or other
  modified_base (835)..(844): a, c, t, g, unknown or other
atggtgatggggcatggagaccacatggaatggcgccaccggcaacccatcggggcactgcatccggaatgcccatgcggtgtcgctgagtctcaggcccgcgtacgcccctccccttgccgctgcagggaggcgcaagctgcggggccgcctttccagttgcaggacccggggacaaacgtcctggggcccatggcctgcatccaggccctgcactggtcctttgcctccaggtcagcgtggccggggggtttggggggcaaacaggaaaggggaagaaggccgccggtggacggaggctccagggcgtggtgccgggggtgcgaccaaacgccccatcccgtgcctgcgcaggccgacggccgacgacgcgatgtggcgggacctgggcggcaacctgtctgggctggagcaggcgtccctggtgagccgctggaagggggggatggtggagtgggcccggcatggcgggcgggcatcatgcaggccatcatgcctcaactccgtgtgcatcaaaggccgcgggcgtgtggtcggccagggcgaagggccaccagcgcccggnnnnnnnnnnctatgcaggccatcatgcctcgactccgtgtgcatcaaaggccgcagggcgcggggccggccagggcaaagggccaccagcgcccggggccggccagggcgaaagggcacgagcgcctggggccggccagggcgaagggccaccagcgcccggggccggccagggcaaagggccaccagcgcccggggccggccagggcgaaggaccacgagcgcccagggccggccagcgcgaagggccaccagcgcccggggccggccnnnnnnnnnntgccatctccatccctgggcagcctgactgtggcccctccgcctgatcctcccgacctccccccgactcgcaggcgctgcagtccggcaccggctccgccgtgccatttgagaaagtaa

SEQ ID NO: 6547 - DNA, 1323 bp, Chlorella protothecoides
  modified_base (188)..(197): a, c, t, g, unknown or other
  modified_base (784)..(793): a, c, t, g, unknown or other
atgctgactcagctcctcgaggagggccccgactcctctcccttccttcctggggctctgagcgccgcagaggagtatgcagcgggtgtcaatggccgggttctcccccaggacgtcgagaaagtcaggtgggatcaatgccaggttgagagtgcttgctttgttctggacatcggtgctccgtccgnnnnnnnnnngtggcgacacggcagaacggattcacaagacggcatggttcctgatcttgcacgccctgcctgctgtgaatcttttcagctccgtcctccgcttcctgccctgctcacacagtgtgtgctgttcatcacgccacgtcacatccccaactttgccaggtacgtcctgaagaacctgatgagagattggtcagaggagggggcggcagagcgggccgcctcttatggacggatcatgcaggaggtccagtccatcgccagccgccaggcccctggccaggtcccactgtccatcctggtgcctggggctggactggggaggctgtgtgccaacctgtgctcggtgcgggatagggatgctgaggggtacggagtgttatcgcagcctgtgggtgctgtcagcgatcaacagccagcctgccgccatcatggtagcccttcacttcggaaagtatgccacctatgcagatgggccatcatgtgcgcgggatggcgggtctgcatgcatgcctggctggcggctcctgggtgcgttggccaaccaatacgccatcatatcccccacaaacctccctttgcacccaccgacnnnnnnnnnncatgcctggctggcggctcctgggtgcgtttgctaaccactacgccatcacatccccccaaaacctccctttgcacccaccgaaagtggacggtgcacccctggctccactctggctgcaaccacttcacgtcggcgagccagttgcgggggctggccatcccagacgttctgcccgaagacctgacaggtgctgggactagggggttgagggtgtggggactggggttcgtaatcgaacagaggggatgctgggcatgccaggcgggtgcagatagctctcttaaaaagcaacgagcatacctgtccttcctcctcccatacccctcctcgtcatcaccagcgcctggggaattgggcatggtggcgggcgactttgtggaggtctttgcgcgaccagagtaccaggccgtctttgacgtggtggccacctgcttcttcatagacactgcacataacgtcatcgactatctagagaccatcgtcgctgtgctgaaggcaaggatggcataccggctggccctgcattga

SEQ ID NO: 6548 - DNA, 969 bp, Chlorella protothecoides
  modified_base (169)..(206): a, c, t, g, unknown or other
  modified_base (686)..(695): a, c, t, g, unknown or other
  modified_base (947)..(956): a, c, t, g, unknown or other
atggcagtgtgtcggaccgagttcgtggtagagcatgcgcagcatccccagtccgttccgcctcttgaatcaggagatcacgtcgcacatttacacccgatcaaaatggtatataccattgtcgatcctgatgacagatctgcatgccctgctcggcaaggccatcccnnnnnnnnnnnnnnnnnnnnnnnnnnnnnnnnnnnnnnggggctcagctctcccttgcaatccattgtgagcatatttgcagaggcaaagtttcgagtactagataatgctggcaagcgtcaacgcaatccctggctccctccaccagaatgggagtcgcggctgcccactgaatgggtgttccaatacaccaggcacgaacggtcagccagtttcttaaaccccattcccatcttttgtcgtagggatgacatggccaatggtttcaggctgcactgctccttgcatgcggcgactggccgcatgtttgcccatgccagcgaggtattgcgagatggtaccctagtggcccacaacatccaggtccttggcctccagcttcagaaatacacggtggccggtcccactgtggaccggagctggcgaggtggggtcgaacgaggagggaggaagactggaggggagatgggtcacaccatctggtcctcccgcaaaacacgtgagccaatatccgactnnnnnnnnnngggagatgggtcacaccatctggtcctccctcaagacacgtacgccaatatccgacaggactcgctcagccctcctttctctcccttttctgttgactcagatatcgttcagaacgagagtgcactggtagacatggtgcggcagtacctcatccacccactcctggaccaggcggcactggcaccccaggactcttctctgcctgaaggtacctcaggtggagatacttcacagaccgatactggcgccannnnnnnnnncttctctgcctga

SEQ ID NO: 6549 - DNA, 501 bp, Chlorella protothecoides
atggaggatgcagatctcagggaggcatcggatgaagatgccaggcgaagagcctggctcttgcacctcgagtctgcagcgctggcagctatcgatgacgtggcaatgatcgatggggaggtgcccctcctcaagcatgcctcgtccctgccgacggcgccggggggggggcctgtgggtgtcgcagatcgccgccgcaccgagaaagcgggcgagctcttgcaaggactgcgtggggtggtccaaggcctgcagcatggtgcgctggagaccgggcttggtgagcgtcagcaggtgcgtgacaacgtgttcaagcccagtcacatcctgcccacgatgagcgttgagcagtttggggagctggaggcgcgggcggctgctcagcgtgcgcaacgtgaggaggaagcggcgagggagagggccagggcggaggctggccggcggtcagatgatgaggatgacgacgctgctgcaaagcaaaaggtactggtgtggaggtag

SEQ ID NO: 6550 - DNA, 1995 bp, Chlorella protothecoides
atgtcaagaggaaagcgcgccgcaccagcaaatcccgctggaccgcgtagtaccgctccttcaggtcctccatggatcgtcgcgcgccgccctcaaactgcgagagggggaaggaggttcacttgtgcaagggatcatccactcctgctcgcttgcctacaaggagtgaccagtctgatggaaaggcctctccagcacccagcagcgcccagccctgcacccaccgccctcttcccccgctccgcacacctcatagcggtcggctatgaccagccagcgaagatccagcgcctggacgacgtccagcaggtggtctgtctcctcccggctccaaccctcctgcttcgtgatcagggaggtccactcctcatcgtcgtaccgcagcactaccacctggcgatgccaatgagcagtggtggcgttggaggggagaaaagacaggagcaggtgcaacttgatggcgcatccattccccagccaaaccaaacagtgtgccactccgcccaggcccacctttttgttgtacttggcgaagctgtattcaccagggtccgcaggggcgactttgcctgcagcatcctgaaagcacttcacccagtgcttgagctggagaccgtctgcccggccagggttggcgaacggccgccactggaagacggcccgccctgtggaggagtgaggcgaaatatgtctgtattcgaggggagttccgttgcaaaaacagggcaatctgccactccaagggtgcctcgctgtcgacttgctccacccctcgtgcaagagcattcaacagagtgccaaaactgcctctttgcgcaggtcgcccgccaggtgggaggggtgcagcgggtgggaggcgctgagcagtgcaaacgcctccctgcagatgtccaggtgaaggagtattgggtgatcgttgtgggtatcgcctgctccctaccctgccctcctggccatcgtcgacgaaagcgccacgacacgagccagctcgggtgctcacctgctcatccccttgggcttgacaagcttcttttccttgaccttctccacccgctccgccacggcactggcggagcgcgacactccgaggatatctttgacatccatggcccgcgtgccaacggcagtgcttcggccgtgggctccctcccccctcctatcgctggcaaatcgagcactgctctccttccgctcgaacacccgctcaacgtctgctgcagcttaagaacattcttctggaggatatcccccgcattcggcgtgtctgaagtgaaggtcccatcgaaactgcagcacctgacggggcatcactatgccacttcaatcattcacgacatgatgccgtgttgtgcgcaggtagaagctgtaatgctgaggatgcagttctcacaagcacataccggaagatcagctcacccccaagagtggctcttcatataccagatgaggacttcctcaccactctgtatattgcaggaacttccaaacaagagggctgtcggattccttgtaccagaactgcttcaggactatttcgtcgatccgccccacttcaccatagtccccaacccaagcacaatgtccgagaccccaaagatggtgtacaagcagctgggaaagactggactcaaggtatatgtccttgggttttgtgagggctgccggtgctcaggtccactccggtcgacagggatcgcgtgtggagctcagggtgggttcctcacgatcttaacaggtttccgctctgagctacggagcctgggtttcttttggcgaccagctgggcctcgaggaggccaaggagctgctcaagacggcatacgatgcgggcatcaactacctgccatgccgcttgaaggtgcgcagcgggcagcgcctcacccggattgcatccccctcccccaggccgagatcttgatgggcaaggcgttcaaagaattgggctggaagcgtgaggacatcgtggtcgccaccaaggtattcccatggtggtga

SEQ ID NO: 6551 - DNA, 885 bp, Chlorella protothecoides
atggaggacctgaaggagcggtactacgcggtccagcgggatttgctggtgcggcgcgctttcctcttgacatgctgggacctggagatgctgcctgcatgctctggaagcctgcctgtcgggagggcgggcggtcccgagcccgtggcccacgagcccctggtgcggcacccttataatcgccagcacgaacaggaaaggaagaaggggcttgagctccttctggaccgcacgaaggagcagatcaaccgggccaaggcacacctgctctcggcgtgtgccccaagttatggcccgcctcacacagacacatggctcggccattcctgcttcgtcgctgcctcagtgctcgcatgccctcagcttcccccctcccctgcacaggaggaggccgagtcccgggtgcttgcggaggccgccgctatagaaagcgcgcgcaaggaggaggaggcggcccggagggcctctgcagagcatggtgcgtgtctgggcggtggggggtcctggcactatggtgacgaagggagtgttcagaggtcaccgcgagcgtcgatctgttcctcacttgccgatgctggcctgtggtctgcttgccgactgctcgcctcccgccatgcccggcaccccttcacccatgccctcctccgcaactcttcaggcggcagccctgggcccggcggcgttccccaggaggcagcaagcacggcggcggccgccggccccggccccgtgtccgccttctccaacgagccggagttgggcgtgccgccggtcttcgatgaatccggcaagcccgccgtgccccccaagcgcgccatcgtgcgcggcgccttctgccgagagctggcagagggcgttgccgcccgcctgcagcccgccaagtga

SEQ ID NO: 6552 - DNA, 237 bp, Chlorella protothecoides
atggcggagctcaaggtcacggagttcccgcgggcgcccacgcgggcggcctgcggggcctacatctcgctgcaggcggaggtgctggcgctgctggagctgaagcgccagctggcgaccaaccaggcgctggcggctgggaacaaacgccctgcggccaggatggagggcggggatgacggcacgccacgctccgacaagcgccagcgagtcgcccggaagtttgccgacgactga

SEQ ID NO: 6553 - DNA, 708 bp, Chlorella protothecoides
atggaagagctgtcggcaggtcaggcaaccacgctgcttcggaatgagcaggaggtcgacagggcaacggctgagatggaggagatggaggagactctccttgagtcactgcgggactcgataaggagcaaggcggctgcagctgcaggaggcggcgaggcagcgcagaagaagcgacggcggcgggaccctgacgatgacgacgacgaccagggtgggttggatccactgcggcccaccgctacccttcatgcagagtggtcggggaaagaggacggcttcatgtatgatcgaacgcagggcacccgcaagtctcgggccaaggctgcccgcggcgcccgctccggaccccaggctgcggacgcggccctggacgccgcctcgctgctggcacgcaaggcgctgctggagcaggaaaggacggcgctgcaggagcggctggacctggcgcggcgagacgaggcgagccgggccgcaggcggggcgggggttgttgcgaccagcgaggcgctgcctgagtccgcggaggctgccccggcgagcgggtccagtgaagcagtagtggacagcctggatgccttcatgacggaggtaggcagccgactggaaagcgagaaggtggaggtgctgacgcggcagctggctgaggtcgaggagcagctagaccagacgcagaagctcatccacattgccgatcccgaagggtga

SEQ ID NO: 6554 - DNA, 603 bp, Chlorella protothecoides
atgccgagcacgtttcctatgtacccttatatcggagcaggcactcatctaatgctaggccaatcacaacggtgcacggcacgggtactcgtgcgcctaaaccggtgctcgcagcaggcggggcacggacaccaccgcgcgacatgcatgcagccactaactggtcgagaggatacatgcgtggcccagcgtccaactctatcttgcgatcaatataatgacggtgcgtgttgtgtccctgctccccagcgccaccgagatcgtgaccaaggtgatcttggcgcaggggccggggccgacagtacagctcgtggggaagaggtggggaaaccggatcatggtctcggcgagtatgcactggcctcctcaccgccttgcagccacgagtgcgactacggccctacctccctggccggcctgccgatcctgacggctgccaggaccaagttcaccacatcagccgacgtggatgagcaggtgcgcacctccctggctgcaggagagagcctctactccgtggatagggacctcctccggagcctgaagcctgatgtcgttcttacccagacaccctgttcagtatctgcgctcgtgcctccgtga

SEQ ID NO: 6555 - DNA, 261 bp, Chlorella protothecoides
atgcagcgctttcctgagctgtccgtctccggcatcgatctgctgaacaagttgctgacctacgacccgtcgcagcgcatctctgcgcgcgcagccctgcgccaccccttcttctccgagcaccccctccccaaggcccaggagttcatgcccaccttcccatcaggtgcgattctgagcgacggggtgtggcttggagctcagagcccttttggggctaccccatggagatcactgatgatcgcaggggtggtctgctga

SEQ ID NO: 6556 - DNA, 2340 bp, Chlorella protothecoides
atgctatgcagtctgtcagcgaggtctcggagagcacttgggaaactgggatggtgtcgagggcgcgcgcgcggctcagcccgcatgcgaactcgaactcccactcgacagcgggcggggtctcacatacttggcccacgtccagaatcgaacggtgctgtggcccatcctgcgcagtcatcagccgatccaaggaggcgaaagaccatcccggccagtgtcatggccccggctgggacggggctcgtccccctgctcctggccggtctcgcctcgcgcctcgccctgctcatctgggccggctggcaggacacccacatggcggtcaagtacaccgacatcgattattttgtcatcacagatgctgcccaggcagtgctggcggggggatcgccctatgaccgggccacgttccggtacagccccctgttggcctggatggccctgccaaaccacctgctgcacccctccgccgccaaggtctgcttctgcgccgccgaccttggtgcagcctgtgcagatcagcggccaggcacagcagcctaccaccaacacccactcccttcaacccctgaccaggttgatggcacgccttctggaacgcaggcgtgctcccattgcctgggtcaaggcaggcttggcggtgtggctgttcagccccttcaccgtcgtgatctcgacccggggctcgggcgaggcgctggtgacgtgcatgctgctgggtatgctgtgcctgctcgacgccggcagacccctgctcgctgggctctgctacggcctggcggtgcactggcggctctaccccataatctatgcgctgcccttgctgcgaaacctggccatgcggcggggggcgcgcctgctgagcatccccggcattgtgtttggggcggcggccgcggcagccttcttgacactgggcggtcttgggtatcacctctacgggcactccttcctccaggagacctacctctaccaccttggaagggtggacccgcgccacaacttctcgcccttcttcctgccgacagtcactcagccgatattagccatggctccattgctatgtggatgcacggtattgtttggaagggtgtacataccgctcatgaccacttgcccccccccgccaacatcaatgagtgcaacccctgtcctcctcccttgctcagggtgtttggtgctgctcaggccctactcatcgcagtccttggctggctccacgcagcagacttgccctacgccatgctcctccagaccctggcattcgtgacttttaacaaggtggccagcatggcaatgatgtgcccacgctcgggtgagtgctaccaatgggtgggatgtcacgtggcattgttatctgtcctgaagttgggtacccagctagtgcactggtatagatcccgcccacttcttctacccattccctcacatgcagggccaattgctctgggcagcaggcatgtgttccgccgccatcgcccattggcttgcctgggcatacgctctggagttcctgggatggtcggtctttctacctgtctgggcggcggggctgggtgtgttgcttgccaagtcttggctgctggcctgcctgatgcgtgtcccgcagggacaggcatcagatggcttcctgctgacttgcggctgatggtgggtgggggatggactgcacggctgcccccctttcctcccgtcgtctgctccaaatgcgcgcatttcaggggagactgggcaaactcgaccgcccatggtcggcatatacatgcaacatccggcctccatgcgggaaccgaatcgtccctcacagcatcacagatcacccagcgcgaccttctacgatgcctggaagatgcaggggttgttcgcgtatcggagagctatcttgatgcgaacaacacccgatgggcagtatcgggacagctgaatgtggcccctgagattgcaggggctgctgtgtcccgcttccaaatggcccacctgcaagaggaaggctcgaatgccccagcaaggacagtgcacctcctccccgctggtaccggcaggcaaatggcactggtgaatcatgaacgagccgtgtgcatcatggtgcagccgctggcgcagggcctgacccccctgtcacgtctggagcggcggctgggtgactctgtgcccaccgtcgtgtcggcatgcagcatcattgggactgcagcagccaccgccagcgttttcggtgccggtttcctcctggatggtggtcctctcagctcagatactcttgcctccctctccaccgctggctggggagccttcgcagttgccctcatccttcgttctagcgggacagtctcacactga

SEQ ID NO: 6557 - DNA, 1470 bp, Chlorella protothecoides
atggatagccgccgagaaccgttgcaggccttggctggggtggtggcagggccctacggccctggcatggaccaggctcggaaactcggcctgagtgaggtggaggagctgtacgcctatgatggcgggcaagactcaggggtcgtggacaaggtgctcttcattcatcggggcatggaggcccctggttgtgagcatgcccctgcaccacttgagcaccaccctgctgccgccatccgcagttcagtcctcaccctctctttcctcaggtcctggcgctgctggaccgacacgcccccagagcggaccgtaggcagctgggcatcttcctggagctgctgcgctggaggctgggcaccctcctcctctgcgggcgggactgcatgcacggccggctgggcgctccccaggcctttgtggccctgtcccccgcccagcgcgaggccgcggtgctggcctgggtccgggccggcagcctctcccagatcaaggcgggtgttcctgggggagccagggtggcctcatcgagagcgggccggcctcgattcaggcaggagggcctgcattgttgcaagcagaactggaccctcctccacttggacacccaacccgcaggcctggaccggggtcaagaagctggtggccctgtgcctgatgtccaagctggaggcggatggcagcagccgggcaatgcgcgcgctggggttcccgatcagggacccgcgctcggacccggcccgcaccgagcgggctgggcgggccgaggcggggctggaggctgccatctgcgacgtggccagcttctccgcagcctctcccacagacgtcaccgcgctggccgcccgcctgcagtccctcggcctgcagcccgtcgacccggcccggtgcgccccgcccggcacgccggctgctctcctcgcgggcgctccgcacctggtcctcagcgctgacgtcgtggtggtggggtccggggccgggggcggcgtggcggcggcgcagctggccgccgccgggctgcgggtgctcgtggtggagaagggggcctgggtgccggtggacgccatgacacagcagggagggcggcgtgagggcgctgccgtccgggagctacatttcagaagctctgatccagaacccggcgtcgggtgccacctcctcaccaccccccatgcaaccgaatctcccatctttccacaggaggacgaggggtacagcgcgttgtacgaggccgggggtttcatgcaggacagccggggcgtgatgggggtgctggccggcgcgacccttggcggcggcaccagggtcaactggtgcgcctccttccgcacgccagagcacgtgcggcgggagtgggcggcggcgcacggcctgctgtgcttcacagacgcgacctacgagtcggcaatggacgccgtgtgcgagcgcctgggcgtgcggacgggtgggcaggatttcaggggtggagggggg

SEQ ID NO: 6558 - DNA, 138 bp, Chlorella protothecoides
atggatccacttgttgctgctgctagcgttgttgctgctggtcttgctgttggtcttgctgctgttggtcctggtattggacaaggaactgctgctggttatgcagtagaaggtattgctcgccaaccagaagcagaa

SEQ ID NO: 6559 - DNA, 1257 bp, Chlorella protothecoides
  modified_base (920)..(1151): a, c, t, g, unknown or other
ccccccccgcagaccactccctgtttgtgggggacctggccccggacgtcaccgacctcatcctccaggagtactttaggcaattttactcgtccgtgcgcagcgccaaggtttgctgggctggcaggggaggggtgtcgatggggaggctgtgctggcgttggcccaggcggttgcccgtgcatggcctccctccttgggcagggccggggagattggggcttgtgtggatgggaactgagggccggcgcacgccttctcgcaccagcgggggaagcaagctctgccctccccgcgaagctcgcgggtgtcactcctcctgcttcgtcaccctcccttgccctcccaccccactcccacacactgcctgcatgccaggttatcaccgacgcaggcacgggacggtccaagggctacggcttcgtgcgcttcctatcggaggagcagcgcgacgcggcgctggagggcatgggcggtcacttcctgtccaaccgccccatccgcgtgcacttggcaacggcaaagaagaacgctaacgccacgacggcgagctcgctgcaggcgccccacccctccgactttgacaccagcaacaccacgctcttcatcggcggcctgtccggcggcgtgacagaggacgagctgcgcgctgtgttcggccgcttcggcgacatcatctacgtcaagataccggcgggcaagggctgcggcttcgtccagttcgtgctgcgcgtggcggcagagcaggccctggccgccatgaacggccaggccctgggcggcggcgccatccgcatctcatggggccgctccagcagccgcgcggcgggcgcagcggcgctgggaggggcagcgggcttcccgccccccgccgccgcggccgccgacccgcgcgccttctcgctctacgacccgggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcaggcctccgccgcgggtggcgggccctccgccgccgacttctaccacgccttccaggcgcacggcaacggcctgggcggccgcttcggcggcctggcccgcg

SEQ ID NO: 6560 - DNA, 324 bp, Chlorella protothecoides
atgattatgcaatgttcagccgacgcacccctccacgcagaggtttggccgggagagaccatggcggacctgtgcggctccaactacacggactacgagtttgcatccgacttctacggtcctctgcagttcttggaaattcctgatgtggtggtggcctactaccgcttcggcaatgcatccaccgacttgccccccgtggtcctgatcatgggattctctggtaccatgaagaactggcccatcaccatgctggttgatctggcggaggacagggaggtcattctattcgacaaccgcgggcagggcttctctaaggtgtga

SEQ ID NO: 6561 - DNA, 1866 bp, Chlorella protothecoides
  modified_base (156)..(165): a, c, t, g, unknown or other
atggtggctctgaagatcgaaggcgctgcccagggccaggaggccgaacaaaagggcgacacgcagcattttcactcccagaccgcaacacggaattattgctggcgtttgaaacgcgtgcgctcccaaagccaccacggaaacctcatcgccgtnnnnnnnnnncaacacggaattgttgggattcttgacccagtcaaaggtctcgacaacgcaacaaacgcagaggctcagattcgccgagccttgacgatttaccgatttactgggacggaacagagtggtcgtccctctcatcatctggcccctgtggcatgtcgggggagaccccggaacttgttatccctgcacgaattgacagatgggctcagagggcgctacgaagttgcatgggaggccaaaagatgcgcagcattggggaaaggatttgcatccgggattagactgcacagcaggcagggcacaaaaaaggactgtcactcttcagcgcgagaagaggcgcagtccgtcgtccctgtcgccggccgggcctttcatcctccgacctcccgagcatgccgggagcattctggtagaaaagcaaactccatgacagacgtggctgatcccgtgtcacggccgacgcgtgaggacaagcaggatggcgagccgggtctcgaggccgggccgcgagacacgcgcttcgaattcgatgcccctcgatactacgatttcggcaatggcagcccagagtccaccatggatcgaccggatgactggttcagcacgaaggcgactgccggtgggaagacggggggagctgtaggatttaggtgggcaggcttaactcatgttcactccatgagcagggtgtccgagcccatcccgatgtatgcaggcctgaggacaccacctgggattgcaaaggactccaatcctcctgcaccaaccacgactcccaaggccagccaggtacagtgctcgaggttgagctcccgcagccgcaactttgcaaaactgcgatattgtggtgcccaaacccttgcaacctctcaccccataccaaagtcgtcggagaacaagctcgccagccagccggccggcaaggccagcagcaagcgcccggccttggcatccatcacgaatactgtgctggatgtcgaggcggcgacggctgcggtcgcagcggttgatgaagagcaggatacgaccatagagttgctgctggacgacgggccgatccaggacccaccccagggctccgcccctgcgccggagaagggagcgggggcccagcccagccgcccagacccgccggtgctctcgcacggcatcacggggaaggcggcacgcgctgttgttctgccgcagcagcccgaggtccccgcgcccaggcggacgggacaaccctcccaccgggcaggtcccgcctcgcaaaccgcgcggacccctgtcgaggccgggtcgcaggcccagaagaaagcacgggtgcatggcatgcgcacccgctccgccgccagcgaggtgcgtcccggagattttagccattctgttgttggggtgtccttggtggctggcctggaggagcccccctccgcctcaccatggaggtcgagagcagagcgcatcgcagagttcgaggggcggcagccggcccgatcgtcccatgcagcggcgcgcacaagagcaggaggaagggccgggcccgcgaagcggccgcggaacgaaggcgccgagaccggcgcggggagtggcctgaccctgccgcgctcgccagccctggccacgcggaaacgggctcggccgccgcgcttcaagcccagggaggaggtggaggcggaggagatggcggcgatgccccccttccgcgctcgccagctggagtga

SEQ ID NO: 6562 - DNA, 1467 bp, Chlorella protothecoides
  modified_base (413)..(457): a, c, t, g, unknown or other
  modified_base (953)..(962): a, c, t, g, unknown or other
atgagccagcccggaatgcaggggcccgcgtctcggcccctctcggcccgatcagtccacacgagggtcgagactgacttccggtcctgccaccacgatgcaggagtacgagcaccgatttgccatttggatggacaatctgcagatgtggggagccggtggggctgggcaattccatgggcgtcatggtggggttctcatggtgctcgatactacaggctcactactgccgcgcacgcacctattaaatcatcatcatcgcatcttggctgctgtatctcgcatccgctgcccctgtggtatttacagcctctggcgtggaccgcgtcgctcccatcctcatctgcctcagcccctgcctttatactgcaaacccctcctgccaacccccccccccccccccccccccatcnnnnnnnnnnnnnnnnnnnnnnnnnnnnnnnnnnnnnnnnnnnnncagctgggcatgggcacctgggccgacctgacccaggacgagtatcgcgtgcgtgcactgggcttcaggcccgacctggcggcgcagcggccgcggcacgaggatgcgcgcctgtctgcgaccaaccccgccgcgctgccggaggcggtggactggcgcaagcagggcgcggtgtccgaggtgaagaaccagaagatgtgcgggagctgctgggcgtttgccaccacgggcgcgatcgagggcatctccgcgatcgtcacgggcaagctggactcgctgtcggagcagcagctggtggactgcgaccgcgagcgcgaccatggctgccacggcggcctcatggattttgcgtacgagtacgtgatcaggaacgggggcctggacaccgaggccgactacgggtacagggcggcggagggggtgtgcgatccggcgcgcgaggctcgccacgtggtgaccatcgacgggtacgaggacgtgccgcgtttcgacgagnnnnnnnnnntgagtacgtgatcaagaacggcggcctggacaccgaggccgactacgggtacaaggcggcggagggggtctgcgacccggcgcgcgaggcccgccacgtggtgaccatcgatgggtacgaggacgtgccgcgtttcgacgagggcgcgctgcgcgccgcggtggcgcgccagccggtggcggtggccatcgaggccgaccagcgccccttccagctctacgcgggcggcgtgtttgacacgccctgcggcaccgcgctcgaccacggcgtgctggtggtcggctacggctccgagaacaacggcaccgcggacgtgccgttctggatcgtgaagaattcgtggggcggcgcctggggcgacgcagggtacatccgcctgctgcgcgccgagatcgcggcgccggcgggccccggccagtgcggcatcgccatgcaggccagctacccagtgaagaaggggcctaacccgcccacgccgccgcccacgccccccgcgccgcccccg

SEQ ID NO: 6563 - DNA, 198 bp, Chlorella protothecoides
atgagtcacacaccacaatccaccacccatcacaaacaggtggcgcacacggatgtggtgctggacgacgtgtggagcctggacctctccaagctggacgggtggacgtgcgtgcaggagaacacgggcggggaggagctgaaggacctcagcgactgggagtccgacgaggaggacagcgactcggaggcggagtga

SEQ ID NO: 6564 - DNA, 360 bp, Chlorella protothecoides
atgacgactgcgctgtcgtcgagcctgcagctggcgaccaccaaacgtgcctcgacttgtactgacccggccgctgggaaatccctcccatcccgtgagctccatcattcctcccacctcccgctgacaatcacctcctcccacaggagcgacctggagcaggccgcggccgcgcccgtgcccgagaccaagcccatatccaattttggcgacggatttgcagagggggcgggcgcctttgggtccagcatcctccgcgggctgcgcggcgtggtggagaagccgcgggagggcgcacgccagcgcggcttccagggtgggtttgcggtggggtgtgagcggaggtgggagaagatatga

SEQ ID NO: 6565 - DNA, 402 bp, Chlorella protothecoides
atgcatcgggacatcaagccagagaacatcctggtgaggggcgccggaagctcaggtatcatgcttggtgattttggcctggccatcaacactaacctggaacctcccatgtctcgagtcggcaccctggactacctggctccagaggcaagagggggatggggttacattggaggggcacagtggtccaccacaggtgtacacagcattccaatcgtacaagatacttgccgctccccatcactctgcatcactgcgcgtatagtgaagctcacggtgtccagcacaccagtcatgcctacaggggccaactacaccctggcggtggactgctggtgcgtcggagttctggcgtatgagctgctgattggcggcccgccctttgaagcgccgtcaaagtga

SEQ ID NO: 6566 - DNA, 957 bp, Chlorella protothecoides
atgctttgctccacatcacaggcacggaagctgctgcacccaggctacctggaattcccctcggtgaacgagacgtgctttggcagagcgcacgagttcgtttttgcggaaactgccgactttgaaggctcaaagtctggactgatcaaggtggggagctggctaaatgtcaatccttctgggctggcaggggctctgtgcgcatgcatcccagcacgcatctcaactccaccgacccgcttaacatcgctcctccagctggacatggcgagcttggaggctgagacgtggttccctggtcgccaccagtttgtcggggagccccagtttgtgcccaggcccgacgctggcgcagaggacgatggctggctgctggcctgtgtgtttgagtccggtgagcgtcgcaggggtagggtgcctggacccagagcgagagttgcggcgcactgcagtgtcctggcatgccgtggccatcgtggatggcgaatcaacgaggctctctcccagactccatgtggtaccaaaacccacagaaagcctcacaagccggttcgtgatcctggatgctcatcgcatcggtgcggggccgatcgccgtcgctttgctgcctcacccactgccgcacggtctgcatgggagctgcagcgacacggcatacatgccgacgcatggcgcaggctcggcgaccctcagctccaatgccgtgcccttcacgcccccttcagcgcctctgcttgggggggagaccagcctgcaggggacagggtgagggagggcaaggcggcgggcggcacccaatggtgcactggcatgcctccaggacatggaggctggctgaaggaacattctagctcatatcaacttgtacgacaatctgtaccttttccatggcaccatagcggctgctcacttctgtgcgcagatcttgagtgcatagctcgtgctccaacaaggtag

SEQ ID NO: 6567 - DNA, 555 bp, Chlorella protothecoides
atgtctaaactcacgcctgctctcgtgggccagttgcatcctggggagagcttgggaacagtgcagcggctcgatgtcgccggccgtggcatcacaacggtcgtgggcatggagtcctgcaccggcctcacccggctggacgcctccgacaatggccttacgtccgccgacggcatagctgcgctgcctgccctgcgctggctttccctagccgggaaccaggtggagagcatcgaacccttgcggtcctgcgattctctggaggtcctcaacatcgccaacaaccgtttatctgggaaggtggctttaggcaggctcagccggctgaaggccctggtggccaacaacaacgccatcaccctggtgggggcgctggaccgttgcaaggagctcaacacgctcatcctgtcccacaacgcggtcgcgagtgtgtcgggctggttggcaggggcgggtcccctgcagaagctgcaactgtcccacaacatgataaccgacctcggaaacgctcttaggtcagtcgtgggggggtgggggggtgggaaacaggcatga

SEQ ID NO: 6568 - DNA, 690 bp, Chlorella protothecoides
atgcaagccccccctctgccccgcctctgcccaagcagggaggcaacctacacgcggatccagaaggcggagcccttcctcccccgtcacctgtcccacgccgccaaggccttcctcggcgccgccctccagcgtgaacccagccagcgccccagcccgagcgccatgctgcgagacccctggatcacaggcctgcaggaggggcacctggctcgtgccggggccgcgacgccagcccctgccccagcgcaagaccaatcaaggtcacaaccagacgacggagcggtcgcagcggcctcgcccacgccgccaagctccgaggcgccgagcacagccgcgccggcatgcgttcccctggagggcagggaggacggggccgacctcatccctgccgctcggcggcccggtggcgccacagtcatcctggctcctgcgggcaccaaggtgcgggctgggattgctgcggaggggccgggcaagccgctgcaggccctgcggaagaagctgtctggttgctgcaaggctgggagggaggtccgggcggagccgaggtccagcatcgccatggtgaacaccgccagggtgcctggcctggggacacacccggtgaaggcgggagtggtcggtgaaacaggatgcacagccacacggcacaaacctcagggacgacaggctggacctgccccgtag

SEQ ID NO: 6569 - DNA, 1110 bp, Chlorella protothecoides
atggaggccagtttctctcatgagattccccccacacccacacccactgaccctgtcccccacgtcaggtacgaggcggcggcgctcaacgcagctgccctgcagctgccttacaccgccttggcctccctgctccacgcctcccccgacgagatcgcggtgatgggcagcgccacgcttgcctggcaggccgtggtctatggcctggcctggacatggcgaccgggggacacggtgctcaccggggtcaacgagtacgccagcaactacctggcctacctgcagctggcacgccgcaccggcgcgcgcatcgtggtcgtccccgagaccgcccaggccgagctggacctgacggcgctggcgcgcgagatcgccgccgcgccgcgccgccccgtgctcctcgccctcacacacagccccaccaactcgggccggatctacgacgcggcgggggcgggcgcggtggcccgcgcccacgccgtccccttcctcctggacgcctgccagtcggtgggccaggtgccggtggacgtccaggccatcggctgcgacttcctttcctccaccagccgaaagtacctgcgagggcccaggggggtgggcttcctctacgcagccaggtcggcgtgggacctgctggagccggcctgcatcgatctgcatggcgcggagtgggtggcgagaggggcctacgccctgcaccccactgccaagcgcttcgagtcctacgagatcagctttgcaagcaaggcattggaggctccctgtatcccagctcgctgcactgcgagccagtgccggctgtctgcaacaccttgcctgctcaccattcttcccatctccacacccgctgtcaaggtgggctttggcgtggcggcccaggaggcggtggatgtgggcatggatacgatcagcaccgcaattgccaaggttgccacggcgctgaggaagggtttgcagggcgtccccggcatcaccgtgcaggaccgggggcggcgcctgggcggcatcgtcagcttcacagcggtgcgcaaacggggctggcagggggaggggttgttgcgcagcagtattgaacagggggatgatgttgttagtacccggatctga

SEQ ID NO: 6570 - DNA, 666 bp, Chlorella protothecoides
atggggcttcctgattcccaacaatcgatcgctgtatccaggaacggcacggtctacctgctggacggcagcggctacctcaaggtcgcacatgggagcacgcggcaacccctggatatcacaatcgacgcccagccccaggcctacctgggtcctgggcgcccgctggggttccacctggacggtgacgatgacctgtacatctgcaacagcctcctgggcctgacgcggctgccagatggcgcccgggcccagcagctcctggccaacagcgtgccgggcgccgcccccggttccttctcccccattgcctacgccgacgacctggacattctcctcggcggcgacgtggtgttctccgacgcctcggccatcccacccgcgcttgggcgggccggacgctatgacaccatgcgctcctacgtgctcaccgtgctgcagggcgcgcccagcgggcgtctgctgcgctggcacgccgggtcgggggagaccagtacgctggcagacggcctctggttccccaacggcgtggccctggcggcggacggcagcttcgttgtggtggcggagacggtcacggcccgcatcctgaagcactggctggcggggcccaaggtgctcgaggagggggggatttggatcgcatggggtgcctgcaacgggtga

SEQ ID NO: 6571 - DNA, 567 bp, Chlorella protothecoides
atggcaaagtctgcgttgggatggggcttatcggtagaacaatcggttcctgcgctgtccaccgcgccggggcacctgtctgctctgagaagtggatctcttgacctggcggcgcggtatgctgagcggtacgtgtcggtggcctggcagccagccctgcgcgccctgagctcggactccagccagcagctccgtggggcggccgccctgcctgatgcgcagagggctgccgtgaagacggtctggactgcagtgaacgccgcgcttgacaccttcaccagccacccaggcatcgtggagtccatcgtctggcagaagcgagtccgggagcaggtgggggccgctttcctcccggcctaccgcgccttcttcacaaagtacgagggggtgcctttcaccaagggtcgccggtccaagtacgagcgctattccctggccgaggccgaggcggccgtgcagggcatgctgagtggggccgctcgggcccccctggagggctcgccgcagaggagcggtgccagcatgagcaatcgcctggctcgtttcaggtccaagctgatggactga

SEQ ID NO: 6572 - DNA, 1728 bp, Chlorella protothecoides
  modified_base (750)..(759): a, c, t, g, unknown or other
atgtcggattttgagaggaggggggtctcgcagggatgcggcacgcctgcgtgcttgaacctgaggggcgccagggctgtgaggcgcccagggcggcaaggagtgggccggggccaggctgatggcacagcctcgccggcttacgccgtgccccggcgccttccatcgccccccccccctgctttttccacggatgcacgtaccttctccaccctgccatcaggaacggcggggctgtacacgaacccggtggccatcctcgactttgccagcctgtacccctccatctaccgcgcgcacaacctgtgctacaccacgctggtgcacccggaggacagggtgagggtggcggggagggggggttgcggaagcaccttgtggggaggcgcagcgcggctgccgagcatccctgccgtgtgtggtgcgtgccgagcccttcgccacgccccttctatcccatggcgcagcgaggcacagcgggcggtgctggacggccggcagaaggccctcaaggtcacggcaaacgcgctgtacggcttcacgggtgagcgagacggcgcctgcagcgcgcggggcggcgcctgcagcgcggtggatggcttgccaccttcattcctgttgcagacggctgggccttcgcctcagcccatgttactgctcacccactgctctgccacccaggctgcagacccagctcaaccatgccatccctcccactcgcatagatacacacactcgcacacactcctnnnnnnnnnnagcctcgccggcttacgccgtgccccggcggcttccatcgccccctcccacttttttcacagaagcacgaccagcagggttggggccagctgcacctgcatcggggactggagggaggccgctgtctcgcctctcaccgaccgcgccactgcacagggtcacttcgcggaggaccagaccacggtcacgcccacgggcgacgtgtttgtgaagcccgccgtgcgcaagggcctgctgccagccatcctggcggccctcaccgtcgcccgggccgccacgcgcgaccagctcaaggccacgaccaggtggggggcgggaggggcgcgctggggaggcctggtcacgacggcacgccactgcccgcagcgtgagctggggtgcgggcagcgcagcgcggctgccgggcatctctgccgtgggtggtgcgtgccgagcccttcgccaccccccttctatcccatggcgcagcgaggcgcagcgggcggtgctggacggccggcagaaggccctcaaggtcacggcaaacgcgctgtacggcttcacggcccatgtcaccgctcttccactgctccgccacccaggcttcagacccagctcaaccatgccatccctcccgcttgcatagatacacacactcgcacacgctcccgcaggcgcacagacctcgccgctgcagtgcatcccgctggcagactcatgcctggcttacggcgcacaggcctgccgccgcgcgctggatgccctggaaagcgcgagcaggtctggagagctgggccccatcggacgcggcgcacgcgtcatctacggccacaccgacagcctgtgcgagggagggtggggcccgtcccgctggctttgcattggtgtgggtgcaggctgaaggctgcggctgctttgatcggtctgagcaggcctgctgggcatgaggcctgggctgggcctgctgggcgtgaggcctgggttgggtga

SEQ ID NO: 6573 - DNA, 2517 bp, Chlorella protothecoides
  modified_base (543)..(598): a, c, t, g, unknown or other
  modified_base (838)..(847): a, c, t, g, unknown or other
atgaaagaccggagagtacctctcagatatactgacggaactccgagtgattcgcccagccaaatggaatcttgcgatgctgtatcgccttgtagtggaggcagagtggctcccacaggctgattgaaagctcaggaagaggccccccctcggggtggaggtttcgagctcgtcatgtcgggcttcatgccagccccactgtcgaccaccgaagcagcttcctgcttaaccggtggtggacctcgtgctcgtccctccgacacgggtgcaaggctgggcagaccctctcagccaggctattttggagatgcgatgcgacagccgatgctcatctatgctgatagcggtcctgcacatctgacagtccgtggtcgtccacacaccacagccccgacatggagctcttcacagacaggcgccgtccgcacagattggagccacacgaggtgctctagggctggacccctcatggccatgtggagggttggaatcctgctgtgcgtgggcatgtctggcccgtcatctccacctgccaacccccannnnnnnnnnnnnnnnnnnnnnnnnnnnnnnnnnnnnnnnnnnnnnnnnnnnnnnntggacattctggaggacgatcatgggcagttcaccatctggggggcgagcgcctcgggtgccagcgtgctcttgcaggtccagggcttccgcccctacctctacgtcgtggcgccggcggccatgccaggctccgccccggccctggactggtttgaggaccgagggctcagggagtcgtttcgcgccgcggtcaacagggccattcccccagacctcagggtggctgccgtgctggcgnnnnnnnnnnaccgagggctcagggagtcgtttcgcgccgtggtcaacagggctattccccccgacctcagggtggctgccgtgctggcatgcgacaggcggcccctgcagtactgtcgccccgcagacctcgggccggccgcctcgcccatgctgcgactcgaattcgatcccggcaccagcctgcgccgagcagcccccgccctcgcgcgctgcctggcctcccccggcctgctggaggcgggggggaactttggggcggggacgatgttcgagagtgagatcggcctgctgcagcgcttcctcgcagacatgcccgtctccggtgagggaggggagcttgtaggcggggcctggctgtacgtcccgccggccgcgagccccaaggctggcgcaccggcgcccggttacactctggcccaggaggatcggcgggcggccggcttcgacatcgatgcgacggcgccctggcaggccctgacctgcctcacccccgacgccacacagctcgcggacgcaggctggtcgccctttccccccggcagcgctgccgcggggtctgccgccgcccgcgccgccgcggcggcggcggtgcggggcgacctgccgccgctgcgggtgtgcacgctgagcacgctctgcgcccccgctgatggggcagaccgcgtggccctaccagagaagggcgaccccctggtggccatctgctgcctgctaacgccgctggacggcggcgcggtgcaggcaaaggtgcacgagtctgagaccgagggggcggaggctggcgtggccaagacagaaggcgttgaacctccaccttcaccatcccagtccgacgatggcgcggaggccgcgcagaacggcgaagaaagcgaagctggcacgggtcccgccgcgctgctgacggaggccgagctggctgccgggccccggcgcgtgggcctgccacccgcccccccgggggcggcgccgcccgggtcactggtattcacccactccgaggccgccacggccgcgacgatgccagaccccgcctccggcgcgcgcacgctggtgttccgcagcgaggcggcgatgctgcgcgccttcctggcctggctgcgggccgccgaccccgacctgctggcggtgttcgacgccgggcgcacgctgggcgcgctgggcgcgcgctgcgccgcgctgcgcgtggacggaggcgccgcggcgctggggcgcgccccgccggggtcgagccgctcgcgcccgctgcgcctcaagcgcatcaccacctacagcgcggcctgggtgcggtcgcagtcgcgcatgagcagcaccagcaaccaggagacgctgcgcgctgagcctgctgggcggcacgctggagaccctggcgccgcgggaggtcgccgcgctggcggccggcgacagcgctgggctgctgcgcctggcgcggtacatggcgacgcgcgcgcgcgcggtgcgcgcgctcctcctccacctggccacggtgccggacatggtggagatggcgcgcgtgaccggcctgaccctgggccaggtggcgtaccaggcgcagatggtgcgcacgcacagcctgctcctgcgcaccgccgggcggcgcgggtacgtgctgccggcgcggctggaggcgggccagctccaggagcacaccttcatcctgcaccccgtggagaacagtga

SEQ ID NO: 6574 - DNA, 1101 bp, Chlorella protothecoides
atggcggggccggacaagggaccattggacctggccatgcagcagagccgatgccccctcctctttctctcccccagggcctcgtcagcatgtggcgccaggcggctcccatcgtccgcacgaccctgcatggcgtcctggagcggatcatcatgcgtggcgacgtggagtgagcgcgagcaggtgtcaacactggagtggtggcagggcgctggctcttggtactcaatctgtgccccacccctccgtgccaggtcggcgatcgcgtttgtggaggaggaggtccgccgcctgctctctggacgggtctccctgcacgaactcatcatgacgcagggcctgtggcgggtgaggtggaggtgggatctggaccctctaggatcgctgcccgtgggcctgcacgggatgtctggtctgcacccagccagggtgttatttctggcttgggtctgcctgccaggggtcatgccggctgccatcagaatttggcaggacacgctggggaaaacggccctggtcgggagtcaaggcccccttggcccatcaccaaaccaccccccccctctcaaccagatcaccggggagcaagtgagcagcgccgcagcgggggaccccgcggccgccgccgagatcaccggggagcaagtgagcggcgccgcagcgggggaccccgctgccgccgccgaggtgcgtgggccccatgcctcgctggcggtgaggctggtccagcgtgatcccgggcgcgcctttgtgctgggcgagcgcctgccctacgtgctgctggcgggggccccgaagcaggacgacgcggcggaggatccggtgatggccgcgcggtctggcgcgcgcgcagactacctgctctactggaacaacaagctggtgcgtccgctgagcgagatgctggggcattgcatgccgccggcgcgagtccaggtgtgtttgtggggttggggtgaagggtttggggtgaggggtttgacgcgatgggtggggcagcggggggcagcaaggcctgggagtgccaggatccacatggcagcggagttgcatggattgctggggtgcggggcttactgcacgtgtgtgcatgtgtggtga

SEQ ID NO: 6575 - DNA, 753 bp, Chlorella protothecoides
atggtgcaagtcaccggcaccatgaactccggctcaagcaacagcgatgagcagctcatagacagacgactcaccattagatggggccccacagaggaggaactgatcgagcggcaggacacattcaatggcagcgtcccggatgagactgcagccgaaattgcgtcgctgcacggcaactcggtgagaggctctgccggtacctgctttgcccctccttctccctccctcgtggtcattcctatcttcccaaatcctgcgcaggccgcacaacgtcgagccatcacagagttgctgtttttcgcctgcgtcggcgacctcaaacggtgccaacgtatcgtgcgcctgtggaacctgaaggtgcggctggcacgcgatgttcacctgccagactggcaaccgcgcgatctgcttagcttgtccaacctggaactgctcgttccaaagtttgagcaattccaccctccctcatccccacctgcaacccatcgacaggtggccgcacctgattgctgcgactatgacaagcgaacccccttggcttcagctctctcaggagtcatctctccaacacatctcaggcacctagctgccagcgaaggggcttacagcgtcactgaatggctccttgccgagggtgtgaatgtcaatgcgctcgaccgtttcaaccgcacccccttggaggtgagatctgttgtacaacgatgcgtgttgcgctcagcacacgggtcaggagctcctggcgccttgtga

SEQ ID NO: 6576 - DNA, 822 bp, Chlorella protothecoides
atgtgcgcagacgcgattgggccggcctttgtgcgcctgtgctctgttccttcgagacccgcatggtcagatcctgcccaccctcacacccttcctcgtgcccctcccaaccctctctgctggcccaggtctggcggctggaaggcagaggccgactgggcgcagacgttgtccatcggcgagcagcagcgggtcgcctttgcgcgcctgctgtaccaccgcccgggcctggccttcctggacgaggcgacctcggggctggacgcggccaccgaggatgccctttacacagcactcgccgcgacgggggcaagctttgtttcagtcggtgcgtggggaagtagggggtcttgtgtggaggtgaaggggacgccaggacagaagatcttccacgcggccttgcgccgtggtgccgagcagccgtcgcccattgtgcgcgtatgtctgtgcctcggtgttccagaagcaaccgctttgtggaacctcatatcctgtccttcagaacttatccacctcccaccaaattacgccatcaggccaccgcccgcagctggtccagtggcacacgcacgtgctggaggcccagggccggggcaggtgggagctgcgggacgcggaggagtacctcgccagcaggggccgagccgcgagcccccaggcgtcgggcggcggcagcatgacgctgcgccggcacactggcatgccggggattgcgttgccagaaagtcaccgccagggtggcccgtctggggcgggggtgtcgtgtcaaccgggcctgttttgagaggtccaatgccgggctcgcaagcaggcacagggtga

SEQ ID NO: 6577 - DNA, 1986 bp, Chlorella protothecoides
  modified_base (72)..(81): a, c, t, g, unknown or other
  modified_base (794)..(803): a, c, t, g, unknown or other
atgctgaagggcagctggtcggaacatgaagactacttgaccaaactctttccaaatactgttgaacacatnnnnnnnnnnctgaagggcagctggtcggaacatgaagaccacttgaccaaattctttccaaatactgttgaatacacaggggagaaccgggcgatggcctggcgactggccatcgcctcaaccgccctgtccattgccaccaccctcctcctgctcaagctcagctacacgcagagcaacctgtcctccaacctgtctgagaagtccgagtgtgagcgcgggggcattcaggaccggggcggtgccttccatgacctgcctgctgcaagagtgagcttccgtcctatactctcaaggctcacccccggcccccaaacccaatcacccagccggcttctactcggccgtgtgggagtttgtgggagtggcggccgttgccacccccctctttgccctgtcagagatcatgctgtgctccctccagggtctggacaaccccgaccaggtgcaggcaaaggagggggggggggtggtgggggggctgatgctggtgagggtggtatgagattcagcctcggagccatccctctccagacttcgcatgtgcgaggacgcgcgcagtttcgcctcctccagcgtggccctcatggtgggcctgagtcgcaagctcttctacctggccgccttctcgggcctgctcttcagcatcgcgccgcgcatgatgtggttcctcctggcctacgccgcggccggcaccgcggtcaccgccgctgtctttgggnnnnnnnnnncagcatcgcgccgcgcatgatgtggttcctactggcctacgccgcggctggcaccgcagtcaccgccgctgtcttcggccgcggcctcatgcgccgcacctacgaggtcctgcgccgcgaggccgacctccgtttccagctggtgcgtgtgcgcgaagccgcggagtcggtggccttctactcgggcgaggcgcgcgaggcgggcgtctcgcacgccaggctggcggccgctgtgcacgctgcgctgcgccgggtggcctgggaggcgggcctggcgctgtgggtgaacgcctacagcaacaccacgctgctggtaggtgttgagatcggagggggaagaagggcggatgccacgcagggccggccgccgacactgctcgactgcagcaccggtgacgcaccagggcacacaagacgaatccccctgacaacaccccccccccctccttctcttccttcctctcctccaggtcccctccttgctcatggcgccggcctactttgcgggccaggtgcgcttcggcgacatcacccaggtctccttcaccttccagcgcatcgagtccgcgctgtccttcgtcgtggacaacctggccgcgctctccggcctggcggcccagaccgagcgcctggacgagctgctgcgcgcgcttgtgccgcgcggcgaccccggcgccagcgttgcgcgcggcgcggcccgcgccggcgccgtgctggagctggaggggctgtccctgtggactccgggcggggcccagcacctggcggacggcctggacctgagcctgggggcggggcagtcgctgctgcggctgcatgcgtgcagggtgggatgtatggccgggcgagggagtggggaacctgcagcgagcatgccaccgctgctctcaggccagggagggggcgccccagtgcgttcttggatgaacaggcgggacagcatggccgctgggtgcatgaaacgcttgagatacaggcagcacacaggctgtgggacgaagggtcagggactgtgcgcaccctgccacgcgactcgctcttcttcctgccccagaagccattcatgtgtctgggcaccctgcgggaccaggtcacgtttccccacgtacacacacgcggcagcgccacggacctggcagccctgctcgctgccgcacagctccccgacctgctggagaggtga

SEQ ID NO: 6578 - DNA, 1110 bp, Chlorella protothecoides
  modified_base (196)..(205): a, c, t, g, unknown or other
  modified_base (540)..(549): a, c, t, g, unknown or other
  modified_base (630)..(639): a, c, t, g, unknown or other
atggcaggcctggcatcccacctcacagtgcgacccatgctcgtgcctaccagacacaggttctcggcgcgactcgttccttcgaggagacagaaaccttttgtgcgtgctgcctatgcttcaggtgccggcgaggatccctacaagatactggagcttcctcgctcagcagactccactgccatcctgagggccnnnnnnnnnnagggccttgctctgggttggtgcattggtggcatagaggtgggaaatatgacaccttcctctgacttcccgccagatactggagcttcctcgttcagcagactccactgccatcctgagggcctaccggaacaagctgagggaagccaagggcaacgaaaacgcgaccgccaggatcgaaaatgctcactcccaaatcatgatgtcatccctcagcaccagacttcaggtcggtgcaatgcactggacgtgaggcctttaggggattggaaggttcctgtgagcacagcagccagtgaggatgagacatggacatggagtatagctgaatgcctnnnnnnnnnncagctgaatgcctcgctggcatgtgagcttgatgcccttctcggcgtggcattctacaagtgtatcagggcaagtctgatnnnnnnnnnntcgtggcagtctacaagtggcaagtctgatgtgggcaaggagatcctgtatgcggatcgtgccaagatcttcccatggcgcccccgcgtctaccctgccaaccggaagctgctgatgtacagcgccatcgcccaggccctcttcctcgcgtacggggtgttcaacccctccctcacgctgcccatcgtatacggtgcgggaggggggggcatttgtgtggtgtacatggctagactctcatgggaagtcatgcttacagagcagcgctgcgacgtgcagagaggtgcaatgggcggggctgttggccagctgctgaagcagaacgagatcaatccgccgccccctcctggggcagaggccggagcaggaggcggtgggtggagcagggtgtcggggcagggacagcggtggggacagcctgtgcggacatgggattgctgtgctgtccatggcatgatggctgtggcctga

SEQ ID NO: 6579 - DNA, 420 bp, Chlorella protothecoides
atggtgatgccaggcgggcacaaggcagcggcctcccttgtcagccaatacatgcccagtacactggcacaaggacccgggatgctgcggccttgtcggtcattccggcctgccttcgtgggcctacaccccctcggggggcctcggtctcgcgtgcctcggcggtctccagccaccgccgcggccacaccctacaagccgccatcagaggagatcgccagtgagggcctgccatctgaagttcgacagagggcggagacggccatcctgaagcggggtggggcagtcactgtgggcgacgtggcagctgtggcagggatcagtctgaaggaggctgaggatgccttgcgggccctagccagcgactccctggccaatctgaaggtttgtggtttggaagggtccacgaggggtgcctga

SEQ ID NO: 6580 - DNA, 396 bp, Chlorella protothecoides
atgcgctccagacgaataagagcgtctcacttcccacgctgcagtgcgctgcacgaccgccgtttcccacccgtcgaggcccatgagctgccagcgctggagtgcaccgtgtccctcctgcattcatttgagacgggcggttcctgggaggactgggtcccgggagtgcatggcatcatcatcgagtttgcgtgccccctcaccgggggcacccgcagtgccacgttcctgcccgagattgcccagcaggagggctggacccgggtgcagaccattgaccagctcatttccaaggcgggggccaggggcgggcaggccagccttcgctccatccgtgctggactgtctctggtcagataccagagcactgcggccagtctcacacacgcacagtga

SEQ ID NO: 6581 - DNA, 423 bp, Chlorella protothecoides
atggtggagagcatcgcgctgctgcccaacctgccggtccacggcttcgtgggcgtgaacatgtacgtggacgacgaggggtccatccgcgaggcgcccttcaacgcgcgggccagcgagctggccaccctctgcggcaagccactgcaggtgcgcggcgacgctttcttatcgcgcgtcctggacgacggcgaggccttccgccgcctggactttggcgccaacgacctgtcctcctccgcgccctgggtggcggccgcgcgggccaagaatgccgaggcgcggcggggggagggcgcgcaggccatcttgcaacgcatgcaggcggagggggccggtccggggcccgcctccagcccctcgcccgccgatgcgctcaagcagcagggcaatgcaggtgtgtgttggggggggatggggtag

SEQ ID NO: 6582 - DNA, 321 bp, Chlorella protothecoides
atgaccacagccttcaagcggtgtgagtgggagacagcggtgcggctgtacacccaggcactggaggccgagtccggcctggtggccgcgcggaacaaccgggcgcaggcgctgctccacctccagcgctggcgggaggcgggcgccgacgcggaggtggtactggcggcgcagcccgacaacgccaaggcgctactgcgccgcgctgctgcggcgcaggcgctgggcgagcacgccgccgcgcgcgccgacctggagcacgtcctggtcctggagccgggccaccgagaagccgcgctgcgcctcgccagcctaacctga

SEQ ID NO: 6583 - DNA, 321 bp, Chlorella protothecoides
atgcccctgcctaacccttctgcaagtccattcaccgtcactccccctccccgcaccgccaggtttggcacggtagtggccgccaaggtgctcaaggcctcctctgagatcgcggtgaatgacttccgggcagagatcgagatcctgcagcgtacggcgacagcccatccacctcgcttacctcacccctcctgcccagttcctgggagcctgcacggcaaaggagccgtacattctggtgaccgaattgatgagcggcggctcgctggcagacgccttccgtatgccgcaggtgtggatgaggcggggcagggtgggtga

SEQ ID NO: 6584 - DNA, 348 bp, Chlorella protothecoides
atggcgggcaacatcatccacgccgtggcgacgaccaacgccattgcctcagggctcatcgtggtggaggccatgaagcttctggcaggccagtcaaaggcgtgccacaccactttcttgcttgcggaggcgagtaacaagaagctgctgacgcccatgcagtcgccggaacccaaccccaactgcgtcatctgcggcaaggcgcagctgctgctgcacgccgacctgcatgccctgaccctgggggacctcatcacacaggtggggatgctggacatgattggtgtgggcccgtcatgttgtctggccggaagtatggctttgctttcacggcccaggcgtcaatag

SEQ ID NO: 6585 - DNA, 621 bp, Chlorella protothecoides
atgagagccccgtgccgattgtcctgtgacgttctcatgcggcgagagggagaagcacgacaccctggccccggccgcgcaggggatgcctcagcagaggcagcaacgacggcaggccctgcgctcctgcgccgcagcggcgagccggcggaagagtacgccctccgcgtcttccaggcggtgtttgtcgccgacatggagcgcctggccggggtggaggagatgtggaaggggcgggagcccccgacgccctgcgccctggatttagcagcggtgggcgagcgtgtgcggctggccgaggaaagcgcggcggggcgtgggccaggcgtcgcagcctcgggcatgtcttccgcgctgggcctgcccgacgcccagcgcgcctgggcgccagaggacagcgcggccgtgttcctggccagcgtccgcgctttcctcacccaccgggccgaagaggtgggcgcgctgcgcttcgataaagacgacgcactggcgacggagtttgtggcggccgccgccaacctgcgttcacactgctacggcatccccccccagaccctcttcgaggccaaggtttgtgggcgtgtggctgggtggatagggaaagaggctgttggggcgtag

SEQ ID NO: 6586 - DNA, 564 bp, Chlorella protothecoides
atgcgcgcaagagggcacctggcagtgcccggactggggcgagggcaagtcgcacatggtcccaccccttcactcacacatcctccaccctcccatgtcccacaggcttacgccttctccttcttcgccatccccgcgctgcgagcgctgagcctgcgtgcccggaacgcgggcatcgaggcccggaaccaggctcgcttggcagcgtcccgccggttacgggccccggacccccagctggccaccaaactgcgggccgcccaggtggaggcccagcagcgcagcttccagcgcgaccgggtggtgtacgccaccgacacccccctgcccacctccagccgcgacgagcccgacgagtgggaggcccgactggcggcgcggcaggcggcgcgggggcgcggtgcggggggccggcgcggtgcggcgcggaggcgcggtgcagggggcgggggcggcgtcccggagcagcggccgggggcgggggagcaacccgtcatggaccgcaagggcgggtcccagcggcagcgtgggcgggacctgccctcctggctccgcgaacgctga

SEQ ID NO: 6587 - DNA, 642 bp, Chlorella protothecoides
atgcggcgcgctctggagatcgcactggacgcggcgcgcggcctggcgtacctgcacaatcgcaagcctacccctgtcatccaccgcgacctgaagcccggcaacctgatgctgtctgggtcgcagtaccaggaccgcgcgcaggtggtgttcaacacgggcgtggtgaagctggccgactttgggctgtccaagacgctgcccaccaaccgccacgccaacttccacttggacgagcggttcaagctgacgggcgagacggggtcgtaccgctacatggcgcccgaggtgttccggcacgagccatacaactcccgcgtcgacgtctactccttttccatgatcgtgtaccagctgttcgagtaccagcccccctacgccgacatggaccccgtggaggcagcgcgcctggccgcgctggagaacgcgcgccccaacttcatcacactggcgcagccggggccgcacaagaaggagctgcgcgagctgatcgagcgctgctgggcgcccaacgccgacgagcggccctccttcccggagatctgcaggatcattgagacgctgctggctcaaattccgcgccaggagtaccagagctcgggggcggtcggcggcgacgccggctgctgcgtcgtggcgtga

SEQ ID NO: 6588 - DNA, 267 bp, Chlorella protothecoides
atgcgccatttgttccctcaggatgctgtgcgtggcgacttcaacctggtggcctccctcctgatgaaggctggcggcaaggttcacgcctctggcaagttgataccgctggaggactccgagctggtcaatggcctcggcttccgtgcgccccagcaaaaggcgtcgggctttgccctcgagtgggagctggacccctccaccatcaacatccgggagaagctgggcgagggagagtttggcgtcgtgcaccgagccaagtggtga

SEQ ID NO: 6589 - DNA, 528 bp, Chlorella protothecoides
atggtggccccgagcgagggtggtgccatcccctggcctctgggtgccaccagctacgccatgcgaaccagggtgcgcatgggcgctgatctgatcgacctggacacaatcgaaaccagcaacctgaacaggcagttcctgttcaggcaacagcacgtggggcagagcaaggcctcggtcgctgcggcggcggtgcaggcgatcgtccccggggtcagcatcaccgcgcaccgagccaacgttaaggaggcgcggttcagcgcagactttgtttccggcttcgacctggcgattgtccccggggtcagcatcaccgcacacccagccaacgtgaaggaggcgcggttcagcgcagacttcgtctccggcttcgacctggtcctgaacggactggacaacctggaggcacggcgccacgtcaaccggctgtgcctggcggcgcgcgtgcccctcgtggagagcggtactgcagggtacctgggccaggtgtgtcggaggagggtgcgggtggtggacgaggccacatga

SEQ ID NO: 6590 - DNA, 384 bp, Chlorella protothecoides
atgctggagggccaggtgggcaacaccaccagcatcgcagtggacgaatcatacgtgctccccgtgctcacgcgcttcggcggctcgccggtagtcggccaggacggcgagatcctgtaccacttccccaacctgcagcagaccgccgcggcccagaggctgccggcggtgcagcccaagctggtccaggagaggcccgtgcagctcacgcaggccaatggcggccagaagctggtggccatcgctctgggcgccgccaatctggtgggcgtggtggccctcgggggcatgctgggctcgccccagggctactatgcgctggcccgcaacggcctgggctggatcccaaacgccatgcccttcctccaagtgagcttcgggtga

SEQ ID NO: 6591 - DNA, 2556 bp, Chlorella protothecoides
  modified_base (949)..(1007): a, c, t, g, unknown or other
  modified_base (1653)..(1662): a, c, t, g, unknown or other
  modified_base (1756)..(1765): a, c, t, g, unknown or other
  modified_base (2130)..(2139): a, c, t, g, unknown or other
catgccgcaaggcctggcgcgggcgcggggcccgccgtggtcgtgcccccggcgcccagcggcgcgacctccaccggcggcggctccctcgccggcctccgtgccgactccgggtcgggcggcgaccggcaggagggcgcgcgctccagcaagcgcgcgatcaagaaccgggagtcggcggcacgatcacgcgcgcggaggcaggagtacacgcagaccttggaggccaaggtggctgagctgcaggaggccaaccgcctgctgagggagcaggtgctcaccgccgcggccgccgcggcggccgggagcgggcatgcgggggcgccgcgcgagagcggcgcggcaaacggcccggcgcaggtgggggtcaagcgggcccgtgggggtcaagcgggcccggtcgctctgacggggagcgtgactctgtcccagccttgcggcgacaagcggaagttccatccctcttttcttgacgtgacgccacgatgcagctcgggaggcccagggcctcaccttgtgaccattactcttcattctccaccccatttttcagtatgtgatacccagggccagtttgatggaaatcagggcgagaatgtgtatcgatgtgtgccatggccatgtgtgggtgggtgcccgagtctctccaccggcgcgccagccagcgcgcgcgggttaacaatgcggggatgcagattaagccatgctcgggtccagtccccagccagaggagtgtcggggtgggatccccgccttgaacgtcgaggggccagctgcagggttggaagaggcgtggcgtggcgcaggctcgtggtgatggctggcagacccaagagtgcgagatgggtggatgttggcgtcgtggaccccgatctggagcttcgagcacacatcgccagcctccctgctgcacggctaccgcttcccccaacccgcctcccaccccccnnnnnnnnnnnnnnnnnnnnnnnnnnnnnnnnnnnnnnnnnnnnnnnnnnnnnnnnnnntggctacttcctgatctctgccagcaaggattcctccccccagctccgcaatggcgagaccggggactggatcgggactttccagggccacaaaggggcggtgtgggctgccgtgctcaacgactccgccttcctggctgccaccgcctccgccgacttcacggcccgggtgtggaatgccgtgaccggggacgagctgcattcctttgcacacaagcacatcgtgcgaacagccgcatttgcaagggggcaggactcctgcaagctcgtcaccggaggtgagctttggttgtatatcgcttggctggcagcgggcagactggtggttggggaaggatgggtgtccgaatggctggagggcttgccgttacctttcgtgtctggacctgaggcccgtggtcccgagaagctacttcgtgtgtttgatctgtcacgccccgatgccgcccctgagacggcagccctggcatccagtcccgagaagctgcttcgtgtgtttgatctgtcacgccccgacgccgcccctgagacggcggccctggcatccagtatccggggcgcggcctggatccacgacaacaaggccatgctcatctcctactccgacaagcccaacctggagcactctgctccggcaagacttgcnnnnnnnnnngtcgctgcggctcgccatcaaaggtcacctgcctttcgtcacccttccgtcctttcttcctgtgcgcagcgtgctggacacgcggacgctgagnnnnnnnnnnagtgcttgcacgagactgctggtcgcctggcgcacccgctcgtgctggacacgcggacgctgagcgtggtgaagacgctggagacggcgggaccggtgaccagcatcgacgtcacggactgcggcagattcatcgtcaccgccgacggcagccaggttggtgcaggaggtcggcgggggagtggggcagtgtttgagaaggagcctggaggcgcgactgccaggcgcggcgcgcggccgctgagccgaggtgcaatcgccagtgcgggaaggcgggccagggttgccgccgggtcacactcaccgaaatgcatattcacgctttccacccccaactccacacacaatcccacggcgagccaggtnnnnnnnnnnctgccgccggggccacactcaccagaatgcatattcacccttccccccctcacctccacacacaatcccacggcgagccaggtcctgctccacgacggcaccgactttgcggtgaagcgcaccttccgccccagcgggtactcggtggaggcggccgcgtacgcccccgaccgcggcaagctggtggcgggcggcagcgacatgtgggttcacgtgtatgacgagacggacagtgaggtggaggcggggcgggggcaccatgggcctgtgcacggcgtgcgtttcgcgccggggcacgcgacctttgcctccggctcggaggacggcaccctgcgcatctggcagacggagccgccggcggctgctgtggcggcgccggtggcggccaaggagacgagggatgggcagggcgtctga

SEQ ID NO: 6592 - DNA, 897 bp, Chlorella protothecoides
atgcgcaccaccgccgacagccccaccatcggcctggtcctccagcgctcccacctggttaccggggacgaggggcactactccggtgtggtatccgagctggaggcacgtggcgcgcgggtcatccccgtcttcgccggcggcctggacttctcgctgccggtcaagaagttcttctacgaccccctgaagcccagcaaggcgcacgtcgacgccgtgctttctttgaccggattcgcgctggtgggggggcccgctcgccaggacgcccccaaggtgccagacgtcgttgacttgtcgtgtgtgtgtgtattttggtggtgggtgctcaatcgctacccagggacaataacacaatccctggtgctgttgtatctcttcgactctgtttctccctcttctggaccggcacagacagccatcacggcgctcaaggctctcaacgtgccctacctgtgctcgctgcccctggtcttccagaccacggaggagtggttggagagccagctgggcgtgcacccggtgcaggtggcgctgcaggtggcgctgccggagcttgacggcgccatcgagccgctggtctttgccgggcgcgacgcgggcacgggcaagtcccactccctccccgaccgcattgagtccctggccgcgcgcacggtcaagtgggccgcgctggccaagaaaccggtggctgagaagaagctggccatcacggtcttctccttccccccggacaagggcaacgtcggcaccgccgcctacctcaacgtctttggatccatcttccaggtcctcaaggagctggaggaggaggggtacgatgtaggagagatgcccgccgacgagaagactctcatggagtcggtgctcaaccaggtgtgtgttatgcgtggttag

SEQ ID NO: 6593 - DNA, 993 bp, Chlorella protothecoides
  modified_base (712)..(721): a, c, t, g, unknown or other
atgagcggcgagtgctaccccgactccctcattggctcgctgcccaacctctactactacgcggccaacaaccccagcgaggccaccatcgccaagcgccggtcctacgccaacaccatcagctacctcacccccccggccgagaacgcggggctgtacaaggggctcaagagagctgtgagcatcaaagaatcagacctcaatgtatcccgaacagtcctggcatcccgcgagagctgtgtttgtagttgtcctcaatgcgcactcatcaatccttgtctctcccacccccccattaaattccaggagctcaaggagctgatcagtagctaccagtcgatgcgtgagacggggcgtgcctccgccgtcgcagccagcatcatcgagacggcccggcagtgcaacctcgacaaggtgtggcgttgtgtgggagggccaacttgtgggagttttgttcactggcagcccaaggaggcagtattcacacacacacacacatcatcatcatcatctgttggccccaacaggatgtggagctgcccgacgccgaggccagagacctcaccatggaggacagggactctgtcgtgggtgcgtggaaatccagagctttgtgatgtggttgttggtttggaaccgcctgggctgatggcgtacatcccctcccctcctcccccattcccacctctccaggcaaggtgtaccagaagcnnnnnnnnnnagctgggaagcactgtgcatcttagtgtctctattgaccctttgatgtgcccatgcatcccaaccgcctgggctgattgcttacatcctctcccctcctcccccgtttccacctctccaggcaaggtgtaccagaagctgatggagatcgagtcgcggctgctgccctgcgggctgcacgtggtgggcgtcccccccactgccgaggaggccatcgccacgctggtcaacatcgccgagctggaccgcccaggtgagggtgctgggccttga

SEQ ID NO: 6594 - DNA, 666 bp, Chlorella protothecoides
atgcccctcacatcagacgccgacccaccgatccggggcctgcccggcatcctggcccgggcggcaggtcgcagcatcgaggaggtgtacgcgggttccaaccgtggcgtgctcaaggacgtggaggaccttgcgctgatcaccgacacctgccgcgaggcggtgcgcgcctttgtctccggccaggtggacagcgcgggccgcgtcaagcgctccaccaccggcggcggcctgggccgcatgtttgggctggagcgcgaggcctggctggcgccgctgaagggcacgcccttcgcccgtgccaagcgcgaggagctgcgcacgctgttcgactacctggcgggctgcctggccaagatcgtgcaggacaatgagctgggcgcgctgaagtccgcgctgcgcggcgagtacgtggagcccggcccggggggcgaccccatccgcaacccgggggtgctgcccaccggcaagaacatccacgccctggacccgcagagcatccccaccgcagcggcggtgaagaacgccaaggtggtggtggaccgcctgctggagcgtcagcgtcaggagatgggtggcaactacccagagagcatcgccgtcgtgctgtggggcaccgacaacatcaagacctacggcgagtccctggcccaggtcagttggtag

SEQ ID NO: 6595 - DNA, 447 bp, Chlorella protothecoides
atggaggacgctgccctgccggggtgggtgctccccgtcacgctcgtcctcggtgcgatagtgctggctttcataagagtctggtttggcatcgacgagaagaagaatcgaaagtatgctggcaaacgagcggtcgccacgaagccaatccagaagccgctgggccggtacacgaaggaggaggtcgcccggcacgcctcggagtcggatctttggctcatcatccgcagcaggaccacgggcgtggcaggggtgtatgacgtcacacagtacattgaggatcacccggggggcgatgccatcttcacgcatgctgggggcgatgccacggagggcttccacggcccccagcaccccgccactgtgcatgacttggtccgtgagtatctcatcggcaccctcgtggaaggaggagacgctggcgtgagcccagtaacgacaagttag

SEQ ID NO: 6596 - DNA, 717 bp, Chlorella protothecoides
atggaaggcacagccatcctgttgcgatgcctgcgccacccttttctccacacacacacactcgcacaagtgtgcgtggagatcgttggctatctgttggaggagctgcgtgatgccaccaactttgcgcactttaaggcggacgtggcggacgccaacatcttcatcggctccctcatcttcatcgaggacctggcagacaaggtggtggaggcggtggggcccgcccgcgactcgctggacgcctgcctcgtcttcccctccatgcccgcggtcatgcgcctgaacaagctgggcaccttccagatgagccagctggggcagtccaagagcctgatcggggacttcatgaagaatgcgcgcaagaacaacgacaagtttgaggagagcatgctgaagctggtgcgcacgctgcccaaggtgctcaagtacctgccctcggacaaggcgcgggacgcacgcaacttcgtcaacgccctccagtattggctgacgggaaacgtggacaacctggagaacctcatcctgagcaccagccaggcctacgtccctgcgctcaagggcgtggacttcgaggccgccgagccggagctcctgcccgacgtcggcatctggcacccactggccactcacatgtttgaggacatcaaggagtacctcaattggtggggcggttggtgtttttttgggggggggagggggggagttgaggtttga

SEQ ID NO: 6597 - DNA, 717 bp, Chlorella protothecoides
atggtgggcgtgcgccccgtccccgatgcgctgggccgggtcaacaagctggagctggtgtccctggaggacttgggcaggccccggatcgacgtcgtggtcaactgctccggcgtcttccgcgacctctttgtcaaccaggcgcgtgtgggggggaggaacctcaggggaatgccttgctcatgtcattgcggtgccttgccagctgttccaacgccccaggacccggcgtccacatcccgactcccacaacaagaacccctcacacatccccccatctcaaacccacctccccaccccaaccccaaacagatggcgctgctggaccgcgccatcaagatggcggctgagcaagacgagccgctggagatgaacttcgtgcgcaagcacgcgctggcgcaggcggaggagacggggcgtagcctgcgcgactctgccacccgcgtcttcagcaacagctccggctcctactcctccaacgtcaacctggcggtggagaactcttcctggtccgacgagcagcagctgcaggagatgtacctgtcgcgcaagtcctttgccttcaactccgaccgccccggcgcggggggggaggagtcacgcgacatctttgtctccgccctgaagacggtggaggtgaccttccagaacctggactcgtccgagatctcgctcactggtgagggtggtggtaggtggtgggcgggtgggggttga

SEQ ID NO: 6598 - DNA, 912 bp, Chlorella protothecoides
  modified_base (348)..(357): a, c, t, g, unknown or other
gcggcgtggcggggcgaggtgccgccggactccagcaccaggtccaccaccgaggcgtccagcacctgcaggccggggacggcggccagcgccgcctgcatcgccgccttgtacagcgcgcggtccatctgggcgcgggggcctcggacggcggggcccttgctcgcgttcagcatgcggaactggatgccagcctcatccgccacgcggccctgttgcgttttcaaggggggccggggaggcggcatcatggacctgcggaggtctgtccctgttgatgcaccacaccaatgcccgctggcatgcaagcctgcttttcaattccaccacctcatgcccgccacgcannnnnnnnnngggggaggcggcatcatggacctgcgggggtctgtccctgttgatgcaccacaccgatgcccgctggaatgcaagcctgctgctcaattccaccacctcatgcccgccacgcatctccgagcccaggctatgcccacaacctctcccctcacccccaaaacctaccatgagcccatccagagcgtcgacctcccggaccagggtgcccttggccaggcccccgatgctggggttgcagctcatctccccgattgtggcggagggggagggggtgatgagcagggtgcgggcaccccgccgagcggcagcggccgcagcctcgcaccctgcgtggcccccgcccaccacgatgacatccacgtcgcgggtggaggagaaggctcgtatcggacgagggggatgcctggtccagggccgcgccaccctgaacatgctcggacggagcctgtgcggtgggaggggtctgaggtgtcgagtggtgcaccgacgggactcatgcatgcaccccagcacccgccccatcactcacatatttcccgactggtggaagactag

SEQ ID NO: 6599 - DNA, 300 bp, Chlorella protothecoides
atgcacaacaggatatccatatatcaaggcgatgtggtgctcaagaacctgaggctcaaggcagatgccctgtcagagctggatcttccagtgacagtcgaggctggcctccttggcagcctgaccctcaaggtgggttgttggcatgcagctggggcgacaaactctgtgtgcctggagagcacgctcacaccactccacacccctgcctcatgcctaggtgccatggagcgcgctgggtcaggcgcccgtggaagtgcgtatggaccgcctgtttttgctcgcaaagcccagggatga

SEQ ID NO: 6600 - DNA, 480 bp, Chlorella protothecoides
atgttcagggtggcgcggccctggaccaggcatccccctcgtccgatacgagccttctcctccacccgcgacgtggatgtcatcgtggtgggcgggggccacgcagggtgcgaggctgcggccgctgccgctcggcggggtgcccgcaccctgctcatcaccccctccccctccgccacaatcggggagatgagctgcaaccccagcatcgggggcctggccaagggcaccctggtccgggaggtcgacgctctggatgggctcatggtaggttttgggggtgaggggagaggttgtgggcatagcctgggctcggagatgcgtggcgggcatgaggtggtggaattgagcagcaggcttgcattccagcgggcatcgcgggcattggtgtggtgcatcaacagggacagacctccgcaggtccatgatgccgcctccccggccccccttgaaaacgcaacagggccgcgtggcggatga

SEQ ID NO: 6601 - DNA, 1284 bp, Chlorella protothecoides
atgctcatgttccggcgcctggcgcacgcggaggtgcagcgcgagcgcaagcgcgaggcgcgcgccgcgtcgcgcgccgcggcgcagcagggggccgccgcggggtgggtgtcctggctgaccgggcgcgcggcgccggcgacggggggcggcaccgccggctcccccgacgcccccgcgccggacgacccggacatgcgctccgacttctcgcccgacgagttcgcgcgcctggtggacctggtgggcgaccaggaggagggcctcgtgtacggctccgcctccccgcactccctgctgcagcgcctgcgcgtcggcgtgggctccgcctcggccgagctggtcgggcgcgacggccgccgcgtcctgcgtggaggcctggacggcatcgccctggagctgcgcaagttccccaagaccctggccgtgggcctgcgcgtcgccgccatgggcgtggactcgcccgagggcgtgtttgtgcgcacgggccgcgggctgtcagctgggacgggcggcgagggtgcagggggcgctgggtcgggcgaggctggcgccgacggtgccgaagctggtggggccgtcgccgacgagacccccccccctccggaggaggaggcgctgacggtgacctttgtgcacgcgccgcaggacggcagcgccgacgccgaggtgggcgtggtgctgcgcccctcctacgtgcactactccgcgcccacggtcgcgcgcgtggccgccttcttccgcgcgcccgaggccctggacttctccaacctgcagctggctgcgggcgggcagctggagcgcgcgcgcaaggcggcggcggcctacgcggcggccgccatgcaggcccgcccccgcttcaacctgcgcctgcagctggacgcgcccaagatcgcggtgcccgtgtcggacgccgacggcgacgtctgcctggtgctggacctggggcagtttgtggtcagctccgaccgcggcgcgccgcgcgggctgtcgcctgaccaggccgcgctgtacgagtgcgtgcgcctggagggctccgacgtggccgcgttcttgggggccgcggggcacactcccagatcccccaccgccgcccctcgaccgccgcgcatcccgctgctggaacggtgcgggctcagcgtcgcggcgcagctgtcgcgcttccccgacccggaccgccccgcggtgcggctgcagcccgcagtgcccagcctgcgcttccacctctcccccggccgcctgcgcgccctgctgcgcgtgctgcgcgccgtggcgcccggggag

SEQ ID NO: 6602 - DNA, 441 bp, Chlorella protothecoides
atgcatgagtcgcagtggctcgccgagctggagaggctcgacaaggccaaggagaaggcggaagggggcggcaccggcggagggctatttggtggtgggcgcctgaagaatgtcatcgacaccgtcatcgcaaacaccttggcgcttggtggccgattgcaattcacagacccctgcaccccgacatctccacaaaccttttccctccacaccggccccctcccaaccccaggcaatctccagctgtccatcacaaacatccatgtgcggtacgaggatgacgtgaccaacccgggccaccccttctcctgcggcatcaccctcgacaagctggccgcagccaccgtcaacgacaagggggaggaggccttcgtgaccaccacccctctcagcctgctgaggaaggtgagagggggtgtgttcggcttgtttgcttcataa

SEQ ID NO: 6603 - DNA, 864 bp, Chlorella protothecoides
atgtccgacccgctcaccgctggttaccaggtgggacgtgcggtcgtgaccggagcgaccgcgcctttgatacccccttgtcgggggagcaactcctctgggttcagcatgaggggcgccattcataacctaagacacccacttgcagtctcaccttcgttttgtctgagaattgggtggtttgacctattgttaagcgttcggccgcacccgctggtggctgacgtgcttcctccttgtgcaattgaagtcattctacgtgaaggtctgtggtggcgaaggtggcggttcgagaggctgcgccccccgcgtggatacacttcgggagatgcgcacactctactcccattccttaccccccgcaggcatcctgcaagacagccttctacgcgctaccgagtgcaaagtgagagcccattggctatgaaatgcgcattcggtgcaatcaaggacttacgtgtgccattgaggaacgaacctggtccggccgggcgccctgcagggtcggaactatccgaggtgcctcggcgacaatccccctcaccatgcccttccccttgcgacctgcagatctgggagcaccgtgctccttctcagggaagacagcagagtcaagggcatactgaagctggatcagtccgcagtggtcccttggggtcactcgtccttccagtagccgcaatcagcctcaaatccttccaaaaatgttctggtgcttcatgccaggccctcctgggcgtggaatgcctgcggcgaggcgaggccgcatgcagcgccgatgcaatggggaacattgggacagggaacattggctggcacaatttcggttccagtaatgtaggatcacgcaacataggcaagtaa

SEQ ID NO: 6604 - DNA, 357 bp, Chlorella protothecoides
atggtgaacagcggtgcctccacccccagcgactttgtgcgggccacctccaccgccgcggcccgggccttcaacatctacccgcgcaaggggagcgtggcgccggggtccgacgccgacgtcatcgtgctcgaccccagcgtgcgccacgtcatcagcgcggccacccatcactccgcggtggatgtcaacgtgtacgagggcatggaagtcaccgggaagtgccaatgcaagaacggagctggccacactgcggtgccagacgccgtccagccaccgcccaccagcagccacatggcagccactgccaccatgcttttgcggggagcaactgcgagtggcatggctgtgatctag

SEQ ID NO: 6605 - DNA, 381 bp, Chlorella protothecoides
atggcgaccgtggccgcccagggcataaactccttcaagttcttcatggcctacaagggctcctttatggtggaggacgacgcgctcctgcgcggcatggagcgctgcgccgcgctgggcgcgctggcccaggtgcacgccgagaacggtgcggcggtggcctggggccaggagcgcgtggcggcgcgcggcgtcaccgcgccgcacggccatgcgctttcccgccccgcagcgctcgaggacgaggccacgggcagagccctccggctggccgggctggcgggggcacgcctgtacatcgtgcacgtcatgtcggggggcgccgccgacgagattgcggccgccaggtgcgcaaatgagcggggggggtggtggcggtga

SEQ ID NO: 6606 - DNA, 357 bp, Chlorella protothecoides
atgtgggactccaacttcacggtggccgctgcccatgtcatgagcccccccatccgctccacgacgcacagggcgtcggtgcgccaggcgctggcaggcggcgtgctccaggtgagaggtttgcttgagggggaggaggttttgcgggggtcaaagggagaggggtgggatgggcctgacatgggagggccgggcgaggtgagagaggtgctgaactcctcgcctccccctgcgccccccgccccccgcaagattgtgggcacggatcacgcggtgttcaactcgacgcaaaaggcggctgggaaggaagacttccgcgccatccccaatggcgtcaatggcattgaggagaggtga

SEQ ID NO: 6607 - DNA, 357 bp, Chlorella protothecoides
atgcaggtgctggatgccactgggaagctggtcatgccggggggcatcgatcctcacacacatctggacatgccattcatgggccaagtctcctgcgacgactttgctaggtcaacgcctcaaagggggaaaaggtgcggcatccccacaccccagcaccccagcaccccccaccctcctcgccgccgcagtggccagcgagctgcgttggcggggggcaccaccatgcacatcgactttgtgctgcctgtggagcacgacctgctggcgggcctggaggcctggcgtaagaaagcacggcacggggtcatggactacggcttccacatggccgtcacctcctggtccaacaagtga

SEQ ID NO: 6608 - DNA, 294 bp, Chlorella protothecoides
atgctgagtgcgtgtggccaggcatggcgctggggatggcttctcactgggacgttcgcgccggcttcgagcccaaactccactgcgcaggcctccagcctgagcgagacgctgtccacgctgaacttcggcaagggcgtgacggagatcacgctgggcgcggccaggaagaacacggagccgggcgcggtgttcgaggcgcgggacgcggcgggtcggcacgagcgcgaggccgccgccgcacgcgtcgcgctggccgagcgctccgcgcgctgcgaggagttggagggcgag

SEQ ID NO: 6609 - DNA, 276 bp, Chlorella protothecoides
cgccgtgcccgacggcgcccaccgtgcccaggggccgagcgcctctgcgcccctcaccctcctgaatctgagcgtccatcggcgcccaggcccccgaccagaccccctcaccaacctcgaacccccttcacctcgcgcattcccgctttgcaggtcctgctgagccaggtgcaccgcttgcgcgccctggtcctgctcggccgcttcctggacatgggctcctgggcggtggacctcgcgctctcaggtgcacctggggtggatgggaggggttct

SEQ ID NO: 6610 - DNA, 1539 bp, Chlorella protothecoides
  modified_base (55)..(64): a, c, t, g, unknown or other
  modified_base (402)..(411): a, c, t, g, unknown or other
  modified_base (823)..(888): a, c, t, g, unknown or other
  modified_base (973)..(982): a, c, t, g, unknown or other
  modified_base (1495)..(1504): a, c, t, g, unknown or other
atgcctcgtgggagttccagagagttcttgtggggccacagggtcactcagacgnnnnnnnnnnttaccttgtgggagttccagagaattcttgtggggccacagggtcactcagacggcacatgcagattccctggtccaggggcaccctggcaacccaatcctctctccatcttaatcccaggtcctgttctatctcctgcgactggagccctttacgcgccatgcacgtgcgctgcaaggcggtcgcctggaccatgcggaccgcctcttccactctttggaggcaacatggcagaactgcttgaacagcacttcagcccgttggccagcactccaaaatctcagcatatcttgaagggtacagctgagtgcaacggcatgtgcatcatggaatgggcnnnnnnnnnngttcatcttgcgacaagcaacagggatgtagatggagagatgccctgcttgcttgattgtctgtgtggtagcccgttagccagcagttcaaaacctcagcatatgttgaagggtactgctgggtgcaacggcatgtgcatcatggaatgggcaaccccagaatacgtgaaggagctgactccagagttctactatctaccagactttctagagaacggcaatgcgtaccacttgggcacacgccagtatttgatgggctggaggaggagagatccgagtgctcgatgcgctgtgttgatcttgggctgtatccaagtggctgctgtccagtctgaagcatttccctgtctccaacctttttactgcttgcgccctttcctccaggatggcgtgcggctgggggacgttcagnnnnnnnnnnnnnnnnnnnnnnnnnnnnnnnnnnnnnnnnnnnnnnnnnnnnnnnnnnnnnnnnnngtggatagacttggtgtttggttgcaagcagcgaggtgcgtgggtagatcagtggaacatgtgagggtgtctgtgtgtgcatggnnnnnnnnnnattccctgtctccaacctgtttactgcttgcgccctttcctacaggatggcgtgcggctgggggacgttcagctgcccgcatgggctgggacctcgccccacaccttcatccacgccatgcgggaggcgctggaggggccccacgcctcagcctccatgcaccactggatagacttggtgtttggatgcaagcagcgaggtgcgtgggtggatgtgtagaacatggatgcatgcctgtgcagagcacgcatccataccctgctcccgaccccttggtcaaatcccaagtccataaacataccccctcgaccccaaaatatcaggccctgccgctgtggcggctgacaataccttctactacctcacctacgaggatatggtggacctggatcgaattgccgacccggtgcagcgcgccgcggtggccgctcagatccggcactttggccagacgcccagccagctgtttccccggcggccgcaccccccccgccgcccgccccccgccccctnnnnnnnnnnagctcctgacccctcggtcaaatccaaatccataa

SEQ ID NO: 6611 - DNA, 2328 bp, Chlorella protothecoides
  modified_base (278)..(287): a, c, t, g, unknown or other
  modified_base (936)..(945): a, c, t, g, unknown or other
atgctcagactaccaagcgcacctctcaccggcccatcggttgatctggcaagaagatcgaggtcatgtttataccgaaacaatcctgaggaatttggaatccatggacaggcaacgattccgcacattgatcggatgaagcgagcatcaagaataacattgcaatatcgaaaccacaatgtcatggcccatgtagcccgcatgcacacagatgggtgggcatggggcggcacgagggcccctcccgctcccacgcggcactgcagcccttacggtcnnnnnnnnnnctgttacaaccagaagcgagcatcaagaatagcattgcgatatcgaaaccacaatgccatggcccatgtagcccgcatgcatacaggtggatgggcatggggtggcacgagggcccctcccactcccacgcggcactgcagcccttacggtcgcatgacgctgcaaggaaggctaaacatcgtttgcctgtccactgaacagaagagggtggctgtaattggtgctggggcggcaggtctcaccgccgcttactttgcagccaaggctggggcccaggtgcttgaggttgggttgcgtatgggtgatgaggccggcaagaagatcctcatctcaggcggcaccagatgagctccctatagtcatgccacgatacgtcaagcccctcctcaaacacccccaaccctggtagtaatgtgctgcctgggagcgtggatttggacctggatttccagaccagcagccgggctgccggggtgcgcgtcatcctatctcactggagcctatcctcgtgcaaggagtggtgagcgtcggctggggcagcccggcacagtgtgggccgggggtgtcgttgcagaaggtgtttactatcgctcgatggaaatcccttgggagactcaatgcccctcgccccaggcctgcgacctgtgnnnnnnnnnncttactatcgctcgatgggaatccctcgggagactcgatgcccctcgccccaggcctgcgacctgtgcgttcccctgccctccctcggcgtgcaggctggagcgcgacctgggcatccgtctgtccttggacccggccaccaacaagtacttccccaccaccaactccgccaagacggtgcgggacgcgctgctgggcgcctgcctgcgggccggggtcagagtgcggtaccgctcgccctgcggtgccccggtccccgccggcggcggcggctgggcgctgggcctcgcggctggcgctgccacggcccctcgccccgccgccctggtcatggcggccgggggcgcctccttccccgcgctgggcacgacgggggacgggtacggcgcgctgggcgcactgggccacgccgtgcgcgcccctttcccggctctgacaccgctgacggggcggcaccccggcggcgcgcgcctggcggggttggcagtgcacggcgcagcgctggaggcgaggcgcccggggtcgaggcgcgcgttgcaggtgtcgccgcgcggggacgtgctgctgacccaccgcggctactcggggccggcggtgctggacctgtcccaccatgccgtccgggcgggcatggtgcgggtgggcgaggaggcgctgccaaaagggaaggccccacgccaggcgcccggcgccggtgaggaaggagggcttgcggggaggaggcacagcagacccctggctgcacatctgggcacctgccccctcagctcggagggatcactgttggcgacgcgacgtgcatgcaatcaagcatcccggcgcctgaccatcacctccagcagcctcttccaccgcacaccttctcctttgccccaacctcgcagacctctacctcagctggacgggtctggaccggcagggctgggaggcggtcctgcgcgccacgcccggcggcaagggcgcgggcgccacgctcaaggcacacggcgtgccggcgcgcctggcggccgcgctgtgccaggaggcgggcgtcgcgcccgaggagaggctggcgaacatcacccgcacccagcacgaggccctgctggcgaccctggcggggtggaagctgcccgtcagcggcgacgagggttttgccaaggtgggtgggtggaggagaccggcgtagcctgtgtgagtctggggatgcatcgtggtattggcctgagcctcaggtcgtgtcgcactccttgctggacccctaggatcctcaaaccccccgccctcccgcatgcacacgcaggccgaggtgtgcggcgggggggtgccgctggaggaggtgcactggtcgaccctggagagcgaggtcgtgccctccctgtacatatgtggggagctgcttga

SEQ ID NO: 6612 - DNA, 2094 bp, Chlorella protothecoides
  modified_base (101)..(110): a, c, t, g, unknown or other
  modified_base (1021)..(1030): a, c, t, g, unknown or other
  modified_base (1223)..(1232): a, c, t, g, unknown or other
  modified_base (2014)..(2023): a, c, t, g, unknown or other
atgaacaccaatgcagactgccttcgcctgccccccacgacatgcagccggtccccaccaccttcactccacacagaaaccgcccactccggagcccgatnnnnnnnnnncctggacctgagcaagtcctcatcccgcctgctcggccagagcggctcattatacgcatggacaccgatccagagtgccttcgcctgccccccacgacatacagccggtcaccaccaccttcactctacacagaaaccgcccactccggagcccgatcccaagaacgaggagtttgtgatgtttgtgcgcagcaagaagctgatgaagtgggtgcccctgtccatcatgaaggggggcaccgcggccaacatgctggtgaagagcatgcaggggaacctgggaaagaagatgtacaccaacaccctcatccggaacatagcgcaaggcctatacaaggtggagtggcctgggcgggctcgttgtcgtggatgcaggggaatgctgcaggccacggcagcctgctggcgggtgttttgcattggacctatagattcatgtgacgcctgctgcgcagtgtgcccttccatgtgcccaagaggttccactttggtccctcccaatccctccatgcaggatcggttggaggttgagcgccagctgcggaaccagtacccatttttcaaggagaccaaggagtttgagtatgccttcaagatcaggtatggggagcgaagtgtatttacaggatgggatgggtgggctcctcttcctaatgtccttgcacttatgagatcagcagcgcgagagttctggtcccatacaatacaattcgcctattcacgctgcaccctggctgaacctgtgaccccaccttgccatttgccagggacaagaccaagcccgaggagtgttgtctgggcgctattgattgctgacagcccaggttctgtcgcctgttccttgttgcattggtgttcaggaccccgcatgtcgcagcccagtgttgcgctctggcctgccagcacatgcnnnnnnnnnncgtcgcctgttccttgttgcaatggtgttcaggaccccgcatgtcgctgccgagtgttgcgctctggcctgccagcacatgccaggcaagaaggagaaagagaggatgcaaccacaaacatactggccatgaaagaaaagcaatgtgagtcgctgaccaagggttccagcgcctacaccgtggtcagctcctnnnnnnnnnntcctactggccatgaaagaaaaacaatgcgagtcgctcaccaagagttccagcgcctacaccgtggtcagctcctcgttcttggacttggccagcgcatcgatgctggcgacgtactcattcgtcagctcctgcacggcatcctccaggtccttgcgctcgtcctccccgattgcactttctttctcacgcttctctatggccttcatcgagtcgcgcctcacattcctgccgaggtggcaagaggggcatatggtgtgaagcccaaagatacacgccgctgcgagccagccgcaccttatggccaccttgccttcctcggccagcttggcaacaattttggtcatctccttgcgccggtcctgaggtggcatggggaaaggctcagtgtgagagggcacaggtctctcataagggcaaggcaaagcgaacgagcaggacgcctaactcccccttgggtagctggaggcatgctcccctcccaggccccccattcagtgcccctctggcctcaccgaggtgagcgccgggatctggagccggatgaggcggccattgttgttgggggtgaggcccaggtcagactgcattatggccttctcgatcactgcaatggcggaggtgtcgtaaggttggacgaccagcagggaggcctcgggggcgctgatgcctgccagctggcggagcggggtcggcgcgccgtagtagtccacctggcagtgtgggcagtcagagggtcaaaccagcgctccggggtgggaacctcgacccgacaaggctgcnnnnnnnnnnatcagagggtcaaacctgcactcctggggtgggaacctcgacccgacaaggctgcgcatctctcaagatag

SEQ ID NO: 6613 - DNA, 1617 bp, Chlorella protothecoides
  modified_base (1097)..(1106): a, c, t, g, unknown or other
  modified_base (1472)..(1481): a, c, t, g, unknown or other
atgacccggtccagggcggctggattggcacggccggtgcggacggtgccgaagctgcgccgagtggcctccatcgtcttctccatgcgttccatctgggaggaatgcaaggggatgcgtgggaatggcatagctaccatcgcacctgcagatgagccaagtaactctagggatctgggggcataccaggctgcacacactggccatgccctcctcgcaccgaggctcaccgtatcctcctcaatgtcgacctcgacagcatcactcccggtggcatgcaggacatgggacgtgagatttgcgggtgaagggatgagtagagggatgatgcgccgttgggccggcctgcgagacagggcgccagtcacggaggatgccgcttcacacttcatgagtaatatcaacttcattcctagctcaggggtggacacggtcgcggtggcaacctttgatgtagaggaagactgcatggtcgctttggccgggggaaacctagttgtctccgaatttctgctcgctcacaaggatctagaggccacagttccgggctccgatcccaatgcgatcagattgccgcgacgcatgcatgatggcccaggagtcattgtgaagaatgcaaggggcactcagtcgtttgttattccatttgtacctaattctatacattcatcgatgccaggtggtgaggttgtggcacccttgaagagtctgtattggaaaagctgtgcaccagccatgtgccccatgcaatgcaggaatagcatggaagttagagcaacacacggcgacaagggtcatctgcctcaactaggaacccagaaagcatcattatctcacaatttgatttcggaggcgtgtcgggaaggctcccttccacgccttgtcaagatgttggtcgttttcggcaagcagcggaagagtctcctttcgcccactaagcggaagaacacgctcatggtgacaccggaagaagaatctttcctggcctcgctgctggataatctgtacagcagcctgcccaggcgccagaggggctacgtccaagagcacatgttcggcgggggtggcaacggcatcgcgtatttggcctctgaccnnnnnnnnnngcctttccaagccccaagttgccacccaactttcccatcgttggatgaacacctttcatatccaccacaggctccaaccccacctcatggttgcttgggtcctgctccacacctagaaatactgtctggagttctgcacggcaactcagtatcttcttcttcctccctccgcttagatcctctggaggatatagaggaggccagttacatccttcaaaagtacgaggatgactggtgcacagatatcgtcagggagcgaccaaacttctccgcactccaagttttccaaggcccttttgcgtttgtcctcttcgaccggagctgcctacgaatcgtggcggggagggacgcgggtggcgaggagcnnnnnnnnnntgaccggagctgcctacgaatcatggcggggagggacgcgggtggcgaggagcccctctactggggagctgccctgctcagcgacggcctcctcttcgccagtgacaggcaagggttgtgggtttctctcggatga

SEQ ID NO: 6614 - DNA, 2436 bp, Chlorella protothecoides
  modified_base (1599)..(1608): a, c, t, g, unknown or other
  modified_base (1784)..(1793): a, c, t, g, unknown or other
atgtgcgtgcatgaagcagtgggcatccgtcgcaagtcaggaatacccagggccaaaacctcagcgctgtgcgtacgaggctcgccctcaagggttgctgatgtgtggccacaggatgctggtgagtgggcagggacaatgctgtcagtttggacagaggtgccatgcatcgtgcacagaggggcaggtgtgcatccacagctgcattgctgggatgagtacaagaccaaggactgtctgtgggacaaagctgccatgacatcttcccaggccaagatgggtgtccatgaggcacagcatgctgtgcccagcatccctcgcatggacatcggcgctgcaccttcggggtctggccccctcccgacgagggtccgcctgcggcggcgcgggtcggggcacacgcgctcagggcctggcgttgccgtttggccccgcccccgcggcgccgcccacccacggcacctcctgcgctaccagtgtcaggctgagcgtgcccgccccaggcctggccacctgcagcaccaggggcttgccgatgctgtcccccagcgcggcgacgagggccttggtggtgggaggcgcgccgcgcgccgcgccagcccaccccgtgaccacgtccccctggcgcaggccggcgcggtcggcgggcgacccgggcgtcaccgccggcaccaggatgcccgcggtcacgtccgggaaccccgggtcgcgctcgcggaagcgcgcggcgctgtgccgcgtcagctccagcatcttgatgccgacgtggggccggatgacgcggccgtgcgccgccagctggcgcatgacgtctatcgcggtgtccacggggatggcgaaggagacgccgtcggcggccagggccttcatgcagctgatgcccaccacctcgcccgccaggttgagcagcggcccgccgctgttcccgcggttgatggcggcgtcggtctggatgtagtcggtgcgcgcgccggccaggcccagctccgccgcgcggcggtcgacgcaggagacgatgcccgcggtgacgctgttctggaggtgcaggggggagcccagggccaccacccactccccgacgcggaggcgggaggcggagcccagccgcacgcagggcagcggcgcgccagcctccacgcgcaccaccgccaggtcagagacggcgtcggaggagaccacgcgcccctcaaaaacgcgcccgtcctgcagcgttacggtcacggcgccaccggcgccggcgggggtgccggcggccccgccgccgcggcgcggcgcgggcagcgcgtccgccaccacgtgcgcgttggtcaggatggtgccatcggggtcgcacaggaagccggagccggaggagccgacggggaaggggccgcggccgaccaccacgatgttgaccacgccgggggcggccttggctgccgcgtccgcgatgaagtggggggagaggcaggggggcccgggagcggtctgggacagggcgccgaaagacggcaggtgccctggtggtcccgggggaggagtgaaggggcgtcgtcgttcatgaaggggatgaggagcgttgtggtgggagggagcacagggtggggcgcgaggacgctnnnnnnnnnnggggggaggagtgaaggggcgtcggcgttcatgaaggggatgaggagcgttgtggcggaagggagcacagggtggggcgcgaggacgctccagaaagtcagcctgttccccggcgcatcccccctccatccccgccgctcgtccagagatccctgcgacctccccctggccttccnnnnnnnnnncctccatcctcatcaacacacacgcgctgcacctgccagctggtgggagagggccgacgcagcgcccggcgtagaagatggcgtggaggctgccccgccgtgctgcgccacgcccagcctgtcgacaggcggctctccggcagagtgccgctgccgcccagcgccgagggtgcagcctcgggctttggcacccctggggcaacccctcccttggagggcatcccagaccacagctggcgcgatcgcagggccaggagctgcacatccttggacaaccggcgcctcattgggagggtctgggggtctgagtgccccgcggagggagcagcctcacacaaaggccgagagtctccaggcctgggggttcgcactgcatctcggggcctccaggcatttgcaattctctggctaccgtgctggaaatttcttcgtcgctccaagagccacgatgtgctcccaaggtgagggtttcgatccccgggacacgactcttcaaatacaaagtccggaatcccccatccacattcccgccacagtcgaggtgggacaggcacagactctcgcccgatcgccccagcctccggccaagaggcttgccatcgcattgcaacacatactgaaccccttgccatgtctgacatag

SEQ ID NO: 6615 - DNA, 249 bp, Chlorella protothecoides
atgccacctcaggaccggcgcaaggagatgaccaaaattgttgccaagctggccgaggaaggcaaggtggccataaggaatgtgaggcgcgactcgatgaaggccatagagaagcgtgagaaagaaagtgcaatcggggaggacgagcgcaaggacctggaggatgccgtgcaggagctgacgaatgagtacgtcgccagcatcgatgcgctggccaagtccaagaacgaggagctgaccacggtgtag

SEQ ID NO: 6616 - DNA, 300 bp, Chlorella protothecoides
atggagaagacgatggaggccactcggcgcagcttcggcaccgtccgcaccggccgtgccaatccagccgccctggaccgggtggactactacggcgcgccgaccccgctccgccagctggcaggcatcagcgcccccgaggcctccctgctggtcgtccaaccttacgacacctccgccattgcagtgatcgagaaggccataatgcagtctgacctgggcctcacccccaacaacaatggccgcctcatccggctccagatcccggcgctcacctcggtgaggccagaggggcactga

SEQ ID NO: 6617 - DNA, 657 bp, Chlorella protothecoides
atgcgatcttgtgcggagttctggagcgggaggcaaaggctcgatgcacggcgttggggtcagcaaggccgcgcaacacagagttcactgggccggcgggtgacccagcggccactgatcccatgcagctccagcgctgcatccatccccccaccctcgccctcctcgacaggtgattgcggacctggtggactcgtgccggaaccacgactacaccgacctcattgtggtgcacgaacaccgcggcgagccggacggcttggtggtctgccacctgccctacggccccaccgcctactttggcctcttcaacacgtcgatcacctgctgcatgtgtgctcacatcatccttcgccacccctcccccgcccctctcgaacccaggtcttgaggcatgacatcggcgacaagaagacggtggggacggtatcggaggcgtaccctcacttgatcctagacaatttttcctcccgcctgggaagccgggtgtccaacatcctcaagcacctcttccctgtgcccaagctcgacaccaagcgagtcatcacatttgccaaccaggtagacggggaggggttggggttggcgacgtggagaagaccggctaatgggagcatgcacatggccatcccagcctcagtggtacaattactctga

SEQ ID NO: 6618 - DNA, 1059 bp, Chlorella protothecoides
atgtcgacatccccctcaccatcaacacaacaggaggccaacacgtcgttcaagatccgaggcgtggtggagggcttgctcccggacaccctgcgccgcatcccgatcgagaagcggttcaaccgcgcgtacgtgcgcgagatctgccgcgaggcggacgggtcccagccgcacctggtctcccccgagcgcggcatccggcgcctggtggcggaggccatgctgctgaccaacgaccacgtgcaccgcttcgtggacgaggtgcatggcgtgctacaggacacggtgcgcgaggcagcgcggcgctccgtgctggccgaggccggcctgggcgccacgcccggcatggagttcctgcgcctcaagggcttcgagaacgcagtggtggtggccgccgaccgcgcgctggaggagtggaaggcagaggcccacaaggtggccagcaccatggtggccatggagtgcgactacgtgaccccctccttcttccgcgagctggagcgggagtggcaggaggcgcagcacggcggcgcagggggcgacggcgaggagggcgcagggggtggggccgggccgggcgcgccggcgatccgggatgcgggcgacgacgacgacgacgactcggaggacggcgtggccgatggcgaggcggggcgcgggtccgcgaccccgggctcggccccaccacccgtctccaccgcccccgacctgaagggcggctggctggacaagcggtcgggggacagctcctcgctcaacgccctccccgtcgactcctggaagtggcagcggcgctggttcgtgctggcgggggccgcgggcgtgctggcctacttccgcaacccggaggaggcggcggggcgcaccgcccagccccgcgtcaccatcccgctcaaggcctgcgtggtggacgacttcgccgccgcgccgcgcgccggcggcgccgacgcgctgctcatccgcatcgcgcaccgcgacccggcgcagcccgtggccaaggcccaccactcggtggtcctgcgcgccgccgacgccgcggacaagaccgagtggctggcg

SEQ ID NO: 6619 - DNA, 414 bp, Chlorella protothecoides
atgcagactctggttggcgtacttggtctcccccgcccctcaatgttcctccattccgctggcctttctcaccaggctaggacacggcagaccttggccaccagcacggagctcgatgcggatgagcaggagtttgcgctgctctggaacgtctggctgcgagtacacaagctgtaccgggatgccgacatggcagacacctgccgcgctttcttcgcgcactatgtggacctccaggcagacacccccatgcggcgctgcttcgtctcgcacctgctcatgctctggtcttaccgcctcctgtccccggaagacgtgcagcgggtgctgcggctgcctgtgttgagcccggcactggggccatcacagcccctccttgcagcacagtctgcacccagcttggttcagcagtga

SEQ ID NO: 6620 - DNA, 561 bp, Chlorella protothecoides
atgctgcgccgcaatgcgcggctgcgcaaggagtacctgtaccgaaaaagtctagagggaaaagagaaggaacagtatgagaagaagcgtctcatcagacaggctctcgccgcgttgagcccagcgtgcaccctcgcccatgcccctgtcccgccccctaccccgcctgcagacggcaagcccatccccagcgagctccgcaaggaggaggccactctgcgccatgacgtggcgcttgaggacgacaacaccgccgtgccgcggagccacgtggatgacgagtatgcgcgcgccggcgaacgcgacccccggccgctcatcaccacctcgcgcgacccctcttcccgcctcgtccagttcgccaaggagctgaagctggtgttccccaactccatccgcatcaaccgcggagggaacgtgagccaaaggatgaggggggggggtactggaatggggcaggacggcacgtgggccggtcatggaatgcgggggttgggaaaggctctggagcaggggccgccccaaactgttttctgcacctgcctgcccggcagccgctag

SEQ ID NO: 6621 - DNA, 1614 bp, Chlorella protothecoides
atggttgggtggagctacctccacctcgtcctcggcttcgatgccgctgtgtacaccatccacacctggctggacgctcgacagctacgggccctgcgccgggcccacccccccaaagagctggcgcacctgtacccggccccgcaggactacgccagcaagcaggcgtacagcctggacagcctctgcttcggcatggcgcgcggcgcctttgactccgccctctccgcagcgctgctcctttccggcttcctgccctggtcctggaacgcggtgggccacctcctcggcggtgcccaccggcccatcgcacaggccgtgctctggacgctgctgaccagcggtctgaacgccacgctgggcctgccctggtccctggcgcggacctttggcctggaagcccggcacggcttcaacaagaccagccccgccacgtttgcaatggatgccctcaagtccctgggcctgggcctggccctggggccaccgctgatcgccgccgtggctttcatcctggagagggctgggccctgggtggcgctgcacctctgggccttcctcctggccatgagcatggtattgatggcgctgtaccccagcgtcatcgcgccccttttcaacagcttcacgcccctgccgcagggccagctcagggcaccgccggagacatctggccatagcatcgggggcaaggacctcgtccttgtcactcagccaggcggcggccttgtccacccgttcctacccactcgatcaacccccaccaacaaaagggaggagatcgaggcgctggcggcctcgctccacttccccctgaccaagctctttgtcatcgacggctccaagcgctccgcccactccaacgcctacatgtacggcttctggaggaacaagcgcatcgtgctctacgacaccctcatcgagcagtccagcgtgccccaggcaggtggctgggctgaggaccgaaacacgctcgcccccacgcttaaacccatccccgccgccctttcctccgcgcctcacacgcaggtggtggccgtgctggcccacgagctggggcactgggcgttggggcacacgccgcgcctcctcgcggcggcccaggtccagattctgggccagctggcgctattcaccgcgctgcgggccagccccaccctggcctccagctttgggtttgaccctgtgacctcgccccccttcatcgcctttgtgctcttccagtacttatcggggcccctggacgaggtgagggggggaagagggccaggggggaagctttgggagtgggggaaagaagggaaattgaagacttcccgggagccgggcgcccggcgactgtgcgagtcaggggcgttgggctgcctgaacaactacgtgacgcggcgtttcgaattccaggctgacgcgtttggcgtcgcgcagggccgcgccgaggacctcaaggccgcgctgctggtcttggacaaggagaacaagtcgccgccgcacactgacccgctttactcggcctaccactacagccacccgcccctgctggagcggctgagggccatcgacgccgccgtggcgcggggcggcagctgcgctgcggaggccaagaagaaggaatga

SEQ ID NO: 6622 - DNA, 597 bp, Chlorella protothecoides
  modified_base (184)..(251): a, c, t, g, unknown or other
gcggctcgccgccggggtcgctgtcgctgggcgcgcgcgcgcgcggcgacttccccgcctcgcgcgacatgcccacgccggacgtgcggctgtaccaccgcgccgtggtcgtggcgcaggacgtgcagggcgagctgcgcggcctggttcgccagctgtccatcgaccagttcgagaacgaggnnnnnnnnnnnnnnnnnnnnnnnnnnnnnnnnnnnnnnnnnnnnnnnnnnnnnnnnnnnnnnnnnnnngcgcgtgtcgctgggcggcgccgcgggggacgggccgccggggtcggggcgcagccgcaccccgcttttcgaacgcgcgttctccatgccggtgagcgcacgtgcctcgctgtgttggggcggggggggaggcgaggggccggcgtgggcgaggcgaggggccggcgtgggcggggctcccgccagggccagagggtgggccggacctgggggctgggccaccgagccgccgacgtgtcgtcggtgggaggtagactgtgcgcgccaagggggaacagggggcgcggcggaatactcgtatgagcatggggagggtcggcagcgaacagagacacaggctggatag

SEQ ID NO: 6623 - DNA, 552 bp, Chlorella protothecoides
atgcagacgcacggcatgcacaagcaggtgctgcgggagctgctcatcccacggcactggcgaccaccggagtcgcgcgacttcttcctggacgccgacgccatccacacattgtgcgatcaggcagaggccatcttccaggcggagcccaccctactgcggctcaggggtaggtgtggtgattttggtcggctagaaagggggaaaggggaggggggcacgcggggtcagagagacttgccatggggctcgggagtctgtggtattggaagtgcacggggatgtatgctggtcaccggtctcgtggacagctccaggtcacgccaggcctgcccgcctgcacatacaaccacactttcacaaatcccgcctaaacttcctgaaccaacagcgcccgtcaagatctttggggacctgcacggccagttcggggacctgatgcggctgttcgaggagtacggcacgccctccacctccggcgacatcacctacattgactacctggtgggagttggtttttgggaggggggggttctctggcaggagaattaa

SEQ ID NO: 6624 - DNA, 2169 bp, Chlorella protothecoides
  modified_base (228)..(237): a, c, t, g, unknown or other
  modified_base (1215)..(1224): a, c, t, g, unknown or other
atgggcaacgacagcaagggcacccagcatgggatggcagggccggcttgcagcgagggcgcatgcttgcacaatcattgccctgccttggtgggcgcctgtgcctcagggcatctacaactccaggatgggacggggtttggcgtcctggtgcatcaagccgcaagcctggagacggtgggtgatgaagtgtacgtcccgttgttaagagggctagtcctcccgctnnnnnnnnnnagcctggagacggaggtggttgacaccacgggcgctggggacgccttcctgggctcgctcctggtcagtgtgtctgttggtgccagcctggaagctgccgcgaagctgggcacggttgtcgctgcggccaagtgcactgagctgggggcgcggacgggcatgccccacctagcccagctgcacccctccctgcaagcttgcgagaaccccaagaagagcaaggggttggtggcccactgttcactttctcagactgtcagcctacctgctcagcacagtgcttggcagcaccccggtctcctgcggcacacagtgcaatgcaacaccattgcagccgcccctgcttcccaggcgccgccgcaactttgtttctgctacatcatgcgcttgcaagctgggactcaggtgaatgatggtcgaatggggggaagagagggtgggagtcaacaccattcgcacatcggggaacttccatgggaggtcccttcatcaagtttccctcccagcaatgccaggctcggggcctttgagaatgaggccatgcacgacacagcagaatggggtttacccataggccgcatgcaccctacccaccaatatcaccccgacccccttccaagagcgccagcccacctgcatccacatgtcgcccgaggaggggtggggtgtgggcgggtcctcgatgatctcctcccccgccagggtggggctgtgcggttgtcgcggcgtcgtcgggggcagcgggtggatcagcttgggcaccatcacctgtgccgcatgcatgaatgcatgcagtggctctacgatctgcgcagccaggcccgggatggcagcctggattggcccacatgtcgttgtctgcacattcccatcgacccctcctgcagcttctgcacatcatcaggttccagcctctgcataccccccacaccaagccctcatcgtctgacgacccggccctcccccccaaaccctccnnnnnnnnnnatcgacccctcctgcagcttctgcacatcaccaggttccagcctctgcaccccccccacaccaagccctcatcgtccgacgacccggcccttccccccaaaccctcttcccccatctctggccacccaccaggtccctgcccaggacgagcacggcccccgcgttattggcggtgccgcagtagttggtggcggagaagagggtgatgaggcggccgtgcgcgaagcgctcgaagccatccatcacgcactcgtgagcgcgcacgatcatctgcagctcgttcgcctggcagaactccagcacgcggtcggggccaaaggtgaccaggcccgggccgcgcgggctgggctgcaccccctccaccgcgtcgttggtggtggggtcggaccagagcaggtccatcagcaccacgccgccgtcctccatggtgagcgggcgcgccagctccgcgatctgctccatgctgtggatggagcgcccgatgccgccgtgcatgcacagaaccttgtcctcgatcaccgccgccaggggcagccagttgaagagctggttgaagcggttccaggcgcgcaggccctccggctcgcccagccgctccacgcactccaaccggaagccgaagagggcgttgatgtcggaggcctcgtggttgccccggatcaggtgcacgttctcggggtggtcgatcttcagcgccagcagcaggcacatgtgagggattgggggaggcaactgcacaggcaaaacacgtgggccggtgaacgggagggcctggaaccatggcgaaggctgaaatggcaaggttgcgccgcccgatgcgggttcaaagtggctcacccactcttcccatgtttggaatggcactcggcccatggtgtatggtgggacccctctgcccccggcccgctacctgaccggctgggaccccactcctccctgccttaa

SEQ ID NO: 6625 - DNA, 696 bp, Chlorella protothecoides
  modified_base (92)..(101): a, c, t, g, unknown or other
  modified_base (422)..(431): a, c, t, g, unknown or other
atgggagacatccggaagcagcggtgcagcttctgggtggtgcgcatgcgagaggtgcgtgagtcagtcggcgatggtgttaccatggcccnnnnnnnnnngctggtgttcttggatgggagacatccggaggcagcggtgcagcttctgggcggtgcgcatgcgagaggcgttcctgtcctggtggaggcggaaaagccacggccggggcttgatgtcctgctgcaaggcgctcagtatgtgtacaccaacgccaccttccccaaggtgagcatcgcattgcagaggggatgcaggtgcagctgtagagaccagggtggccacaattttcaagagcgatggccgacagggacagcaaatgcatggcatcgtcaggccattgtccactgcctcgggacgccacctgcacaggccttcatgannnnnnnnnnacgccaccttccccaaggccattgtccactgtcggggacaccacctgaacaggccttcatggctctcttgcaaccttcgctcagcatgaacagcgctcctcgctcccaataccccccacccccaccccaagacgtggacccaggaactctcgctgggctccgccctgctgtgcatgctgaggagactgacctcagcccgctggctggtcaccacactgggtccgagcgggttggtggcattccaacggcaggaaggcagtggtga

SEQ ID NO: 6626 - DNA, 1455 bp, Chlorella protothecoides
  modified_base (402)..(411): a, c, t, g, unknown or other
  modified_base (491)..(500): a, c, t, g, unknown or other
  modified_base (1295)..(1304): a, c, t, g, unknown or other
atggcagcacgtggccgtccctctcgagtggatcaacatgatcccaaagttcggttttcattgccggaaacagtcccggtgctgcatggacaagaacccggagccatgctttttgccgtggggtcaaggtctgtttccattccagatcacggtgtcgcgcaccgtgcaggcacctcctcggagcacaccgtgccgccaacacaccgagtgaatcatcgacgcagcttgcttgccgccgtaccgggcttcccaattttgcacttgcttctgcctcgtttggcagcctctcaagaagccgagcttgtcaacaaagtttcacccctgtccaaccttttacagtccccagcaggcatgatggcccatttggagacctgcactctgactggacatccattcctgccnnnnnnnnnnggtgaatcatcgacgcagcttgcttgccgctgtgccgggcttcccaatcttgcacttgcttctgcctcgtttggcagccnnnnnnnnnngacattctaccgatctcggcagcaggcgggtggcggagccaagatcctggcacccatccgcgggtccagagccggcctggaacgctgccgcttcatattgaatgatgggggtcccaacccgtacgtggccatgctacggctggcaaggagtgcctccatgaactgctatctgtacgaacctaacgctggggaggggtgggaggcgcgcgcatctctcatccaacagagcctgccattcagcgacccttgcacgcttcgcttgatgcgatcactgaagcgatataaaagagagcagttgccatatttgagcctcccatccttctactgcacacttcattcacagatacaagaacagcatcaccctgaacaaggaccctgcgctccagcagcaagggaaggtgcaactagaacgtctgatcaggctgtaccgggccatgcgggagtacatgttgatttgctcaagtgggccctgcgagagtacacgttgatttgctcaagcggtgctgtagttgcctttcgtcttgaggttgacgatcaccggtcgtctcaccagccgctctttgcgatcctgtccaaaggaacttccagcttttggatgacatgctggagcgggcgtcgcagggggaccaggcagcagtgcagcaggtgcccaaaattcttgatgacgccatcgagactaatgctggttttgaggccaccatccttgcatgcctggggttgtgagatggccactatgtgtgtggattcactagcagatgatcgcttggcagccattgagcaagggcaatacacccnnnnnnnnnntaagcccagcgtctcatgctcactcgttgacggggaatgcacgactcacagggcaatacacccgtgcgattggagcacgaagccgatagccgtcgggcaaacgtcgcgcgaaagacctgccgtgatacttgaacatgaagtggaacaatag

SEQ ID NO: 6627 - DNA, 984 bp, Chlorella protothecoides
atggccgaaacactccgctccctcactcgacgcccccctcctcctttgcagatcgtggggcgctacttcaaggtgaaggagaggaacaccagcttcacccaggagctgcgcggtggcagtgtgaccttcctcacggtgcgctggcggcctggcatttgtcagtcgagggacacatcggggcgggctgtcggggtggcgtacatcctggcagtgaacgctggcatcctggccgacaccggcggcatctgccccaccaacggcgcctgcccgctgggccccggcagcatcggcacggcggcctgcgacgactgcgtggccaacaccaagcgctccttcatctccgccaccgccgccatctgcgtcatcgccaacttcctgatgggcatcatgggcaatctgccgctggccatcgcccccggcatgggcctgaacgcctacttcacctacaccgtggtcggcttcttcggcacgggcatggtcacctaccagatggccctggccgccgtcttcatcgaggggttcatcttcgtcttcatctccgtcatcggcctgcgcacctggctcaccaccatcgtgcccaagtccatctggctggcctcctccgcgggcatcggcgccttcctggccttcatcgggctgcagcaggcggagggcctgggcgtggtgacctacaacggggccaccgccgtgggcctgggcggctgcccccccggctaccgcaaccaccagtacaccttctccaccgcgcagctggagtcggcctgcatcctgtccgacggcgcggccatcgccaaccccgccaactcgggctggacgccctccagcaactacttttgcgagagcgcgggcgtcatgcgctctggccagacctggctgggcatcgcgggtgggagggggggaaagggacgacgtcgtgaggatgggttggggaccatggggttcgctttggcgctggagtggcggcggcgcccgcttgcggtgtga

SEQ ID NO: 6628 - DNA, 645 bp, Chlorella protothecoides
atgggcaggccacgaaagccttttatcgacaagaagaattccacaacttataatctcattcatagaaatacagatgctggcgaagtggtggatgcttctggtcgcgtgttcgtggacgccggcaagggagtgggactgggccgggtggacgaggaggctgcagctgcagcgcgcgcagcctctggaactgcgaacaggaggtattcagaggcgcttgtttgggcttgggagtttgagagggccagataccccccgggacacccccttgcctggctggaggccgaggagagcggcccctccagctccctcacccctgcgcggcgtcgcgagctgatcgagctgggcttcccagatgacggctacgactacctggcccacctgagggcgctgggcggcggcagcaacgccctggagggacccgacaggagcgagccggccgcggcggtcgggcccggggtcttcgtcccagcgcaaaagcccctggcccccgccgccgacgtggcgctgtacgatgcgcacgccctggcgctgccggacggggcggtgaaggaggaggaagaggaggccgagggggccatgggcggcgtcaccgccttcacgcgccggcgcgagcgcgcccccgctgccataggtgagggtaattga

SEQ ID NO: 6629 - DNA, 1119 bp, Chlorella protothecoides
atggttccaggccctcccgttcaccggcccacgtgttttgcctgtgcagttgcctcccccaatccctcactgttccgcaccatctcagatcccccttccccctctccttataaaaagttcctgggcgactacgtggaccgcggcgctcactcgctggagaccatgtgcctgctgctggcgctgaagatcgaccaccccgagaacgtgcacctgatccggggcaaccacgaggcctccgacatcaacgccctcttcggcttccggttggagtgcgtggagcggctgggcgagccggagggcctgcgcgcctggaaccgcttcaaccagctcttcaactggctgcccctggcggcggtgatcgaggacaaggttctgtgcatgcacggcggcatcgggcgctccatccacagcatggagcagatcgcggagctggcgcgcccgctcaccatggaggacggcggcgtggtgctgatggacctgctctggtccgaccccaccaccaacgacgcggtggagggggtgcagcccagcccgcgcggcccgggcctggtcacctttggccccgaccgcgtgctggagttctgccaggcgaacgagctgcagatgatcgtgcgcgctcacgagtgcgtgatggatggcttcgagcgcttcgcgcacggccgcctcatcaccctcttctccgccaccaactactgcggcaccgccaataacgcgggggccgtgctcgtcctgggcagggacctggtgggtggccagagatgggggaagaggacaacgacatgtgggccaatccaggctgccatcccgggcctggctgcgcagatcgtagagccactgcatgcattcatgcatgcggctgcacccgacccaggtaccccatacgacgaaagacccctgtcggaaaccccccccccactcacacatgcacccaccacaggtgatggtgcccaagctgatccacccgctgcccccgacgacgccgcgacaaccgcacagccccaccctggcgggggaggagatcatcgaggacccgcccacaccccacccctcctcgggcgacatgtggatgcaggtgggctggcgctcttggaagggggtcggggtgatattggtgggtag

SEQ ID NO: 6630 - DNA, 609 bp, Chlorella protothecoides
atggtggttcatgcagtgggaccccgtccggaccatgtcgcggccatgagcggcatcgccagctccagcgcggcagcggacagacagcggggtgcaaagcatcagcagcctgagaaccggtgtgcataccgccatcggccatcgcgttaccccatcgtcggctccgcgatgaaggagccccgcccggctcagctcgactgcgcggtcctgggtctggggtcctgtggtctggacaccctggccctcgtggactccttccccgcccctgacgaaaagatccgcgccagacggcttttgatccagggcggcggtaactgcgccaacgccctcactgccgctgcacgtctgggtgcacccgtggccatcatcagcaaggcagggagtgacgctgctggaagcagcattgaggctgagttgcagggggagggcatcgacacccagtgccttctgttctccaagaccggcccctcgcccacaacctacatcatagtggatgcagcaggtgggttggggccgagaaatggcccttgctggttgccgaatcgagtgttcatcgagctcatgatgtcagttgtggtcgtcattatgcaagtgttgcagggaacctga

SEQ ID NO: 6631 - DNA, 966 bp, Chlorella protothecoides
atggcggtgctgctggccaagaacctgaagggcgcgctgatggtgggcatcctgttcgtcaccttcatctcctggatcccctcctccggcaaccacgccgcatacctgggctcctcggcggggcccgggggccaggagcggctggactacttccgcaaggtggtggcggtgcccgacaccagctacaccgcggcccagctcgatttctccggcttcaagaccggccagctctggctcgcgctcatcaccttcctctacgtcgacttcctggactgcacggggaccctctactccatggccaacttcctgggcctctacatccctaacttcattgacaagaagacgctgcagttcgagcgccagctccccgccttctgcgtggacggcgtgtccatcaccgtcggtgcagtgctgggcacctccccggtcaccgtcttcgtggaaagcgcgtcgggcatcagggagggcgcgcgcacgggcattgccgccctcatgataagcttctggttcatcgtctccctcttcttcaccccgctcctggccagcatcccgccgtacgccacgggtcccgcgctggtcctggtcggcgccatgatggtgatcaacatcgtgaagatcgactgggccaacatccaggaggcggtgcccgccttcctcaccttcatcgtcatgccgctgacctactccattgcctacggcgtcatcgcgggcatcatgtcctggatcatcatcaacggctccgtggccgcctggaactacgtgagcctcaagatctggggccggccagaccacgtggaggaggggtccagctggaagatggtccgccaggagagcgaagccctgcacaccttccaggacccctccaccaggggcatgaaggatggggacgagtcgccctctgcctcccaggccgccgccgaggtcgagctgggcggcaagtcggtggacaccagcgtcaagccctga

SEQ ID NO: 6632 - DNA, 1230 bp, Chlorella protothecoides
gccgcggagacgcgccgcaaggcacaggccgcgctgcgcgaccgggacagcgacgggctgagcgcgctgcgcgcgctgtgcgcctacctggcgcacggccgcgacgcgggctgggctgccggcgccgggctgcacgcgcggcacctggaggaggccgtggccctccgcgcccagctggcccgtgtgcttgccgcctgccccgtgggtggactggggggggaccatgcgttcagcctggctgccctggacggcgtgaagccgctgccggcgccggggccggcggtggccgacgccctgcgccgggccatgctggcgggctggcctgaccgcgtggccaggcgccagcgctccgcagagtacctggcagggcagagggagcaggtatggatcttgggtcggggggggagaccggatcaagtgggtgtgaaggggagggcagtgacgcttctcccacacttggttgtgtgggacgagaccccctggcaagcaggcaagcgcgatcgtcagccgcttcacgcctccatcctctcctcgttcaccaagccacctacccggcccaccccacagggctacagctcccgcgcggtgcggtaccaggccgcggagctggaggagccggtgttcctgcaccccctctccggcctgcaccgcgcgccccccgcattcctgctctacacagacctggtgcgcaccgccaagcgaccctatgtctccggggtcacggccctggacccggcctggctccccgccaccgccgccgcgctgtgcagcctgagcgcacccctccccgccccggcccccttctacagccccgcccgcgatgcggtgctggcctggcacgaggtgaccttcggccgccacggctgggccatgccgcgcaccgccgcgccccaccccgacccagctgagcgctgcgcgcgcttcgccgcggcgctgctggagggcagggtgctgccggcgctggagccgctggcggggggtctggccgccccgcccgccgccctggcgcggccggaggccaggggtggggccagggtctcgaacctcctgctggccctggagcgggcgggggtggactcgcggcggagcctgctggcggccctgcgggacgagccagggttcctcctccgagagctacgagcctggtaccccgcgccggccctgcccatactgcagcaggcctgggctgcgcttctgggaggggcgtgccgggaaggagtgcccgcttga

SEQ ID NO: 6633 - DNA, 1260 bp, Chlorella protothecoides
  modified_base (864)..(873): a, c, t, g, unknown or other
atgctgccggtctatttcaccatttcggaagctccagagcataagcaaccaggccacgtagagagaccagagagaattgcagccatccaggctgctctccagtcgtcgggtctattggacaaccttaaccaggttcacagaacgattcctggagagattagagatgctgtcattgacagcgtgcatgcataccgcgacgccctcctgtccagaggggcggcggcgcctggaccatacatcggtgacacactggcaattgcagactttgacgatcccgacggccagaccttcctcacctctgcatcactgcccctggcattgcaggcatgccgtgagtctgacgctgagcaccctgagccaagtcgtgttgagcagctgccccggggtctgcttcctgcggcccccgggacaccatgccacaacagcgggtgtgtggctgtgatctgtgtgcatgatgggtgtggtgctggtggaacgttttggcgccagtctccgttttggcaggcgaaggtcatgattctggattttgacgtgcaccatggcaacgggacgtgcgagatcttcgacacggatccctcggtgctggtgctggatgtgcacgaagaaagcgcggtctacctggagtacgggtcgggcgtggacgatgctgggcgtggggagggcgggggcttcaccatcaatgtgcccctgccccgtgcgtgggatgcaggcatgctcccagtcttctgtggtgcgtgcagtgcagtgcacacggtgcgcagtttgcgtacaggtattgcttgcacccattcgatgtggcaatgttcgttccctacaccgttgatgtccagccacagacactccacccctcccctgtgccttccnnnnnnnnnngcgtgcagtgcagtgcacacggtgcgcagtctgcgtacaggcattggttgcaccctttggatgtggcattgttcgttccctacaccgctgatgtccagccacagacactccaccccttccctgtgccttctcccagggggcgccggccatgccagcgtactcaaggtgtgggatgacatcgtcgcacccgccgctgagcgcttccgtcccgacctcatcctggtgtcggccggctttgatgcgcacgaggacgaccctttccagctcctgtgctaccggactgagacctacggcgagctggcctcccgcctctgcgccctggcgacccgtctgtgtggtgagtgccaccctgcatatgtctgcggttggttcctggccagggtttag

SEQ ID NO: 6634 - DNA, 441 bp, Chlorella protothecoides
  modified_base (323)..(332): a, c, t, g, unknown or other
atgcctcagctcttctccctggggcaccaccagtgccgctggaactacaaagatgaggcggacatcgcggcggtggatgctgggtttgaggagcatgccctgccctatgatgtgctgtggctagacatcgagcacaccgacggcaagaggtgggtggggcgaaggagctgcggcgattgcgcgtctcttagaaaggcggggtgctggccgagcaatctattgcttggtctggaatgctctctagggtttccaagaatcctcaggccctcgccaagtctcccaagagcatgccgggaaggatgctgctgtggctgggccactcnnnnnnnnnncactctctggggtttccaagagtcctcaggcccttgccaagtctcccaagagcatgctgggaaggatgctgctgtggctgggccactctatgcgcagactccttcctga

SEQ ID NO: 6635 - DNA, 351 bp, Chlorella protothecoides
  modified_base (101)..(110): a, c, t, g, unknown or other
atggtcggtggaggggtgatgaatgggggaggggtgatgatcgggggaggggtgatgattggtggaggggtgataatggggggagaggtgatgatgggttnnnnnnnnnngggaggggtgatgattggtggaggggtgatggttgggggagaggtgatgattggtggagaagtgatggttgggggagaggtgatggtgggagagttgtgcaaattgaggtatccagatgcatgccaatggcgggcagaaacccagagtgagggcccccccacccctgactggccacccccacgcactttgcgcccccgcgacgcaaggtcgctctgcatcgcaatcgggtttgggaagtag

SEQ ID NO: 6636 - DNA, 456 bp, Chlorella protothecoides
atggcgcagacttcaaggggtgggtttggccctgagcacttttggcctttcaatggcatggtgcccaacaggggaccaggatgggaagagcagcatgcttttacctactatgcagtcctcccacactcagatccctatcgtgaagtggtctttaagaccgttgagagcccctttagcccttccatccactatctcttctccaggcactgctggcccggggagagtgcgtacctggatatgctcaaccctacagttcgcgattggtgggccgaccagttctcgacgtcggtgtacgaaggcagtacgactgacctgtacatctggaacgacatgaatgagccgtcggtgttcaatggccccgaggtgggatttggggcagggactttggggtgggggacacgggaccgggtgcgggtatggctgcatcttggggatactgcgcccaagcctgcgtga

SEQ ID NO: 6637 - DNA, 1140 bp, Chlorella protothecoides
  modified_base (862)..(871): a, c, t, g, unknown or other
  modified_base (1021)..(1030): a, c, t, g, unknown or other
atgttcctgggtgtgaacatccgcttgtccaacctcgcgtggttggtaggtgggttcacagcggctctatttttcaccaccctcgtggggccccttcagacgcagcccgtgctgccctccgaggtgtatgagaacctaagagccctgagcgagcctgcccaggacgtttcggcgaagcggatcaccgcatttgtcggcatacaggttcgtgattcgacaccgcatggggaccgcgagcgaaccctccagcaccagcttcctactgctcagtctcaccactttcccccgcagacgggcttcacgaccaaccacaacaacccgaagtacaattatgaaaacagacgggaggcactgcgcgccacgtgggcgccctccaacgagtcagagaggagcaaactcgagactgagtccgggattgtcgccaggtttgtggtgggccactcccccgactccggggccgaggcagcgctgaacgccgaggaggccaagcatggaggcttcatgcgcctggacctcgtggtgaggggccatgggaaggtgtgggaggaggagtactctgcacagcgcaggcgaggtgcacttggaatatttcatgaagatagggcccagtcctctcctccttgtgaggactgcagagcgcgcccctctcaccctgggctgccacctggatgcccccgcaggaagggtatgcagacctgccacgaaagacgctgctcttcttcgagaccgtgctgcggcagtatgacccgcagtacatcgtcaaggtcgacgacgacgtatacctgcgtctggacagggtcccggcagccgtggagcagtgggccagcgtcggcgcaggtggggcgttgttgggacaggctgnnnnnnnnnnggcagccgtggagcagtgggccagcgtcggtgcaggtggggcactgttgggacagccttgcgggggtgtggcgtcgctggtgcccctcacggatttgtcgtggtggggagcctggggagcggcaagtggcgacggcgccgtaccattccnnnnnnnnnngctggtgcccctcacggatttgtcgtggtgaggagccggggggagcggcaagtggcaacggcgtcgtaccattctcggactgcgcctttcaacgtcggcacccaggctga

SEQ ID NO: 6638 - DNA, 828 bp, Chlorella protothecoides
  modified_base (418)..(427): a, c, t, g, unknown or other
atggcctgccacgagcgcggcgggcagtggcgccgcgtggtcaccacctacgagcagatgcggggcgggggcgggcgcccggactccgtcgtctacaacgtcgtggtcggcgcgctgtggagcaccggcgcggtctgggcgcaggcccgcgccgccgccatcttccggcaggcttgccggtcgggacacttccgcctcaccgtgcacaccaccgaggcgacgggcggcgagacggcgcagggcgccacgccgccggcgcacgcgctggcggcggcgctgcccggcctggagggggcgccgagctggtgcaccatcgagtcggccgactcggccgctgcgccgacggcctcgctcccgcagtcgcccctgcttgtcgtagaggagggggatggagtgaacgccggctcgccaggccccnnnnnnnnnncgagcgggccccgccggcgtgctcatcgagttcagcgtgcacgcattcagcctgggctcggccgtgctgtgcctgctgcgctgggtgggcgagctgcgggagcgcctgccccgcgacaggggccaagcctgtggggcggggacgcacgtggccctggtcatcaacaagggcaagccctgcagggagcatgcctacccgggaatgcgcagcgccctgcaccagtgtgtcgccgcctggaaggccccgtttacgtgagtttttgggagggtgaagatggagaggggggtgggcttgggaatgggaggggtttggcagttgtgcattccaatggacattggaagttgcagtgtctgtggcagtatggtgcgagattatgggaaggccgtcgtgggggtttttaa

SEQ ID NO: 6639 - DNA, 501 bp, Chlorella protothecoides
atgcccaaggatgcgcggcatgtccagggggtggagcaccgggacctgcacaatgccaacggactcttctaccacatggccacggcctcggggctgagggtggttgttgtgcctagaatacggcatgaagcgattggatgcagcggccacgccgattgggcacaagtcatagatggtggagctactgcctgtggtctgacagcatgcgtcgtagcatgttctgcattgctgacatcaacgccgcgtatccctccttccaccaggcggcgcgggtacaaggaggtggacaccgtgtcgggggaccgccccttcgtcctgtcccgggccttcttctccggtacgcagcgcgtggggcccatctggaccggggacaatgcggcggagtgggcgcatctagaggtctccatccccatgctgctctccctcaacgtcgcggggctgcccttctctggtgaggaaacggggcaatcgctggtgtgtggatgtgccgcgctgcagtga

SEQ ID NO: 6640 - DNA, 1248 bp, Chlorella protothecoides
  modified_base (113)..(122): a, c, t, g, unknown or other
  modified_base (525)..(534): a, c, t, g, unknown or other
  modified_base (994)..(1003): a, c, t, g, unknown or other
atggaactggccctggccacccggagggccaagcggcatctatgctgtcgggggtccctgggcttcagggatcccagcaacatgcccgcgccctgtctgactgcatacatctnnnnnnnnnngagacccaagcggcatctatgctgtcggggatccctgggcctcagggatcccagcaacatgcccatgccccgtcggactgcatacctccggagcaccccacccctcacacccttgcacctgcacactctgccctccgcaagacgcacgcctccccctccccacctgcccatgccaaggtatgacatcgcctggaagtatgtgcagtatggccgcatctgggactacctgcgctccgagctggagatggatgcgcgattcaagaccctggacatgaagctcaacctggtgcaggacaacctgaagtacttcctagagattttccaggaccgcaaggcaaggtctgggttgcagcggtggttgctgcttgagcagggttgcagctaccctgcaggagtgcggtannnnnnnnnngaccgcaaggcaaggtctgggttgcagcggcggttgttgcttgagcagggtcgcagctaccctgcaggagtgcggtttcaccagggccaggacacgccgcagatactgctgtgcagctggagcggcgcatgccagcacacaggctgccccgtcgagacctgcatccgagccagacaccacggctgcatgccccgtccccagccccccgaccacccgcctgccgcacccgtactgcagtccacatcgctggagtggatcatcatcatcctcatcggggtggagatctgcctgtcgctgctggacctgtaccacaagggcatgatggtagtctgcacacacccgcaacatggacttggatgtaggatgggggggtcggaggtgcgggtgttcgtctgcaaacttgctgtgcatgggtcaggcgaccgggagcacaggaccctccagcggaggcatcatcctnnnnnnnnnnggtgttcgtctgcaaacttgctgtgcatggatcaggcgcccgggggcacaggaccctccagcggaggcatcatccagaccggcagcgacaagtttgaaccttccggaatcgcgacacgtctgtgcgtggttacctgcctgcccgatccatgcgtcccaggaaatgcgccaatccccatgttaccaattcgtgtcccggaaattcatcgcatcgcggccatgcccgcacctccagccctcccttga

SEQ ID NO: 6641 - DNA, 549 bp, Chlorella protothecoides
acgcgcggcggcggcgccgcgccggccgacgaactggtggcgcccaccttccgccgcgtgctcgccgacgtgcgcgagcgcctgaccttccgcgcgcaggccttcatccgcgagcgtgtggcggggcacgccgcggtgcccaccgactttgacggctactattcgctggatggaagggggcagggaggggtggccagggcggtgcaggggggcgacgcagcggccggcagcgcgatgcgggcggacggagcgtcagagtctgtcggcccaggaggagtcgccaaaggcgatggggacccgccgacagactcgagcacaccgccagcgggcccgccggctgctcgccagtatccccccgtcaccgccacgctggcgctgctgggccagctggcgccgcgcctggacgcgcgcatcttcgcggggctggcgcacgaggcgctggccgccgccacgctcgccgtccttgccggcagccgcgctgtggccaaggtagagatggggggtgggggggctctggagatgcggtgggagtcgaggcaggaggtttga

SEQ ID NO: 6642 - DNA, 330 bp, Chlorella protothecoides
atggaaattgaggacagcctccccgggtgcacccccctccaggcccagctcttcggtgtgtcccagctgctggccctgcgcgagggcgccgtgcgccaccccaccaccttcgccgtgcgcgacctggacttcagccacacgcgggagacgctgcgccgcgcggcctcggggcagctcccactcttcacgctttcctccagcaacgcggtgctgcagctgatgagccgcggcgcgccgcgcctgctggagagccggttcgaagccaagaaggtgggcaggctatggtgttggcgtgtttacaaggggtttgggactggggcatggggttga

SEQ ID NO: 6643 - DNA, 252 bp, Chlorella protothecoides
atgtccagtacccatcaacgcaccccttccacccaggagctggagcgagaactcaagttcagctgcgagtccttcatcatgtccgtgaccaagctggcggtggagccggcgctgtccttcatgagcaaggcggcggccgcgggcaaggtgccggccgcgcctgcgggcggtgcgggggcggacaaggaggcggccgtgggcaccaagcccttgcaccaactggtgagcaggaagttggagaatggagaataa

SEQ ID NO: 6644 - DNA, 606 bp, Chlorella protothecoides
gccgccgccacgccgcacgtgcccacgccgcccgcgcccgtcccggacctcctcggcgacttgctggacctggggggcgccgacgccgacgccgccacgccggcgccggtacaggcgccgaccactcacgccgccgccggggcgccagacgtcctcgatctgctgggcgggctcagcgtgagcaacggcgcggtcttcggcgcggacgccggccgcgcggcgcctggcgccgccagccacctcccggtcctccttgcggccgaggcaggcaagggcctggtcatccgcggtggggtcgagcgcgaggccggcggccagctggcctaccaggtgggggtttggagtttccgtgcaggggcaatgggggggagagcaaggaaagtggggactgtgggcatgggcactggccagtggaagctgggaggggtgtcaacagcggtgggggatgacatcccgggcgtcgcctgggcagcaagaaaggcatccgccgtcgttctgtggccccctcgaggggcgcccctcacacctgctcgtcggctcgccccccaaacccacagctgcacctggagaatgcgggggcgggcgtccccctggacggcttcatga

SEQ ID NO: 6645 - DNA, 1419 bp, Chlorella protothecoides
  modified_base (191)..(200): a, c, t, g, unknown or other
  modified_base (274)..(283): a, c, t, g, unknown or other
  modified_base (615)..(624): a, c, t, g, unknown or other
  modified_base (710)..(719): a, c, t, g, unknown or other
  modified_base (1241)..(1250): a, c, t, g, unknown or other
atgccaatggacgaaagctgccttagtgcatggggagataaagcgctggctcggtgggcaaggggtgtgcgccatgccgagggggggacctgtgctgtgcatggggcatcacatctgcccatatatcactccgtcgcttgcctggtccaggctcatgtcccccattccacacactcgccttggcctccccnnnnnnnnnncctcatgatctcctgggtggcgcccgcctgcaacagccccatctttgccgaagtggtgggtggggcttctgaannnnnnnnnntgcagctgctgcccatgggcaactccaacctgctggtctggatctacagcatctgcttcttctcctggggcctcatgatctcctgggtggcgcccgcctgtaacagccccatctttgccgaagtggggaattacatggatgtttcgcagcacatggccactacacagccttgggtcatcattcgcctccccattcctccctacaggtcccctcccagctgcgcgccatcgtctactcctttgaccgcgcctttgagggggagttgcatggatgtttcgcagcacatggccactgcacagccttgggtcatcattcgcctcccatttcttttnnnnnnnnnncttctggggaatgaaatgttgctgccactgttgcccccccctggaatagtgggtggggttggtcccatgagcggcagagcccacannnnnnnnnncaggcgccatcgctgcgacgggggcgcccatcgtgggctggctggcggagcacctggggttcagcaccgaccccagcaagcccggcaccgaccgggagcgggcggttgcgctcggcaacgccatcgtcatctgcacctgcatcccctgggcgctctgctgcttcctgttcacgggcttgcacgtgacctacccgcgcgacaaggcgcgggcctcggtgcagcagcgcacgcgcagtggcgcgctcagcctgcgcagcgcggacctggaggcggcgctgctggaggaggaggaggaaagggaggcggcggaggaggtgggccgcatgcacgcggcatcgcgctcccggtcgggcctcatgctggcctgacttgggaagggcctggtccttgggcgcggccacgtgtatgctctcttgctcgaatgaggatggcccaggcgagaatgagcctcgtgcaggatgcgcacaagcgcatcggaccaagaacgtcctgtcggtctgcagggcctcagcttcgagcttnnnnnnnnnncgcggccacgtgtatgctctcttgctcgaacgaggatggcccaggcgggaatgagcctcgtgcgggatgcgcacgagcgcatgggaccaagaacgtcccgtcggtctgcagggcctcagcttcgagctcctgcatccaccttgcttttgagttgtgtactgtgttgtag

SEQ ID NO: 6646 - DNA, 3435 bp, Chlorella protothecoides
  modified_base (339)..(348): a, c, t, g, unknown or other
  modified_base (642)..(651): a, c, t, g, unknown or other
  modified_base (1742)..(1751): a, c, t, g, unknown or other
  modified_base (2442)..(2451): a, c, t, g, unknown or other
  modified_base (2544)..(2553): a, c, t, g, unknown or other
  modified_base (3060)..(3153): a, c, t, g, unknown or other
atgtggccctactcctacagcacctgcgacgacgccgccaggaaggtggcgtggagcacgctgccgggccagcgcttttctgcctgcatggaccgcccggggcaggaccggggcaggtttggatgggagcaggggcggggccgcggtgccccggaggtggacctcatagaagttgggggctctgtggggatgcctgggggcgatcccgtttcctggcgtcggcacggagacggcctggcgccggagcactctgttcccgcggcatcatgcccagccactcagccgcccgtgcgatcccttcgccccccccaggctggggtacaggaaggtggacaagannnnnnnnnncctggcgtcggcacggagacggcctggcgctggagcactctgttcccgcggcatcatggccacccactcagccgcccgtgcgaccctttcgccccccaggatggggtacaggaaggtggacaaggagggcagggccaagggcgccggatcccctccgacagcctcgcacagcctgcagatggcgcccctgcagccgccggggacgcccttcatggagcgcggcgtggcgtacccgggtgggtggggcacagcgtgcgggcaggcacctttctggcgcactgcagtgtgcgcgcnnnnnnnnnnggggacgcccttcatggagcgcggcgtggcatacccgggtgggtggggacggcgtgcgggcaggcacctttctggcgcagcgcagtgtgcgcggagcagcccaccccactcacggatgagggccagcccaccacctgcactgcacgcccccggatgatgctcgccagccggcacagggcccgccccggcacagggtcctggcgcctcggagtccagccgccccgtgctccgccggccctcgccagcaacaccgtccttgccggtcctgcatcccccgcaggctcccagacgcaccacaagacgaccaagaacgactggaagggtgtgcacgggcgacctgggaacctctggcaggactgcttctccgccaagtccctgctgaacggcacgttctacgcgcagtttcacaagtttggcctgttctggcagcctggggaggatgccgtggcgcagcgggcgtgtgggagtccagccctggcggcatccgagggctcgctgggatctggcctggggcccccttgcacagcgcgcacagtggccgtgaggttcctggtgcagacctcggcggagtgccgtctctggcatgcccggcggggaaacgggcgtgtcacgaggatgcccggcagcagcgctgcacacagaacgctcccaccccgctgcatcgcaccgcctgccctgtacggcggggcactccgagcggtctccctcccgcgtgcgcgcaggtggtgtttgaggtcaacgcggatgccctggtggagggctgtgagatggagcagggcagcagcccctgccaggctggcaggtgtgcctccccggtggctgctgccctgtgtgggacacccaccactcctccccggcactcccctccgcccagcgctcggatcgcccagccccgccccccccacgcgcaggcatgagctactccttttcgtcggtggacctcgcccacctggcgttcccttccatcatgaagatcgaccacgtcaggtgcagcggcgcagggggggcggtgcgcgtgaggcctggcagtgtgcgagggcgagcgtggactcgctcgctcgtcgcgcactttccgtccctttccctcgtcnnnnnnnnnnccacctggcgttcccttccatcatgaagattgatcacgtcaggtgcagcgacgcaggggggccggtgcgcgtgaggcctggcagtgtgcaagggcgaccatggactcgcctgctcgtcgcggaccttccatccctttccctcattcccccgacctcccctccgcaggctgtaccagctgacagacaagatcaacgttggatgctcgcccatgaggtaccccacgagtcagtacctggcctgcaacaaggagaggtttgtgccgttgaaggaggacaagatcaggatcccagacaggtgcctgagcaccaccaggagctacctcccagcgctgtgcagcagggggtgtatcatggctgtggctggatgtctgccagcatggctgctttcgaaatggaggaccgggagggcgcgccagaccattccacgcacgagatgaatgtaggctcaatgcatgagtgcttccgtgctgctgttgtacatttcacctcaagtaccaactcatcggaaagcgtgatggggcggctacgagaacgacatggacgattagaacttgtcaatggcgcggggagcgagcagggcgaggtgagcgggcgatcgatctggggacagaggacggctgttcaaggacagcgacttggtcgtgcagttttcgcatggaggcacatgcctgaggttcccagacagtaccannnnnnnnnnggggcggctacgagaacgacatggacgattcggtgcggggtgtgtgtgggggagggagtgtaccagtccggacccactgccgacgtgccagannnnnnnnnnccacctgggaatgggcgagatcgaagtgcgatgcccccagggcgttcccgcgagggaggctcatgcctgaggttcccagacagtagcgcggaggagacggagcgccacctgggaatgggcgagatcgaagcgcaggctcctggtggagaccatcctcctttgcacccgaatcgcagccccccccggccatgcaggatgccgtccagccacactgccacctcccggggtccgatcgtggcttgccacccctcgcgacccctggcggcagcgtctgtgcccctggaccgccaggcgcaggaagaatcaagcagcggcgtggcagtgtggcgtgtgggccggggccgcagccccgaccccgccaccgtcctggcgcacgagctgcagtctgacgtggcggcgctgagctggcggcccgtgggcggccgagacctggccgtgggctgcggcacgggggtggcgctctggcgcgtccccccggacccgggcgcgggcgcgctggcggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgccctggcgggtacgggccaggtcaacatgctgacctggcaccccgagggccacctgctggcgggggcgtgccggggcgtggcggggttccaggtctgggacgtcgccaccggccgtgcgacgcccgtcaggggtgaggcggtgttgtcggtctcctggtcttgtcaaaaaggggggttgattcagtggtattgctgtgtgcatgctcaggatcgtataggaggtttggtgaggcaggctttcagaagcaggctgggcatgcaccgaggctttctttaa

SEQ ID NO: 6647 - DNA, 1284 bp, Chlorella protothecoides
  modified_base (367)..(376): a, c, t, g, unknown or other
atggccagtactggcggcatgtggccgtactcgtacgacgtctgcgacgcggcggctggcaaggtggactggagctcgctgccgggccagcgcttctcggcctgccccgacacggccgggaataaccagactcgttatggctggccggccggcgtgggccgcggcgcccctgaggtggacctctttgagatgaggtggggtgctgcagcaagtgtgggagggggggggaggggaaggggccccctgagctcgccgagtgctgagtctggacgtaggggagggcaagggacgaggcctgatgagttgacccatcaatggagcttgataaggagcaggttcttatcgatgcaaggattcacttgccgcnnnnnnnnnnaagggacgaggcctgatgagttgacccatccatggagcttgataaggagcaggctcttatcgatgcatggattcacttgccgttcaggccacatggccatagggcccagcaaaattgatgaccctggtcatccaacccctcctttgcctccattgcacagcgtgcccagcagtgtaaatgggctcaagggcacgcccacggcccacgacagcgactacagcctgccgtatgtcagccagacgctgcagatggcccccctgcagccgcccggcaccgccttcatggcttcgggtgtcaactatccgggtccgtgggcaggggcgggggcctggggaccctggcgaggggctatgggaatgggtagctgtctggttgatcactgcaattgcacctggaaagctggctcgtatgtgtctcgccgcagacacccatcccccccaactgtgtgcactcacgcacaggggggctgggcatgcttgacccctcattcgaagtcatgcatttggagcctcctgggtctcccgcccaccccttccctcccagccactttacacattctaatcatacagttcccacaaattctacacaatcaccccaccattccatttccaggggcgagctccgactttgacacccagaagagctcctggtctggcatctatggccgcccggggaacacataccaggacagcttctcggcggtgtccagcattaacacctccttcttcagcgagtatcacaactttgggctgttctggcagccgggtgaggtcctgcgctggtacatcgatggccaggtgggaggagagggtgctgcgattgctgttgccggcaggtgtggtgggaggacggggatagcatggcaccatccactgcacagcagtgctggtgcaagagggagctgctga

SEQ ID NO: 6648 - DNA, 438 bp, Chlorella protothecoides
atggaatggcatcctgtcccctacaccggcaagtatctcaggaagctgtccagtccaccagcacctcctccccaccgccccaatccacaggcaaccagcgaccccatcaccgcactggcctggtccccctgcggcgcctacctcttccagggccacgcctcgggcacgctgcggctgtgggagaccacggcttggaccagccaggcgtgggcctacggtggcagccacagcgtgcacagcgcaagagcgggaccaaggccgtcccccgtggtggcggcggcctgggcgcctgcgcgcctgtccgcccagggtctcatgctcgtggcccatgccggggcgcccggctccctgaccgccctgcacatgacgggcgccagcgcccccagcctggaggcgcagcccatgcctgtctccctggcatggccggcaggtgcgtga

SEQ ID NO: 6649 - DNA, 705 bp, Chlorella protothecoides
atggcaccgccccgcaagaccgtgggttttgtcgccgtgcctggcgaggacgaggacggcgccggccagtccgccttctcatcgcctttccagaccacaggggcacaggaatctggtgaacccgtaaagaaggccgggggcgtgctgcgcgacaagcatggttggtacagggaggggggtgacaagggtttcgggggttcgactgatatgcctcgcctctgggttgtgcgcggcgcgggccgcaccgggggtttgcccgtcctgactggacccaggaagtctacagccccaggcttggccatgctcctcgttgttaaccctcggcccccctccctgtcaccccctccctgtcacccctcccccctctgtaaaggcaacctgcgcacctggaccgaccagcgggcccgcaccacggtggtggtcaacctggcgggcatcctggagcgctgcaatgagcagaccctgccagccctttaccgctacgtgggcaagtccttcaaggcctccccccgccagctgggctacataacgctggcctgcgcgctgatgcaggcagtttgcgcgccgctgggcggcgtgctgggccacctgtacaaccgcgtctacgtcatgagcgccggcgccttcatctggggcgtcatgtccatcgcctttgccttcaccaccaatgtcaagcaggtaggggagaaggatgaggagggatga

SEQ ID NO: 6650 - DNA, 597 bp, Chlorella protothecoides
atgctgagtggcacgatgaacaccgcggccgcggtgcattcacgatgtggagcctgcggggggtcgcaggccctggcgctcgtcagaggcgacagccgaaggagtcgtgcattctcatgtcaagggaccccacccaacctgacacaccaaaccatgtgtggcggtggtcttacgagcgccagcaccaccgcccatggccgagtctcatgggtgagtggagctgcaagcccccagcagacaaccctgtacactgccgggagctcgacatcgtcgacgagcagcacaagcagcagcggctccagctctgacagcgaggagcccacgacatcacgagccgctcggcggactgcagtcaaggccatgcagcctacggtgtccgtgtgccaggacaagtcgtgcggtcgcaagggctctgccgcgctgctggctgcgtttgaggaggcagcccagggcgcctgcgtccaggcgtccaaatgccagggctactgcaaggtcggcccgtctgttcggctccacaaccgacaaggcggatacgtgcagtacgccgctgtgaatacagaggacgtggaggagctgctggacaaactcaagcaatga

SEQ ID NO: 6651 - DNA, 678 bp, Chlorella protothecoides
  modified_base (76)..(85): a, c, t, g, unknown or other
atgtctcaaactggtggcctgtggccctgtgcttgccgtttgcctggtgcagctggcgagcagtggtttgacgccnnnnnnnnnntggcctgtggccctgtgcttgccgttttccaggtgcagctggcgagcagtggtttgacgccgcacggaggcagagccgcctcatcgaaagtgcctgagcagatgcatgccccgagcacgggccctcttgatgcggcagggccgccaggacccctgactccacacgacccctcgctgccatgtccaggggagaagtacaagcactgcgcggcatttggagtgacgccggtgaccgcagactggctggtggacagcatcaccgccggcctgctgcagcccgaaaaagagtaccaccccgggagacgcgctgcagcccaggccccgctcgctcaccagagccaggcggggggccggccgcgccagggtcaatcgcaggagcagtgcggggccggggaggggagagcaagccaggcgtccaggaagcgggccggggagggcgcgcccgctgacctggggcccctcaacttggagagtctgctggagatgaccgagagcggcgctgggcatcgtgagaaggcaggcccgccccccaaacggtgcgtgctgggcgggcacggccgatcgaggctgccgagggccggaagcggggaatga

SEQ ID NO: 6652 - DNA, 699 bp, Chlorella protothecoides
atgctggagcagacccgcgatgggagcggtgctgcagccccaagatcaggctcttccctgctgccgacgtgtgtcctccagcccagcagtcgcccccccgccctctcagatccctccgccggcccgatgagcctgtgcatggatgcctgctacctctggctggtggggtgtgggcctcaggagcagctgcaggcgctgcaggcaatacgccgcgtggctgccaagaggtttgcggtcccacacccgctgctgacccatgtcatcgtcggcggggcactgggtgacacggacgcgcggcgtgtggctgccgtggcctcggggaacgcctcgttgcaggtggtgtgcctagactggctgctggactgcgtgaagaagggctgcatcctggcatgcgggccctaccacttccgagcccctcctggagcaagagggggagcaggggcgatcgccatggtgggccagggctggctggggtgtgggagggatcccgccagcgggtggagagggtgccttgcgccctggaatcagagccaagctcgctcgtcgctccattctgtaggccggtatgtcgtccggcacggcggagcagtcggcgtcggaggcaagcaagggccatgccggcatccttgtgggtcgctactttacactgtcagcgctgtgcaacccagaggagcttgcgcgggcccgccaagtgattaa

SEQ ID NO: 6653 - DNA, 477 bp, Chlorella protothecoides
atgtcgccgtcgcgaggcttgtttgcagggcatcgcgtcctttgcacagccgtgactgtcgcggagagggaccgactggtgcagcatctgagggaggagggcgccaccctcatcaccgttttttcggtggaatcgccccctgatgtggtggtgacgcgatccgccctggctacaggaagcagactgtgccgcctctctcgccccgacatccctgccgtgacccccgactgggtgacagcctgcgtcagcgcgggacgcctcctggcacatcatcctcaccgcctgccatgcttctcaggcatgacgatctgcctgtcgggccttggctcatcggagaagcaggacctggtccagctggtggaggcacacaatgggcggcactctgcagccctggaccggcgctgcacccacctggtcacctgcaccacccagagcgacaagtacaggtgtgcgcgtagtctttccagcgtgccgtga

SEQ ID NO: 6654 - DNA, 1659 bp, Chlorella protothecoides
  modified_base (102)..(111): a, c, t, g, unknown or other
atgccaccctcccgcagtccccatctacgactccttgggcgacaccgccgtcgagtacattgtcggtcatgcgggtgggtgcagcttgtggggtccggaggnnnnnnnnnngggcgacaccgccgtcgagtacattgtcggccatgcgggtgggtgcagcttgtgggggctcgaagatgtgagggtcgctcatccacgccgccttggccccgactcctgtccccaccctcctcaaccccgtgggcaccttgctccgccctctgccacggccatcgtcgccgccccactcccccccaggccaaacacaaccctgccccccctcccctcaccccaaactatcaacgtccactgccagaggtgcgcgcgatcgtggtggaggagaagaaggtgtcccagctggccaaggtggccaatggcatctccaagctggtcagggatgtgatcgtgatcggcgagcccggctcggaggccgcccccctgcgcgacgcgggcatcgaggtgcacggcttcgccgccctggtggacggcgcgtcggcgtcggacgtggcgccgcatccgcccgccccctcccaccacgcctgcatcatgtacaccagcggcaccacgggcacgcccaagggcgtggtgcacacccaggccagcatgacggcggtgatcgcgggggtggtgaacctgacccgccaggggcacatccccgtcacgcatgacgactccacgctgtcctacctcaccctggcccacatcttcggccgcgtggtggaggagtttgcgctgtcgcgcggcgccagcatcggctactggcagggcgacgtcaaggcgctgatggatgacctgaaggagctgcggcccacgctcttcatcgccgtgccgcgcatcctggagcgcgtcgccgacggcgtgaggaagaaggtcgccgccgggccggccctgtcgcgcgtgctcttcaacgctgccttcaccgccaagcgcctgctcctcaagaccgggctgtcccacgggggggggcaaaaacccggggttaagcgagggggggaagagacgctgggtgtgagggagagtgggggaagagtcgcagggtgtgagggagagtgggagggatgctgcgcacggcatagccgccacccctctgtacttgccctgcctcgtgcgccgcgccgcaccgcacccattgtttgtcgaaaggaatcacacgtgcacacacacaatcattcgctccgagccaatcagcacccccacccacctcctcaaccccgctgcaggctggcgggtttgggcggcgaccaggtggtcttcagccgcgtgcgccaggccatgggcgggcgcgtgcgtttcatcgtctctggcggtgcgccgctgtcgcctgaggtggaggactttgccaacgtggcgcttgccccggtgctgcagggctacggcctgaccgagacctgcgccgcctccttcctcatgatccccgacccgcgcctggcctactccgtggggccccccctctccgccaacgagttccggctggagagcgtgaaggagctgaactacagcgcggaggactcgccgcccaagggcgaggtctgcatccgcgggcccatgctcttccagggctactacaaggacgagaagaaaaccaaggaggacatggacgccgacggcttcttccatact

SEQ ID NO: 6655 - DNA, 678 bp, Chlorella protothecoides
atgcgccaaggcactgccacacgctcactcccacctgaaccccaccataggtgtctgggctggcgccccaggggctcggatggcaagtgtggcccctacaagtggctgacgtacaaggagacccagggtaggaattcttgtggctttgtgtggggtggcctttgtgtggctgttcaggacaaggcctactcatttgcggcggccctgcagaagctgggtttcgagccccaaggtgagattgttcctgagtcagtggtgggagatgctaggattgctcgagagttcgtcatggcggccacagcctggggaagctgggtttcgagccccatggtgagaatgttcctgagtcagtggtgggagatgccaggattgcttgagtattcgtcgtggcggctacagcctgggggtgtgcttgagcgtctcgttgtcatcagaacacacgtgctcattctctttgcttaccccacagacaagctaggcatctacagctccaacaatgtggagcacatgctaaccctgaaggccgtggatgtcatctccgcggtcgtaggtgggtgggatctcatggtgcccgttctcgcacaacgctcgaggggaagggggagccagtctggttgggatgtgtctgactggatgtgttttgttcctgatcaacctggttacctcctcttggtgtga

SEQ ID NO: 6656 - DNA, 198 bp, Chlorella protothecoides
atgagctcgctcaagcacgtcgggcccctcaccgtcgaggtcacccccggcagacccgagcagggtgacacgcccgctgtctcggccgtgtaccggaatgtggcagccgccgagaagtttaccaccactgtagatggctctactaccctgtacgagatcttcaaggccagcgctgagaagcatgctgatcagaagtga

SEQ ID NO: 6657 - DNA, 1434 bp, Chlorella protothecoides
  modified_base (1273)..(1282): a, c, t, g, unknown or other
atgtgtgtgcagcaagggccgcgggctgactccctcaccgacacgccaaccattctgcctctatgttcccatgcacttcgcgccctgcacgttgccgggtcaccccagcgacgggacgggcagccagggcgcgagaaggggtggtttcgggctcgagctgacccacccaccagcttgaagccttgtgcagagcaggcacaggtcaaagaagatcaggtccagctcacatacggcttggcccctccgagtcacatcttccctcctgcagagccaaccagggattctctgtacatgtctatctccaaatcatgtgccacaaggctacagaaggagtacaaggccatcgtccggcatgcctgggacgcgagcctgctcgtggctcctctcggccccatgttactgcagacacagcatgtttcacgtccgcaggaccccgtgccgtgcatagaggcgcaccctagtcccagtagcctcttggtgagaggtggcagtgccccgcctgttcatgacagacctgcaagtggctgtccttcatcaggttcatgccgggtgcgaccccccagctttgatcagccccacatcagcctctcgctcacctgcgtgcaggaatggcactttgtactgcaaggccaggatgagttcaagggcggagtgtaccatggaaagatcaccttcccctcttcctacccatacaagccgccctcgatcctgatgttcaccccaaacggcaggcacgctggtttggggattggtaatggtcatgggaagctgtgcaagcgttcatcggcctgctttggtgcaaatgtttgcgaccaacaccaagctgtgcatgagcatggtgagccagtggtgccacttgtatcctcctgtgggctggcgacccccgggtggacgagaaacaaccactcagcagctcagattgtgacagtgtctggaccagtgcacagacctgtaccctccaaaactcctcccatccccgcagaccgacttccacccggagagctggaatccaatgtggtcggtaggcaccatcctgaccggcctgctctccttcatgtacgactccgccaacagcacaggcgtggtgacctccacgcccgcagagaaggcggccctggcggcccagtccctggcgttcaacgtgcgcagccccaccttccgcaagctcttcccccactgggtggcgaggcacgaggaggcccagcgcgctgccccccctccgggaatggaggggggttgcagacccccggaacaggatgcggcagaggggccnnnnnnnnnncgccccccccccggggatgggggggggttgcatacccccggaacaggatgcggcagaggggccgacggggcctgcgtcggcgccagcagccgcagcccccgcgcctccacccgcggctgccccagttctcacgagttggagcttcctggtag

SEQ ID NO: 6658 - DNA, 675 bp, Chlorella protothecoides
atggccgtgaccgcagcacacctgccctccccgtgtccacaggaccccaaggcctgctccatcgtcctacgcggcgcctccaaggacgtgctgaacgaggtggagcggaatctgcacgacgccatgggcgtcgccaggtctgcgatgggatccggtcttgatggggagggggttgccttgggggagcaagccggtcctctggccgcacatcgcgcagcgcccagcgtgcatcgcgcgatgtgcggctcgttccccaacaggaaaacaattcttgtccggccgctagctcggccttggcctgtgctgcgctggagatgccgtgtgctgcacctcccctgctcccccccccacccacacaccaagacgccttgctgtgacccccccaggaacgtggtgctggatccgcggctcgtccccggcggcggcgcggtggagatggcggtgagccacggcctggcggagctgtccaccgccggcggcgtgctgggtaacgagcaggcggcctaccgcgcggtgggcgcggcgctggaggtcatcccccggaccctggcctccaactgcggggccaacgtcatccgcaccatcagcaagctgcgcgccgcccacgccgagaagagcagcagctttggcatcaatggtgagggcggcggcttctccgaacaggggttgggttga

SEQ ID NO: 6659 - DNA, 855 bp, Chlorella protothecoides
atgagaatgaagcttgcccgtcacctgcattcctgcatacttgaaaacaccaacactttcgccctcaccccgacaggaaacaccggcaaggtggaggacatgcgggagctgggtgtctgggagccgtacgaggtcaaggcccagacgctgaagacggcagtggaggcggccaccctcctcctgcgcattgacgacatcgtgagcgggctgaagaagcgcggcggtggcggtggaaagggcggcggcgtgccccagaaacccccatggtgtgccaccgggctcaacacagcgctgggggcaacaggggcagggcgagcgcaggggggtggagatgcctgcagcagaggcccaccctgtggcaatccctgggccctgactcggaagcaaggtcagtaccagacactgcttactgacactttggtcagcaaggcggcggcaggtctggtgacaacaggacacgcaacaagggaaaggcagcagggggggataggagcaggaatgcccacgaacgcccgctataggggaactccgcctgctcagggtgcgagtagggtccgttgctctgcagagaagctgggcgtctggagtttggcaagtcgctcctggtgcctacgagctgaatctgagagcgcggcgggtcccccgccacccgctccgttgctgaagaccacctcacttcttcttgttgctaacgtccagctcagacatgttgagcagcagggactcggagctgaggtacacgcggttggcggaggaggccaccgtgccggcgatctcgcgcgcggcctcgatcttcctgcacgatgttacagggtgtggggatggatgggtgggtgctgggtaaggaacatttga

SEQ ID NO: 6660 - DNA, 678 bp, Chlorella protothecoides
atgctgcggcccagccggagggagtcgccagcagaatgcaactccccaagcctgttccccttcctgcaacccacacaatctgcaggtcaacatcggcctgcgtgtgctcacccggcccatgcccgagaagctgccggagatctaccgcacgctgggcaccgactacgcggagcgcgtgctgcccagcatcatccaggagacgctcaagtcggtgatcgcgcagtacaatgcctcccagctgctcaccatgcgcgaggtggtatcgcgcgacatccgccgcatcctcacccagcgcgcgcgctacttcaacatcgtgctggacgacgtgagcatcaccaacctcaccttctcccgcgagtacacctccgccgtggaggccaagcaggtggcgcagcaggacgcggagaaggccaagttcatcggccatctgcagtgggggcctggccagcagtagcgctgcgtgacatcacccctagcttgccgctgctgccgactctcccaaggtcgttgctacttccacccaccccgctcttctccctttccaatcaccaggtggacaaggcgcagcaggacaagcagtcggccatcatccgggcgcagggagaggcgcagtccgccacgctcatcggccaggccatcaaggacaacccctccttcatcactctgaggtgggtgtag

SEQ ID NO: 6661 - DNA, 1362 bp, Chlorella protothecoides
atgcaggcaccggtgaccgtgctgcagaccaacacacggcgcgacaccggcaagaaggcgcagtatggcaacatcttggccgccaaggccgtggccgacatcgtgcgcacgacgcttggcccacgtgcgatgctgaagatgctgctggatgccaacggcggcatcgtgctgaccaacgacggcaacgccatcctgcgcgagattgacgtgtcccaccccgcggccaagtccatcatcgagctcagccggacgcaggacgaggcggtgggcgatggcaccacctccgtcatcatcctggcgggggagatgctggccgccgcggagcccttcctggagcgcaacctgcaccccaccgtgatcatccgcgcctacatgcgcgcgctggaggacgcgctgcgcctcgtagatgccgcggccttccccatcgacgtccaggaccgggaccagatgctgaagattgtcaactcctgcatcggcaccaaattcacacagcgcctgggcaatctggtggcggacctggcgctggatgccgtgcagctggtcaaggtggacgtgcccggcggcacgcccgagatcgacctgaagaagtgggccaaggttgagaagatccccggcgcttccctggaggactcgcgcgttctgcgtggcgtcatgttcgagaaggacgtggtggtgcccgggcgcatgcgccgcaagatcgccaacccccgcatcctcctcctcgattgcccgctggagtacaagaagggcgagaaccagaccaacgtggagctggccaaggaggaggactggtacgagggggccgggagctgtgctgctgcgcctctctttggctcctgccccccttcgtgcctcccccttccggcttgcccaccgttcccttcgtcccaaccaaccccacgcacacgggaccctccccatccaccctctccctttctcatccacagggccgccctactcaagctggaggaggactgggtggcgcgcacgtgcgcgcagatcgcggcgctgaagcccgacctggtgatcacggagaaggggctgtcagacctggcggcgcactacctgaccaaggccggcatctccgccatccgccgcctgcgcaagacggacaacaaccgcatcgcgcgagcggcgggggccaccatcgtgtcccgccccgacgaggccaccgagcgcgacatcggcacgggggccggcctgtttgaggtccgcaagatcggcgacgagttctggacattcattgtcgactgcgaggtgtgctggtgtctgagttctgtgctgggctggaggcgtgtacgttttggggtgaaggagtctgaccacggcctcgctgccacacaagtgcaaagcttcgggtag

SEQ ID NO: 6662 - DNA, 912 bp, Chlorella protothecoides
atgcatgccctgatgacccagcagtgcctggcacctcgaaacgtggccggcagctactacgccatcctggtggactttgaccccggcgccttcctggccaccacgctgcactctgcagtcctgtacgccgcctgcgcggtgctctccggcgtgggcaccgcgctgcagcgccggctggcgctgagctggcgccagcgcctcactgcgacgctgcacgccgcctactgcgcgggcgccgccttcgcggggctgcgcctggacaaccccgaccagcgcgccacgcgcgacacgcgcgcgctgtgtgacgacctggccgccgtcgcgcgcgtggcggtcagcatccccttccgcggcgcctactacgccgcgctgaccgccgggtacctgggtttgcgcggcctggcggtggccgccgcctacttcatctgcgccaccctgctgcagtggtgggagggaaggagtgggggcaaagtgatggcggttgatgggtcgggtggtcgtgtgatggaaagtgcggagggcgacctgcgcaccgcccacgcccgcctgcgcgcgcttcgccacgacgcggccctggccggccgcggtggcgccggccactacggcgccgaggccgaggcgctgggcgccgcggcggccgccgcgctgggcgcgcaggcgcgactggtgccgcgccaggccgcgctggaggtcagcaccaaggccgtcgactacggcggcgcgctgctgacctacaccgccgtggccgtggccgtgttctctggcacagggccgcgtggtggggaccctggcgacaccgcacgcttcgtgtccaacgccgcctttgccaccatggccctggtctacaccttcaccgagctgatggacaagcttaacacgtacgcgcgcctgcctggtgaggaggagggatga

SEQ ID NO: 6663 - DNA, 459 bp, Chlorella protothecoides
atggcgctctccatccattctggggcgcccgcctgggccgagctcgccactgttcccccagagacggccctgcaagcagcgaggccgctgccgcagcagcctattgacaagggccgaatctggtttgtgctcatagtcggtgcatccgcgctctttggggcgaccgtgctcctcgagaacagggctgcctggttcccagccatcgccaaggccaaccaagccatgaagagtgccgcgacggcaagcagtcggaatggggaggcattgcctcaggaggggcctgagggtgcgtcgccggtacccctggaccggtctgggcatgaggccggtgcaatcactggagctgcagggggtgagggagaaccattggatacggcagtgctcgagggtctgcgtgagggtcggcaaaaggccctgcgcggcagcgaggagactgtggcggacgcggccgaccgatga

SEQ ID NO: 6664 - DNA, 2319 bp, Chlorella protothecoides
  modified_base (254)..(263): a, c, t, g, unknown or other
  modified_base (1249)..(1258): a, c, t, g, unknown or other
atggttttgatgtcggaggtggtggcgccgtgggagaacgcctggctgtcggtggtggggtggctggcctccttggcaaacacctcctcgctggcagagggcgtgactgcggggcgagggacgcagggggagatggagtatgggttacggaggggggtgggagatcgacctcatttcattcaaatcgcccatcggcacccaatggagcaagacaagcatggcagccagcgacgtcggagcatcgcacaggatcnnnnnnnnnncctcctcgctggcagagggcgtgactgcggtgcgagggacgtagggggagatggaatatgggttatggaggggggtggagatcgagctcatttcattccaatcgcccatcggcacccaatcgagcaaggcaagcatggcagccagcaatgtcggagcatcgcacaatttgacaacagaaaaggtggggggatgcggccaggctggcctcgtgctccctcagggcggcctcggtcagggtggcatccccctgaatatcgagtggagatatttaggaccacagaacctgcgactcaccggcctggcgttatcacgggagtgatcctggccaacccgagggctggaggaggctggactccctggggtggggggcccagcgagtcgctggagccctcgacatgcttggacgacggcatacctagcagttctggtgcaccgatatattgcacagacgcgtttacgatcgagaataatgttgatacaccactacggggctcggggttgcatggagcgtggttgcttgctctgtctgaagctggttggaaggtgcataccccgcttcgtccccacgaatcggtacggcgaggtgcatgccaggtgctcgggaatccgagtgtccctcaacaggctgcgcgaggcattgaccaagggcacccggctgtccacatgtcggaagttctcatcagtttcccttacgccgagctgtacattgtgaggggcagtgaggctcccatcctccagagcgagggcgagctggtaattagctccagtcctggcacaggagatgccgccgagcaggggccacccgccagctgcatccagcttgcggtgggaaaggtgtcatgggaggtaaagccctccagcaaggccctgaaggcgggggagtacacctgggtgttcagcacctcggaggcggggatattctactccctcaccctgctggcatctgccagcgaggaggacggagaagcagggactcctccagtannnnnnnnnnccgtgctggagaacattgccgtcgtcaagtacgtgggttgctctgtgaagtactgggttccttcttgggatggaacttgtttccagggagaagcagggactcctctcatggcaagcatgtcctgtccctggcatgtgtggtgcagtcgcacagcccacccctccgaccacacctgtgctcgtctgactgggtttcgcaggattgtcaccatcctgcactgcatgatctcccccccccacacacacccctcacacaaactcacatacacacctgtcttcagggagtcggaggccctgctagcggacccggaggcccagcacggtgaggctgccctggccggggccgcgtacaacagcgccctcgcgcgcggcgtgcaccgcgcctcggctggcctggcctcgggcctgctggtcagcgcagcctacgccaccggcgccatcaagcgcgtcaccgacgcggcgcgccccgccgcgcccaccgccgcgcccgtgcacgtgtcggaggcgaccaagcgccgcttcgagcgcaccgccgccgccgccgagtgggcgtcgggcgctgccggtgcggtggtgggcgggctggcatgggtcggcgccaaggtggcgggcggcgctctgtgggcgctgggcgcagacaagccgctggcgccgggggaggaggcgggggtgctgcgcgagacctcgcatgccgccgccgccggcttttcccaggtgtgggagggcatggaggacgcggggcgcgccgtgctgctctccgcccgcgatggcgccgcgggcgtggtgggcgaccgctacggcgccgacgccgcgggcctgtccttgcacagcatgaacgcggcggggagcggggccaacgcggtgtacgcggtacgcaagctgggcgtgcgcaccgtggccaaggccgccgccaagcgcacggccaagggcgtctttaagaccatgggcgcgggcggggccggcgccggggccgcggcggcaagtggcggggtggatgtggctgcagaggcgccgcctggcgccaagcagcagcagctcgtgccgcagggcaagcaggcgtga

SEQ ID NO: 6665 - DNA, 1254 bp, Chlorella protothecoides
  modified_base (135)..(144): a, c, t, g, unknown or other
  modified_base (629)..(638): a, c, t, g, unknown or other
atggctgcaggtgcggggctggtcgactggacggggcgcactgcatgtggggcgcggcagcggtgcggcctggggcagcctgggtcacgccgtgccgtgcacagccctgtccaccgcggcgatgaccatcttcannnnnnnnnnggtcacgccgtgccgtgcacagccctgtcctccgaggtgatgaccatcttcacccccggtcccacgccacagcgggggtactacaactggaatgcagtgtttgcgccgtacaacagcgcgaccgccgaaggggcccagggtcgcgtcgcgcgagagcagccctgcgacatgccggcgcacctgtggatggtggccacgcccgccgtggccgcctgccttggcatcgcgtggcccggcgggcccgacgccgtctcgagggaggcgcagcgcagcgaaggcggcggggcgcaggcccaggagaccgcggagcagacgaccccgcggctcccatgcctggaggagccgcctgccggctgggagcgcgcttatgccatggcgtgcgaggcggcggaagacctgcgctggacgcacaggggactgcgatcggaccacgagagcgctgcggcggcccacgaggcggggggtggggagcctgcggttgaatnnnnnnnnnnggagcgcgcttatgccatggcgtgcgaggcagcagaagacctgcgctggacgcacagaggactacgatcagaccacgagagcgctgcagcggcccacgaggcgggggatggggagcctgcggttgaaacgcagggcaccgcatcctcgattgaggtggaggagagctttcagacaccagcagtggcagacgatggggaggcggatggacgtctggtggcctcgttggtgagttgcgaggcgccgagcagcgccacgcctagcccagactccctttgctgtgccaccagtctggcaggccatcgagattcccagcaaccaggcccgctgggcgccgctgcggcgtggcgcgccctgcgcggcgcctccgccgtcgtggctatgcaccccgaccaggccaccgagtttgctgtggacctcgcactggcgctggacgtgcccatggcggtggtgccgtgctgcgtgtacgcgtcggacttcccgcaccgccggctgccggacgggcggcgtgtcacctcccacgaggactttgtggagtacctgtgcgccaagcacccctccatcggcaccgccacgctgcccttcgagggcaagaacaccctggtgttccggcgctga

SEQ ID NO: 6666 - DNA, 1188 bp, Chlorella protothecoides
  modified_base (293)..(302): a, c, t, g, unknown or other
atgatgaccatccctccaaaccgcacccccgcagacggaccccttcaccctatcggcctgggtgctgagccagcagcacctgaccgcccccaatgccaagggccggctcactgtcctcctcaacgccatcaccgtggggtgcaagtttgtcgcctcggccgtgcgcaaggtgggcggtggggtttgacggggcctggctcggggcactcccccagcagtgctgggcagatgggggcactggtggccagcgctccccggtcccacgagccccctccatcagtaagcccccctcnnnnnnnnnntcggggcactcccccagcagtgctgggcagctgggggcactggtggccagtgctccccggtcccacgtgccccctccatcagtcaacccccctctttgaatacaatccgcaggctggcctggcagggaacgacgtgctgggcatggccgggtccagcaatgtgcagggcgaggaccagaagaagctggacctggtggccaacgaggtgttcaagaacgtgctggcgcgcacggggcagtgcgcggtgctggtgacggaggaggaggaggagcccatcttcatccggcccgagcagcgcggcgagtactgcgtggtgttcgacccgctggacggctcctccaacatcgactgcggcgtgtccatcggcaccatcttcggcatctacaaggtcgcgcccgggagcgagggcagcctggcggacgtgctgcgcccggggcgcgacatggtggccgcggggtactgcatgtacggctccatgacctacctcatgctcagcacggggcggggcgtgtcggggttcaccctggacccctccctgggcgagttcgtggccacacaccgcgacctggtcatgcccccgcgcggctccatctactccatcaacgaggggaacgcggcgatgtgggacgccgccaccagcgcctacgtggcggagaagaagcggccgccggggggtgggaagccctactccctgcgctacgtcggctccatggtcgccgacgtgcaccgcaccctcctctacggcggcgtcttcctgtaccctgccgacgccaagaacaccaaggtatgtggggtggtggggcatgccgtgctggtgttcggaagggaggagggtgtaccatgcagtggtgtggaagctgcccatgcagggcctgttcacccctag

SEQ ID NO: 6667 - DNA, 297 bp, Chlorella protothecoides
atggggaaaggagggaccaagttctgcggcgacgcggtgggagtgcggctcaagtccgtggggtacacattgaaggatgcgaagaaggacatggaatccttccttcaaactgggcaccacccagaagttgagcgtctgaagacaaagcaggccaatgccgtggtgctgctgccagaggccagcaccgcccggccccatgtgtacatggatctgacgatcagcgggaagcctgcaggttggcatggacatactgtgggagttccaggccctggggtgctcctgaagaagatctgttga

SEQ ID NO: 6668 - DNA, 240 bp, Chlorella protothecoides
atggccgtctgggacccagacacggagcagctccagagcctgtgccgctgcatgagcgggttctctgacgcattctaccgcgaggccacggagaggctgaaggccaccgagattcctgggcccaaggcgtactatgacaccagcgagtcgccagacatgtggtttgagccacgcgaggtctgggagatccgcggggcagacctcagcctgtcgccggtgagtgtcatggaggagttgtga

SEQ ID NO: 6669 - DNA, 783 bp, Chlorella protothecoides
atgggcagcttccacaccactgcatggtacaccctcctcccttccgaacaccagcacggcatgccccaccaccccacataccttggtgttcttggcgtcggcagggtacaggaagacgccgccgtagaggagggtgcggtgcacgtcggcgaccatggagccgacgtagcgcagggagtagggcttcccaccccccggcggccgcttcttctccgccacgtaggcgctggtggcggcgtcccacatcgccgcgttcccctcgttgatggagtagatggagccgcgcgggggcatgaccaggtcgcggtgtgtggccacgaactcgcccagggaggggtccagggtgaaccccgacacgccccgccccgtgctgagcatgaggtaggtcatggagccgtacatgcagtaccccgcggccaccatgtcgcgccccgggcgcagcacgtccgccaggctgccctcgctcccgggcgcgaccttgtagatgccgaagatggtgccgatggacacgccgcagtcgatgttggaggagccgtccagcgggtcgaacaccacgcagtactcgccgcgctgctcgggccggatgaagatgggctcctcctcctcctccgtcaccagcaccgcgcactgccccgtgcgcgccagcacgttcttgaacacctcgttggccaccaggtccagcttcttctggtcctcgccctgcacattgctggacccggccatgcccagcacgtcgttccctgccaggccagcctgcggattgtattcaaagaggggggttga

SEQ ID NO: 6670 - DNA, 381 bp, Chlorella protothecoides
atggacgcgagggtggggtcgtgggggtggcgagggcgaggcctggaccccgcagcccaggagtgtgtggccccctgccgcgccaccgccccctttccaccgttgagggggttccccatgaccccggcttccctggtgccagattcccccccccctgtgtggagccccgatggacccaccccaccaccaccacaaccaccccctctcctgacctactccacaggggagagcaagctggacgcgctgctgcacggccactcttacaccgcccacccgaccggctgcgcggcggcgctggcggcgctggcggcatacgcgagccccgccctgaaccccaatgcgggcgcgctggcgggggccgcggcgcggcgcctgccgctg

SEQ ID NO: 6671 - DNA, 630 bp, Chlorella protothecoides
ggacagggcgcaggccaggggctctttagagagactgcgtgggtgccgggctgcgggcagcaggcgggaagttgccatgcagctgcggcacctgctcccgccccagcgtggctcgggattgcgagtgtgttgcatggggtggggcagagcatactgcagggggctgagcatcggtgcggggccctcctgcctcgacaaatcgaccttcctggacaccctccgtctccactctcccagctggcggaggcgatgctggactcggtgggccagggctgggcgtcccgcgccttcttctcggacgacgggtccaccgcggtcgaggtggcgctgaagatggccttccggaagttcctggcagaccggggggccacggactgggaggtggacgacggccccgagctgggggtgaggagtggtccgtgggagctagcggggggtgtccaggggcggacgccttgcacaggcccggcagctgtgcacccaaggcttccctgccggggtcactctgccccgggcccgcccgatgggcgcctggacagcgttgggtcccggtgtcggatgggtctgtccacctcccacacgcgcgatgaccccgcaccccggcccctcggccctgtccgcagcccttga

SEQ ID NO: 6672 - DNA, 972 bp, Chlorella protothecoides
atgatgggtggtcgcggggggagggggccgattacgggaggaggttccggtgatttagggttttggcaacctaccaattacccaatcatgctcatgatcacctgcgcacggcgcccgtaccgggcgagtctgattcctgtgtcaggacgatgcactgctggtccagtggtgggtacagagacagctgctctgacagaagcgctccatggctggggaggaaaggatggaccaagccagccaagcctttgcgctgtctcggtcagtcgacgtggaggtcgcacgagattaataagcacttctgagaccagctctgagtcgccagtcttaccccctgaccgtgcatcactgattgacacagagcgcctgcgccgcacttggacgatcccccctgggagcaggatgccgggcttcaagctgcccgccatcgaccagaatgacgaggactggggccccaccaccgtgccggaggcattccgcgatgtcccattcatgccatacagcaagggcgaccgcctgggccgcatcgccgacttcagccagcaggccagccagcgtggataccaggggcggtaccgtgaccgcgaaattctgccgggcatggcggtcttcaacttcgagaagggcgaggaggtgggggcgctggatttggggaagtatgtgatcgagtcattctatagtgtagcatgggcaacatggatcgtatatgcagcgggccatgggctctctggatccatcgcctgggttccagaaaagaaacatagcggcttcacatgggaacagcagcgcttgctcagcagtcacagcatctcccctccctcaccccctctgcgtgcccctccaatccctgccacacaggacgaggccttcgagctggtggacacgcgtgtggtgcgcaagccccccggcggccagcgcggccgcggcggccgcggcggctggggccagggccgcggcgacggcggccgccccacg

SEQ ID NO: 6673 - DNA, 1440 bp, Chlorella protothecoides
atggcccaggtggcggccagtagcgcggtcaagagggccatcttctgggcggcctacgggtacaagcggcggcgcatggcggagggggacatgacgggcgggcggtgggcgcccttcttaaatcgcctggtcttcaacaagatcaaggccgtggtcggaggtgggaagaggtggctgtggttgggactgctggggttaggagtctgggggggagcattcaatgccccccccaaatttgatcaatgctgcagcggcagtcctgggttcctcatggagaccgcccccagccttgcggaagccttcccacagagctgccatccaatgcactctgcacctcctcaaccccctccaggcgaggtcaaggtcatgatcagcggggccgccgcgctctcccaagatgtcttcgagttcctgcgcgtcgtgttcgactgcgtggtggtcgagggctacggcaccacaggttttgagcgactccatgctctccgggccaggcatcgcatggtgctttccccacctgaagatgagaccacggccgccgccacggtcaccacccccggcgacccggtggtgggacacgtgggtccccccctgccatcctgcgagattcggctggccgacgtgcccgagctgggctacaccagcgcggacctgcctgatccccgcggcgagatctgcgtgcgcggcaacatcgtgttcaaggagtactacaaggacccggagaccacgcgggagacgatcgacgcgcaggggtggctgcacaccggcgacatcggcacctggctccccggcgagcgcctgaaggtcatcgaccgcaagaagaacatcttcaagctgtcccagggagagtacgtggcgccggagaagatcgagggcctgtacacccactccccctacgtcgcccaggtcttcgtccacggcgacgccctgcgctcgcgcatcgtgggcgtggtggtgcccgaccaggaggccctcctgccctgggccgagagcaatgggctcgagccagacctgggccaggtgggtggctggccgtccggggtggggaatgctgatgaatggctttcactccctgggcacgactgccgggcgtcctggcgcttgtctggagccccactgtgctgcgtgtggttgcgagtgcctggtgacgtcaggaggagtggggcagctgcaggtgtgtcacccctctggccagcttcccaccatgacctgcagttgtgtaaggaggagcgggtgaaggccctgatcctgcagagcatgctggaggagggtcgcgccgccaaacttaacggattcgagcaggtggtggacatcaccctgacgccaaaccccttctcggtggaggccgggacgatgaccccgaccttcaaacccaagcggccccagctcagggccgccttctctggcgccattgcagacatgtatgcccgcgcgcctgcctga

SEQ ID NO: 6674 - DNA, 1419 bp, Chlorella protothecoides
atgcccaatgcagcgctgacgctgagccaggcgctgggcgtcacccaattcctgaaggtcgtggtgacttcttccgcccagtttgagagccggttcaactcagtggagcgcctgcttgcgtactgggacctgccccaggaggcgcctgcctacctgcctgggaaagagtgcgtcgttgttgacgagggctattgttggggtcaaagagtcttcattgaactggcattgcaggttatggagttcgttcctccacaggagcgtgttgccagttgcagggtatggcccccaacttgccctcatccctacctacgtctgcttctatgcagggcccctgacgcctggcccaagaagggcgcactggagtacaaggatgtgtggatgcggtaccgtgcagagctgggcccggtactcaagggtgagctggggttggcgggaggggaccccaggctggatggggcttggcatccgccacctgcgcaagtagcatctgcaggagtctgcgcattaggtggcgtgacgttctccgtggcacccggcgagaaggtgggcattgttggccgcaccggcagcggtaagtccagcctcatcgtctccctcttcaggctggtggagccgtaccagggctctattgtgctggatggcatagatcttctgtccctgggtctgaacgacatccgctctcgcatcgccgtcatccctcagctgcacagccgagtcgtgatatattctgtccccctctacacgcttgactatacatacaccctcgcaagctccaatcgggcccccctgccagatagtctcccaaccaccatccctcccccactccacgcccaggacccgatgctgttcagcggaagtgtgcgcgccaatctcgacccatatgatcgctacacagacgccgatgtgtgggaggcgctggcgcacgtcggcatgcgcgaccccgtggcagcgctcccggacggcctggcggcacgcgtggcagaaggcggcgataacttctccgtcggccaacgccagctcttttgcgtcgcgcgcgcgctgctgcgcaagcctcaggttctggtggcggacgaggcgacggcctcagtagactccgagacagacacactcatccagcagaccatccgccgcgaattctggcactgcaccagcctcaccatcgcacaccgcatcaacaccatcctggatgccaccaaggtgtgtgttgtgcacggacctttctttgtctgcaatgaggaggtctctgtgcgtgaaggggagtgcaatggtcgctgggggttctgccaggcgctgaacatgcctttaatggctagcaagagcactggaggccgtctttctgcaacacttcctgatccaccctccagggccgctgccataccatgttgcccatccctcataccagtgcatttaccaccctaa

SEQ ID NO: 6675 - DNA, 1551 bp, Chlorella protothecoides
atgcaggggaatcgggtgagaaggaaggtaagctgttcttatcaaattccgatgattacatacgttgagagcctgtgggtagaatatcagccagtgttggcatgtttgtgccaatggcttattcaccttttcaccctttatgccaccaacccaattcagatcaagcctggggagttggtctgctgcgttggacgagtgggcatgggtaagtcgtccctggtgcaggcccttctcggggagatggacaaggaatctggacacgtcagggtgaggatggtgaagtgcactgtggagtacggatgtaccgtgccaatcactcaacctgatgcctctcgcattcctattaggtgggtggctcggtggcatacgttgcacagcaggcctggatcatcaacgccaccgtcaaggacaatgtgtctttcggaaaggagtgggatgaggccaggtggaatgcgaccgtggaggtgggttgagcagcttggtcggaagtgctcctacgctctgatggccacctcttacctttcaataatgccctggctaaacgcattttgcagctggccactggccgctgcaccacgctccccatctccccgccccgccccaccccaccaggcatgctgcctgtcccaagacctggcgacgctgccgggcggcgcagacacggagatcggggagaaggggatcaatctttcaggcgggcagaagcagcgtgtctcgttggcgagggccatgtatcaggtgggggcttggctaggattgagtggccaactggtgcacatcagcagcacagttctgctgtcattcttcagagcccatctgtgtcttggtgagatcacgcatcttgtgtccccttctcgcccttcctcctctcaggatgccgacgtctacatcatggacgacccactgtcggcggtggacgtccatgtgggccgtcatatctttgagaacctcatcactggagccctcaaggtgggcaagattgcttatggggtgtacgctgcattattgcatgtgcagcccctattgcttcagtcacccacccatgcttcctctcctcctctccctccgcaggccaagacgcggctgctggtaaccaaccagctgcagtactgcccccacgccgaccagatcatcgtggtggatgagggccgggtggtggtgcagggcgactacgatacatgcatggcgcaccccatctttgccgggctggtgcgggagcatgccgccgaggcaagggctgatgaggaggccccgatggctgtgctgtcctccatgctgttgagcgtggagctgtcgatgcgtgccgtctcccgcggcgaggcggcaaagcatgaggtgctggaggagctggactgggagccagagttcagctttgaggaactgccacaagccccatccgccaggcttgctctcacagggagcccgctggtccggccttcccgggtctctaccacttccggcatcgagcagcacgatgtcaaggtgtctatcggcgtgcaggctggggctggggtgagggagcaaggctgccagcccctcccatctcgttga

SEQ ID NO: 6676 - DNA, 213 bp, Chlorella protothecoides
atgctgttctacagcagcgagaagtacccagtagaggacgagtacagcaagttcatagccaagcatggaggccagaccaacgccttcacagcgagcgagtcaacaaactatcactttgatgttaattgggacgccctggcaccagcactggacaggcatgcgggtggagtgagtggagctctcttcttgccacaagccattttcgctatgtag

SEQ ID NO: 6677 - DNA, 186 bp, Chlorella protothecoides
atggtgcatgcaagggagagcaccgatctgggtggcggtgctcctggcctgctgcgctgcccgatcaccgacgagaacggatatcgcttcgtcaagcttgacaatggccttcaagtactacttgtgcacgaccccaagacggacaaggccgccgtggcatgcgatgtgaggagacctcgccattga

SEQ ID NO: 6678 - DNA, 498 bp, Chlorella protothecoides
atggtggcagaggacaaggcgcaggggtcggtggcgtggagcgtctactggcgctacatcacctgctatgggcgctgggcggccctggccctgctggtctgctggagcggggaggagaccacgagcgtgctgaccaactggtggctgagcaagtggagcaccgctgaaaccctgaatgcggtccaagtgcaagctggtctccccaccgactttaaccgcatcagctacatcggtggctacctgggctttgccctcacctatgtattgctgggcaccctgcgcaccattgccaacttggccagctcgctgaccgcctcccgcgccatccatgcacggagcctgctgtcgctgaacaggtcccctgtcgccttcttcgacaccacaccgattggacgcatactgaataggttctccaaggtacttgaacctgaagtggagggggcggtgcaagctcaaggctgggaacacagtcctgaggggctgaggcacggtctctga

SEQ ID NO: 6679 - DNA, 345 bp, Chlorella protothecoides
atgctgggcacggtgcgcatcgatgccctgatcgccggcaacgtgccgtccgccgacgcgcgggcgctgctgcaggcgctggaggcgcggctgctggcaggggctcccgtggccctgctgcgctgccctctgattcctcgcttcgcgcctggcacgacaaccaccctcccacgcacacgtcggcaccgcaggcgctgctcccctcccccggcctcgcagcgtaacgaggcgcgcgtcgtggcgctgccctcgcccatgcgtgccgtgcacgctgtgccgggacccaacccggccaacgacaactccgccgtcgtcgtcgccttccaggtgctcggggagcggtag

SEQ ID NO: 6680 - DNA, 468 bp, Chlorella protothecoides
atgcatgggttgtgcctcacaggcaaccctgttcacgcatacctccatccatcacctccctgccaattgccacccgacacaaaggtgtacggaaggcatgacctcctgctggcgatacaccatgtgcctcagcgatacgaccctgagcttctggacactgtgctgagcacgctttgccccagcgaggttcgagttctctgggcatccagctccttccaggtccccaccgactgtcccctgaaggagccctggtatgggacggcacacagtgcaggcccgctgccagccgagtggctgactcactgggaggccgcgtgggggggcgagggggccgccctaggtgacaaggatggccatagattctgtgggatgcacctgccaccccctaacccatacatcccttcccgcttcgatctcatcaaggtgggcaaggggaatggtggagggggcttcactgccaccgtgtga

SEQ ID NO: 6681 - DNA, 1545 bp, Chlorella protothecoides
  modified_base (744)..(753): a, c, t, g, unknown or other
atggtgcaggggagaactccaggaacagagcatgcaaacagttggaacacatccttgaactcaacgttccaagcagcggtgatgtatgcagaatgggtggctgatgatatctggggagttttcgttcttcaagccatctcttggtggggcagctctgaaactgtgcctggggaaactcgaatgtgcgcggggtcgaatgcaccctgccctggcctcgctcatgcgggagctcgatgccctgcacagtacgcccgtcgcccctcccacccaaccccctccctcttggcctggagcctcgccctcttccacacaccttcgcctgggtgtggttttcacccagatcaagaccctgcgactgcgagatctccaggggcctgcctcgtgcctgggctgacccgcccctcgtcccctgcctgtgcgcgcacgggatgcccgcctagccttccccccgatcttccgcttgatccacctcctcgctctgcttccgccgcctgtccgcggcgtgtgaggcctcaccatggcggagttcgtggagatggaggagatcgatgccgtgcggatggtgtggaacgtgtggccgcacagccggctggaggctgccaagtgcgtcattccctttggcgtgatgtacacccctgccaaggcgactcgaggcctgcaggtgcggcgcctggggcgtatggtgtgggtttgggggcaggtgctggcgccgtgacacctggtgctcgtgcccagggtccccannnnnnnnnngggggcaggtgctggcgccgtgacacctggcactcgtgccctgggtccccgaggggaatcctgagacgtgccaggcctctggaggcatgcctgggcagcagtgcactgtctgggttggggagctgccggtcgggggccctgtttcggtggctctcgagcacagccacgggatggcaggcagtgctgccggcgcggggatgcagggacgctgcgtcgtggtcaggctttcaacccccacccacaccccgactggctgctcatcccacccacacccacaccccaacccctcccacacaggccatcgagtacgacccggtgcagtgccgggggtgcggcgcggtgctcaacccctatgcggcggtggactttgccagccggcagtggggctgccccttctgcctgacgcgcagccccttcccgccccactacgctggcatctccgagacggtgctgcccgcggagctcttccccagtgccaccaccgtggagtatgccacggcgcgccacgccccccccacgccgcccacctacctgatcctgctggacacctcggtgcccgaggacgagctggcggcggccaagtcggcgctgcagcaggcgctgtccctcatccccgaccacgcccaggtggggctcatcacctttggcacccacgtgcacgtgcacgagctgggccacgccgagtgcccaaaggtctacgtcttccgcggctccaaggagcacgcggcgggggcggtggccgcgcagctgggcgccggctcgccgggcccccgcgccgccggcggcgcgggg

SEQ ID NO: 6682 - DNA, 321 bp, Chlorella protothecoides
atgctgtccctgctgggccagaacccgggcgtggcggtgcccgtcatcctggcgcgcctggtgcagaaggacggcgagtggcgcgaggcgcgcgccgggctcatgcccgtctggtcggccatcttccgcgacaacttctacaagtcgctggaccaccgctccttctacttcaagcagggcgagaagaaggcgctgaacaccaagggcatggtggcggaggtgcgcgaggcggcggagcggcgccgcggcgaccgcgccgcggtcctggccgccgtctccggcgcggggctgggcggcgaggcacgcggcgcgccgcacgcc

SEQ ID NO: 6683 - DNA, 393 bp, Chlorella protothecoides
atgtccatcagcgagctggacgtgagcacctgggagcggtgcacgccgtcctacgtggcgctgccggtgaactacccgcgcctggcggccacggggcgcgacacggcggggcaggctctgctcaacgacggctgggtgtcggtgacgagtgggtcggaggactactccttcaagcactaccgcaagaaccagtatgaggaggcgctgttccgcgccgaggacgaccacttcgagctggacatggtgatgagccagaactcgtccaccatcaaggcgcttgaggtgtggtgggtgggctggtgggcggggtccgggggttgggagggggagtggtttgaagggaggaaaggaggccgggagggggagtggaggctgctgggtagggagcgttga

SEQ ID NO: 6684 - DNA, 612 bp, Chlorella protothecoides
atgaattctcacagaattgacacggcaggcgtcatcctgaaggtcaaagaactgtttaaaggccactctgagctcattctgggcttcaacaccttcctccccaaagggtacgagatcagactggatgacgacccgatccccgccaagcagtgggccgaacctgcccgggccgccccccaggctccggcccagcgcacagaccgcgagcccaaggcccctgtcgagtttgaccaggccatcagctacgtcaacaagatcaagcagcgcttctccacggacgagcgggtgtacaaggccttcctggagatcctcaacatgtaccgcaagggccagaagtccatcggcagcgtgtatgaggaggctggtgtttgggcgggtgcggtgggtgcagggacgccaggggcgtgtgagggcctccttctgcatgaggaacctgccgtgcggagcacgggagcgctgtcaaagcagtaccctcccaacctttgctctccccaggtggcgctgctcttccgcaaccacgacgacctgctgagggagttcacctacttcctgcccgacaacaccccgccggtgaggacctgggggtggaacgagggggccagtgcctggtga

SEQ ID NO: 6685 - DNA, 909 bp, Chlorella protothecoides
  modified_base (793)..(802): a, c, t, g, unknown or other
atggcattccggaaccagaagctcagcgtttcagcgcagcagaatgacgtgcacaagcggatcctcactggcctcctgcgccaggaagagaaccgccgatgcgcagactgccatgcacgtggaccaacatgggccagtgtgaatctgggcgtgtttgtctgcctcaactgctcaggtgacgagcggatagacgagggcagggtggcttcactgtatggcaggttgattgtgggagccccctccacggcaacccatacgccatctcagcttacacactatccgtccactgccaggtgtacatcgcagtctagggatggcagcaaggctcatgaccacggccttccctccccatcaatgcttcgtcccaggacacatggctgccagagcaggtcgcctttgtccaggccatggggaacgcacgtgcggccgggtactgggaagcaaacctcccgtcaggcttcaggcacgtgcggagggttgtgtcggtgtagtgcctgtatgagcctcacctccctcttcaggatcaagactggctggttcattgttttgcgcctgcccgcacgcccccaccagccgctcgatcgccctcctgctttccatccatgcagccggccccccgacagcgacatgggcctgctgcggaccttcatcaccgacaagtatgtgcacaggaggtacgcgctgcagcaatcctccgagccacccagcatcgacaacttcgccgctcacccggtatgtgtggatgtatgtgtgggaggggggggggggctcctcatggtggttcctgatgcannnnnnnnnnatgccgctcacccggtatgtgtgggtgtatgtgtgggagaggaggtggggggctcctcatggtggttcctgatgcaccataagtacccatcaaatggctcttcctga

SEQ ID NO: 6686 - DNA, 1266 bp, Chlorella protothecoides
  modified_base (324)..(333): a, c, t, g, unknown or other
atgcggaggtcgctggtggtcagcgaggatcgaaacctgtgctgggcgcgcaaagttggcgacgggcgcccaaagtatcgagaccaccgcgtgccgcggatgccgagacccaccaagtacttgcaatcgctgttgcgaggatgtagttccgacatcgcaagtagccttgtaggatgtctggactcgtcgggcgtgtcgctttcatcaccggcggtgccaagggtacgtaaacagagaattagttgcctgggtgcaaatccgatactccctgggtccgactcgcaagcatatgtattcacaatcaaccatacgcaacatctcccnnnnnnnnnnatcaccggcggtgccaagggcattggcctggcatgtgcccaggccctggggcgagggggtgccagggttgtgatcgcggacgtctcggccgaagacctgaagagcgcggagcgtgatctgggggccgagggcatcgagtgcgccagcgcggtctgcgatgtcggcgacaggacccaggtggaggccgcggtggacttcacggtgaagactttcggaaagttggatgtcgcggtggccaatgccggcatcgtgcgggcggcggatttcctggatctcacagatgcagactgggatgcggtcatccgggtcaacctcaccggcgtcttcctcgtgcgcctgcctcacgggggcctgttctgcctgccgcttccaggacatgtatccgcgggtgcccatggagtgcgcagccgtctcaaactgagggctgcggccctgatgctgccagccccatcgtcagcagacctcttttcacccctcctccaaccacagaccggccaggtggccgctcggcagatgaaggcgcaggggcacggcggctccatcgtcaacatctcctccgtcaacggcgtcatggccatccccaccatcgccaactacaacgcctccaagggcggcgtgaacaacctcacgcgcgccatggcgctgtccctggcgccccacgccatccgcgtgaacgcagtgggtccggggtcaatcatgaccgacgtgctgcgacaggtggtggccgacaaggcggccatggccaaggtgctgtcccgcacgcccatgctccgtgccggcgaacccattgagatcggaaacgtgggccccgggggagtgggaggggtgggagggaggggcccaaggtgcttgtgctgtgggaagcgctggtcgatggcgtctgtcgcacgcgctgacctttggccgcgtctccctctggcggtgtgtacctga

SEQ ID NO: 6687 - DNA, 1509 bp, Chlorella protothecoides
  modified_base (538)..(547): a, c, t, g, unknown or other
  modified_base (795)..(804): a, c, t, g, unknown or other
atgtcaggcgggatgcgccctgacccacccagagccgttcccccccggccggcagcagcactcacagttgcggtagcaagagatggacggcatgattgctcctcagcctccccgcgctatcactcctcttcaacgcacagcaagcgacagaggaaccagtcgcctggaaagagactcccacatgtccgtcgtgccactcacagcctgggcggcgaggggtcctcgctcctcccggaggcgggaaagtgcaccactttcattagaaagggtggaaaggccatgctcatgcccgaaccctttacaacgcgaaatcctccgataacttggtcggtgcggacatcattcagggtctccatgcattcaatttattctatcgccagatgccgggccggctgggtaccatgtcggccgcatcgaggggcaatcgtcgcgagggacccctccgtgcattcctctgcagcccgattcgtgcccagagctgcgcacaatcgccccccttcaagtgtggaggcgacaaatggcgaactgataaatgagnnnnnnnnnnttggtcggtgcggacatcattcagggtctcgatgcattcaatttattctatcgccagatatcggggcggctgggtaccatgccggccgcatcgagggacaatcgtcgcgagggacccctccctgcattcctctgcaccccgattcgtgcccagagctgcgcacaatcgccccccttcaagccatgcaatcctgtgaagccatcagatcagaccccggggcacaacatccgcaaagtccatcctggtgnnnnnnnnnnaccaggatcaatggtgcatggattgcatggaaggccatgcaatcctgtcaagccatcaaatcagaccccggggcacaacatccgcaaaatccatcctgctattgtgtacaggtgcacaggatccagcatctccagggtgaagtcatcaaaggggtcgcaggagttgacagaggcgaatcgacactagaccttgggtgcgtgcttctggcaaacactgccgctctcatgctcccaagtgctgtcggtgcaagatcactgagagtgctcacttctcaatgcaggacgcttgcggcactgctggctggcgacggggcgtgcttcctcctgtttgctgctgtcggacgcatgcagcatggggagggcctggcccccctgagcctgctcggcaccgcaggccccttccttgcagcctggtatgggacggccctgctcctcgggacgtactcaaggcaggagctgcttcgaaaacctgaacagctgttcaagacctgggcggtgggggttccccttgggatcggactccactccctcgccaagggtcatgtgcctgcgctgagctttgtcctggtctccctggcctccactggggcgttccttgccagctggagggctgtgtacaatgcactggctggacccatggtgagtctgatgggtgggggggagctaggcagaaatcgcccttcctctggagcggaaagaggatga

SEQ ID NO: 6688 - DNA, 405 bp, Chlorella protothecoides
  modified_base (98)..(107): a, c, t, g, unknown or other
atgcggtacaagctcttcttcattgcctttggtgggcccggttcctgcacaccgagcacccacccctgtatcatcggccactcccgcagatggcaagnnnnnnnnnncagtgccacccgcgctgaggtcggatgcggtacaagctcttcttcattgcttttggtgggccctgttcctgcacaccgagcacccacccccgtatcatcggccactcccgcagatggcaagaccttcaagaagccccgtcgtccgttcgagaaggagcgcctcgacgccgagctgaagaccgtgggcgagttcggtctgcgcaacaagcgcgagctctggcgcgtgcagctggtgctgtccaagttccgctcccgtgctcgtgagctgctgaccctggaggagaaggaccccaagtga

SEQ ID NO: 6689 - DNA, 312 bp, Chlorella protothecoides
atggctgacgcgatgaagggagccacccgggcgatgggcatgatgaacaagaggatgaacctgccagccctggccaaggcaaacctctcccacacccgccacatccccctccgcctcatcgattcacagatcatgcgggagtttgagcgtcagaacgagaagatggagatgaccagcgaaatgatgggtgacgctgtggacggcgcctttgaggagggcggggaggaggaggagacagacgagcttgtttcccaggtggggcctgcggcggcctgtgccgctgcaagaggacggctttggactgggcactga

SEQ ID NO: 6690 - DNA, 516 bp, Chlorella protothecoides
atgcaccgccaaacgtctctcttgctaatcagtaatgcttccctcctcttcccccagacattcacagcatccctccagttcatcctccggcctggctttgcgttcaaccagggctaccacgtgagcctggtgccggaggaccccagcaagtatgcatcaggccacatgtttggcaaggcagttcgtgaggagagcatcgtcgcgacctttcctcgtccagagctgccgatagagctgtacgagtttgagagctgtcccttctgtaggcaataccttaccttgctggatgcttgctccgcaccccgcaggaaggtgagggaagctgtgaatgtgctggacattgacgtcaagttcttcccctgccccaagaatgggccgacctggcgcaagcaggtcaaggagaccaccgggaagtcgcagttcccctacatgaaggaccccaacactggtgggtgcgaggaggggggaaggatgagagggagagcgcctgagtgtggggggatgcgaagagtgtga

SEQ ID NO: 6691 - DNA, 525 bp, Chlorella protothecoides
atgctggaaggggggacggtgggaacatgctcgctgcttggagcacttgtcaccccagtcagggtacgtggggtgcagcagctggcacggcatggtgggcctggagatcgatcagcgcccagcaacgaaccccctccccccgcccgaccaaaaacacaggagctggacgaggcggcgcggcggcgcatgcccaagcagctgtacatcccgctgccctgcgccgaggcgcggcgcgccatggtccagcgcgcgctgcgcggcgtgcgctcccggctggaccccagcgagctggaccgcctggtggcgcgcaccgcgggctacagcgggtcggacatgcggggtctggtggccgaggcttgcgccgggccggtgcgcgaggcggtggctgccgcggcgggggcgggcgcgccggggtcgggcgtggcggcgctgagggaggacgacctgcgtccggtcagcctgcgcgactttcaggtgctgcctggaccgtgtgcgggccgagacctggccgtcaagagggcgtga

SEQ ID NO: 6692 - DNA, 963 bp, Chlorella protothecoides
atgaccccccatcagggtgaggccaagcggctgctggtcaacgcactgaccaagacgctgccgaccaccctgggcttcctccaaagcgtcctggagggcaactacagcgctttggctgggggagggggcgggccagccgccgaggccgccgtccatgcagccctaggtatgcgatgcctctcagagcactgttcggctgttgggcagcgaccagaggtgtgcatccaccctcacctgcagtcacaggggcgcaggggcgctctgggtgcacgcgtgtgtttgggcggcctcgctgccccgcttggcccctcgccgccgacccgctctcctgactccactccaggcgcgacggccaccatggcggactgggcgccgcagggctccctgctctcatccggactgctgaacgcctgcggcttcctcctcaccagggaggagttccgcgacgaggcgctgggcatcctgcggcacatggcaggtcggcgggcgcgtgggggctggtcggcgggcgcgtggggccgggtgctggggcgtcgcggcacagcggcggtgcgaggccccccggcctgcagggcgcaagggctgggtggcaacccctggatgccctcggggggcggccacccgccctgtgccccattggccatgcacaaaggcttgcgccaccagtgtgccccccccccaccaccaccaaacaaaaaccacacacatgccacaggccggaaggtggagcaagaggacgaggcggcggtggcggccgccgcccgcgcggtggccgacgtcctttcctcctgcgcccagtccctgctcttcccctccgcctcgctgggctgggagggcgaggacgaggagtttgcggagggcgtgtgcgaggcctgctccgtgctggccgccacgcactgggcgcgcgcctggggcctggcgcccgcgatcccggcgccggcgggggcggcggggcgcgcggcg

SEQ ID NO: 6693 - DNA, 966 bp, Chlorella protothecoides
  modified_base (734)..(743): a, c, t, g, unknown or other
atgatcagacccccccctcccctccaaactcgtcccgctgcagctgaaatctggcgatgcagcagcaggcgctgcagtcgcaacggatctcatcagtgcccacaggcccctggaagtgagggtgctgggtttcacgctcctccagcacctggtaggctctgccctgggatgcttgagagaggagggttggaggttgtggaggggtcggggcgcgctgggccgagttccaggagtcggaccagcagcagtgggcagcagtcacgtttgcgcagctgcagcagggtgagctggttcagccccggaacccgggcacacctggatcccctgcaagtcctgccgggtgcctcgagcttctgccggcagattcgtcccatccagacgcgatgtaacccctccctctccccctaccccgcagccgccagcggggagaactgggcgctgcgcagcaaggcggcgctgctgctggccttggtcatccggcgcatgggcgcggaggtgtgggactcggccctacagcgcctgctggccctggcaggggaggggccggtgtaccagggtctggtggcgctggtcatcaagtacgtggcggaggagatcacccaggcctcccaggacgacatcggggtaagtgtgacgaccttgtgtacttgttttggggagagtgtggggatgggaaccggtgtcaagggggaaagagatccacccatttctttgggagagcatgtttggagctnnnnnnnnnncggtgtcaagggggaaagagatccacccatctctttgggaaagcgtgcttggagtggacagggggctcgcacgcgcgtgttggcatgggttgcggcgtttggctgccagtgtgcacccatcatcggctggcaccacaccctcaccctcgcagcactcaccctggaccccattcccaaccctcatgcccatttctgcgaccctgatcccatgtcctcctcatga

SEQ ID NO: 6694 - DNA, 999 bp, Chlorella protothecoides
  modified_base (800)..(809): a, c, t, g, unknown or other
atgcgtcgggaggggcccaccacatcagggtgtctccagggatcccatccctggctgggatccactgattgccagccaacaatcccgatggacataaaatttgatcttccggacccctccaaacggtccctgttggcggctgtgggggtggaggcacgcagcccgtacacccccctccgcatacatgcctgcgggcaaaatgtgaccctcctcatgctcgtcgctcgggttcactgcttgagcaaggtgtgcgagtcgagagtcggtcggcaggggccatcgacatcctggcacattgtgcggtgggacacccgaaacccccgaccacgcccggcgcacgctccccctgttcctcctctgcagatcgagtcctacttcctggagtccccacaggagctgcagtcaccgctgaacctgcgaaatgaggctgcggcggtgtccctgctcctctcctacctcccagggcctgggcaggaggagggttgtgaggaggtccgccaggccctcagacagcactgcgagggtctctggccctcctttgtccatggggatgcctcgatgcaggcggacagcgttagatacccggccgatgacagcccggcagcagattttcagaggctcatcatggggatcatgcctggaaggctgacttctgtgaagcattgcgctgtgttttctcaaaagatgtgggccaggtgcggcccctccccgtcgcccgaaccccgcgcgtccgtccagactcgctcatccgccctgaaccagcacacacgcaggtgggctgctgatgtgggcatccagtnnnnnnnnnnccctgcaattcgctatccaaaggctcatcatggtgatcatggctggaaggctgactcctgtgaagcattgcgctgtgttttctcaaaagatatgggccaggtgcggcccctccccatcgcccgaacccctctcgtccgtccatactcgctcatccgccttgaaccagcacacaagcaggtgggctgctga

SEQ ID NO: 6695 - DNA, 1065 bp, Chlorella protothecoides
  modified_base (561)..(570): a, c, t, g, unknown or other
atgcagggctttgtcatcgccgacaacccgcatgatgtcgtccccctgaccctagagctcccggccgaggaggacgcggccctgcacgcccgccgcaccgccgtatgggagcggctgggcctcgccacggagcacaacctgagtgccgcccgcctgtcgccgcagctgctggccgccctgcgggtggccgtggccacggccgaggagttggccgggatggagaccggggacgatccggggcgcgccccgctgaacccggagaacgaggcgcaggcgctgcgcactctggacgtcgccctggcccagctgctggacccgctggaggcctgcccgctcctggcggggtcgccacgagctgcaaactccctggagtccaggcagggagtggccatggcgggcgcaggggggcaggacgcgtcaggtgtggatatggaagatgcaacgggcgcccaggactcggcgcccggtcttggcaatgaagtccatgcagcagggtctgttggaccggggccaaccacagccatcacgccggagctggacgagaatggcatggacgacggnnnnnnnnnncaaagtccaggcagcagggtctgttggaccggggccaagcacagccatcacgctggagctggacgagaatggcatggacgacggctgggtggccagctcggctgcgtgccggcagtacgtgctgggccagcaggccatcctgcgttgcgcgcagcgggagtgcctcgcccggctgcgggcggccgtcgccggggtctaatgcgcaccccatggaccctggcgagatcagccgggccagtgcaggacctaagcagtcagaccagtaagtacgcctgccaagcaggaacccactccttggctcacccttcacattctctccagacaataacgaaccggatttccttctcccgttgctgctctccctgctgctcctggatgctcgctcctcctgaactgctcaagcattgttgccaaccttcttgcctcagagtatggcaagagacagtgatcgccagagacagtgattgtcaaacttgtactggtgtctgccggtag

SEQ ID NO: 6696 - DNA, 1188 bp, Chlorella protothecoides
  modified_base (840)..(849): a, c, t, g, unknown or other
atgccgtcggatgcatgcttcttcacacgcccagcgcggcagggaacctccacctcttctcccccgggcacctgctcaatctatgcgaccagactggcgtggtcccccgcggatcgcgccatcgcggctccagctctggtggaactggcagcggtgacccgcacgcagcaggcccccaacaagcccttcatcaggctggagtggcccacagggacactggtactagggtttaactctgtcagcgaccgcgatgaggctgtcgacctcatcaagaagctcagggagctggctgattggaggctgtacctcaagggacagcattcaagcaatttgaaggggtgttgcttgtccacagcccccctgatgccgttgacaagagtctgtcctgctaagcaatcgcaggcaaagctgttggcatcatcgaccccaccccctggagtgcccagtgccccgcagaaggccgcctactttgctcaggacaggcttgcaatgcctttccgaccagcccaacctgattgcccaagaaactgctgctggcgccgcaaggatccagcaggtgctccttccaggaggatggacatcgatcattgccagacctgctgccgtcgcttctgtatccagcacatcgtgcaccacctctgcctccttcagggacctggaaaagctgtacctggaactggtggtgccaggcatcctgccagagcaggagttctgggcggcccgcgcttcgcacctggcgaggctggggagtggggctggggcgtctgcgtctggacaccgcacagcctcgagctcgcagcggaggggggtcccgaactccctgacctcagaggtcaggcnnnnnnnnnntccccgcgcagcctcgagctcgcagcggagggggctcccgaactccctgacctcagaggtgcggggttgatacctcgtgccaggaaccggagcctagagtgtttgaaggggggaggcacgggtggtgagagcaaacagtgcatcttcaatgaacggcctgaggtgcatcgcgccttccttgccaaggtcccgcatgaactcaacgaaaaggagttttggacagtctacttcaaggagcagtacaagcgtctagcaaggaggtgggcgggccttgcttgctggaacccttcccccccttgtacaccgcctgaacaaggtcaccacatttggcggccctga

SEQ ID NO: 6697 - DNA, 1683 bp, Chlorella protothecoides
  modified_base (22)..(31): a, c, t, g, unknown or other
  modified_base (130)..(139): a, c, t, g, unknown or other
  modified_base (718)..(727): a, c, t, g, unknown or other
atgaacggcctgaggtgcatcnnnnnnnnnnggacgaagaggattttgaggacgaggtgtttggcccatttcgacgacggattgccttgcaggtccgaagatggtcaaggggtggcgcgcaggtgtccannnnnnnnnnagacgaggaagattttgaggacgaggtgtttggcccttttcgacgacagattgccttgcaggtccgaggatggtcaaggggtggcgcgcaggtgtccaggggttgggagccaccaaaccctcgttgatgacacagcctccaagctgccgcgcctgcatcgcgacaggccacgcggcaggagcgggtttctgaacctccgctcatgctgccctcgcagcggctgtgttggccaggatggcgtttcgatcattcaacagaatggcgtttcaattatccaacagtttcccaacgcacctccgcaccaacccctccatccacctcgccgcttccccacaggaggcagcacgggctcgcggcaggatgcaggaggtggaccccacgctgaacctggaggcggcccagggagagcagtacgccatgctccagcgctcggagggggccgaggccgggctgggcgccgcgggctacctggccaaggacctcaacaggtgggctcgggtgtgcctgctgagtttcaaggccaacctctgcgaacgtgtgcagtcaaccgcccctgcctggccccggccttgagcaaannnnnnnnnnaaacatccacgaatgtgcgcagtcaatcgcccctgcctggccccggccttgagcaaagaggtggcagtcaccccagcagcccgctggggtggctgccccgagatcccagcatcatccaaagccctctgcaaggggcatttgccgacatgggcgtgctggacctcgccggggacggggacggcccctcctcccatgacacggccgccatcgccacgcgtctggcggcctcccaggcgggggcgtcgcgcacggccgcgagggagcccaggggcgagccgctgcgccatcgcgaccacggccttgaagaccttcgagggcctgaacaggcacgtggcaggagttttttggggggggggagcaggccattccgctgctgccaggggcggggaagggggagggggggaggaagagaggagagggaggtgggacgttgccctatccaggctgcagggcatctccctggcccgccagcaccctccttacaaccaccccagcctgtgcgcagagcctgcctcccatacataactcgattctcttctgcgtcgtcctggcaggctcccggcatcccgctcaacatccgcgacccggcggcgtactaccgcgccggcgcgccggcggtcgacggggccgccactccggagtccgagcccatgagcaccctgcgcgatcccggcgaccacacccccaccccgctgtcggccgtgctacggtccattgaccccaccgcgctccccctctgcccctgcgaccccgcgctcgcccgcgctgtgctggaggagctgtccgccggcaccgacgcggggctggcggcgcgcttcggcgcactggcggctggtgtgcacggcgttcgcgccgacgcggcgctgccccccggcctgctgggcctgctgcgcgacgaggccctgcgcaccgacgagctgctgcgccacttctggggcgcgctgccctgggccgcg

SEQ ID NO: 6698 - DNA, 813 bp, Chlorella protothecoides
atgctgagcgccatccccgacctcaccgtggacaacctgctgatcctgttcaccatgatcgaccgccacgaccccgacagcacctgggcgcgctactgggcctccctccccgccgccttccacaccggcctcagcttcccgcccactctcgtgcaccgactggcggggacggctggcgcgctggagctgacgcgcgcgcagggccacctgaagcgccagtacgacgccacccggcccctgctggccatgctcctggcggcctaccccgccctcctctcccccgcctggttcgagttcgggcagtacacctgggccgcggagctgtggtacagctacgccttcgagatagagttcccgggcgcgggccgcgacccggcgcctggcgcaggggccggggcgcagggcaccggcgagccgcgccgggccagcggcgagagcatagcagtcccgccgggcccgccctgctccccggcagccgccgcctgcccctccgccggcgccacctccgcctccgccccagccccagccccctccacctccacgccggtcatggtgcccttcgcctgccacgtcaaccactcccccgcgccacatgtggtgaggtacgggcggctgagcgaggcgggcatgctcaacttccccgccttcaggccctgcaaggagggggagcaggtcttcatctcctacggcccggtgcccaacctgaagctgctgtgctactatgtaggcagaagagaggggtggggggaggtggggcgggggtttacgaggagggaaggacagggaattgaaaggggctggggagtgggttga

SEQ ID NO: 6699 - DNA, 261 bp, Chlorella protothecoides
atgcccgtgaactcagggcctgacgttgggacgatttcggggttgacggtcggacctcctgaggccccagccgacgaccctgcgctcgctggcgtggaccggagctaccatgttgtggtttccgcgcaaggccaatccgtgcactggcagatgcgcatcaattactaccactacaagaaggcaaagcgggcgtgtgccaagctgcccatatgccacgtgagacagacgggaggtagcgtcatgcacattgccccccgctga

SEQ ID NO: 6700 - DNA, 501 bp, Chlorella protothecoides
atgcacttggcgcccatcgatttgagacttgccaactcttccaaactccatcctctcgaggcctgcctcctcttccaacctccaccctcatcaaacccccaggaccacctgcgggccaaccacccctccatctacgccgactgccggtactccatcgtggagatcagcgccgcgctggccgccacgcaggcggcacgcctgggcgccgactccggccacgcccggcgcttcgacgtgcagcggcgggacgccacgcgcgccgacggctggcctgcgcaccctggcccctgcttcgtgctggccatggaggtgctggacaacctggcgcacgacctggtgacgcggcgcggcggcgccacctggcgccaggtcagcgtcgaggggggggcggacggcgacgcagcgtcaccgccgcgcgaggtggagggcgaggtcgccgacgagcacgtggcgcgcgcgctggcggcctggcttcacgcggcgccgccgccgcggcgcggc

SEQ ID NO: 6701 - DNA, 1059 bp, Chlorella protothecoides
  modified_base (461)..(470): a, c, t, g, unknown or other
  modified_base (928)..(937): a, c, t, g, unknown or other
atgtccctagcggcagctctgcgggcagtgtggtccccgggccagtgtcgaaaggcacaccgatgggcagcgtacatccccttcagacagctgcagactgtacagtctgagctggaagagccaggcacagacaaaagatacatcgatagattggtggtgacagcgcaggccgggcgtggaggctccggatcctcaagctgcatacaaaagagcaacaggggtgaggcatgtgaggctgatagtgggaggattctggtgaggtgcaggatcgatggtgtagctagagcattcgttgctccaaggccaaagattatgcaaaggggacgcaagatcaccgcagacggcggcaacggcggcagtggtggagacgtcatagtgcgggccagtggcaggtactcaatcgtcctggtgctggcgtgggcacaaaggggctggccccaccgccctcctgccagcctgcnnnnnnnnnnagccagtggcagaatgaagagtctggcaggtgtcggccagctgcacaaagcccagcctggctcccacgggtcctcccgggtccagcatggtggcgcgggtgacaacgccacgatcctggtgccgctcggcactctggtgtcccgcatcctggaaccttccgcaatggatggcgcgggcgaggaggcacagcagcccgctcagggccaggccggggtcctgcgccgccccgccccgcgtcagcccgcagatttaggacgggaggaggccgcgccgccgccggaggaggcggagctccccccctggctcgcacgctggcgcaccgcctacaccggcgacgccgtcgatgccgaccggcgggacggcttcgacgacgaggttgggggaggggctggtggccagcccggcgctggcccgagcgcgggcgcggaaaagcgtaggggtccccggcactaccccnnnnnnnnnngggggctggtggccagcccagcgctggctcgagcgcgggcgcagaaaagcgtaggggtccccggcactaccccactgaggttctggcggacctggtggaggaggggcaggaggtggtggtag

SEQ ID NO: 6702 - DNA, 828 bp, Chlorella protothecoides
  modified_base (814)..(823): a, c, t, g, unknown or other
atgttgatgcccgaggcatcccttggtgttccactcgtgactgcgccatggcctgacttaaatccaaaggcgtgtggcatgtctcatgcaggtgatttcagaaaaggtgcttctcaccctccccaaccatcacaggcctgcacccagggagtccacgcccggcgcggcgggggagcggcatcgactgctgctggagatgaagatcctggcagacataggtgggggggagttgccttgtacgtcgacttgctgctgtgtggagtgagttgctatgagaacaaagcggccctgcttaccctccgtagtaattgctgtctccacccagctggtaccacctggcgcctgggccgcacgcccacctccctttggcccccaccttcccctacaggcctcgtgggcgtgcccaacgccggcaagtccagcctgttgcgcgcgcttaccgccgcccggcccaaggtggggtcgtacgccttcaccacgctcatgccgcagctgggggtggtggatctcggctggggcgagcgcatggtcatcgccgacgtgccggggctgatcgccggggccgctgagaaccggggccttggccacgctttcctcaagcatgtcgagcggacgcgggcgctggcgtacgtcctggatgcctcggcgggactccacggtgcgatttcgtgtgctgttgtcgttcagcggtcaaagcttgagagcctcacccgggatccaggcccaggacgtgaaaagaatgttcaaagcggcgtgtccaactgtcaagggcacgctcttgaaacactctcccactcccaccgtcaggctcccnnnnnnnnnncatga

SEQ ID NO: 6703 - DNA, 339 bp, Chlorella protothecoides
atgttcagagcggcgtgtccaaccgtcaagggcacgctcttaggacactctcccactcccaccggcctgcggccttggaggcagctcgagctattgcgggaggagatcgcagcctactcccccgcgctggctgcccttccctcaatcgtgatcgccaacaaggtcgacctgctcccccgcccctcactcgtactgtgcgcgctgcgcgaacgcacccacctccccgtcctggccagctcggcccgtgacggcacgggcgtgccagagctgctgcgcgcgctgcacgcgctgtgggccggggaggaggtggacggcacccccccgccctgcccgacctga

SEQ ID NO: 6704 - DNA, 681 bp, Chlorella protothecoides
atgccagaactctgcgtccacacaccctcctccccctcacccaagcagccaccctttcctccctccccaacgcacatcgtaggtgtcgcccacgaggtgtcggggcaccccgccgtcgcgcccaaccacgccaagttccacggcatccgcaacgggatcgaccccgagatttgggacccggcggaggacgaattcctgccgcgcagctacagcgccgacaccttcacggagggcaaagcggcggccaaggcggagctccgcgccaagatgaacctgtgcgaggcggacgtgccgctggtgggcgtggtcacgcgcctgactcaccagaagggcgtgcacctgatcaagcacgcggcctggcgcaccctggagcgaggcggccagtttgtgctgctgggctccgcgcccgacgcgcgcgtgcaggccgagttcaacgcgctggccgctgacctggcgcggcagtaccccgatcgtgcgcgcctgtggtttgcgtacaatgagccgctgagccacctgatctacgcaggggcggacatgctgctggtgccctccatgttcgagccctgcgggctcacacaggtggtggtggcttgtacttgtgggacggggaagatgaggggaaacgacatcaggcatgcgaagcgagtccgtggcatgtgggacgatgggcgctgtggatag

SEQ ID NO: 6705 - DNA, 1059 bp, Chlorella protothecoides
atggtcaagggcccagcgagcgcctggtggagcaggcagccccctgcagcccccgcgcatcggtctcccgcaccacagtctgtgttcccccacgtatccctgccatgctctcatacgtcatgtcccagccatctcgacaacacccagaccccctccactgcgccacacccccaggtggagctggacgaggtggcgctggtggtggactttgtgttctgcgacgagcggcgcgaggcgtgggacaacaacgagcgccgcgactaccacaccgcgctggccggcgcgctggccgacgccgagctggcggcgcggctggcgtgcgccgcgctggagcgcgacgccgacgccgcggcgcggcaggaggacctggcggccaagcgcgctctggagaaggcggagatcaagtacgaggcggccaaggcgcggcgcgcggcgcaggccgccttcctgtacacccgccccaccacgccgcgtgcgggcgaggcggtggagctgctgtacaaccccgacttcaccaccctgcgcggccggccagaggtgtgggtgcgtggcgggttcaaccgctggaccgcgggcaacttcccgccccaggccatgcgcgccacgggcgtgggcggcttccacgccaccaccatccaggtgccgcgcgccgcgcacgtcctggacctggtcttcctggactcgggcgacgcgcacggcggcttcaccgacgacaaccgcggcctggactaccacctgcccgtggcgggggggcagggggcgctggacccgctgcgcgtcgtgcacgtcgcggcggagatggcgcccatcgccaaggagggcggcctgggcgacgtggtgaccgcgctggggcgggcggtgcaggaggaggggcatgaggtggagatcgtgctgcccaagtacgactgcatcaactacgacctggtggaggtgagcgggggcggtggagggtgggggaaggtgagggacgcgctgtggggtggggaggcgggggagagccagggcgggggaggcaggcggggacgagatcgggatggggagcacctgcgcgcgggatga

SEQ ID NO: 6706 - DNA, 1194 bp, Chlorella protothecoides
atgcatgcgccttctccccatctcagtgccacccttccacgagcaagccccgcctttcctcgcccctgcatcgcccagcttcagcggaggccccacatccagcggcacgaaatccattgcagggcagtcacagggtctcgcacttgcctcaaggaatgggcgccggtcgtcgaggccctcagggacggcacccagacgtggaggacgcatcgcttttctcagttcagacagagtcagggtctaaacccactccccgtcaaaccaactcagatcctgctccgcaagggtggactgcgcgaacccgtgttccgtccgacagacagctccttcctgctgttccccaccgccttccacaccgaggacgacctcctccggccccacgccaaggagcgctacagagcggtgaggcacgtggcggatggggcagaagggcatgtcccctggacagcaactcagggtggccgtgccttgggggggcctgtggcggcggcggtgacggacaccttccccgcccccgcccctcgaccaagcgcaggccctggcatacgaccctcgcagcgcccgccacctggagctggccacgggtgcggtgctgacgggggcctggacgaccgcggaccccgccgtcctgcagctgctggccgactttcacatctgggcgccgcgcttcctggatgcccggctgaggtggcggccgcgccagcccatcaccgtcctggagctgcgcgccttccggtgagcagtgcagggcccctgcagcatgggtgtcgggcggtgagcaggcgcgacgccgcctgcccgggccaggcgtgtgccgagcgcgcaaacccacaccctccgccccgctccgcccaggctggccacccccgcccgcctgtccaccgccggccccgacggccgcctgcccgggccaggcgtgtgcccagcgcgccaacccacaccctccgccccgctcggcccaggctggccaaccccgcccgcctggccaccgccggccccgacgtcttcggctgcttctcctggctgcgcgacgcgcctggcgcgccccagggctggctcccctccagcacccccgccctggacgacgtggcctttgcggcgcggcagctgcgctgccgccgcctcctgtcggcgctcacggccgacgaaatctgcggggacctggtgcagccagggaggctgggcgcgctgtaa

SEQ ID NO: 6707 - DNA, 747 bp, Chlorella protothecoides
atgggccgcgagctggcgctgacggaggtcgccgggcccctggtccacgcgcgcttcgaggacctgtgcggccgcccgctgggcgcggccgacttcatagccctggcgcaggccaagcacacgctgctcctgcgcggcgtgcccgtcttcacgggcgccagccgctcgcaggcctatcgcttcgtcacgctcatcgacgtgctgtacgagcatcgcacgcgcctcctctgctccgcggaggccaccccctcggacctctttgccaacgtggtcaccgtggcggcggccgcggaggccaggcgcaagggccgcccgcccggcccggagcaggcgagcggccggcgcgagtgtggctgttgttgtgtctgcgtgtctggggaggggtggggggcaagaaacgatggcggtgatttagcatcgggccatgcccagcgcccgcagtccggtggaggcttgaccccctccggcagcctggcccaggcgagaggcgcccaggcgagaggcgtcaccaccccacggcagtcctccaagccaacccccaccgtcgcaacacaggtggtggacgacaacctggggtttgccaaagaccgcaccatctctcgcctgctggagatgcagagcggggagtacctggaggcgcatgccaagtcccatgccccccacctcctgctggccatccaggagcagcggcgcaaggaggaggcccgagaggcggggctgggccgggcggcgggcgattcgggatag

SEQ ID NO: 6708 - DNA, 852 bp, Chlorella protothecoides
ggcgaggcgggcgcggcggccctggaagctgtgtcgcctggcgcgggcaaagggggatgcggctcagcccctgcaatgcagctcggcgccgggatcttcgcagtgggcgccccctttggcaccgtcgccccggcccacttccagtccctgttggcgcgcggcatgctgtcgggcagcgtgccggactgctcccggctgccccagcccgtgctctggctctcagatctggtctgcctgcccgggttggagggcagccccgtccacgccatggcggcgaccgacgcggccgccactcccaccgggcccctgggcgtgctgctcgggccgttggcgccacgcagcggtggcggcggcgccgtggccacgctcctcgtgcccatggcccgcgtcctggaggcggtgcgggacctggagaatcaaggggcagccggcgtcgctggcctgagcgctgaggcaggcagggggacgcccagttttgtcggaccccactcgcctgacacgccatccacgagcaagctcccagcgtcaccagcgccccccgccgcggcagcagcgggtcgcagcgtcgtcgcggtgaaggccaggggaggctgggccagcggcgtgctggtctcgcatcgtggccacatcctcaccgtggcgcacctgtttgcagacccaggcggcggcgcggggggaaggggcggcggcgagcccaaaccgctccccacgccgcgcgcggcgtgggtggcctgggccccggacccaggccggcccccgcggtggctgcccgcccgtgtgctgcacgtcttccggggcccgatggacttggcggtgctccaggtggagcgcggcgtgctgccgcgccacgcc

SEQ ID NO: 6709 - DNA, 321 bp, Chlorella protothecoides
atgatcaacatcaagcagattgccaaatttgtcgtgggcctgggcgaccgtgtcgcgcccaccgacatagaggagggcatgcgtgttggcgacatcggcggctgcaaggagcagatcgaccgcatgcgggaggtggtggagatccccatgctccaccccgagaagtttgtggcactcgggatcgacccgcccaagggcgtgctctgctatgggccccctggcacaggtgccgaggcgggattgttccttgtatctagagggagggcgaatactcaatctaggagacgggaggaaggtgctgcaagaggcttgcagttttag

SEQ ID NO: 6710 - DNA, 276 bp, Chlorella protothecoides
atgtcgcaggcctgctggctggctgcagagccgctgcaggttgatgtgtcggagaacgatcacagtgacacaatccagatcccaggcaaacacacccaaaaccgaccaccccgacagggcctgttccacccggcgcgcaaggtgcgggaggtgtactggcggcactacaacaacctgtacatcgggtcccaggacgccctcaccgccttctacccgcgcatggaggacgagggcatcaacacctacgcccgcgccgagatggacgtgttcatctga

SEQ ID NO: 6711 - DNA, 624 bp, Chlorella protothecoides
atgactccaaacccaccggatgtcgcgctcgacgctcatggcacgggtgtggatgcggaagatctggctgcgggactccaggtccggcaggccaaactccaccttgcggtccaggcgcccaggtcgcagcagggccgggtccagggtgtcgggcctgttggtggccatgagcaccttgatgttcccccgcgcgtcaaagccgtccagctggttgacgatctccagcatggtccgctggacctcgttgtcgccgcctgcgccgtcctcaaagcgcgcgccgccgatggcgtccacctcgtcgaagaagatgatgcacgccttcttgctgcgcgccatctggaacagctcgcgcacctgatcgtgtttcgaggcagggcgctctcccaacccccattctgttcgactcaccatgcgggcgccctcgccgacgtacttctgtaccagctcggacccgatgactcggatgaagcaggcgtcggtgcggttggccaccgcccgagccagcagcgtcttgcctgcgaggcaaaaggaggatgggccttgggaatgagtgatgctcgggaggggcatacgatctggagtggtgcttattggtcgagtggcgctccaagccacatttcctaa

SEQ ID NO: 6712 - DNA, 336 bp, Chlorella protothecoides
atggcgaagcccggggcttccgaccccgagaaggatgagaagccgatcaagacactgtcggaggaggacgtcaggatcatgcagacgtatggggccgggccatactcccatcgcatcaagaagctggagatcgagctcagggagattgcaaaacgcgtgaatgaggtgtctggcatcaaggagtcggacacgggcctggcgcacccctctcgctgggaccttgtcagtgataagcaggcgctgcaggaggagcagcccctccaagtaggacggagagctccttcccgcctgatgctctccctcaacttcattgggaacatggtcatggagcactga

SEQ ID NO: 6713 - DNA, 468 bp, Chlorella protothecoides
atgccttgcagccatcggggctgccaagtccctgcccctgcgctgcctcataccatgcattgtcgttgctgcaagccctgtgcgggcgccgacgcctcgtcatcccctttccccccccgcaacgcacagttgcctgcgccagagccccgcccgcggctggccctggagggaccaggcgcagagcccctgacgctgatgagcctgctggagggcctggcggcaggcatcggcgaggtggctgcccgcctggaggacgctttcgcccaggtgacgcagctcctgaggtcgctgggcgagtcgctgcgcgcggcgctggacccagacggcccccgccccgctgtgcacggcgcaccggggtccgcagccgccgacccccgtgtgggcaaggcggtgaccaggctggccctggcggtggccgtctttgtcatcttccgccgggcggcgcccggactgctcatgcgcgtgtga

SEQ ID NO: 6714 - DNA, 228 bp, Chlorella protothecoides
atgctgggcctctccagcgcggcggaggcgatgctgggcaagccgctggacaagggcctgcgcatgtcggcatggcagcggcgacccctcacccccgcccagctcaggtacgccgccctggacgcgctggtgtcggtacagattgtggacgccatcgtgcgacaaaaccccaagctggggagcaggcggggcctccatgcctatctgtttgatgccgcccgcgtctga

SEQ ID NO: 6715 - DNA, 1440 bp, Chlorella protothecoides
  modified_base (979)..(988): a, c, t, g, unknown or other
atgggacggctggcgcggcccggcaggaggacgtcatctgcatgtttgaggacgacatggcgtcacccacctggaggcacacccacgtcggcgacagccgggggccgcacgccgacggtgctcgggcggtggagtttgtggttcgtaccgtggccacaattgggaactacgactacatgtttgacgtcaggtgcaccgggggtgggggggtgtcctttccactggtctgcgtgtgaagcagatggggaggtgcatcggatactgcacagaatggtgctggattgggagagtcagggcgctgctggctgctattctatgctgctgcgttccatccagcgtcgaaagtatagcacagtgtcactgtccggccaccgaccaaacagcacggcgcccactcccttccaacaccacccaggttcaagcgcgacgcctccatcgaggtcaaggtcaccatggccggggactgcggcacgccgctgtgtggtgctcgggtgtgtgagagggaggcttctctccaggccagtcaacctcgcaactgccccacccaacacactgccctggcgcccgacgcccctgtcacagacggtcaaggccggcacatttgcggaggcgctgaaggatgtcgacccaggtgctgaggcgccgggctggatatcggagcctgttctcaagtacatatccactcgccgccccgacaaggaagtcgggctggtgatgaatgccagccagcccacggtgtggcaatttgtgaacgagaaggaaaccaatgcgtggggcatgccacgcgggtatgtcatccagtctggtgtgactaccgcccagcttctgccgccgcagcatcctctgaccaaggctgcggcatggacgaagtatcatcttgccgtgactcgcagcaaggacaacgagtaccgcagccatgcttccatgtacgatttctttaatccagctgatgccatcgtaaaccttgacaactacctcnnnnnnnnnnctgcacatgactgggatcgggtccatgcgtacgacttctttaatccagctgatgccatcgtaaatcttgacaactaccttgatggcagagcaagcattcagcctcccagccctgcgtcgaagcagtatcagactatccatcctctcaacctccctctcgctcttttacaaacaggcgaaagcgtgaccaacactgaccttattggctgggtgacaataggggtgcagcatataccccgggcagaggatgtacctctcatctccaactttggtgcaaacttctacatcaaggtgaggtgcttagcgtcgagctgccgggatcatgttggttgcctgggtgagacactcgttgcatctcttgccatgtcacctgattgtgctgcctgcagtactcatctttctgttccctcgaaaacaccatgccttgtgcagccttggaactatttcgacagc

SEQ ID NO: 6716 - DNA, 1698 bp, Chlorella protothecoides
  modified_base (72)..(81): a, c, t, g, unknown or other
  modified_base (150)..(159): a, c, t, g, unknown or other
  modified_base (672)..(681): a, c, t, g, unknown or other
  modified_base (1037)..(1046): a, c, t, g, unknown or other
atggtgggtggggtcaagtggatagaaatatttgccgctgtggagccacgacttgcggaactaaccatgtcnnnnnnnnnnggtgggtggggtcaagtggatagaaatattggccgctgtgggccgccagcacgtggccgccccccgaannnnnnnnnnaattgcccttacgatactcagaatgttgtgcaaggtgattcaggagggccgccagcacgtggccgccccccgatgctcgttgccggccggcaccgggcgatcgatcgatcacatgggatgcacctgcactcgcatgcagctcacacggctggggctgatccgaacgagtgctgggacatttttaaaggatcaaaagcaacactgagtaccaacctctgtgaggcatgcgctaaacgagtcaggtgcgggaagcatgcccgacgagcgcggcacactgggtcactgtatatggtccctggcgtcggtaatgtcatccccggcgaccgaaagtttctctcaggtaggggaggctgtagtcctctaattggaggatcctggatcgaacaagcactgatacaaagagctcagacccaaacgggggagcgtgtgccagctgcgacgctgatcccaagccggcgtccgcaaaagtcctggatggtgcttggacccctcgcagtcacatctttgaccagnnnnnnnnnnctctcaggtaggggaggctgtagtcctctagttggaggatcctggatcgaacaagcgctgatacaaagacctcaggtgacatttgatataacccgtatcgtaggaagacacctgagtacagcccactcgggcatggaaccaaacgggggagcgtgtgccagctgcgacgctgatcctcagccggcatccgcaaaagtcctggatggcatttccccaggcgctgacaagaccttcccctcgcctcgcgcctcagtcctcaggtgcttgttgattgcacatcctgcctggaagttgcttggggtggaggtgactgcccctgctcccatctcccctgcacctcgactctcagactcacnnnnnnnnnnggtgcttgttgattgcacatcctgcctggacgttgcttggggtggaggtgactgtccctgctaccatctcccctgcacctcgactctcaggctcatccctcaacacaatcacgctgcacccctgcagccaacccaggacatcctgtatcgcatcgagcccatgcctccacccaaagctgcagcggtggcatacctggatgggcatgggccggagccggagcgttttgcccatgtgatcacctaccgcggcacagccagcccacgggacatcatggagtaccgggtgagctctggattggcctccgcgcggatggcgctgggcgtgttgctcttaatatatgcagagctggcaggttgccagcatcaatccattaggtgtggcactcatgaaattcatgtgcaggtgggtcccctcccagtcagcaacaccaccatcaccgtcgccctacgcgcccctggtgagataccctttgtgaaacaccccgtggactccatttctggcggatggggacaagaagccgtaggcaaggtgcggtcagcaaggaggtcctggaggttgcgagtcctgctgggtttgcccagtctcagcatggatccagggacaggcttgcaaaatgcggttgcaatcactcctgcatacaattcactgtag

SEQ ID NO: 6717 - DNA, 1257 bp, Chlorella protothecoides
  modified_base (236)..(245): a, c, t, g, unknown or other
  modified_base (560)..(569): a, c, t, g, unknown or other
  modified_base (633)..(642): a, c, t, g, unknown or other
  modified_base (1079)..(1088): a, c, t, g, unknown or other
atgcgatatctgtccgtcggacgctgtggctttgatcccggcgatggcgccgcacgcgcgtccgaggccctcctgcgcctgccccgcctgcgatccctggaggccccgctgcacgaggtggggcctgacctggcctccctcccccgtctcacggccctcaccctgaccggggtgccgcacggtgagctccgaggcgcggcctggctgggggcgctgcctgatctcgccagcctgtnnnnnnnnnncctggaggccccgctgcacgaggtggggcccgacctggcctccctcccccgcctcacagccctcaccctgaccgaggtgccgcacggtgagctccaaggcgcggcctggctgggggcgctgcctgacctcgacagcctgagcctcgtcctcgagtcggatctggccgccgtttcctggagggactggctggacggcttcctggcaagactcgtggttggcatgcctcgcctgcagcacctcaccatcctgggcttggctggcatcagcgaggcgggcatggccagcctgggtcaaatggcggcgctccgggagcnnnnnnnnnnggaggaagtgaagtccgacagctgtgccagagaggggtcggggagcacagcaaagtgcctttgnnnnnnnnnntgcacctggatgtggaacccacgctacacaacttgctggggtaagtgtggatcgacttggttcaaagtatctttgggggcgagggatttgggagggttactgggagaggaggggaagggaggaagtgaagtccgacagctgtgccagggaggggtcggggagcagagcaacgtgcctcttggccatccctgcagggtcccctgggacgcgttcctacacttcaacacgccaacaacctctccctctttccaggaagaggcactcccctctgcagagcctggggagcttgcgacagctccgcaccctcagcctgtcccatgtcgacttcctgcgctgcgggagcggcgcgctgagcacgctgcccgcgctgcgctgcctaaccctgcgggaccccgcctgcctggacgacggcgttgcgcacgctctgcgtttccttnnnnnnnnnnatccctgcagggtcccctgggacgcgttcccacacttcaacacgccaacaacctctccctccttccaggaagaggcactccccgctgcagagcctggggagcctgcgacagctgcacaccctcagcctgtcccacgtcgacttcctgcgctctgggagcggcgcgctga

SEQ ID NO: 6718 - DNA, 222 bp, Chlorella protothecoides
atggacgcgtgcgcctctgaggctcagcgccagggtgacgccatgatgagcaagtgggcggaggtgatgaccaacatgcggcccaagacctacttcctgcgccccgacgtggccttcaacatgtcccgcgccatcgtgcgcgagctctggaaccagaaggtcctcaaccgaccctcggcctacgtcctgcaggagcccgccgccaacggcaaggcgcactga

SEQ ID NO: 6719 - DNA, 1029 bp, Chlorella protothecoides
atggtggcagggaacggcgaggagcctggtgcctactcattcgtgccgcacaccaccccaagggtacctcatgccctcgattctcctctattctgctccacatggtgtatcccaagcacactcaagcctgccctcaggcccaggcacaagccagcctgcaggcaggtcctcacacgtcccttttgcacgcacccatttctggagcttggtgaggacagtgggggtgtcctcccgcccactcccctcctcgtcggccgagtaccgctgctcggagtcggggtccgcctcaggagggggattgaaacccagacgccggatcctggacaccaaatgcttgaaggttctggacaggaggggggggccgttcatcggcgtcccagcaggtgctgcgcgcctggtggacgccggagtgtattcaagcgcagcctaggttccggctgcccgtcaagcagcgtgttgcagggaaccttgcatggccaggagggtcgacgagaagggaccgccccgctgccctacacgacggaagacctggcgcgctgcgacgagctccagaagcttgtcatagagtgggaggcacaattctgctgttcgaagcaggaccacagtgtaagcgaccccaggccccatcggttggttgtgacaggggtttcgttgccccttgaggccgcccctctttctttcaaaactcggcagcttcaaaaagcctgtccggccgctggcaccccttctcttcgttcatgttcatttacctggactaactctcatatcaccgccatggtccagttccagctccccgcagcggattggaaggaccgccagacccagctttacgctgcgggcgcggccaccgccgtgctcgggggtgccctcctggccaagcgcgccctgcgccagcgcaagccctacaatgggtcctacacccccgaaacccttccatccggcgcctacgatgtcatcatcgtcggagcaggtgcgttgtctgggaccggcgcaggggggtgcggccgtgatcaggctcacaacttctga

SEQ ID NO: 6720 - DNA, 504 bp, Chlorella protothecoides
atgctgtgcctaggaggcttctccccctcagtactgcactcaaaacagccccatctccccgttctggctgcagacacgggcaggcgcttccggtggtttggctgggaggggcatgtgacgctgcgcggcgacactggcatcgccctgcacgacgtcacctacaagggccgccgcatcctgtacgagctgtcacaccaggacatgtacgtgtcgtacagcggatatggaggggacggccagacgttttacctggacagcgcgtttggcatcggccagaacaccagggcactgaagagggggtacgactgcccctggaactctgcctacctgggaagcggtgagttgcgatgtggagcggagggtttcctcacggttgcaaaggctccctcgatgctggtggagacggcgggtatgtggcacaccaggccgtgtcaagctggggctgtactgctgggcagaagtgtggcgctggggcccaactgccgtacactgcccgccaaatga

SEQ ID NO: 6721 - DNA, 735 bp, Chlorella protothecoides
atgcccaccccttcccccatccacactcctcttgcagcaaacactcatgcagtctgttcccacaatcctccccccttccagggaaaggccgtggtcggccgtgtgctggtctgcgccgacggctccacctcgcgcctggccacgcagctgggcctgtgcaccgcgccgccccagggcgtgtcctcccgcgcctacatcgagggcgggacgcacaacaccgacttcgacggcgtctgcttctacccgcgctggtccctgccaggctacgccgccatcttcaagcacgccaaggacgagctgggcttctgctactacctcatcccctgcggcaagaacgccgacaagggccagctcggcaacgtcacggtgcgtcgagtgggggttgtgtaccaggaggagggggatgagaggcaggggcgggggcctggcaaacctgcttgccctgggaacagggaagcccctctgctgccccggcatccacagccttgcaccgcacacctcctcccaagccaacacccttcctctgcccaccctgaaaaccccaacaaccaggctgacgacctgaagcggttgcacgaggacgcgctgaagcgcgaccccttcatttctcgcgccgtgggtcccaaggccaagatcgagcgcatgcgcgcgggctccctccgcatcggcagccagggtgagtgtgtgtgtgtggtgggggggcgtggattcaaggaggggactcgaggggcgtga

SEQ ID NO: 6722 - DNA, 246 bp, Chlorella protothecoides
atgtgtggagcaagcagtctcgcgcccagccgcctccctgcacacctcttctggggtgaagtcgttgacgatgttgaagtgctgccggatttcctctggcgacttgcccttgatcatgttggcgaccgtcaagcatgtcaggtccaggaggggcttgatgttcaagtagttggcagcctatgggggatatgggtgattggtgccaggtatggatgcttgggagagggcttgagtgccgtcctctga

SEQ ID NO: 6723 - DNA, 666 bp, Chlorella protothecoides
atgtctgcagtgacgctggagttcaagcacaatgtcgtggggcggcgggtgtatgccgagggcaccgtggatgctgccctcttcctggcttccaagataggggagggggcggagaagcgcctgtacaacatggtggacgtgctctctggtgctggaaagcgcggccgatgtcatcctccatgcatagagcgctccggaatctcccttgaccttcgcaattcattgctgaacacgcctgctgatgtaaacacagccaatcgcgcaggcacggcgaaccccgctctcgctgcgtcgcccagatgcattagcagcagatccgcattcacgaggcagaggcgagcacctccacctctctggagaaccgcccgcaatccaggccggaacgtggcagtgtctggaatcttcggcctcggcgtgccggagctggtcgtcattgctggggtcaccgctcttatttttggacccagcaagctgcccgagcttggcaagacactaggaaggaccgctaagagcttccagagcgcagccaaggagcagtgtgctgcttcttggccaagatctcatcattccattcctacaatacaggaattcgaatctgagctcaaggatgcagccaagtctgatgatgccagcgactcggcaaagaagttgaaggatgggcaatga

SEQ ID NO: 6724 - DNA, 1479 bp, Chlorella protothecoides
  modified_base (393)..(402): a, c, t, g, unknown or other
atgtgtgagcgaggacctcggtggcgctgcaaggctctggttgcatgcgcagagcagtggtgcggtgtgatcagcggtacggacctgcgaaccctccctgtgacaaggtcgagagactcttcctgctcagatccttacggccgaactaatgacacatgttcaaggaaattgcaaggcgggatggcttgtctgttgtttgcaacaattagctcacttgctctctcgcggaggaaagcaccggggggtgaagggaaaattagattctgggcgatgcacagagtggcaaagagggaggggaaaggattcaaggatacaaattgcaagttgtacttatacaatccaagaacacctcgagggctctgcccatctggatgcagcttgatattccttgcnnnnnnnnnnttgcgctgggcaattgagtgcattatgatgctgagcttagcatcatggcaattttgtgtctgcaggaacacctcgagggctctgcccgtctggatgcagcttgatattccttatcgcgtggaagccgtccttcacctcagcatacgcagcatgcatagtaggtggcacacgcagagacccaccatcgcgctctcgcatcgtatcaatcgacggggagcttgccgaagttcccttcccccggctgcgcactgcacattttcatcaagtcatacctccggccgtacggcgtgtggtgggcgcgagacccatgtcggcaatgcatgccgtggcctcgaggccctctgccctgtctccactggttcccagaacgcagcgccatgctggagctcgccgatcatccgtcgccactcaggcctctcagaagccgcccatcatggtcaacagctgcagtggcaagctgctcacgatgcatggctccggctgcagatgggccatgctgctgctgaggccgcagtgcgggcagggttgaccctggtgcccttctcctatgggggccccaccgagagcggccgcgcggtggatgtgggcggcgtgcaagtgactctggtgcaccccgatgagaagctggacgtcctgcacagggtgggcctggaatgccggctgtgcgcccgggtgtacaccatccatggagcctggcctggcaatgtcagggaggaataccccggcaccgtcatggtggactacaccctgccctcagtcgtgaacggtgagcggcagttgtggagtctggatgtgcttgtgtgcgagctatctaggctgacccaaggcccctgcgcatgtgaccctcggcaagcgctgagttcaccctcataccaatcaagcctgccaccctctgccccaggcaatgccacattctacagcgaaaactccgtcccctttgtcatgggcactactggcggcgacagggacaagatcatgcgggaggcaacggagtctggggtctacgctgtcatcgcccccaatatgggcaagcaggtgggtctggggtgggacgtgcgagaagtcttcatgacttga

SEQ ID NO: 6725 - DNA, 198 bp, Chlorella protothecoides
atgatcaagggcaagtcgccagaggaaatccggcagcacttcaacatcgtcaacgacttcaccccagaagaggtgtgcagggaggcggctgggcgcgagactgcttgctccacacatgatccctttcccgacatgagctcacgtcactgctggagtgcaggaggaggaagtccgacgggagaaccagtgggcctttga

SEQ ID NO: 6726 - DNA, 264 bp, Chlorella protothecoides
atgctggagctcatggcggcccaattcccgggctgtctatcggggtacaccctgcgtgtggtcgagtcgcaccaagccacaaaggccgatgcgtcgggcacagccattgccaacatccactccttccagcggatgggcctggagtttgacctggtaagccgctcgcacgtgcacaggacgcccagctgtctgctgactgcacctggccagcatgaagctgccctgaacctgcttcccaacaccacgcacccagagcaacattga

SEQ ID NO: 6727 - DNA, 708 bp, Chlorella protothecoides
atgggcatctgtaggctgggcgactacgtccgagagggcctgggcgcggtgatcacggtgcaggtgccctcccccgaattcgagggccagaccaagacgcggctgggcaaccctgaggttcgccgcgtggtggacggcgtggtggccggcgaggcggcggccgcgctggaggagcagcccggcactctggcggcggtggtcagtaaggcgctgcaggccgcgcgcgcggccgacgcggcgaagaaggcgcgggagctggtgcggcgcaagagcgcgctggtgcgctccacgctgccgggcaagctggcggattgcgtgagcggcgaccgcgacgcctgcgagatcttcatcgtggagggcgacagcgcgggcgggtcggccaagcaggcacgggaccgcgggacgcaggccatcctgcccctgcgcggcaagatcctgaacgtggagcgcaaggacgacgccaagctgtacaagaacacggagctgagcaacctgatcgtggccctgggcctcggcgtcaagggcgcggaggacggcggcggcgcgctgcgctacgggaagatcatcctgctcaccgacgccgacgtggacggcgcgcacatccgcaccctgctcctcacttttctctaccgctaccagcccagcctgttcgagcaggtggggatgtgtcgtgtgtgtgtgtggtggtggtgggtgggggccgggtga

SEQ ID NO: 6728 - DNA, 948 bp, Chlorella protothecoides
atgcctcccccactcgcccctccaccacacccacgcggcacctccccttccccctctcccccccccttcacacaaaacctgcaggtgctgcaaggcctggagccggtgcgcaagcgccccggcatgtacatcggcagcacgggccagcgcggcctgcaccacctgatctacgagatcctggacaacgccatcgacgaggtccagggcggtcacgcctcccagatctggcttgagatggacctggcctccggctgggtgcgcgtgcgcgatgacggccgcggcatccccaccgacctccaccccgccacgggcaagtcggcgctggagaccgtgctcaccgtgctgcacgcgggaggaaagttcggcggcgaggccagcggctacgccgtctccggcggactgcacggcgtggggctcagcgtggtcaacgccctctccgcccacctcgccatcagcgtgtggcggggcggggtgcggcatgcgcagcggtatgcgcgcggcgtcccgctggcgccgctcgcccccgcgcaggggccgggagacgaggcgccgggcgggccgcgcctgaccccggaggcggagctgccgcaggccgcgcccagcggcggcgccagggaggagggcccgccgaacggcggccaggcggggccgccgcgccgcggcacagacgtcaggttccgcggcggcaccagggaggagggcccgccggacggcggccaggccgggccgccgcgccgcggcaccgacgtaaggttccggtacgacgacgccatcttcgccgccggcgcggcgttcgaccccgacaccatccgcgcccggctgcgggagctggccttcctcaactccggcgtgaccatccacttccgggcccggcctgccaagggcggcgacgcgccctgggaggccctgcactactcgggtgagggccgtggacttgtggcggggtga

SEQ ID NO: 6729 - DNA, 243 bp, Chlorella protothecoides
atgcaccgctctgtggaggttgggctgagcatggacgaggccaacctggaggccaacgagggcatcaaacgggacctcaacccccagaagatcctggaacccaagacgccctacctctcccccatggagaccgacgacgagctggacatgggtgagtgggcagggtgtgtggggagaggggagaggcactgggagctcacagcacggctgatcttggatctccccgccacacccgccgtctga

SEQ ID NO: 6730 - DNA, 1290 bp, Chlorella protothecoides
gcggcctgggcggcgaccaacctcgcggtggggccgggcgccgcggcgcgcgcggtggccgccgcgctgccgccgctcaccgcactccttccgtcggctgaccgggagctggccgagcagctggcgtgggccatgggcaaccttgcagccgacggcagggagctgcgccggcgattggtggcggcgggggtcgtgccgctgctggcgaggcgggtcgtggaaagcgccgcgatgttttgtggagaagaggccggcgacggcgtaggaggtgggcaagaaccagctggcggcaacggacaggaatgcacggcggcggccgtcgcggcctgggccctgggccgcaccctgcaggacgctgagtcagcgccagtccaggcgctcctgtgcccgggacctaccagcctggggcccgcactggtgcggctggtcaggctggcgccgccggcgctggccacggaggccgcctggctgctggcctgctgcgcctctgcgcccgaccccgggccggggtgggcggccatgctggacgagggcctgctggagaccgcctgcgcccggctgcagcgcgccgtggcgggcgggggcctgctggaggccgcctgcgcacggctgcggtgcgccgtggcgggcggggtggcgacccggcgggggcccgcgggagccttggcgcaggccctgctgcgcacgctggggcacatggtcgctgccggcgacgcagcgcgcctccggcccctcctgatggaggagggacggggcacgctgcacgcgctctgctcctgtgtggagagtgtagaccaggggctgcgcggcgaggcggcctggaccctgggcaacctggctggcctgccggggcgcgagggtgctgaggccgtggcgcaggcgggcgccgtccaggtccgattgagactggtgaaggcagcgggtggtctgccggggcatctctgggcctgggcatcgcggtgtgcctgctgcaaggtggatggcccttggaaacaagctgccggcctcgcggctgcgctgtcgagcccctccatccccatccctaccccaaaccaggcgctgctgcgtgccatggggaggggcggtgcactcgccgtccggcacgccatcctgcatgccttggccaacgtgtgcgcgggcgggggggacgggcgcggcgacgctgctgcgatccagtgggtgctgacgcaggcgggcgccaaggaggcgctggtggagatcgcggcgatggccggctgtgcagatgcacagtcggcggcgctggctctccaggtgcgatgccaggcttga

SEQ ID NO: 6731 - DNA, 258 bp, Chlorella protothecoides
atgcgcttcctcgcgccgcttcactgccctgcaacccgatgcgctcacgctgtccagggcctgggcgagatgatgccggagcagctctgggcgacgaccatggaccccgcccggcggacactgcggcgcctgtcagtggcggacgcggcggcggcctcagacatgtttggcatgctgatgggggacaagccggccctgcggcgggcgctgatcgagaagcatgcggccggcctgcagctggaagagctggatgtctag

SEQ ID NO: 6732 - DNA, 1143 bp, Chlorella protothecoides
  modified_base (358)..(367): a, c, t, g, unknown or other
atgttcgctggcaccaggccacggtgcaacgcgccgacaaggagcgcatgctgtgccaacggggatgtgtgctttggttcacaggtgagaggagagcagtggcgggggttggggtccacaggaagccctgatctttttccggtgcatctggggagatggtttgatctcccccctcccacggctcccagggctcagcgcaagtggcaagagcacggtggccgccactctcgagtccatcctgcaccaaaatgggtggctggatcttcgggaatccaaacaacaagggtgttttgggggaatggtgggatcatatgtcgtgcccccagtggcctgttgtccatgccaactgtggctaggnnnnnnnnnntcatggactcaactccaaccttggattcaggtgaggagtgggtgttcctgcagggtggctggattttcgggaatccaaacaacaagggtgttgtgggggaatggtgggatcatatgtcgtggccccagtggcctgttggccatgccaactgtatgggaacactatggcaccagcgtcgcgcccttcatccttcccacagtgccgaggatcgggctgagaacattcggcgagtcggagaggtggccaagcttgctgccgagtctggcatcctgaccatcacctcgttcatctccccctaccgagctgatcgagatgctgtgagagcacgcatggctcctggtgagaggaagatctgtgggatcgtcgagtgcagtgacgatgggagggtcggtactcatgagagcctgcgcatgctcctgccagaggtgcgaatgcctttgtggttgctttgcgagataagagtacccacatcccgatctgatgcagtcatgcttccttcctacagtcatgcttccatcctacaggtgatttcctggagatctatctccgggtcccgctggcgttgtgtgagcagcgagatcccaagggcctctataagaaggcgcgagcggggaagatctccaacttcacgggtgagttatcatgccgagggggtggtgagaacttgcggttcgcaggcacctgctggctgcagcctgagtggccatgtcccagcagggaccgatgcattgcctacatacataccaacacccaaggctgctgagatcccaggttga

SEQ ID NO: 6733 - DNA, 1404 bp, Chlorella protothecoides
  modified_base (113)..(122): a, c, t, g, unknown or other
atggctgctgtgcctcgttcccctatgaagacaattcaagggccaagagcaatgcacatgccgacacagcccctgctcaagctccccgcacctctttctcatacacagcagannnnnnnnnnaaatgactgctgtgcctcgttcccctatgaacacaattcaagggccaagagcactgcacatgccgacacagcccctgctcaagttccccgcacctctttctcatacacagcagagcgcagtcgcagggcctccacgccgaaactcaacgcagccccggtcgtcatgagctgtccgaagaggaggagggggtccaatcgccagccctgggggtgggggggtcagggtgtgcggtgggatgatggcaagaaggtggagcacggcaggccgattccacaggggcctgcctctgcgaccagtgcggctcacactctgaggcctcccggtctcttgttagacaaaaagaccccattcaatcgcacgtctcacctggaagatcaggatacccccgaccaggagtgccacacacgagatgacgacatcatagtccttgctgatccaaggcttggcctgcctgatctgccacagtgtgagtccgctgcctatcaggcctactcccaaaatgacggcagggcttacgtcaacgttcaccatggcgagcgtgagaggctggatggaagagcttggtccagccctcgtccgagacgggcgagcgtacgtggtggggtggagccggacccgaaggcacctgcgacaactttcgagtgggtgaccatgtcgactagctcttcagggagtcttggggatttcttgctgaaccagcaaattacaagatgctcaagagcttcatatcattcttgtgtttgcgctggctggggagggagtggattacatttggacgccggtgggaccggctggtggccgcgcagaatggcgctgcgagcactggcccaggaggcctggaccgtcggtagcgccctactcaggaggtccatccacagcagcgccacaacttcgtgcctgcacgcggcgcggcaggtgccagcgctccagagctgcgcggggttgtccaccagcagcggtcgcagcttgccaggcctgaccagggggttcgctgctcaggcatcctattctgatgaagaaattcgggaaatagaggcacgcatattcggttctcatatcgggaatggtctaccctcaggccgcaagattctgaaacagaagctggtgggcgagaagctggcatcctactaccctgagaatgtcctccgggccgacccgtacatgctgaacatccaggcagagagcatcaattttggtgcattaccactcctagcgcgcccctctccacagggcgaagctcaagctggatcgcctacgaaggcggggcaaggcacctcctaa

SEQ ID NO: 6734 - DNA, 426 bp, Chlorella protothecoides
atgaccgtatttgcggtgagcaaggagctccctgaggcactgcagggcctgcagcctgcccccctgtggcgcttcttcggggagctctcctccatcccgcgtcccagctacaaggagcaaaaggtgctggactggctcaagctctttgccgaggagcgcggcctcgcctggtcccaggacgcggcgggcaacctggtcgtgcgccggccgggcggcggcggcggcgaggcggcgcccactgtcatcatccagggccacatcgacatggtcacagagaagaacgcggacgtgcagcatgatttcgaggccgacggcatccgcctcgtccgccgcgacggctgggtcacggccgacggcacgaccctgggcgccgacaacggtgagggaaggagggggaaaggggcgcgggtgcttgacccctgctga

SEQ ID NO: 6735 - DNA, 456 bp, Chlorella protothecoides
atgcacggccggttccagccctccttcgcccgggtccaggcgagcgagctgccggaccgcactgaccgccccgacggcaggttctggctggctggggtggcccagggcagggtctctgacccctaccgccgcggcgtctccggcatcgcgcgccgtaagcccattgtggccgggcctcggaccgtggcggcggtgatcgatggcgagagccacacgctgggcaatgccttccgggacgtggcctgggcgcaccctgcggtggaggcggcggggtacagtcaggagcacccggggtacaaccatgtcaacctgcgggtccagacacgggcgggggcgggggtgagcggggagcaggggctggcgcagagcctggagcttctcaaggacctggtgggggtggtgggcgagggcatgggctccgccatggcagcctgggaggcacggcaggcgagctga

SEQ ID NO: 6736 - DNA, 621 bp, Chlorella protothecoides
gcgcgctggctggccgacgcggaggcccggggcgcgcgcggcgcgggcgcgccggacgccgccatcgtgccggccgacgacctgtcggccgccgcactggccgtgcaggcgcaggacctggccacggaggacgcgctgtacgtgctggacggcctgctgaacaggggcggcattgcgccggaggcctacctgaagcaggtgagaggcgggcgcttgcgggggcgtgtgagggggtggtggagggcaaggtccctgccggtgttcaggacgtgggtttccaagcttggaccagtaactcaccccccatcccccctctccctcccctctccaccaggtgcggtcgctgtgccgccagcagttcatgctgcgcgcgctgggcaacaagatcgccgcggcgcaggagggagcgcgcggcgcgcgcgtctcgccgccgcgcgcgccgcccaacgcctccggctcggcacgcgacctggcggccgccgccagtgggtacctgtcggacgcggtggccatgcctctgggcgatggctgggccaacacgggcatcctcagcaacccgctggtgggcagccaggcgcagcagcgagggcggtgatggcccagggtgtggcatgtcggtga

SEQ ID NO: 6737 - DNA, 1254 bp, Chlorella protothecoides
atggcacccacgggcagaggtgtgtctcccgcgctcactccggcacgcacccgatgccaccccacaggcgccaaaggagcagaagtccaaggaggccaaggccatggcggccatgtcggccggcaagggcaagaagaaggtaacagctgggatagcgtgactgggcacggccgaacagcctgcggcgtcgtgcacggagaccggaggtgtgttctcgggtgcccagacaggcccgttcgtcacgttatcttcccgccctatgcatcgcagaaatggtcgaagggaaagctgaaggagaaggtgaacaaccaggtcctcttcgacaagctcagtctcgcacgcccaccccatcactcgcaggccacctacgacaagctgcagaacgaggtgcccaagtacaagctgatcaccccttcggtgctgtccgaccgcctgagggtgggtgcaggggaggagcagggagtgtcgatggtgctagattgggaacaagtgcctccttatgctttcgccattcttcacaagtgtcacttgcacgattgctgtgcaggtaaacggcagcctggcgcgtgccgccatcaaggagctgctgtcccagggagtcatccgcgtggtctccaagacccactcccaggagatctacacccgggcaaccaacaccgaggcatgaggccccggatctggaggcctatgcgtgctcccgtggtcgcatcttgccgctggatacatgggaggataaggattgggaaagggagaggtggaagggagtttgccagagaacagatcgcaacagaagcagggcttgccatttggaatggcccgagcagtcagattggcctgcaccgcccgaatcagcctaggaatggaatggggggcatgtgcatgtacaatgagccatgtaagcgcatggaaaggagagtctctttctgcaagccgagcaggacgctgacaacaggtgtgctggtgactgatcgggaagtgccatttgtcctcctctgtggccccagccccgctggggcccaggcagaaattacattcactcgtcccaaagaccatgcccacatgggggtgccccctgatcagtttgacagaaggcagggggtcctgaacaaacccacgccagccttccatcccagtatgttcctctccagggttcgagctgcagcgttacagacgaacgacgccactctgaagctggggttgcaccagactcgacgcgcccctccagaagaacacacgcacgcaaggatctcatga

SEQ ID NO: 6738 - DNA, 945 bp, Chlorella protothecoides
atgctaagcaggaaaattgacgctcaagaagtgttttgtcgacggcagggcctggtggcgacgttgctgtgtgccagtagtgccgatgacggattccgacacccctcaggcatgatgtgcatgtcgcatgctgttcaaggaggattatgtgagtctgctttgctgacactgcgcctcactcgggggcctgctgctggcacggaattggtcgtgcaggcacctgcacagatcctcggccgcacccgtgttccccgccagctccagatcaaagaccccaatgtatccgagaggcacgcccagatagcatgggacgggaagacctggacagtacgtgatcttgggagcagcaatggcaccacactcaatggtcgtgcgctggagcgtcaaggagatgcgtgcccgcttcacaatggcgacgtcattggctttggggatgagaccgaggcggcagcagaggtactaccagcgccagacgagtctcagacagtggagcactacattcaggccgaggcggctcgacttgctgaaaaattgagggtgaggtggggctgcgcagggaaggacgccctggtgggtccctcgagggtgccctggcctgctcgccaagccctccctgacccgctttctctcaggcccgatactaacagtgcgacgttcagtcctctcaagggaggcggggccgttttcctccctcggcatcactggccagcggcgcagtggatcgcagatgaaggggggggctcacgacagggagtggatggcaaacaagtctcagcccgggtccaggactccccctcccggtgctgcccaaaggctgggctcactccaaggagatcttggcgccgacagcctccaacttcttctgcagctcctcagcctcctccttcttcagccccttcttcaccacgacgggtgctccctccacctgttggaggtagttcatag

SEQ ID NO: 6739 - DNA, 330 bp, Chlorella protothecoides
atggcggttgtcaagaagtcgaagaagtcggtggagagcatcaactccaggctgtccctggtgatgaagtccggcaagtacacgctgggctacaagaccacgctgaagaccctgcgcaacggcaaggccaagctggtgatcatctccaacaactgcccctccgtgcgcaagtccgagatcgagtactacgccatgctttccaagtccagcgtgcaccacttctcgggcaacaacgtggacctgggcaccgcctgcggaaagctgcaccgcgtgtctgtcctcaccatcaccgacgctggtgactcggacatcctgaagaccaccgagtga

SEQ ID NO: 6740 - DNA, 561 bp, Chlorella protothecoides
atgctgcggctgtgtcttcagcgtgcctgcgctgcgtcctactctgcagcggcgagctgcagccccgctcctccctgcgtcgcgacgtctgcgctgcgcctgctgcccagtcccggcccgcgatccttttccagcgatgccgaggctgagacccgggaaatcaccaatcccagggtgctggaactggcggaccagattacccagctcaacctgctggaggtgagcgacctcaccgagctcctccgaaagcgcctcaacctcccggcatcatacgccaggccgatgtacgcagctggccccgtggccgcagcacccgcagccgaacctgaagcccccaaggtagagaagacggcgttcgatgtcaagcttgacggctttgacgctgcagccaagatcaaggtcatcaaggagatccgtgccgtcactgagcttggactcaaggaagccaaggagctcgtggagggagcacccgtcgtggtgaagaaggggctgaagaaggaggaggctgaggagctgcagaagaagttggaggctgtcggcgccaagatctccttggagtga

SEQ ID NO: 6741 - DNA, 462 bp, Chlorella protothecoides
atggcgtcatactatgcaagctgctggaggggggcgccacgcctgcctctccatggcgcccactggctgtcgaggagctggcagctcacttgccagcatgcaggcctctgccagtccccctcacacgcactcctccccttcccaccgcccagggtgccatggcagaccgaggactctgcgctgacgcgccacttctcccagtacggcgccgtggaggacgcccagatcatgcgcgagcggtactcgggcaagtcgcgcggctttggcttcgtgacctttgccagccccagcgatgcccggaccgccgtggcctcagagcacgtcatcgacggccgcaagtgcgaggccaagtttgcgctgccggagggcaaggtgcgggggcagcacgtagcgagggccgggcgacgggtcgccgggctggccctcctgcgtggacgcaccacgcaaaaggatgcgcgttag

SEQ ID NO: 6742 - DNA, 1209 bp, Chlorella protothecoides
atgccccatcaaccccacaccgttgcccctgccgcgccaactttacccgcagccgccaactccacgcccggcttcgtgcgggcgctgggggtgggcgtagggcggggcgcctacccgccggctctgctcagcgagtggcaccgctgggacgcagagcacgcctccgagaacgaccccgtggatgtgtttgggcaggaccagctgtacacggatgaaggtgtccatgaaagcaatccatcgtgtggcggcctcaggatgagcgacagacaccgagggactcccaaacttcatgatcgaggcccctcccatctccaccccaccctgcagacgacgctggcactggccgtggccgaggaggcggcggagttcgagcaccgtgacctgcactggggcaacctcctggtgaagccggcggcgccgggcgaggccctgcgctgccggctacgcggtgtggagctggaggtgtgtggcgggggcccgcgctgcaccctcatcgacttcacgctgtcccggctgcagaccgcgggcggcgcgctggccttctgcgacctggccgccgacccggagctcttcctcgggccgcgcgccaatgcccaggcgagtgtggggcgggaggatggagttttggggggtgggaggctggggcgagcgtgcggcagtgagggatgcgcaggggaggagcggcacgcccaggccgatcccctgcaacccgccgcaggccgaggcgtatcggcgcatgcgcaagctcaccggcgactcctgggagagatacgtgccggggacgaacgcggtgtggctgcactacctggccgacacctgcctcacgcagaagctggcccaggcgtgtggtggtgggggggggtcggtgtgcgagccccagtgcacggcctggcgctgcgccggggtgcacgcatgtgctggcgccctgcgcactccccattctcaggtggcgaaacactgcaccaggcaccctcgagtcacaccacctttcccctcgcacacccgtctgcagtgcaagcacacgccagcagacaaggtggccctgaggggcttccggaagcgggtactggcctacgccagtgccggcgaggcggtgtgggacgagtacttcaagggcagttggacggccaccgattgatcgatgactcgccagcgagctggccttgtggctccttgatggatgccgctgctgcacatgcatcgatgtga

SEQ ID NO: 6743 - DNA, 1191 bp, Chlorella protothecoides
atggtgggagaaggtgccacgcctggtggccaggcggcaggctccccatccagcagcggcacacaccccttcccactggcccccgcacgccttccacctcacaggcgctccagcgtcggcggcgcccgctggggcgcgggcaaggtttggcggacctcgctggcaccccgcctcagcctggcggggagccagctggcatctggggtcagcagcgcactgcggtgggtcggggtggtccagcctcccagccaggcgggggatgaggagcccagccacgaggccgccacctcgccggcgccctggggtgtggcgcgggcgtcgctggccgctgggaggccggccgcccccagccccatccaggagagtccaggcagcgcgacagacgaggagcctgctggcggggatggcgacaatcatgcggcaggtggccccagtgctgtggggggatcgggaccgctgccgctgaccaagactgggcgcgcttcagggctgagcgaggcattgaaagcgaacgacacatcggagccaggcgacgctctggagctgggggaggccctgcggcgcttgaccctggcgtccgagggccgcgcagctggggagggggaggccgccaagacggggctggacctgctgctggagttttgcggtcagacggtgggtgcggtgacacgactgacggcacgagagtgttgctgcctgggggcttgttggacagagcgtcatcaggcctggcagggaccttcactgcaacctcgcactctttgtcctcatgacccccagacggtgccctccatggaggagctgctgggtcagcacgtggacctctccacggggctggggctggagagcagctactctggacatgccatgcaatggacatcaccatggcaagggttctgcatggagtggcttgcaagtcttaccttccctcacttcccaggcctggcacgcctctcacgataccctgcgcaggtgcggaagatcggggaggggacctttggcgaggccttcaaggccagcggccaggttctcaagattgtgcccatggagggggacatcagggtgaatggcgagctccagaagcgggcggacgatatgctgggcgaggtggccatcaccaagacgctgagtgcgctagccgacgaggacgcggctggtgaggtggcggactgtctcgggagagggctttga

SEQ ID NO: 6744 - DNA, 2142 bp, Chlorella protothecoides
atgggcggagggcgtgggatggcaggtcgtatggctcctttattctacaattgtgatctaatgacacttgcattggttccgagtgaggaagcgtgtaacactgctctggatgtgtgtgatccctctgtgcgcaaatcagcggacctttcgtccaacagccagttgagcagatgtcaagcacggacgatctttcctgcgttttggcacccccgcgatagtctttgtgaccaaaatcgcattgtacaagtagaccatggtacaaagacctccccgctagagcccgcctggggaagacgacctgcatgggcagcacctcccgcaggccaagttgcctcgtttgcagaacgaggaacacaccgcgcttcagcggctcagatcggatcaaaggttctaatttggattcagaggagtgaaagcgagcatgtaaggtctgctctgagtccactggcgccagttcctcggtacacaatgccggaattggcccagcattcggcacttccaaccccggagggaactggccgagggaacaagtcatcgcgtccacgtccaccgaagtggggtgttcgccccgaggacaaccgaaagagcgcgcatgagcactatgcggacgcggaggcggcgaggtacaccgaaaccgggcatgcaaaccatatacaggccgagctggccctccgagccgtccaatgcctcggcctccccaaggtggaccctcaatctggtcgggagcatgcacgttgtcaacacggcccatggcaatgcgacacctctggcttgctgggtgggggagctccctgcctgctcgccgacctgggctgtggctccggcctgagcaccgccgccctcctgtccctgggcggctccaggcacgccgtggtcgggctggatgccgcgggcggcatgctgtcgctggcggcgcaggaccccgccctccggggctgtctggcccgctccgactttggccagggcctgcccctccgccgcgcctccctccagggagccatcagcgtctctgccctgcagtggctgttcgccgccccagaccccgcccgcgccacccgccgcttcttcgccgacctgcacgccgccctggagcccggcgcgcgcgccgctttccagctgtacctccccggcgacgtcgagtcgcgggccctcctccgggcggctgcatcggccggcctgcgcgccacctacttcgtggactttccccaccccacccccgccaagaagtactacctgtgcgtgaggcgggatgaccgcacgcggcgcgaaccctcacacggacaccccccctgctgtccactggcctggccccacaccgcggcctgcacgctgagctgggcggcggggcaggggctcgggagcgatctggaccaggcccgcacccggctgcgggcggagcacgcgcggcacgcagcacacgcgctgcgcatgctgcggcgggccgcgcgcgcattcctggcggcgcgcggcgccgaggtggccgccgccggcgccacgcgctccgaacacctggcccgcccggggtccggggcgatggtgccctgcggcgcgccgctgcacgcctggtgcagcgtcgtgcttggccccacaactgccaccgccccagtcggcccctcagatgctgaggactcgattgggcccgcgcccgactcgacgcgagtcggccccatggcggatgcaatcacgatcgcggagcagctcggcatcccgggtgcggaggagtgggtgctggagcccggcccggcgcccccgcccgccccgccctacctggcggcgctgcagctcgccctggaagaatcccagaccggggtccgtgcgccgcgccccgacccctggctctggctggagcccgtgccgtgggccaaggccacgccggcgccccccagcccgccggcgcagacagccgtgctgcatgcggccaagcaggccccgctggtggtgagcctggcgacggcgggcgagacgacgggcgaggcggtggggcgggcctgcgcggcgctgggggcggcggtggtggggctggaggcggagggggcgcgggagggggccattgctgcgtggctggtccacgtgccagcgccctcaggagagcaggcggcgcgtgcctggcagcacgcctggcagcacgcctggctggcctga

SEQ ID NO: 6745 - DNA, 342 bp, Chlorella protothecoides
atggtggtccgggtggacaagctgttcgggcgtgggcgggactccaagcggcgcatgcgcgtgtcggaggcgcggcccctgctggaggacgcggaggccgagaagctggtgagcagcgaggtcgtgctgcgcgacgccatcgccgccgcggagcaggacgggatgggtgtggaggaaggcaccgggcgaggggaggggtggagaccagggaggcggaggtggagggcaggcggcggtggcccgtcggccggcccccccctggcaatgggcggtgtgggatcatcgtgcactcacggcagccggggtgttcgtgcggaggctggggcaccgcgtccccagtaa

SEQ ID NO: 6746 - DNA, 957 bp, Chlorella protothecoides
atgccctgcacaggccagcgcccttcgcacagcacccagggagagccatgctggcggtacgccggggtcctgaagcttggaacagcatgcatattgctcattttacatgtctcaatgctccacacctgcttacttccccctcccaggcctgggcgccgggcttcagcagccgaggagattgtcacgcgaagccatggcagagcgtcggggtcaaggtcggttgaggcaacgtgtcacaccgctgcgtcccatgctgcgttgcttgggcacggtcttgaccccgttcccctccccccacggccttcacagggccggagcgcatccagagcccatgcgctgagggcggcgtcccacccgccgccaccccaggcttcgggcttcggcccgcccgccccctccttcgcccccgacagcccctctgaggacgcctccaccgccgaggcctttgccctggcgcggacgctggcacgggtggccgaggagggaaagggcggcaacacccgcgccctgcacgtggcacccctggtctactggacccgggtcatggtactcagcacggtgaccaaccgcccgcagctgcgcgccatgctggcgcgcatggaggcggaggccctgagcaggcacggcgcgaccccggcgccggggcctggtccggggcgctccacctgggagctgctggactttggggacgtggtggtgcacctgcagaccgccgatcagcgcgccttctacgacctggtggggtgccggacgctggcgtcagggaggggcccggagtggtgggatgggcataggatgctggcgtgcgctggaggggacacgtgtctggcaaatcccctctgccagggggcgtcctgcgtagggcccgatggccgccagagggtgggccgggcccgggaggagggcgccagcccccgctccctcgcacgccttgtcctcgtggacgcagagccctga

SEQ ID NO: 6747 - DNA, 300 bp, Chlorella protothecoides
atgaagcgggaagcgcaggcggccatcgatgcggcggtggaggatcggataatctctgcgctcctgggcgagaatgtgacgcaggagacgcgcagctccttccgagagctctacaggtgctccgggctgctgttggggttgtgtgctgggctgccgcctaaggggcgggacaacgtgtttgtactggcagggaaactcccctgtgggctggcgcctggcccagaggtgcgctccgctctgcagctcgtgccttgtttggccctgcctggcccacatgttctccttcctccaccctcgtga

SEQ ID NO: 6748 - DNA, 312 bp, Chlorella protothecoides
atgaaccaccagagcctgctgcacccccacgtggtgcagctgaaggaggtcatgtgcgtcccccccttcctggccatcgtcatggagtttgtccccggcggcgacatgttccagtatgttgtctcccgccgcggcctgcccgaggccgaggcccgctggttcttccagcagctcatcctgggcatggactactgccacaggaaaggtgcgtggtgtcggagccgggtggggtctggggcggccggtgcgcgggagctgggccttgcttggggcgaggtgggaccctgcggcgccccgcggccccgtccctga

SEQ ID NO: 6749 - DNA, 840 bp, Chlorella protothecoides
atggctcctgggacctcgacctcctcctgctcgtgcacccaacacaggtacgtggagcagacagacatccactcggcacccgtgacagtgcgcgaatccctcctcttctctgcgcgcctgcggctggaggagagcgtttcctatgaccaggtattcaggagctggttggagcctcacgatccgtcaacaaatcatgagagcctgggagatcctggcttgatgttggccaaggaaggctcgcaacatagatcgccatcttcccctcactgggacatggacagctgggatgctgcatcttcatttccctcccccccattctatcaggtcaagtccatcgtggaggagaccctgctgatggtggagctggatcgcatcgcggggcgcgtggtgggtggcgacggctccggcatctccattgagcagcgcaagcggctgagcattgcagtggagctcgtggccaacccatcggtggtttttatggagggcggggggttgaggggtgggtcggggacaacaccgtactcagaacacttctttgaacccacgtcgggcctggatgcgagggcagccgccatcgtcatgcgagcggtgcggaacgtggcagacagccagcgaaccgtcatggtgaccatccatcaggttggtaggggtccaatgaagaggcaagggacacaggttgtctttgaatccagcatggggattgtgattgcccggtctggcttagattaccagtatgcttgctgccaggggtggggtggggtcaggagcttgctcagcataggcctggctgagcaagtatgcggaggatacgagatctgccttcactgcatgcggacatga

SEQ ID NO: 6750 - DNA, 450 bp, Chlorella protothecoides
  modified_base (59)..(68): a, c, t, g, unknown or other
atggacactacgcccgccttcccggatatcgaccccactccgctccacacccctggctnnnnnnnnnncttggatacaacctcacgggtaacactcccggacctgcatggacatcacgcccgccttaccggatgtcgatcccactccgctccgcacccctggccgatctcccatcctacccagggtaaactgaccttgctgatcggcccgcccggatccggcaagtccgtgttcctccaagctctctccggccgcctgaagccccatggaggcctgaggtgctctgagcggagagtgctgcctgcgcccggcagctgtcacgctacagctccgccggccctccccacgagtacctgctgtcctcctccccctgcaggtgtcagggagcatagagtacaatgggcagccgctggacagcttcatggtgcagcgtgccgccgggctggttga

SEQ ID NO: 6751 - DNA, 975 bp, Chlorella protothecoides
  modified_base (189)..(198): a, c, t, g, unknown or other
  modified_base (647)..(656): a, c, t, g, unknown or other
atgtatgcatcaaagacggctatctgtccgtgcaatcgatcagggttctttgaagatggcagtgtcatgatttgaatctgcgcttccaagattttaagaaactcgacactcctcggaagaggcactcacctttatagcaaatggacagctctcaagtctacatcctgccacacaaactgcgattccttnnnnnnnnnntcgacactcctcggaagaggcactcaccttaattgcaaatggacagctttcaagtctacatcttgccacacaaagtgcgattcctcctacaggatgtcggcacaggaacacattgatcctccccttgtgaatcgtacggacagcagctttggggtcgacggagcctccacggtcggcgactactttgtcaccagccgcaagcgtctggatgcatctgcgcgcagggatgaggaggaacttatcgacgctgcaaggggtcaacccctctcctcgcaaagccgcaaggcccttgatagatggggtgacctttcaccagcgactcgctccagtcctccggtacggtcggctcctggggtgtcgagcgttgtgatgggccattgcaaggaacccgcagagcggggcatccatcgccccccgtctgtccaaggtttgacctttgaccgctctcnnnnnnnnnntgtgatgggccattgcaaggaacccgcagaccggggcattcatcgccccccgtctgtccaaggtgtgacctttcaccgctctctcttgccgttcagattgctgcctggggcagtgccacagatagagatccagtacaagaacctggtcgtcgaggcggatgctgctgtggggctgagcaacaaccctagcctatggaattctgcggtgggggtgctcaactccctactcctgcgaggcagggctaataagcagcccctgcgcatcctcgatggcgtgaatggggcgctccggccggtgggtgcagggttgacatggtga

SEQ ID NO: 6752 - DNA, 729 bp, Chlorella protothecoides
  modified_base (96)..(105): a, c, t, g, unknown or other
  modified_base (289)..(298): a, c, t, g, unknown or other
  modified_base (615)..(624): a, c, t, g, unknown or other
atgatcccctactccgagatcccgcggggttggaagtggctcaacaggatcaggtgggcagcgcattcgattgtgggggatgttgctggacggccnnnnnnnnnnggggttggaagtggctcaacaggatcaggttgggcagtgcattcgtttgtgggggatgttgctggacggcagtgggcatttggggtccaggctgggccaatctgccccacccagcaaggagttgccactgcagagagcccttgcatgaagcatctccgaactgctaatggccatcgaccccctnnnnnnnnnnctgcagagagcccttgcatgaagcatctcccaactgctaatggccagtggaccccgggtgagcctccatccttggtctctcccacccgcagtcctgccacgtggtcgctgtatggtctagcatgcagtcagctctgcgacaaggaaactctgatgacaggcttgtcggggagcgacatttacctgcccgatttcatgagagcctactttggttgggactttgcgatgatttggtggtgcgtcctcatcgtcttcgcctactgcatcttcttcaggacagcctctgtcatcctgctcagcaagagtgagaacagccgnnnnnnnnnngcgacgctgatgaccccctgggaggatggagccttgctgcttgtgcaacgagtcgtgcccccttgcaaacagcgtgagaacagccaacatgttgagaatgactga

SEQ ID NO: 6753 - DNA, 1098 bp, Chlorella protothecoides
  modified_base (430)..(439): a, c, t, g, unknown or other
atgcgagcggtgcggaacgtggcagacagccagcggaccgtcatggtgaccatccatcaggttggtggggtgtggggaacattggccgtgggagtgcatcgcctgtgttccagcatcctctgggatgagtacacagacacccctcctcctcctggctcatacatgctaagccagctggccattctcctccccgcactgcagccgagcatggacatctttgaagcatttgatgctctcctacttctgcaagcgggcggggtgtgggggagttgcgtcaggaatgtttggtgttcacgtgcagcgatcctgccaacaccggcgaatcggtgctgtcacgacgcacttctcattcctcacacgactgcaccatcccagcgcgggggcaggctgacgtaccttggggacctgggctttgagagctcacagctcnnnnnnnnnngatcttcgagtcctttgatgccatggtcctactccaggtgtagatcaggattcctgtcccagtgtcctgctaagctcggctctccagtgaccggccagcgcccggatgcagatacctgtgccctcgaccctggtggcatacctggaggcccagccaggtgtggagcccatccgccccgggtacaatcccgctacctggatgctggaggtgactggtgggtccatgagcaccacgttcaaggacgctgggcaggacttccccaccctctacagggtaagttgggcgcatggacaggcatgtatgaggcaagggggtttgaatcagtagacgcaactccgcgcacacttcacacgatggtgatgtgccctgcccaacaccgcttcggagtattctcagcacatccctcccctccctccatcaatcgccatgcaaatccacaggtgagccatctcttccagcaaaatgaggcccatgcttcccagctgctggaaaggtgtgccaaggagcacccccccttgaccctgaggtccaagtatgcagcgtcccaagccacgcagcgccgctggctcatccgcaagttttgcaagatgtactggcaccttccacagtacagtgagcacctgtggcggtggattggggtgggggtcacgggtggatag

SEQ ID NO: 6754 - DNA, 489 bp, Chlorella protothecoides
  modified_base (387)..(396): a, c, t, g, unknown or other
atggcgaggatgtcttctatggcgatgtcgacgctgtccgcccaagccagcagccgtgagccatcctttggggggaaagggatgtgtgctgctgttgtgcacgccacgctcgggcggggggagggctcacgacgcgcgcgccgcagctctgaccgatgctgggccccactggtccatccccccacaccccctatcaaatcagacctgggtgcccagctttcttgcggctcagatgagctggagacctccacctcacagcgttcggcggtgccctttgaccccatcaccctgatctgccgaggaatcaagtactatgtccctgacccgtccaagggcaaggccgtccgcaagggcgctgtggacgacggtgacgaccccgccctcgcnnnnnnnnnngggtggggtggggtcaggagcttgctcagcgtaggcctggctgagcaagtgtgcggaagatacgagatctgccttcactgcaagcggacatga

SEQ ID NO: 6755 - DNA, 444 bp, Chlorella protothecoides
atgcgtttttggtgcactgctctgcgcaccgtccacgctcgcgtcgtgccaccctacccctcgggcaacctggagaccctcacctcgattgagctccaggccctgcccgccaagcacgtcatcatccccttcacccccatcaccctggtgtgccgcggcatcgagtactacgtgccggacccggccaagggcaagggctccggcagggggatcgtgacgggcacgggggacgccgagctggacggcaagctgcagctcttgcacgacatcagcctggtggccgagcctggccggctcatggccctcatgggggggtcaggcgccggaaagaccacgctcatggacgtcatctgcggccgcaagacagtgggcgtcattcggggcgacatcctcgtgaatggccacccaaaggaccaggccacctggtcgcgagtggtcgggtga

SEQ ID NO: 6756 - DNA, 477 bp, Chlorella protothecoides
atgctgaggtccctgcccttcccgcctcatgcagcggagttctggcatcgcagcgagtggggcgggcgcatgctggcgagcctggactcggcaggcgatggggccgagcagcaggcacccctaccatccaccaagtttgccaacaggtcgcagggcgggaatgcggggcatgtgggttcactacggcctgggaaggtgctgccactcgaatccctggttgccttccggctgcgcgccacgtggctggtgattcggcgccaggcgctgctcaacctggtgcgccagcgcgccttcatcatcgcccgctccatcgaggcggcgatccaggcgctcatcatgggatccatgctattcggcatcacacccggcacgacaacttggcgaaaggcctttgcggcgtgcgtcgtggcggtgaactatgtgaccctgatgagcgccccccagctgatcctggtgttcaacaccaagaggtgctga

SEQ ID NO: 6757 - DNA, 1089 bp, Chlorella protothecoides
atgctggtgtcgctgctgcagccgccgccggaggtgatgcgcctcttcgacgacctgctcatcatcaccgacggccacgtcatctaccagtgcgttgagtggaggttgccctgccgggtggcgtccgtgaggcggggcttggctcaagcgctcacagcaccgacccggtcggctgccacagagcgacggctcctgtgccacaccgcagcttggcctgcaccacaaccagggaccttgcacctgctgcgtgtgacgctcagcaccccactccaaaccctcccacctccccagtggcccggtggagtcggtgcttggcttcttcgcggacctcggcttcgtctgcccgccccgaaaggaccctggcagcttcctgcaggaggtcaccacgccagcggggcagttgacctacgccaccaaggcgctgctggaggagaggcaggtgccggagagcctgcggaaccctcgccagctcatcagccagcccccaaccacgctgctgacacctgtcgcagacattgcaggtgtgaggcgggggcaacctcccaggggcatcgaggcctgggcctgtgcttgtgtcctgctgctgggtgtgctagggaggggtggagggcgatgcaggctgcctggccgggcgtgtgccgtgtgaggagggcgggtgtgccttgcgtgatgccagagtttgttgactgggaggctcggcgagtgccggtgccggcaagggccccctgccggcctgctcccacaccagcctggcagccacccctgcgccgccctctcctgccccaccccatgcacatcgccgccgatgccgtcctgtcacgctcaaacatacccccgtccttgctcccggcgtgcagatgccttctggaggggtacggagtggggccaggacatgctggccagactcgacagcggcaagccggggaagggggcggccgagcccctacccaccacccgatacgccaacaggtgcctggcagggtttgctggctgagcggtggcctgccggtctcgcactccccacccccccctcagccctgccacccctcccccttcccagctgggtcttcctggcgggcatggtgctga

SEQ ID NO: 6758 - DNA, 474 bp, Chlorella protothecoides
atggaggagctgaagcgggcgctggagggttcggagcccctccctgcctacctctcacaggcgctctcgcaggcgctctcgcaggcgctggggcagctggaggaggggctggaaatggtagcacatggaaaggatgctagtccgcggagctccaacgggaaggagcccgactcccctgcaggctcccccgccgcgcccacgggaagtcccccccggcccgccgaaggtggcgcgagccctgcgagtccgtctctggggccaccccgcagcgccgtgcgggggacgcaaggtctggatgggacccgcaggcatggctccggggcgccggccgccggccggcgtgccgcgtcagccacgcttggccgtgctgcggggcttggcgtgcagcgtcaggcggtcagagcgccccctggatgctgtcagaccgatggcatggagggtccggatgcagaattcctgaagctggtcctgtga

SEQ ID NO: 6759 - DNA, 489 bp, Chlorella protothecoides
atgcagggaccggctgcgagtatccacgaattcccagtttccttccccccctgcgacggcgcagtggctctactacatcaacccccttgcctggacggtccgggcagtgtccatcaacgagctcatgagcccgcagtggcagttccccgggccacctgccgggggaggcatgacccagggcgagtttgcgctgtccgtgttcggcatgagcaccaacacgtgagtggggcaagggaggggggtgggagaggcccacagagacgcatcgagcccgatcggggtgaggggaggggtgttgcgccggccgtcagcagcaggcgcagtgacaagcatggcccggtggccccccctcctccgtgcagcatcttcatctggatgtccgtcgtgttctcctgggtgttcctgctgatcttcaccatcctgggagccttggccctgaccatcaccgacccgcccaagcccaggcccaccagtgcgtcgagggagtga

SEQ ID NO: 6760 - DNA, 321 bp, Chlorella protothecoides
atgaagctgatggggctgagccacgccgccgacacgcagatcggggacgggctgacgcggggcatatccgggggtgaacgcaagcgcgtgaccacggccgaggtgctggtggggccgcaggccgtcctcctcatggacgagatctccacgggtcttgacagcgccaccacctacagcgtggtacgccacctccgcgacgcctgccacaccctggacaagaccgtgctggtgtcgctgctgcagccgccgccagaggtgatgagcctgtttgacgacgtcatcctccttaccgacggccgcgtcatctaccagtgcgtctga

SEQ ID NO: 6761 - DNA, 1710 bp, Chlorella protothecoides
  modified_base (416)..(425): a, c, t, g, unknown or other
  modified_base (950)..(967): a, c, t, g, unknown or other
  modified_base (1127)..(1136): a, c, t, g, unknown or other
  modified_base (1406)..(1555): a, c, t, g, unknown or other
gtgcccgtgcgcctgggcgccgagacgctggcgctggagtcgggcgtgcaggccggcgcgcggcgcgagacgctgcgcacgctgtgcgtcgtccgcaacacgacggccctggcgctggaggtggcgctgggcgaggcgccggacgcggacgccggcgctggcagcgcgggcaacggcgccggtgtcgtggaagaggtgctggagcaccagcgctggcggccgcgcgtgggctgggcggggtccaatctgcacccgagggaccccgcgcgctttgagcacggcaccgcgcgccgcgacgacttcccccaggtcgacccgccgcgcggctgggagtgggacagcggctggcagctggaccgcgggtccgcgggtgagaaggagggctgggtctacgccccggacttttcccgtgtccnnnnnnnnnntgggactgcggcacagaacatcaccacctccatgtctcaggaggtgggctggggtgactgtgatccggagtggcgacatcccgccgctgctgaatgggggccagggagctccttgatgcacagcagcgtctcacgcgagacaggagagcgctgccggcgacgtttgcatccagcacgcctgggactgcggcacagaacatcaccacctctatgtctcgtacggatgctcccgcgctgctcgacactcgctcacaccggaacaaccaacccttccagccggcgcgtacaagccctccccgagcgatacggtgcgcgtgcggcgctgggtgcgacggcgcgtgcgtgcggggtcggcgcgccggggcctgaccccgcaggcctcgctggtgctggaggcgccccccgcgccccgccctccgagggtggtgggcgtcgtggcgtccggctccaccctgcccctgcccgtcggctgggaccggtcggggtcccagctcctcctgcgccccgcgccgggggagtgcggannnnnnnnnnnnnnnnnnccggcgaggaggagggggaggccggcgagggagctgtcgccgagcagaaggctggaaagcgcaactccccggcccacagcgcaggcccgcccagccacggctggagcgagggcgcggtcgcgggcacacacactgtccttctggactgcctggacgagtnnnnnnnnnncgcccagccacggctggagcgagggcgcgggcgcgggcacacacaccgtcctgctggactgcctggacgaggcggtgacgcggctggtgcgctgcgccccgctggccggccccgatgccgggggggccgacacgcacggctcgcaagcggaggcttcgatctccagagccccacccccagcctcggcggcggaggcgtccagcctgtggtttgcggtcacgctggagagcagcccgctggcggaggccggggcgcgggactgcgaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcagacgctgcgcgtgcgcagcgggcaaagcgcgccggtgcatggtgccgacctgcgctccgcggtcagcttctccttctatcccgacggctacgagtggatggaggcggcgccggcgctggccgccgccggcgcgcgccgcgcgggggcgcc

SEQ ID NO: 6762 - DNA, 1386 bp, Chlorella protothecoides
  modified_base (539)..(548): a, c, t, g, unknown or other
  modified_base (990)..(999): a, c, t, g, unknown or other
atgggagcttgccacaagaaacttgaatggcagggtgagtgggtcaccccatccccgtatggcatcgtctcgttcccactgaaccgtctcgaaatcacgagtccgaacagaaatctccggtggtttccaactccgacgcgcagcctgaaagaccaattgtgccccatatctggtatcagggtatcgcgagtctcaaatcttctcatgatgcgttacgccctgagtctcctggcgagcgcggcccccactgcccgggtggcaggggggatgcggcacgcagcagccctacacacctcccgtgcacatcttcatacccccacacaacacatgctttcatcatggcgacaaagaggggttgaaagttccaggcgagcagcattcgccagccagtcagagggcagagtggcccccttggaggaggtgccttacaacaaagacaagtataacactgtctctctgatcgggaatctgggcggcgacgtggacctccgctacttggagagcggcagtaagactgcgacaatggccatggctgtgtnnnnnnnnnntgtctctctgatcgggaatctgggcggcgatgtggacctccgctacttggagagcgggagtaagactgcgacaatggccatggctgtggctcgcaagacgaagcctgccttctggtctgtggtttcccgcttagtcgccttgtggcaccgaagcattgaggttcatgcatgcgcaatccttgccatgtcaacgtgcaatagggtggacgtcgtagtatggaatgagctggcagaggcggcggcccaggggctgcgaaaaggctccaaggtcgaggtggagggctacctcaccattctagacaccgctgctggcaatcgtaaagcccaggtacgatctgcagagcctggcatgccgtcgaaggatcccccttgggatacagagtgcctccttccgattttgtcgttgggtctgggatccagcgtggtgcaccaagataccgtnnnnnnnnnngaaggatcccccttgggatacagagtgcctgtttccgtttttgtcgttaggtttgggatcttgcgtggtgcaccaagataccgagacagtcagatgatgtcagcaacggagcatgtctgtgcagtgctgaactcgccactcttacaaacctctaacctaggttgtggcccgcgccatacggaaagcgagcaggccagcccagctgcgaagcagcggctgtcaaacgaggagcaggatcagctgtggatgaatctctttgagaacccctcaggtgggatctccgggtgggtcggattaagggcgatgacaggtcacggcatggcgtgtttgcaggacccgagcccacctgctatggtccagcatcctgtcgccctttctggggagtga

SEQ ID NO: 6763 - DNA, 468 bp, Chlorella protothecoides
  modified_base (76)..(85): a, c, t, g, unknown or other
atgacgcccggcccccaaacttggattcccactaaagagcgcgatgcgaagatcacccctcgccccaaacaatccnnnnnnnnnngggggcaggtgcgggagcagggttgggctggggtcgtgccccaagcagtcaggcttgatacccagtcagcggggacgtcagtgggcatctgcacacctgcacggttgcctggctgtcgaagattcccggcccccaaacttggattcccaccaaagagcgtgatgcgaaggtcacccctcgccccaaacaatctcacacccacagctgttctggtggctctcagagacatctccctgggagaggagatcacgatctcctacatcgacgaggacgccccactccaagagcgacaggatgccctggcagagtacgaattcttgtgcacatgcgaggagtgtgttgcagaaggtgttgcactagtggaccagtcctcaactctgtaa

SEQ ID NO: 6764 - DNA, 2529 bp, Chlorella protothecoides
  modified_base (535)..(544): a, c, t, g, unknown or other
  modified_base (624)..(767): a, c, t, g, unknown or other
  modified_base (1448)..(1457): a, c, t, g, unknown or other
  modified_base (1556)..(1565): a, c, t, g, unknown or other
atgtcctccacagccgagggcgacttgatcgcacgccaggtcgctactctgctggaggtgccatcagacgagactagaatcgcccactattataccaagagcctcattgggaataccaggaacctcgccatgtcctccacagccgagagcgacttcatcgcacgccaggtcgctgctctgctggaggtgccatcagacgagaccaggatcgccgactattatatcaagttcaccaggaagtcaggtctgtctgtgaatcctcacatcggacacggacgggggaagggcttgcaggcgacagcttacctcgcccacaccaggatgctcactctcaccccaagccacccgccacagtccttcaaggagggcgaggtcgtgctgatcgagccgcctctggtggcctgtcaggagcccgactctgcggccatcgtagcagcctgccagcacagctttgccgtcctgggcccgacgctggaagcccacctggcccacgccgcgcgaggtgctcaggctgtgtggcgagattcggggtatnnnnnnnnnncctgctatgtgggatggtggagcatggatgtgcagtacctcgcccgcaccaggatgtttattgtcaccccaaaccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgccgtcctgggcccgacgctggaagctcacctggcccacgccgcgcgaggtgctcgggctgtgtggcgggattcggggtacgggaggttgttcctggggccgccagcatgctcatgctgcggggacaaccccgttgagctgtctgggtggcgacagtgggccgctcacgagcctggctggggaagggaagggcgtgccgacgccctcgtctgggtttggaccccaaacccccatcatctggcacgtcctgcagctctgcgagccgaccccgccctgtgtgcggccacgacgtgccagagcgacgagagcgacgactgtgaggaaggctcgccgccgtgctgccctacctttccagtgtccgaggaggtcgagtcggggctccgctccggagcgatccgcctgcctggctccgaccagtggccactgccgtctccggtgaggtgctggattacttgccgagctcgcagtccttgctgccgatgccccccgggatgttcccctgagtcgcgctctcagcggcagccctgcatggaggtgtcctcggtcggggtgatgccagcctgctgttcgccagcgaggtggccgagaccgaggcatgggcggggtacgcccagctcctctgcgccaaaccccccgcgagcggcggcagccgggtccctcgggcaggcgcgcagccnnnnnnnnnntgctggattacttgccgagctcgcagtcctcgctgccaatgccccccgggatgtttccctgtgtcgcgctctcagcggcagccctgcatggatgtgtgnnnnnnnnnnctgcgccaacccccccgcgagcggcggcagacgggtgcctcaagcagacgcgcagcggcagcgtcgcgccgcgctgcgacagctgcgcagctttgcgcgcgagtgcaaccctgtgttcgagttcgtggcccgagccctggccggcgtcctgtcccgggccgacgccgagctggaggccggcgggctgcagccggagggcgaacggacggacgctgagtgggctgccctggtcaaagcctgggagcccctggcccatgggcacaagcggctgtggtgggagctgcccgtgacgggcctgggggagggcgaggcagcagagctgaggcaacgtgagggcttcagggggagggacaggattgggcaggggggttggaggtttgtggtggcatccgtcgcccacatgtcgctcgaggctctgcaccgctctcgactcaacaggctgtggggcggcatgcgcaggagacccgcccaccagcatgcaccgcctggcctcctcggactgcaacccgccggttcctctcctgctgctcacgctcggccgattcaccccctgacagaacgacacgagctgtgtcagaccgcggcggacctcctccggcgcgccctctgggacccccgcttccccgccctcttccacgaggacgtggtggggtgcctggtcggcatggtggagctgaacaacctggacctcgtcgtgcccagcccggcgctcgcctggtacaggtggtaccaagagcagtacctcactgaccccaggcgaagcgagggccagcaggatcctgccggtgcagctgcgcgggaggtggcggtgttcgtggaggcatacggcgatgccctgagcgtcagtggcacggggttctacaggcttcagagctgctgcaaccactcctgcagaccaaacacacacgcattcaaacgggaccaggacaccacgggggcaggtgcgggagcagggttgggctga

SEQ ID NO: 6765 - DNA, 1002 bp, Chlorella protothecoides
atgtgggcaacaaccctcgtgaagcggctccttgccaaatcccaattacatccctcgcttcccccccctgccacatgctactcacaggcaggctactccgtgatcttcctgtcgcgcaccggctccctgctgcccttcctctccgagtgccaggaggacatggccaccgccttctcggtgtcgggccctggcgagctgcaggtgagcgccctagccgaagccctgcgcaccttccacagctgcacagaggacccggggacgttcctccatgtccccttcacgaccgtgtttgagtacctccagacagtgagggaaagggagtggccgcgccgtgcatggcgctgccaggcatggcgtgcacagggtttgaagcacatcaaattgggtaccaatctcgggagctgggcttacttctcttgctgtccaaatctgagggctccgcgctcaggcgagccagtcaccctccccatcatcatttcccgaatcgcagtatctggaggtgatagcaaaacgcctcgcatctcacggtcgcttggccctcttctacctcgcagcagctcctcaccccccccctttgctccgacctctgcccaggtggagcacaagatctcgggcgcaggccccctcgtcctcgagctgcaaaaggtccccaagctgctcggtgagctgacgtcagtctgggcaccccacgccacggtcgtgtcattcaagctggaaacggacgaggaggtgctcctcaccaagggcaccccccctgcccaccatcacccgctgcaggcaaaggctgccattcagaagtatggggtggatgccgtgcttgcaaacgagctgcacagcaggaaagaaagggtgacgctcctggtgagagccggcgagggtagggcagccccgatccactgcagcgtgctgcgactggacccatctgcgccccccggcagcgtcatcgaggaacagctggtcggcgccgtcgtcgatctgcaccggcagcgcagccggcggtga

SEQ ID NO: 6766 - DNA, 489 bp, Chlorella protothecoides
atgtggttctgggtattgggggggtcaaagtcagcgcacacgcatggagtctctcatgtgccccagggagtgcgctccaagcttctcctcttctcccctgcaattatcagtgtgcacaccaccatcactccttgttctccctcgcagctggtcccgcggctgcaggagcgccaggccgcggaggccaagcgcctgaaggccaccgagcgagtggcgcggcggctgggcgagccgtcgctgtacggcgacgagccggggggcaggtcgcggcgcgaacgccgcgccgtcaactatgccttcaccgactacgacgacatgctgcgctccgcgatccggcgcagccagcgcagcggcgagaccggcgacgagttcctggaggagggtcggcgcggcaagcggggggcgtcccctgtccgcctggaccccgccgttgaggcgcagatgggcctgaggcgggggcgctccgtcgccggccaccactccgggtga

SEQ ID NO: 6767 - DNA, 570 bp, Chlorella protothecoides
atgtattctccttccgattgccgagatgttgcccctcccctccctataataccccctccctaccccccccaaaaaacaaataccgttcccaggggcgtgaaccagctggctgtggcctccagcggcctcttcttcgtcagcgcatcctcggacggcactacaaaggtgtgggacgggcggcgcctggaccgagacgtctccttccgctctcgcctcacctactccggccgcaaggtgccacaaggtaggctgctcgccgcccgcccgccccgcgctggcaagagcatcctgggcacgacactcttcctcccttttctcaccccgccaggtggcaagatcaatgctgcgaccaccctgccggactcgtcctccgtggtgacagggtcaagcgacggcagcgtgcacctgtggcgcgtggacaccgtggcacgcagcggcggggagcgcttcaccggggtcaccgcccagcgccaggtggaggggggggaacagcgggaggaaggagggaactttggagaatgggtctcagcggggaggggctccagccataccctggacaccgtgtcatag

SEQ ID NO: 6768 - DNA, 855 bp, Chlorella protothecoides
atgatccggttcttcctccttctcaatcgatctggcaaggcacggcttgcaaagtactacaccccactgtcggatgaagacaagaagcgactggaggacgaggtgtaccgactcatcgtcaaccgggactccaaattcacaaacttcatcgaggtggggaggcgactggaggtcccgtgcattgctggcgtccttcagaaggacatggtgcctgatcctggccaccagcaccttgatgctgtacacaaccggaacacccttacctgtgccccgcagttcaagacctacaagttggtgtaccggcggtatgctggtctctactttgtgtttgcagtggaccccacagacaacgagctcctgtacctcgagagcatccacctgtttgtcgaggtaggcctgcccatgcaatgccgtggtggccatgacagcatcagcagagcgctgggaagtgggccggcgccgtgcaggtatttgggttgtgaagctccccattcttttccatggccccttcggacccctcgtgttcctgccaggcacccgacctcccacccgtccacctgtgccctgcagatcctagaccattactttggcaatgtctgcgagctggacctcgtttttggcttccataaagtctactgcctgctggacgagtttgtcatcggtggggagattcaggagaccagcaagaaggcaggatggggccagggcttgggggtgggtctggctgagtcgaaggggagtcagccacagcagccttggcctgtccagttgatgatagccctcgatgttccctccctcatgggcatgcaggtcattctggagcggctcaaagagctggatgcgatggagacctag

SEQ ID NO: 6769 - DNA, 726 bp, Chlorella protothecoides
atggagcatgggggccgagccgcaaaccgcaggcttgcgtgctcccgccccccggcgtcccgcgtcgccgctcattcatgtgaagagcagccggtcgcccgctccccctctcctgttccggccacagtctccccgcccacaccgcgcaccctgggcgaggcacaggcccagggcgatgatggagtagccgatggacatggtggctcccaccgtggagctgatccaggtggagtccaggttgggcatctgcgccaggaacagctgcatgccgcagaaggccaggatgacgggccacagggcttggtccacaccgtagtgccccactgccacgagggctgccctgcaggccgtcatgggcgcggggtgcggtggggggggtcgggctcgagcctcgtctggagtgcccgagcccgttcaccactccctcaggggtctgggtacatgctgtgtggccttggtgtgaggggcccaggtgcaggccgtcacacagggctgctatgtgaaaagggcgcatgccgcgcctgcagctccgcctggacgacgacagggttgcgtgcactcactccccggcacccctggtgcatcccgagcctgaatgtctccgtctcaccgtcccgatgtgccggcggtgatgaagtatgccagactgaccaggatgagcgtgctcagctgcagaccggccagcagcttgcctgccagggggccctggagggtcgtgcaatgtga

SEQ ID NO: 6770 - DNA, 201 bp, Chlorella protothecoides
atgcaggacacgatccgcatccccccatcctctgagaagaccatgaagaaggccatcaacatctccatcaccatcgcctacgtcttctacatggccattgccatcaccgggtacctggcgtttgggaacggtgtggctggatccatcctgtcccagccagacgtcggcccaggtgtggtttctcacggcgatggtacttga

SEQ ID NO: 6771 - DNA, 579 bp, Chlorella protothecoides
atgcctcggccacggcagggccgaagggaaccccgccgcgacagagcagaatgggaggttgcagcggacagtcggtccctcaatgaaacagaggatagcagcgatgccagctccagcggcagtggggatgagagcgaggccgcgctggttcccatccgcctggccatgtgggacctggggcagtgcgacaagaagcgatgcacaggcacccgcctggtcaggcatggacttgtgcaggagctgcgactcggcacgggcttccactggaacgccacacaggtgtttcccggcgtcatcctctcccccatgggccgcaactgcgtctctcgcgccgaccggcagctcatcgcctccaggggcctggcggtggtggactgctcctgggccaggctggacgacgtgccctttgccaggatcaaaggcaatgcgccccgtctcctgccctggctcctggctgccaaccccgtgaactacggtcgaccggccaagctctcctgcgccgaggctctggccgccgccctgtacatttgcggcttcccagccgaggcccgggccgtcatgggccggttcaagtggtga

SEQ ID NO: 6772 - DNA, 1176 bp, Chlorella protothecoides
  modified_base (694)..(703): a, c, t, g, unknown or other
atgacgtgctcgattgtcagcgcaggcgcaaattcactcgtggggttgcatgaacgaccaggctgccccccacgccatgcggcgtggcatggtacccgtcagcttacagtactgaaaactggaagccacagaaacacagtaccacgctatgctgagcccgaaagggtatcagctgcctcccgggacagcaccccagcatcatcggcaagcacaacccctcccacccaggagggtgttcgccccgactcactcccctccccggacacgtcgctggggaagaagctggcaggaggagccctggtgggcaccctggcggtctttctggccgcacgaggtctgacgggacccacatccctggagcagctcaaatctgatgctgtggatctggacattgccctgacaaatggcaagcccacgctcatcgagttctatgccgactggtgcaaggtgtgtgcgcatgcggattgtttattgtatgtttggggagagaatggtagccgaactgtccaacagcatgttgcacaacgtgattgtgtcttcaagtcaaacttctatgcgcatcaagcctgtttggatcctcttggccatcttcgcacagctttgctgactgtctggaaggcttggcgcttgcatgcatgcgtcctcaatgccagcgcttcatgcgatggggagcaccaaggttcaccgcattccnnnnnnnnnngcatgcgtcctcaatgccagcgcttcatgcagtggggagcaccaagattcaccccattctccaccccatccctgcccccctctcaggtctgccaggagatggccccgatcctgacagatgccatggactccgccgcatctacggcccccacccgtccacccggggtcaacctggtcatgctcaacatcgataactcgcgctggacgcaggagcgccggcagtaccacgtgcgcggcgtcccgcagtaccagtttctggatggccagggccgcgccaagggcgcgctgatcggcaagatcccggggctcgccctggtcgctgacctggaggcgctgaaggctggggatgagctgccctttctgagcgcggctggggatgccgccgatctggacagtgtggcccccagtgccggggtgtcgccgctcccgcccgccgcgcccgcccccagcgcattgccacgggaccattcctga

SEQ ID NO: 6773 - DNA, 3825 bp, Chlorella protothecoides
  modified_base (1520)..(1529): a, c, t, g, unknown or other
  modified_base (1820)..(1829): a, c, t, g, unknown or other
  modified_base (1938)..(1947): a, c, t, g, unknown or other
  modified_base (2056)..(2065): a, c, t, g, unknown or other
  modified_base (2810)..(2819): a, c, t, g, unknown or other
  modified_base (2995)..(3004): a, c, t, g, unknown or other
  modified_base (3335)..(3344): a, c, t, g, unknown or other
  modified_base (3498)..(3507): a, c, t, g, unknown or other
  modified_base (3695)..(3704): a, c, t, g, unknown or other
atgccgctcatgaccctggccgccacggccatcgacgccccacgcggccgcgccgtcgtcgtcgacaccctgatccactacctgcacaccgacagcctgctgtgccgcgaggcgccgggccgcctggccgtgctgcaggccgagacctacgagccgatcctgggctgggcgcgggcacggctgggtgcggccctgcgcccctccgactccatcttcggcgcgggcctgccggacgctgacctggccgcggcacaggcctacctggaatcgctggaccgctggcacctgaccgcgctggagcacctggcggcgtgctgccgctcggtgctcctcgcctgcgcggtggtggagggggaggtgggcgtccccgacgcgctggcggtggccaggctggaggagagcgcgcagatcgcgcagtggggcctggtggagggcgggcacgacatcgacatcgcagacctgcgagtcagagtcgccgcgccgtcggttttcctgcgcctgttgcgggcgggagagacagtaaagagccgagaggtggacggtgtcgatggaaggggggatctgatggggaaagctggagcgcccagacgatgtcggaaggctcccggccgggggactcaggaatcatttaccatcgcaccactctatgctcatgcaaaggagctggaggaaaaatccctcgacctgcgatcagatcggctgccaaggtgtgcgccgaaagtgactctcggagaaacagtactgaacccattgacgcacgcgctgctcaagcactcgggcagcggactgactcccgtcgatggccacctgacggtagctgagatgcggaggctgtgtggtggccatggatggcaggttgctcgccctggacccacccacgccctccagctacctggcccaggcgccgcgcggggcctacaccgcgctgcgcctgccccgccccttcttcgccgtcgactgggcgcagcatgtggcgcgcctggagcagtccatcgggctgctgcacgaggctggcctggtggactacggcgcctggcacgtgagtggcggtggggtgtacggacgctgggagccagacaggagccgggcagggcccctgcggcgccgcgccgtcgcgcttcctcccggctggccgtcgacccctgggcgcccacgagcccgtccacctcaccacagggaatggaaagcgagaaaggaaacaccctcgccgacctgctcctcccgacggcccattcagccctgagcgccctgcccgccccgggcggccccgcctgcctcgtgctgctggcctgccccggcgcgccgctccaggtgcacgccgtggcccagccgctggcgaccgacccgtactgcacggtcccgcccggctgggcggcggtgctggggccggggcgcgcgctgcccctggccaaggactcggcctgggtccgggagcgcgcgcccctggagggcctcaggcggcctggcgcggtcgaggtcctgctggccaacgcggccggcggcctgctggagggcttggnnnnnnnnnnacagcctggcgcggccgaggtcctgctggccgacgcggccggcggcctgctggagggcttggtgactaatttctttgtcatcagcggtgggtggcaccggggccgggggtggggccgcgcgggcagatgtgagtctggaaggccgaggagggggcgtctgggtgtggctgcagggtggactgggtcacacagaaggattgtcgtgggcggtctgatgaaccccatgctgcagggtggcaagctggctcacacatgccgggctctcccccgccgctgccaacggcccagccnnnnnnnnnngcaaaagggtcccgtcattgcggcacaacaagctcagggagtccctgcgacaactgtctccgccacccctgctcatccctcccacccaacccgtgcagcctgcggggcnnnnnnnnnnacaaaagggtcccgtcattgcggcacagcaagctcagggagtccctgcgacaactgcctctgccacccctgctcaccactcccacccaacccgtgcagcctgcggggcnnnnnnnnnnaccgcctcgcagcgggcgtcggactacacactccagaccgccggcgaaagggatggcgtgctggccgggacggcgcggcgggcggccctccgcgcggcggcggcatgcggcctgaccgtgttggagcaacccccggatccctcacatcgcagcgcctggagggaggccttcctcaccaacagaatctcaccaggatcgtgaggccggggcattgggccgtggacctgccaccctttagaccctggaccgccgcaatctgtgcgctgctgaccaagggagagggcggtgtcgacttgcggcggccagccctcgaggccctggagggtactcccgggcctggatggcagcatgccctggccctgccctccactcaagagaccgagtccggttcggtgatacgggccagaccacaggggatgtgctccgcctgtgggtgccagcaaaaagagacacaacaaaagcacctcgaccaacaggaattcaaggggagggcgggggaatgctccaaacataaaagaggtgttcgcagtcctggaccagtgcagggggttgtagtgggacaggtggaagggaacgaaaggacggacaggggctcaaatagccctggaccaggcatggcggtgccgcctgtgcaccaggggcagcgagacgcacctcgtaagagcgaagtgggcatcaatctgagagaatgccctggaatgcggttgccatatggtagtgtgggcatgctggccgggccatcatnnnnnnnnnngatttgggttcaacaggtgccgtctgtgcaccaggggcagccagacgcacctcgaaagagcgaagtgagcatcaatctaagagaatgccctggaatgcggctgccatattgtagtgtgggcatgctggccgggccatcatggtctggtcttattcccaacggcaagcaggcaggannnnnnnnnnagcacggggcagatttggcctgtggcaagctgccagggtgggggcgccctggaagagccgcagggcaggaaatgccctgcaaagggagtacttgggagcaacatgggtggacaaagtgtcccccagtgtgcaatagggtcccggttgggggccggggaagtaatcaagacagcgacgatctgccggatctcgaactgccgctgccggtgcgcagcggggttttggagggcgagactcgcaggggagagccgcctggggagagggtcggggtgggagggggtgacggtttgcgggttgacatgcctttggtcccggatgcaaagcgacaagnnnnnnnnnnggagccgcctggggagggggtcggagtgggagggggtgaaggtttgcgggtcgacctgcctttggtcccggatgcaaagcgacaagtactgggcagcacaagagctgcggcaggtgtaccaaacccgaccgcacatctgtgctcgatgcccatnnnnnnnnnnggagctggggcaggggtaccaaaccccgaccgcacatctgtgctcgatgcccatgccacgcagatgcaccaaccggcgccgacactcacccaacatggtgcccgagcaggtcagggcctggtgcgcactggagcgcgagaagaactcgacaaaagcgatcttggtggcgtggtgcccatcccccagcnnnnnnnnnngcatggtgcccgaacaggtgagggcctggtgcgcactagagcgcgaaaagaactcgacaaaagcaatcttggtggcgtggtgcccatcccccagcaggcggaggcggctcaccgggcctga

SEQ ID NO: 6774 - DNA, 1620 bp, Chlorella protothecoides
  modified_base (1102)..(1111): a, c, t, g, unknown or other
  modified_base (1409)..(1418): a, c, t, g, unknown or other
  modified_base (1472)..(1481): a, c, t, g, unknown or other
atggacacgcatagtccttggcaaggtataaacagcacttcatacccaagcaatgctgcgttggagagcctggagcaggccctctcgggaatgccgtccgtgggcgcagacagcatagaaacgctgctgtccatgcggtcctctttggagggccccccctctccccagttccacctaccgacttcctacccagttccacctgccaacttcttacccaggtgtgcagcggtgcggtgcgggcctgcatggtggaacctcgctccaggaattacgtcggctgaccccccaattacggaccccatgacaggcctgcaaacccacgcctcgccgtccttgactgcccccgaccccctcgaaacctattcttgtcccaatctgaactcgttcctggaagtcgggcccctgtactcgagcctgggcagcatttccggggccggaggccaggcgctggatgggctgcaggccccgtcagcaactcccagctggaatgacacccagggccaggtcctcgcccaggcactccgcaacatactccttctcaagaactggagtcttaatacgtctggaagtgaggtgactgccgccccccatccgccctccagacaagtgaggttgcgggagcggaactctgctggtgagcctggcctccacaggcatgcattgcggcccccgtgccatctcaccgccctttcccccttccttttctcatcgagccaggttgccaccttgcagcctagcgccgcagcgcccagtccgggcacgggccgttccagcccccgtgggggaccacacgcctcggccgagaagatccagcgcaccgtttacgtctccgacctgtcccaggacctgacggaggccgccatctccgccgcgttcctgtcctgcggttccatcgtggactgccgcatctgcggcgacacccaggggcccctccgcttcgcattcatcgagttctgcagcgtggaggctgcccagaaggtgcgagggtgtgttcggtgtaggggccaggggcatgcaggctgctgtgcaccgcttgcgcccggccagacctgggatggctcgatccgccgctgtgcctttccatccaccatgcccgcctcannnnnnnnnnacctgggatggctcgatccgccgctgtgccattccattcatcatgcccgcctcgactgccctctgcaggcggtgagccggagcgggcagctagtggggaactgcatcgtccgtgtcagcccgagcaagactgctatcgtgcccgtcagcaacacatacctgtgcgtggtcaggagggacttggaatcaagtttgggatatgatgtggtcactcacaagtgcctggaggatgtgccgtcctcgtcccaggtgcacacatttatatctgcccgtctccctgtcacatgctcattccatgnnnnnnnnnnagtggctgggctgtcgaagggggagaggggggtggtctccttgttttggggcgnnnnnnnnnnccccgccggtgcagaccccgctcgagcagcgaatgggagcaagtggcgcgcactgtggcatagtgaaggtcctgggaccatgacatctccatgccctgtagtcaaccatgtccacggatgcctcgtattgtcaccctga

SEQ ID NO: 6775 - DNA, 843 bp, Chlorella protothecoides
atgctgcgccaggaccccacggagacgctgttccagttcctgtgcagcagcaacaaccacatctcccgcatccacggcatggtggagcggctgtgcagcggctggggcccccgcctgccactgacacgcagcgacgagtatggcggccccgcccaccacgccttccccaccctggaccagctggcagcggccagcgaggccgacctgcgcgccgcggggttcggctaccgcgcgcgcttcgtcaccggcagcgtcgcccggctgcgggccctgggcggcgaggcctggctcgccacgttgcgcgccggcccgcccaacgtggcggtggccgcgctgtgcacgctgcccggcgtggggcccaaggtggccgcctgcgccgcgctcttctccctggacgcgcacgcgctggtgcccgtggacgtgcacgtgctggcgctggccacgcggcactacctccccgccctgcgtggcaaggcgctgacgccgacgctgcacgcgcaggtgcaggcagcctttgtcgcgcgctttggcgcccacgccggctgggcgcacaacacgctcttcatctccgagctggcgcggtacaggggaagggtgcctggaaccaaacgggcggagaaggtcctgctggcgcggggaagcgaagtcgcagaagaggtcgatgccggcccagatggcaatgcctgtgcgagggtcgttggcatggacggcagcgatgccagcaccgggaagggaggccgggcgcggaggaagaggaaaggcggcgctgcgtcggtggcgagcagtttggttgaggagcagatggagctggcgccgaccacgccaccccaggccgcggcctga

SEQ ID NO: 6776 - DNA, 1065 bp, Chlorella protothecoides
atgctggacttccaccgggtgctgagtaacctgtcggaggtcacctcccagcacgcgacctctggcgacagcagcgacggcagcggcagcgagagcgatgcggaggaggccccggccgccgaggcgacgcccgcgcccgcgaaacccgccccacccaagcccgccccacccaagcccgcccccaagtccgtctcgcatcagggacggttcaagcggcgggagtcggccaaggacgtccggcagtacacctctgacagcctgcaggccatcctcggggggtggccctcggccgcgcggagcgcagacgctgcgcccgctccccaggtctcacggccagacgccagcgcacggccctgcccggcagccccgcccacccctgcgctcccccgcaccgaccccggcgcgtggtgggcgggctactttgagcggtcggggcggctgggcagcgccgcgcggcgcgcgggcccccgcccgggcgccatcgccgtgcacaatttcagcgagggggaccaggaggcgctgttcacgcgcacacacgacggcgcgacgcaggggcgcgtgggcctgggccgtgccggcgctcccaagaaggtggcggggacgcgctgggcggggaccaagacccggctggacagcgaggacgagggggaggaggaggctgagctggcgctggaaggggaggctgaggaggagctgcagggcgtgaccatcgtcatgccgcctggacggcggccagcggatcccaccggcggcacgggagaggggcgagggggccccgcggcagcgcggaatccctcgacgccgacggacgcacaccctgcgccgcgccaggccgacggcaggccgcccgtggccccgcgtacggtcaagtggaagaagctgacgctgcaggtgctgcaggggtgcggcaagcccagcatgcggctgagcaagctggtcaaggcggtggcagcggcggcgggggtggattgcaagggcgccgacgtggccgcagccgtggccggcgcgatcgcaggttccaggcgactctgtcaggggaacgacgggcgtgtgagcttgagttga

SEQ ID NO: 6777 - DNA, 240 bp, Chlorella protothecoides
atggcatcggccttgcttgccccggtgcagaggtaccagggagtccagaaggagtcggcggggtacaagctgctctcctccatgggttggaaagagggcgacggcctgggggctacggggcagggcatcaaggaacacatccgagtaaagaagaagtttgagaactggggcgtcggcgcggtgagcagggcggcgtgggaggagggtggagggcaggtgggttcatacatgggtccttga

SEQ ID NO: 6778 - DNA, 810 bp, Chlorella protothecoides
atgcggcgggctctgatcgcgcttgcgatcacgctcactctaatcaatccatcggcgcatgccctgctggaatctcaggcctccaagtactcctggctgctccagaacgttggcacggtgaccgatgccgacctcggccagcatctgatcaccctgtctgagcagggcgtgctggccagcctgagccccggcgatggtagattgctttggcgaaaggtgctgagcccaggtgcccggctcgtgtcggggcccggggtggccgtcgccatcgagcctgccagggtgctggccttcgctgccaccaatggggccctgctctgggagcgccccgccgtcgaggcagacgtggccttcactgccaatgggcgcctcgtgctgacagctcaggacgccgtccatgtgctggcggcctccaacggcgtggtggtggccagcagcaaggtccatgtggatggggaggagcccagcgaggcgcggcccagcgtgcacagcgccggcgccgatgctgccaccgccgtgctcgccatctgggcgcccattcgccgcgcgctggtggtactgcagctggacagctccagcggcgcgctgactcagattgccagccacgcgcttcctgccaaggtgcaggtcgacttagaccccgccgcggtcgccttcctggcggggtcgcggctgctggctgtcaccgccgacggcagcacgctctgccacgccgagacccaaggtgggcaacgcatcggtgcggagcactgtggagaagtgggttgtggcatgcaggcgcagcacatgtggcagcgatctgcagcatga

SEQ ID NO: 6779 - DNA, 828 bp, Chlorella protothecoides
  modified_base (355)..(364): a, c, t, g, unknown or other
atggacggcagcgtggccactggggacgtggagccctgcgccctaggccgcatgccccccggcttccaggccggcacggggcgaggccttgggccgggcaccctgctccgcttcgagctggggccgggcgggttcaccttgctggacggccgccccgtgggcgccgacctgcgcttgctcggcgtggcgggggcgcgtcgggggcgcgcggacacgctcagcaaggtcctcttccagcatctggccaggacctgcccgctgacctacgccgagctggcggccgcggcgggggccgcgcccggcggcgacgcagggagcgcggttgcgccggcggccgcctccgacatggtcacgnnnnnnnnnncgggggccgcgcccggcggcgacgcagggaacgcggtcgcgccgggggccgcctccgacatggtcactggggggaccagcgaacgggaggggatggagacagagggggaggagagcacgcccgcctcctccatgcagcaggggcagaggcgcctggagaggggtgcggggatctgggtcgcccgagtgtcggtgtcgccagggcgcgaagaggggaaatcaaaccccccagccatcctcaccatcgaagaaggtatactgcagggaccgggacgcgcgcgccatcaccctcatcattggcagcattgcatgtcgaggttcccgctgtacgaagagtgggtcgtcgacagcaccccctcccgctcgcccctgacgcccagagtatcgctgctggatgccatgcatggcccggtctgtgcccggcccggcccacagatggatgtagggcttgagccatggtcctga

SEQ ID NO: 6780 - DNA, 2397 bp, Chlorella protothecoides
atgggggacgacctcgaattatactctcgtgaagtcaacattgaggctcaatacgaaaggccatgctgcatggcgagctcggcagaggcagcgtttagagttgacgaacgcgctttggcactatggtgggtggccttggcactgctccggctcacacacgtgatcggagggatagctttgctggttatcatgccaataattttcctcctcgcagtctggaggcgagggggacaccagtctcttcgagaccccgacctacatcgtcgccctggttctcgtcttcttcctggtcctgtccttcttgttcaacctcatcatgggcaggatccgggaccacctgcgccgcaccaatcgccgcgggttcctggcggcggtcgagaagatgacggaggagctgaccacactgggcctgatctccctcatcctcctctccatccagcgctatatctccagcatctgcggtgtggagcacattggcctggtgtttttttggaagtggggatgttcatccaggatggtaggggtgctcatcaaccgtccggtgcctcgcctcatcacgccattccacttgctcgagcagttgccatgagcttggcgcctgcccagcacacacccacacacccacacatgcctccctttcctccatcagtgtctggcacagacggggctcgccccgcctggtccctgggcactcgtctggcgagggagtgcgcatgctgcctggccagctccaccggcgtccaggcctgcctcctgcgcgcgggggggccgacctgcctgggcggggaggggctctgcgcctgcgacgcgcatgcctgcgaggccggcgccgacgtgccctgcgttggggtgcagccggggctgacctcctgcggggaggggcgggtgcccctcgtctccttcctggccctggagcaggtgcacatcctcatcttcgtggtggccctgacgcacgtggcctgctccttcttccttcactccgtggcacgcgcccgcatccggctctggagacggtggcccgagatggaccacgagcgcgccgccctgtgcgtcgtgagagccatgctttcttttgctgtttgtgtgggcgggagaaggggaggaagaggggcaaggggttttggaggcaggcaatgcatggagaaaccctgcgccgggctgctgcggcaggctttggtcggagtctcatccgcacccgaggcccagggcacttgtcagcacctcatttggaatgtgcggcctcggtatttcatctcagagggggtgaatgcccagatcgagcagtaccatgcccgcctgcacggtggaggagatgcggcggagtatggcccgccaggcgccagctccagccccgccaacgtggcagggggtggggctgcaggggagccccgccaaccctcctcctccccgctggtcgacgagggcatggcgaccgcgctgcgccgcatccagaccctcatgaggcagggcagcgccgccccggggtctgagggtgtcccgcccagcgccgatggggcctcgaccgtggtcgaggccccggccgcacgcatgggtggtgagcgggacaagcgctggcggcactgggcggcgtggtggcgggagtttgccttctgcctctatcacggcctggcgcccaactcgctgacgaggacgcagtaccagaccctggtcatgtccttccgcctcacccaccgcctgcccgcctccttcaacttcctggatcgctggaggacgacctgtcggccgtcgtgggtctgtcccttgaattttggctgctcatcgtcatctactggctggtggcgggcccttatggtgagcccgcgggccctgcctacgaggagagggaaggaagaggggcatgtcggcacatgtgctgcgcagatgctgcaagagatctgcagccatgtcattcgtgacatgaagacgaccattgttcaaggcactttccacggcaaaccgcaactcttcaattgtggccctagctgccccccatcccccccacctcgtggcacaggctaccccaccatgatcttcttcgcgctgaatggcgccgtccttgcgctcacgaacaccaagctccagcacatcattcgatatgtcactaataaagtattggccatctgctgggcatgccgtgtgctgcactctgctgtcgacacacatggagcacccccagctccgacgagacttggcaagatcaatatggagaaggctccctatcctccctatcccgaccccaggtggagtgccccagcagctggagctccacgtgttctggctgaaccggccaccgctcatgctcatccccatcaagctcacgctcttcctctgctcctacacctacgccagcttcatcttcttcctctggcagtttggggcgagctcctgtgcctttga

SEQ ID NO: 6781 - DNA, 1068 bp, Chlorella protothecoides
atgggttacggatcggggccctgggagtttgagggccgcgccctctaccagctgtccctggttcgagtcgatgaggtggggtgttatcacggatgtggtgcacagatccatgatgccatggacgaggtgggctcgtgcagggtgccagggccggctccctttcatggacagggagcctgggccggctccctcccatggacaggtggggccgggcatgtccgcgcctggcgcccacccacatttccccctccccacttccaggcccggcgccacatcccggccgacctccccctggtcagcctcttcggctggaccctgggcggcctgtacctagcccgctacacctccagccccgccggggcctttgatgagctggtagcgctggcgggcctggtctgggacgggcccacctcctgcgcctgggcggggcgggtgctggtgaacagccccgccgcgttgcagcacggacagcaggccgtggggctgccctcccacgccgcacgcttccaggctgcaggccacagtgcctggtggcatggcgggaccccggggggcgagatcgctgcgacccaggctcgggggtggggccagacgcgcgcggagagcgcggcgccggcagccccctgcctggtggtgtcgctggatgaccaggcgggccgtcgtggccagcctggccccgaggctcggcacagccccacgctgtgcgcgctgcggctgccgacagtgccctcgcgcaaggtcccccgcatgaagctgaccctgcccagtttcaggtgggggtgtgtttgcgtgccgagggtgtgcagggccgggggaggcatggcagggcattcccaaggagctggtctgatgtcttcccgactcccttccccacatgccgctggcgtgcagcggagccacagaggcagttcccaccctgctcaagtactccctgaagatgcatgccaggatacagccgtgccgccgaatcctgcagcaccccttggagcccgagggagagcacgacgagcacgtcgccgcgatccagcggctgacggggggcagggctgtgctctgcttggcctttga

SEQ ID NO: 6782 - DNA, 1382 bp, Chlorella protothecoides
ggttgccgaaacatggaaaacttcgatcatgtgagtttccggaaattttcgagctggaaaccccgctgtatcgaaaactttcgggctatattacaccaggcgcttcacgcaagggggggagggagggggcgaggaggcaacatgcttggccaagtgagtgttttactctgcctcagagagcatgccatcgtccaggagatactcatcgtgaaagagctcactcaaggggcaagcgcggtggctcaaagtctgtgggtcttagctgatggagggcttccagggccgcttgatctgacccttgggagctgggacagaaggggagacatgccactgcaatccaatggacagtcctctgtgaatatttgcgagtctcttgactcacaacgagcccgagaaacggggtgggaaatcaaggcgggtcttcccaccgctgcttcgacaggagctgcgatgatgccggagcggagcatctttcctaactactgtccggaaggcagccagcggcacggggagtatatcacacacgtgacctcggagtcgtgcaacgcgatggtgccgcgtgagcggacccctctcctcggcgcggcgctgctgttactgagccttggtgtgcttacaagggtgaggtccaaggaggcgtgcgatgtggacgaatcgtaccgcatgggagtgtgggcagggccatttactcttaagtgcgccgcgcgaaagcctttctttcacacctccagggcgcctgcacctccaaaattttctcgctcccagcagccacgtgagtacttgacgtttctgttggctcattggggtcgcgaccttgctgatgcgagtgtgcgggcctcctttttatgcgcggtagaacctgcgtgtccggactctggcccggacggatggaagctcttgttgatatatgcatatggtgtcaaggtgcggaaccctcctgatcacaggtcgcaagggtacagcaaggcgggtgctgtcaggaagaccactctccatattttgggtctctcagttggtgccattaggatgagtccatttagtgtcatagaggcacggtccaccgagatcatagtcggcgtcgaatgcctgaaggcgggacagaaggcctgcgtggctgacaaggacggcaacataggaaccgggaaccgaggaaagaacaactttggtgactacaatgtcggctacgacaacatagggagctttaacgaggggaacaacaactggggggagaggaacaaaggcaccaacctgcggtgcaacaatgcgaagggaacgcggatgattgtcaacacatgcgaccttgagcagctccgcacgtctgtgcgtgtgaactacaatcctccccctcctccatccaagaaaatgatgcctccccctcctcc

SEQ ID NO: 6783 - DNA, 477 bp, Chlorella protothecoides
  modified_base (207)..(216): a, c, t, g, unknown or other
  modified_base (383)..(392): a, c, t, g, unknown or other
cggacggcggccagggcgggtccggcgggtcgggcaaccccgaggagctgcgcctggtgggcaccttcaagtactcgacgctggaggaggtggcggggaaggtggcggagacggccaaggaccagctgggctgccgcttcctgcagaagaagtttgacgagggcggcggcgcggcggtggaggtggtcttcggcgagatcctggacnnnnnnnnnnccgcttcctgcagaagaaaagctgctggaccgctgcagcgaggagcagcgcctggcggtgctcaagcgcgtggccgggggcggcgagctggtggaggtggcgctcaacacgcacggcacgcgcgccgtgcagcgactgatcgagactctgaccgcgcgggaacaggnnnnnnnnnncggcgagctggtggaggtggcgctcaacacacacggcacgcgcgccgtgcagcgcctgatcgagaccctgaccgcgcgggaacag

SEQ ID NO: 6784 - DNA, 1341 bp, Chlorella protothecoides
  modified_base (632)..(641): a, c, t, g, unknown or other
atggttcgtgcagtatccagcgcccggccccgcacctcgctggatgactggcagagcgatggcccctcactgggtggcatgctgggtggatcgtcgaatggtgcccgtgggtcgggctccgcaccgccccccatggaggtcaacgatgtgcctctaaactccgaggtgtatgggacaccgcagagcatccggaagcgctgcgatgggtatgcatggtgcaccgctgatgcagtagccatggcatgggtgccatggcatgggtggtgggaaagagtagctgtgcgcagagctgcagccctgacatcatttcctcttccaccgcaaatctcggcatctggacccccccctcaccccctcaccctgggcccctccttcgacgcaggccaagcaggactacaccaagctgcagtcccttctgaaggctggcgacttccagggcgcggacgacgagacgcgggcgctgctcatctccctggccgggcccgaggccaggcaccgcaactgggtgtactggtcggaagtggcggccatccccgaggccgacctgaagacggtagacgcgctgtggagcgcggcctccgggggtcgttttgggttcaccgctcagcgccaggtctggacgcagcaccggnnnnnnnnnntgcggcctccgggggtcgttttgggttcactgctcagcgccaggtctggacgcagcaccggcggcgctgggtggagttcttcaaggccatcaactgggtggcgggagagtacaacatgtacaggtgggtgtgctggtgggaccatggggtgtgtttgtgcgctgtgctgcctggcatgctcacagggataattggagggggggatcccagctgggtataccacgtgtctcatccagttgctgttgctctttggaaggggactgttaccctgctccgtcggagatattccagcccgttcatgccgtgcaccaggtccggtgtcaatgcgcccaactcgcatgatacaaccccccctacccgaatgcctgctcaggaaatggccccaggagttcatttacagcacagaggcctgcaagggacacctcccgctgaccaatgcactgcgtggcacgcggctcatggaggctctgttggagcacccggccattgcagggcccacgaaggagcgggcgggcgaggtggtgggaggaaacggcaccgaggcgcggacgcagggatccaagctcccagattggctttcctgaagtcttggaccccaaatctttgggattcgctgactgttaacacaggatcgacggcgtggacccagttgcaagcagccccggacccttactcagatcacttcaccgctccgcattaa

SEQ ID NO: 6785 - DNA, 792 bp, Chlorella protothecoides
atggacacctcacttggacctagaagccacggattcccaagggtgggtcgcccatggggtctgcgcgtactggattcttccgaggcgcctggcgggtcacgtggcgcaactgatctggcttcttccctctctttgcagggcctgcgagtcctcctcgtcgaaaccgagcctgagctaggagccattgcatcgcagctcacgcagcatgagctcggttacacgggtaagggtcggctggcgcgtaggacatgggcgcaatacggggcggagcccgtgccatgtcatgcgaccgggtctgattctgtcccatcgatcgccggatcttcccccccacagtcacttcatgcactaaccttagcgacgccatggcctattcgacgaacgggccgcggtgggctgttgagcgcagatgacaccacgggtaggtcctttgtggacgccttcttcgacgtccccatcgtggccatgtcggactcggctgaggccaccaaggaggcgatgcacgcagtggagctgggggcggtggacctgctgagcaagcccctgtccatgctgaagctgaagaacatctggcagcactccgtgcgcatggtgaggaggtggaggggtgggttggggtggggtggcatgggtgtgatactgcatcccatgcagcgtgctgcctgggcatggccgctcccccaccaggagcccttggtgttgccagcaccccaccaccaacccctccccttcacacccgcccccacagatgatggccactccccacctcctgcccgtggacgccatgtttga

SEQ ID NO: 6786 - DNA, 375 bp, Chlorella protothecoides
atgcattcgacgggacggggcccctccccaccgccaccgcacctgccccctccccaccgtcacccaccccctccccgccccgcacccacatcacgctcccaggtggtggagctgatcgaggcaggcgccgacgcgctccgcgtcggcatgggttccggctccatctgcaccacgcaggaggtgtgcgccgtcggccgcggacaggcggaggccgtcttcgagtgtgcacgcgtggccgcaaagtttggcgtccccgtcctggccgacggcggcgtgcagaacgggggccacatcaccaaggccctcgccctgggggcctccaccgtcatgtgcggctccctctttgccggcacggaggaggcgccaggtgtgtga

SEQ ID NO: 6787 - DNA, 306 bp, Chlorella protothecoides
atgcacaggggctccctccctctcctccgacggccgcctcctggtgggcgcctccgtgggcacccgcgactccgacaaggagcggttgcgccagcttgtgtgagttgcgcgccgaaggcggatatggaggccgggatcgacgtggtggtcatcgactcctcccagggctggtccctcttccagctggacatgctgcggcacatcaagcgcgagcacccgggcctgcagatcatcgccggcaacgtgatcaacgccttccaggtgcgggctcttgtcactgggggggaagaatgtgctctgggatga

SEQ ID NO: 6788 - DNA, 1143 bp, Chlorella protothecoides
  modified_base (419)..(428): a, c, t, g, unknown or other
atggctgacgcagcaccagcagagcggggcggcttcgagcgcggcttcggcggtcggggtcgtggaggcgaccgcgggcgcggtggcgaccgcgggcgcggccgtggccgtgggcgccgcgacgatggcgaggagaagtggacccccgtgaccaagctcggccgcctggtccagcaggtactgggttgttacactgacgccggctcagtgcttatgtacatcaagggaacaaggaagcatgacagctgctgctcgctggtgctcaggctggtggatgtcagacggctggcctggcatgtgggcattgcatgtgaggactgcccatggctggtgaaatctcatcctgccatgctgtttcgccacactccgattgttcggtctccttctcctcacctgggtcgcacaccccctccctcgannnnnnnnnnctgccatgctgtttcgccacactccgattggtcggtctccttctcctcacccaagtcacacacgccctgcctcggacccatgcagggcaagatcaagtccctggagcagatcttcctgttctccctgcccatcaaggagtatcagatcgtggacaccttcctgggctccgcgctgaaggacgaggtgatgaagatcatgccggtgcagaagcagacgcgcgcggggcagcgcacgcgcttcaaggcctttgtggtggtgggcgactacaacgggcacgtggggctgggcgtgaagtgcgccaaggaggttgccaccgccatccgcggcgccatcatcctggccaagatggccatcgtccccgtgcgccgcggctactggggcaacaagatcgggccggtgcacaccgtccccggcaaggtcacgggcacctgcggctccgtgtcggtgcgcctgatccccgcgccgcgcggcgcgggcatcgtggcggcacgcacgcccaagaaggtgctgcagatggcgggcatcgtggactgctacacctcctcccgcggcaccacccgcaccctgggcaacacggtgaaggccacctacgccgcgctggccgccacctacggcttcctcaccccggagctgtggaaggagaccgtgttccagaagggacccttccaggagttcacagacttcctggccaagcccgtcatcaagggccactag

SEQ ID NO: 6789 - DNA, 996 bp, Chlorella protothecoides
gcgcccgcggccgcgccgccgcgccgccccgccacctcctcggccgacccggtgctgcgcgcgctggcggcggccaagcagggccacgtcttcgccaccgacgagctggtggccacgctgatggccagcccgcggtcggtgtacccctgggacatggtggtcacgcgccgcggcgacctgctcttcctggacaagcggcccgggagcagcctggactacgtgaccaatggcgagaccagccccgaccccatccccgaggaccgcaagctgctggacgggctgcagcagctcagcgcggaggccacggccgtgcacgccgccttccgcgctcaggtcctgcgcgccgacggcgagcgcgcggcgctggaggggcccgcaccgccgccggggtctgcgcctccggcccccgtcgcgggcgaggcgtaccgctaccggcgctgggcgctgggcgacatcgacctggtggtgcgctgcggcgtggacggcgcgctgggcagcaccgagggcggcgccgcggccgcggccgcccccgccctgctcgccgtgcacgccttcaacgagttcgaccccaagtggtcgggcatcgactggcggagcaagctggagaaccagcgcggcgcggcgctggccaccgagctgaagaacaacgcggccaaggtggccaagtggaccgccgccgcgctgatggcgggcgtggacgtgatcaagctgggctacgtcacgcgcgccagccctaagtccagcgaggcccacctgctgctgggcacgcagtcggtcaagcccgccgactttgccgcgcagatgaacctgagcatggacaacgcgtggggtatcgtgcgcgctctgctggagctctgctacgacaccatggaggaggatggtgggttcccggtttggcttctttgcagtgtgtgggagggggccaggtggagtccccctcgttgcgacgatggtcatgagtgcgaggcttcctactcaattccccctcccctctga

SEQ ID NO: 6790 - DNA, 405 bp, Chlorella protothecoides
gcgccgccccccggcgcacgacccctcttccccgccgccgctgcgagccagcccctcggcaacgggacagttcccgccgccgccgccgcggggcctgggtctgctgcgcccggcgccccgcctgccgggccgcccccagacatgggcatggtgtggggcgaggagggcgtgagcatggaggagcgccgcgctgcgttgccaaagcacgccgccctggcggcggggagctgcgtcgaggcgctggtgagtgcctggtctgtggggcgcagtgtgtgcatggctggctggcggggtgggggacagggaactgagggtgggggacagggaactgagggtggggagtggacgcgttggatggcgccgcggaccggcaccgcgatccccggcgtgctgtgctctcagtag

SEQ ID NO: 6791 - DNA, 387 bp, Chlorella protothecoides
atggcggcgccctcccgcgacttccgcgtggccggcgcgcgcggcgtgcgcaaccagaacaagcaccgccggctgttcgaggggggcgagggcgcgctgcgccagggcgacgcgctgtcctaccagaccgcgcagggggaggtgctcctgcgcggcaccgcggtggtctctgccatggggccctccggcatcctctgcgactgctgcggcgccgtcgtgtcctgctcccagttcgaggcgcacgccggccgcgcgcagcggcgccagccgtacgagaacatctacaccgccgacggcatcccgctcaagcagctggccctcctcctgccggacctggaggaggggggggaggacgcgggggccgaggacgacgcgggcgaggggtga

SEQ ID NO: 6792 - DNA, 594 bp, Chlorella protothecoides
atgcccagacgcacggaagtcgccgctctgtcagtgttttgcctcgccgtgctctgtgtcgccccagagtcacccaagatgccccattcccacccaccctcccccaacccgagcccaaccacccctcgcctgctgcagctcatggtcgtcgtgccctttatcatccccatcttcatccccttgggcatcgcctttgtgctggtctaccggcgctacgtctgcacctcacgtgaggtcaagcgctttgaggccacctcccgcagcccggtctacgcctccttctccgcactcctcaaggtgggggaggaggggtctggtgcgcacatgttggtgggagagggcgacgcagggatggctcaatctcaagggtgcagggtccatccctggcctgcgcacccggcctgtgctgccccaccaggcctgaagctagttccgccgtgctgccttctgagccccgagtccaccacaccaccaaccccaccccaagtcaccccccctcccccccaaaaaactaaacgaacagggcctgccgtccatccgcgcgtacgccgcggcgccgcgcttccgcgcccgcttcctgcgcgacctctctga

SEQ ID NO: 6793 - DNA, 816 bp, Chlorella protothecoides
atggttcaccgcgctctggtcctgttgggcgaagcggtgcagcgctcctcgcggctgaggccacgtcgggctgccctcgagctcacggactcagccgcgacccgcatcaagcagctgcttgagcaaagacacaaggtgggcacgcgaggatcggacgatgcagatatgatccggacggggtgtccttctcatgcgttgcgctgtggtggtgcaccagtcaaccgcacatgtgaggctgacgccaactccaaagcaaaatttgacgagctggtggaggacccccgtggcgtcaaggtgctcattgacccagctgccctcctccacgtcctgggcacgaaaatggattatgtagaggaccgattacgctcgctgaccctggcctgtcccttcccgcaggtccgaatttgtgtttgtcaaccccaatgccaaggggacatgcgggtgtggcgaatcattcaccacagacgtcaagtctgccacgggctgatggcttcctgttctgtctgctgtggtgccatagcttgcccgctgccctggggcgttttgtgtaagagaaatcttcatggacatgcccaggcagcgatgttgccgtgcactccacaaacccctgctcctgtgcaagctttgacaaggcgggcacctgctcacagatcgccgtcgtccgcgtcatccagctcgggggctcggcagcgctgctcggtcccgaggcagccggtgaacaaacggcggccacgtgtgactgcggtgccccgctggcagacgcagtcggcccggagctcctcgccgggtcccggagtcatcaccttgcgggggtag

SEQ ID NO: 6794 - DNA, 894 bp, Chlorella protothecoides
atgctgtgtgcttctcggcgcctgagcaccatggtagcctgcagtggggagcagcgtgaccatgggagacggcatcctggtggctcttgcagcctcgacccctggccgcccctcaggccggttgcctggggcctggaccgcatgctgcttgattggctcccagtcccaatcacaggcttgcaaccctcccccagcccacccaactcactctcccagggcgggctgtcgtgcggcgtggtggggcgcaccggatccggcaagtcctcgctcctgctcacgctgttccgcctgatcccggtcacccgcggctccatccgcctgggcggggtggacaccgcgcggctggcgctggacgcgctgcgccgccagatcgccatcattccccaggaccctgtgctcttctccggcagcctgcgcggcaacctggacccctggaacgccttcgacgaccaccggctgtgggaggtgctgggcgcggtgcagctggggccggtggtgcgcgctctgggtgggctggaggggcgcatgcaggaggcgggggacaacctcagcgtcggccagcgccagctcttctgcctggccagggcgctgctgcagggagccagcatcctggcgctggacgaggccaccgccaatgtggaccgggcgaccgacgtcctcattcaggaggccgtgcgcaccttcagcaagaccggtgcgggcgacgatggccgcgccaggcgcactgtcctggtcatcgcccaccgcatccacactatcatggactgcgaccgtctgctggtgctgtcggacgggcacctggtggaaagtggggagccgggcctgctggccaggggccgtggcgtcttctcccgccttgtcagggcggcgggggctggaggaggcagggcctga

SEQ ID NO: 6795 - DNA, 540 bp, Chlorella protothecoides
atgtttgtgggccagggtgtgtatctctatggtgactactggattgcggtctggtcctccaagtcagaggcggagcagcaggaggccttctggatctggggctacgccatcatggtgagctgcgtcctggccatctccctggttcgtgcgcagctctttttccattacaccctggtggcgtcctcggccatgcaccacgccatgatcgagcgggtgcgtgggcccagagagttgggtccttccccaggagcaagcgcgctggttggaccctcgggccccgtggccatgcttggtgcatgcctggtcttggcggcagttgggcttccatggcaaccacgccaagccctcctcctcttcccgtcatgcagcaaggatcagggggccgtggatgaccagctgccgacagttgcctttgatgccatccaggccgccatgatcgtcctgggctgctttgtgctggtgggcaggggtgctgattggacgggctcttgtccatgtcattctgcgagctggatcaaaagggataccgcgtcgccttga

SEQ ID NO: 6796 - DNA, 285 bp, Chlorella protothecoides
atggacttcctcagggcagcggcgggcatcgccggcaccagcgtgtactctctgcacaagacgtcgacgcgcgacttcatccaaaagtttgcggtcaagaccctgggcctggcccctggggcggcgactgtcgtggcgcagctgcgctacgacctgccgcccacctacgcctttcacaggtgggcagaccaggggctggaggtgggccagcagggccccaaagggtcttcttcgggcaggggattgcacttacagggcgaaagggcgagccaaccgggagcctga

SEQ ID NO: 6797 - DNA, 1641 bp, Chlorella protothecoides
atgcttacattcccacagggcctgctggggcggcgcatcgtcaggctgcgccacgccaccgcgctgcagaccgacgagcgcgtgaagctgaccagcgaggcgctgtctggcgtgctggcggccaagatgctgggctgggaggacgggctgctggcccgcatccacgccgtgcgtgggcgggagcagggcttcgtgcgcgcccaggcgcgcatccgcgccctcaacatgggcctggcctttgccatctcccccgtggcggcgctcatcacctttgccaccgcacgcggcaccgggcacgtgctcaccgtggccaacgtcttctacaccatcgccctgctccagctgcccaagctctacatggccgacttcttcgtcaagtcggtggaggcgctgtcggagctgcgcgtcagcatggccaggatcgggaagtttctgtgcctggccgagcccccgccgccataccaccacgtctcgaccgcgccgccgggcaccctcctcgtccccggtcttgactttgactgggaggtgctgccctgggcccagggcagcggtgcgtatgggggggtggggccgggcgatgctggagagaagaccggacagaaggaggatgcccagggggggcagggggagagggtagacgcccagcccagccgcgaccctggcgagctgacgctgcgcggcatccggctggagtcggcgccggggcgcctgatcggggtgatcggcgaggtggggtctggcaaatcctccctcctctccgtgctcctcggggagctgcagcccacggccggcggcggcgtggacgttggcggccgcgtggcgtatgtctcccaggtgccctggaccgtcgccggcaccgtcaaggttgttgttggtggtgcagtggggtggggttgtttcttgttcaggcgggggagggcgtccatgcttggccatgaggtcaccatcccagccccggcaggaatggatggagcacctctggacgccctggcgcagcgctgtgctcccccctgcacagttcgcctgcgggcacccaccccctcacacccacgcgagaacatcctgtttgggagcgaggaggacccggattcctacgcgcgcgtcatccaggcctgcgccctgggcgacgacctggccatgctccccggcggcgacgccgcggagcttggcgagcgcggcgtcaacctctccggcggccagcgcgcgcggctgagcctggcgcgcgcggcctacagccgcgcagaggtccagctgctggacgacccgctgtcggcggtggacccgcgtgtgggacgcacgctgtttgaggcctgcatcgggccgggcggggtcatggcgggggccacgcgcatgctggccacacaccaaacccagcacctggccgcctgcgacgaggtgctggtcatgcgcggcggggccatcgcggagcgcgggaccatggcccagctggcggcgcggggggtgcccgaggccgcggccatgcacggtgggtttgggaggggaggggggtgggcggccgtggatgctgggcggggtaaggtgagggtcgtgcggggcgaggaagagggtgggcagcaggaaggggggagcctgaggtgtcgtcagatccccggcatgttgcgggcaccgcgcagtgcatga

SEQ ID NO: 6798 - DNA, 1647 bp, Chlorella protothecoides
  modified_base (319)..(328): a, c, t, g, unknown or other
  modified_base (501)..(510): a, c, t, g, unknown or other
atgtaccgtggaacccacaattcagcacatatgtgcgcgaaggctgcacttcacgatgcgtcaaaagcccgccgggttggctctgtcacccgagccatgtgcgcatgcgcaccaggaaaacgccatcatcagaggcgctccatcggacccaatccagcagcacatcacatggcagcattacaacgttcgaatgtcctgcttgccatcagccgcactttagcatggccaagctgtataagcacattcagaggtgctgccctgacctacaaagcagccaggtatatcgcggcccttaggatggggcaatgcagggtgcacnnnnnnnnnngttgtcgtgcccatgatggggcaatgcagggtgcaaacttcaaggaggactggaccaggatgagagctcaagaacagcagctacgtgacgatgtggtgagaggtcttggcgacactgaagctcagctcatcctccacatgagggccatcgtcgtgcacctcatttggcgctgnnnnnnnnnnaggattctgtacccagccgacaaggagaaggttgaggatggccaagccgcggagaaaatgaatctgccagtcaagagggtctcgttgcttgcaaagatggcacggaaacacttcccacttcatgcggactctggtcccatcgagatactgtacgaagacgaggacatcatcgtggtaaataagccagcgggcatcacgacaaccccttcccatcgcttcaaagggaatagcgttctgaaccgtctagtcggtaaactaggctgggctcctcttaccgttcatcgcttggatatggagacaactggcgttaacattcttgctaaaacctccgaggccgcccggcacttacacgcacagttcaggcatgtctcttgcagatctgggatgcaagaggatactgggaagaggatgtgttcacatcaccttgggccagcaagtccattgaaggtcccacatgccgtacatgtcattattttccattgcagagacaaaaatatcgagaagacctacctagcaatcacgcttggatcccctccaagcagttttgaggtcgacgtaccaatagagcggcacgccaccaataaatatatgagaagggtcgacaccggtggactgcctgccttgacctcttttctggtcatcgcgtctggagtgattgacagcggtgcttgcgaatggagcgagtacagcgactacaatggatctcctattccatgcacaacgagtctggtgcagtgcacaccagtgactggtcgcacccatcagatcaggctgcaccttgcacatcacggctttcccattctgggcgatgatctttatggggcgaaatgcaagttcatggcacgtcaagctctgcacgcgacccctggtgtaaaaccttcgttgtattcgagggtgagactattcactcccgatagtggtgaagcagctcatgtgaagcgaggagcagtatcaagcctctcaacatcatgcgaagctgggaccacggtcaactcaaaggtcgagaatggttgtctaccaagctgcagcgaaaggacttgcggcccggcattgatggggcaaggctgtcagttcgggctgtcgggtgcaactgttagcgagaagacgatgccagtgggcaaacacacgaatgcacac

SEQ ID NO: 6799 - DNA, 516 bp, Chlorella protothecoides
atgctacaaaactgggtctgttggctctgcattgcccatgctgtgctcctgcgagcgcatgctgagggtgtcgagcaacaaacatccaagcgcctgagaactgtccatagccagcttgaagaccggccgaggcaccgcctgcgggaccttgcgttcgcgatgcagcaggacgctggcatcgtggcgtcggccccgacagagtggggcaaggggcttagatgctgcgttccgtgtcagctggtcaaaactttcgaacaattctacgagcagggctgcgagaattgcccctacctggcgatggatggggaccgggagaggatttacgacgcgaccacgaccgatttccacggcctgacctccgtggtagatcctcagagtagctgggtgtccaagtggctgcatcacaaaaaccatgtcccagggtgctatgctctttcggtggatgtgcagcagctaccacagcacattgaagatattctgagcgacaatggggtcaagtggaagagggagcaatag

SEQ ID NO: 6800 - DNA, 963 bp, Chlorella protothecoides
  modified_base (151)..(160): a, c, t, g, unknown or other
atgtgcgttggggtgattccggcctgtgcccttgtgctcgcgctggacagcagcaccacatttgggggtctgtcactgcggccactccaaactctaccttgtacagctgtgtcaccgtgcgggtcgcctccgtgttctcagtgccctgaannnnnnnnnncggcctgtgcccttgtgctcgcgctggacatcagcaccacatgtcgggcgtcaaggcctttgaatgcaatcgccagactcgtaacatgcgagagcgatgccacactcctcacctttaccatctctggagctggatgcgaggtgccctatatcctggaataccctgcttcacaactgcgagagggaaagggcttacggcaacaagataacacagatacaatctgctcggcccgttgtaagactcacagcatcggcatggtccatgatgcgattgccatcgccgtccctgcccttcttggggcagggctcgcactgctgagtaggtgccaagccggcaaaaagtcccgtgaggagacatacaaaactcgcgtcctcaaacactttagccctgtacctcagctcctcgaaggcaaagctgaggcgaatctgcaatctggagctcagcagggtttacctgatgatagaccaaaactatccctgctgggtggtgttggtgcccagaatagacggtgtgatgcgaggatgccaccgtggtactcacgtggcaattccatctgctggaacatagtggtccaccatccggcactgaatggcattcccctgcaggcactctatcatccagacaagatgaacattgcagccattggcaacgtggtctcgcaactgcatgtgcacataacggcacggctagcatcggatcccagctggccagggccttgctatggagctgttccagctaaggagatgagcaggatcgaagtcgagcaagctgtttttacattacagaaggctataaagggatga

SEQ ID NO: 6801 - DNA, 795 bp, Chlorella protothecoides
atgaagtacgagaagcgaggactgcactgcagcattctgtaccgggagcctgctgatctcccaaagtcgtggtcaaaatggatgctggatctcactcgcaccaacatgaagcagcgtcgtttcccagactatgcgcaggctcactatgaagcgtgtcccgggtggggatggagggagagggaaaagaagtctgaattggcgcatccctctgcacgctaccttgtagctgcatccagtgtagctgagagtgaagaaaacatagctgcctgcaatagcgagcagggctgtgatgtgaaaccggtagcctttctccactttcggtttgaggtggaggaccataagcccatcctctacctttatgaactccagttggataattccgtccaggtaggcattgcatgcatgccagctggtatccttgggtgtaagccgcgtgatgccgtgatgaggaaagggctgggtcagttccttgtgcgcctcttggagttggtggcgtggcaatcaggacttagccaactaaaactcacagtcttgaacaccaatgacggtgctggcctattttacaaatctatgggatttgccctggatcaaacaagcccatctgcagtcagtctggatgcagcacctggatactgtccaagaagaatccccgactatgacattggatgcgccggattactgccgagtaaacactatgtgcgctggcgtcagatgcatgtgatctgctgccaagcccttgacatgatgatgccagctaccaccttgttagctggcattctgagaactttccaatga

SEQ ID NO: 6802 - DNA, 1218 bp, Chlorella protothecoides
  modified_base (1000)..(1009): a, c, t, g, unknown or other
atgatgggaggtggagcagtgcacgctgcctgtgcctcccctatagaaggctctgggttctgggagtgccccgccccattcagccccacattggtgacagagaatgaaacgttggagacaataaggccagtggtgctgaactcggaggtagtggcattggacgcagagtgggaaccaggttccaaattcccacgggcgaccctcgtgcagcttgctgcatggtcccacgatgttggactctacgtcattttgctggacaccctcagtctccccatagcatccgtgaggtccatgatacaggagatgctggacaacccaaggagcattgttgtggggtacggcttgcggacagatttgcaaagcattggcattcatcgatcgcctcaaagcctggctcatgcagtggatctcaacaggttgcagaacacccttgcgaatcgcatgccatatcaccttcgccccgccggagccggcctgggtgccttgatagaggcgcacttgggtcagtccctggacaagtcccagcagtgcagccgctggggtgatcgccctctgagcgatgcacagctgcactatgctgccctagattctgtgtgtctgctgggagtgctgcagtccctcatcgtacacactgagagcagcaaggtgcgcgactcgcctggcaccgattctcctgcgctggaaccagccaacgcagacgagagctgctggccacacttccggagggaggcgctttggcaggtagccttgacatggcccgcatactgctgggactccgccaagcaaattagaaagagggacgcccgacgaagacatacgactggtgagtgcagccctacttcgttctctttgccgtgctgccttccattcaggacactcctccacccccgtctcccccccaacgatgcagaggtggtgactcttgcccctatagcttttctccccagggagaggtcatggacacagtggctgccgggcagcgccacgtcaccttcaggtnnnnnnnnnngaccgcccaagtttgtctgtgatgtcatgctgcacggacttgcgcgccagctccggcttattggcgttgacgcagaggccatggacacagtgactgccgggcagcgccacgtcaccttcaggtcaggcgtccaaaacccttcttcatttattggcctgacgcagcatgacgaaaagcagtttcctggaggcttgaacatctgcaagtga

SEQ ID NO: 6803 - DNA, 435 bp, Chlorella protothecoides
atgacaggagaatggtgggaatggctgaagatcagggacggtgggtgctcacacgggacattggcttcatcaactcaaggtagggacgtggatcaaggcggaaggcccctcaaggggcagctagccttcatgttgacgcgtgtactccctcagctcccaggcatggagctgctgtgcgtggtccaggtgttcctgcagcccactggacctcccgatccctgcaggtgtgccaagtgtaatggcagcttcctgccagatccagtgggtccagcagacgtcgagtcgccgcaagttccggagggtgtgctcctccggcagaaggagttttgggtgtgcgccaagtgcaggagcgtctactggaagggatcgcagtatgaggctgccatctcacggctgacccagatgacgacgcgtctcagtctcaattcttgctga

SEQ ID NO: 6804 - DNA, 393 bp, Chlorella protothecoides
atggaggccttagcggactatgggagcagtgacgaagaggtcgagcaggagcccactccaaggaatactgctgacctcactcctcctgtcacaaccatagctcttccaccggccccaaatctgctactgcctgagccggaagctcactttgcggcagggcaaagtcagacagtaggaccttggccaaagagggcacacccatccacagcgccccagctgcccctcaccgccgcttcctctgcagccaagaagcagaaggtcacaagaaggtttcctctgagcgctgctccagggcgtggggacagcctcctcattcccccacagctgcgtggaagggccaacattgcaactgaggacctgtccagcatcttctcgaggcggaggcagccctga

SEQ ID NO: 6805 - DNA, 1050 bp, Chlorella protothecoides
atgctcgtaatgcggggcgtgcaactgggtaggcagccgctgcttcggcagggatacaggcttcaaaacacacatgatccggtatatgcctcccagaatcaatgccagaataggactgggaaggagcatctgcaactacgtcatggcatcttgccggagaagatgccgttcagtttcggaagccttcgccaagtttgcacagcagccgtggcagcaaatatcacagctcccgaaacaacaccagaggcatgggaaaacctttctgtgaccaaaaccgactctggcgtggacatcactgtggaaaagtcggacaacacatacagggtttccatagtgctgacagacgcatccttgcatgatggacttctacactggggcataaacgactgggaagtccctcctgaagctgtgcagccgcctgggacccgagaggcaggcgaccaggctgtgcagacgcccatctctggcaacaagatcaccctgagtttcccagcggacgggtgcccgagcaaggtagtgtttgtgttgaagaagggtgagacctggaccaacaatggaggttcaggatactctgcattcctcaaaccccctggagtggacgagctgcactccaagatcatggctgcagaggggacgtatgagcactggtcactcttcagtcgcttcaacatggctctgtccatcctggaagctgccgatgctgcaggtcagattgttagagctggacggacggctgcgatgctggcgatcagcgctcggcctgattatccggccgctgtgctctcacccacaccctctatctcaggtgtaaagcgcagaggggatggcgctggtggccacctggctacgcctcagtaccatgcgccagctggactggtaccgcaaggccaactaccagggcaaggacattgctcacgtgcagaagcagctggcacagcgcatggccgagaaggtgactgggctgactgtgatgtagacctttctcatggccaagggttccaaccacccagaggttatgttcctgaggagcataatggagcacgactctga

SEQ ID NO: 6806 - DNA, 756 bp, Chlorella protothecoides
atggacctccgccctgccgtgccgcacatttcccacctctccacctcccaccatccgctccagatagtgccagtccgagttttgcgccagcgcatacgcaatggcctgcagaaggcaatcaattttgcgacggtcgtcacagacctcacccgttgccacaatacctggtactaccaccgcgtcgatcgatgcttcgtggccacggaggccagcaagaggcaggcactcgacatgggcctcaaggaggaccagattcggctgtatggactccccatcaggccagccttttcgcggaagtatccccccaaggaaaagctccgcaaatctctccaaatggaccccaggaaaccggccatcctcctggtgggcggcggcgagggcatgggaccggtggaaaggacggtggaagctctcagcaagggctttgttgacaacatgccagagttcatgtttgcgagcgacatcatgatcacaaaggctgggcctggaaccattagtgaggcgctcatctgcggactgcccatgatcctgaatgcctacataccctgccaagaggaggccaacataccatacgtcgttgagaatgaggttggtctctttgagcgcaacccacacaaggtggcgctcatcgtaaagggctggctgggagaccaggccgggcagctgcgtgccatggcccagcgatgcaggaagctggggcagcctgatgccctcttcaacatcgtcagggagctgtcttcgatggtggctgcctga

SEQ ID NO: 6807 - DNA, 543 bp, Chlorella protothecoides
atggaggggcctcaacctcccggcatgctaccgtgtgccagcccaatacccatagcaagcctcaatcaatgcatcgcccatacccggggggtggagccccgagcaagcctcgggctcaagccttgggactggcagttctgggtacccaccagagggccgccgaggccttgccgaggccctgaggcgcagggcgttggtcctgcaggaggcggccgggacctgctcggtccgccggcgagcacatccgaaaggggagatgtcttcttccagggaaaaccgcatctcccaaacctgtccatgggcggtggctctgggcaaggaatcgggtactccagctttttcctgattcaagccccacgcctctggcccttctcttggtggtcacccccaaagaaattgcggacggaggaagagaagaagcggatcctgattctgatgtcggacaccggcggtggccaccgtgccagcgcgcaggccctcaaagccggctttgaggagctgtatggagatgcatacaaggtagagtctggtgtgcaggcatga

SEQ ID NO: 6808 - DNA, 816 bp, Chlorella protothecoides
atgcaggctggcacggcgcctggaagtggagtacccaaggcccttgcatgcctgcgagagctcataccctcagccctggctgccccagccgggttcaaggatgagctggcgcagaaactcgtggctgagggcttggtggcagaggatgcattcactgagcagctgtggtcgcgtgcctggcaagccatctgtacggtctgggcaagcaagtggacggaccgcgcctggctcagccgccgcgcgcaggccattcccgacgccgacctctccatggcggtcctgctgcagcccatcgtacccgccgactacgccttcgtcctgcacagcgccgatccgctgactgggcagcgcggctccgtccatggcgaggtggtgctgggcatgggcgaggcgctggtgggaaactccgcggggcgcgcgctcgccttcagtgcggcggccggggcgccgggcgccggcgccgaggacgcagcgctgctggcgctgcccagcaagcggctgggcctgtaccccgaccccagccaggcgctgctcatcgcccgctccgattccaatggggaggacctggaggcctacgccggcgcaggactgtacgagtcggtgccgctggccccgctcctgccccgcaccctggactatgccgcggagccgctggtgtgggatgccgccttccgcgccgacctcctgcaccgcctgaccagcctggcggcgggggtggaggccgcctttggtggggtgccccaagacatcgagggcgtgctcagcggcgacaggctctacgtcgtgcaggcccggccgcaggtggtgcagaactga

SEQ ID NO: 6809 - DNA, 885 bp, Chlorella protothecoides
atggccgcgtcagacttctccgccctgtgcctgcaggagtacatggaccgcatcgcagggctggtccagccctttgccaacgatttcaaggccgcctgcaatattgaacccaagtacaccctcaactttggcgaggaggtggtcaggggccagccggtattcatgctgagcgtcctgctgcgggccctgggccccaagctccgtggagccgcctcactcgggccctggcaggtcgtcagtgccgcaggcgcggagggggaggtgctactcctgcccaacctggacggggtgcagggccagaccatgcctggcgctaccatcatcctcaccgagcggctcaccggcaacgaggacatcccggagggggtcactgcggtgctgacaagcagtgcgacagacgtgctgagtcacattgccatccgtgcccgggcccagaaagtgctcttggccacgtgctttgaccacgggcattttgaggggctgaaggagctggctggctcccatgcggccgcagtggtgacacctgtgggagacgtaagcctggctgccatcgacaggacctccgtggggccggaggctgtacctgggagcgcttcaaaggcgcccaagatttccctggccaagcccgcgatgcgcaagcggggatcctcatgggtgctgcaggagccggagttcaaggcctccgtggtgggagggaagagcctgaaccttgcagcgctgcgacagaaactggattccctgcaagatgtttctttgccggcatccctggcgctcccctttggcacgtttgaggccgtgctggcttctcctgagaacgctgccgtggctaagaccgtcagcctggccgtcaaggagctggtgaggggccaatggagggccgtttaa

SEQ ID NO: 6810 - DNA, 1560 bp, Chlorella protothecoides
atgggctgtaggcggtggggtctcatgtgggctgggggcatgcatgcttcacaggccactcctcctgctgagcctcctcacacataccatcctgcaggtgacaaccagtccctcggtgccagcctgtcaactttttcagggcacctggctcgcatccaggctgttaggaaagcgtgcacgggacgggagctcgtccttctggacgaggttggcacggaagcagggtatgagaagtattgtaggccaatccacatcatgcatatgaggctactgcagtgcgatgctccttcacactcgagtccttccatcccgtcaacctcctccttcgctcccggttgggcccccaccaaaccctccaacaggcacggatcccacggagggctcggcgctgggggcggccgtgctgcagacgctggcgcgcggtgggaagggcggcgcggcccttgtcctcgccacgacccaccaccagtcgctgacggggctcaagtacgaggacccggtgttcgagaacgccagcgtggagatcgacgcctccaccctgcgaccccggtaccagctggcctggggcatcctcgggcgcagccacgccctggccatcgccgagcgcagcggcctgccggacgccgtcgtgggcggcgcgcgcgcgaccctggggaaggccagcctcacggccgagggtgtgtgtcgtggggtggcgatgaggagaaaggtggggaatgtggcgtggtgtgcaggggtcctgacgcggccgctgagcctcagggggcttcattacttcctcatcacacaggcatggtggccgaaatggagcggctgcggcgggaggtggagaccgcgcgggccagggccggcgaggaggaaagggcggcggcggacctgcgccgcaggtccgcggcgcgccgggccagtacggtcgcgcgcgagacggccgccgctcgccaggcccagacctccagggcgggagtcatcgaccgggcgcttgcggagctggcgctcgtgcagaaggagcagcaggccgcaaaagcggagcgcgggcggaaggaggccgcgctgcgggaggcagccgccatcgcacaggagcgggcggcgcgcgccgaacgccgggcggcctggcgaccggcggtgggggaggaggtgcgtgtggccaggctgggcatcgtggccagagtcctggcggtggatgccgccaggaagaaagggggcgtggtacatggggctggcgcgagtttgttggatcctggggagcttgcctctggcacgaggctcctctgcgatgctcttggatgcaacactgtgccactcttccccgatggtaacccgactgtgtttgcactgcaagcgcggggactgcgtcctctgagagtcctcaaaggtgccatggaagacgttgatggtgttgtcctccacagcccacagctcgtccacggtactctcgatgagatgttggtcgtgggacaccatcagcaccgcgcccttgaacgccgcgagaccctgcgtgaggaggattatggggaggtggtaactttgggtgagtggccagaggaagatctgagcgaataa

SEQ ID NO: 6811 - DNA, 297 bp, Chlorella protothecoides
atgcaggagtcgagccatgtgcctctgggcatggacgcagcaggctggagggccaccctggctcagctgggctggcatgagctctgcgacgaggcgtgccggcgcctgctcccaactctgggggacgcggaggcctcgcagggtctcctgaccctcaccgccgcgctgacagcggccgagcagtcccacggtgcccagattgagctggggagcatgcggtccgtggacgcggcccgggccctgcagcgtgcagaccagggcgggcagctgcgggccagggatcttttggtgagctga

SEQ ID NO: 6812 - DNA, 807 bp, Chlorella protothecoides
atgtgtcccaatgttccgcttcccaaccccgcactcccccgattctgccactcattgcagcacaaggagcaggagtaccgcagtcacctggcgtcctttggcatgaccgctgagctggccaagcagaccatgtacacgctctcaggtgcccaaccggggaggaggaagaggcggggggtccacagggttgacgttgggggattgctctttgccggagggtggcgtcctgcacaaggggctctcacccgctcctttcgggcagccaatctcagcaaagtcacatgtcggcaatctgcaggtggccagaagtctcgggtgtccttcgccaagctgacctggacaaagccccacatgttgctgctggatgagccttccaatcacttggatctggatgctgtggaggcgctggttcaggtgcggccggatggattcagactgtctaggggatggaggggaggcttgtcctgccccgggaacctcatgacgggggactgggcaaggctgatgggcttggggatccatgtgccctgcactgttgttgggattcatctgcacagcccttccgggatggtagtatggagatatttattcgctcagatcttcctctggccactcacccaaagttaccacctccccataatcctcctcacgcagggtctcgcggcgttcaagggcgcggtgctgatggtgtcccacgaccaacatctcatcgagagtaccgtggacgagctgtgggctgtggaggacaacaccatcaacgtcttccatggcacctttgaggactacaagaagcgcttgaagtcatga

SEQ ID NO: 6813 - DNA, 450 bp, Chlorella protothecoides
ctgacaggcctgtcctcccacccacatcggcccaagtgtgagggaccgcacctccttcctcacatacacaggtggggcaagacggtggtcatcgtctcccacgcccgcgagttcctgaacgccgtctgcaccgacatcgtgcacctgcacgcgcgcaccctgacccagtacaagggcgactacgacatcttcgcccgcaccttcaaggaccgggtgaagacgagccaggcggcggccgccgcgcaggaggagaagcgcgcgcacatgctggagttcatcaacaagttccggtacaacgccaaccgcgcggcgctggtgcagagccggatcaaggccctggagaggatgactggtgggatggtgggaggttggggttcaggggcgggtgagggggctgccctgtgggctggcggcgtcgcctgcatgctcagccatggcgactcacatgca

SEQ ID NO: 6814 - DNA, 717 bp, Chlorella protothecoides
atgtcgccacactcccaccattgtgcagaggtggaggtcatcgaggaggatccctcctacgtcttcaacttccccacgcccaccgacctcggtgtgtgggctttggcggctggtggatgtgccaaaattcggcaactggagtccatcgatagggttgagcatgttcctgttccgggctcagcgacgagggccactcacactcacccacaaccctcgtaccccacagtgtcccctcccgtgctgggcttcacggatgtggactttgcctaccccggcggtccccggctgttcagggacatcaactttgggatcggactggagagccgctttgccatcgtgggccccaacggcatcggaaagtccaccatgctggggctcatcagcggcacgctggagcccaccaagggcttcatccatagaaactcaaaggtgcctgctggatactggatgctcaggggccagaggtggtgctgcggcagggctgatccatttgctgaccgagaaactattcagcatgctgcgacccatgtgcctctggccaatcaacatccccacccgccacctcctgcctgcagctacgcctcggcatcttctcccagcatcacgtggatggcctggacttggcactcacgcccctgcagtaccttgcaaagtgctacccaggggtgggtgtttgggttgctgtgtggcttttggatggagaaacccgggggatga

SEQ ID NO: 6815 - DNA, 2217 bp, Chlorella protothecoides
  modified_base (2124)..(2133): a, c, t, g, unknown or other
atggaccagggtaaaaccgtgggggtggtgggccctggccgcatcggcttcgcctatgccaagatgatggtggaggggcacaagatgaacatcctgtacaacagccatgagccacagccggagatcgccgactacttcaacaagtacagcgacttcctggagagccagggagggacgagggtgactgcccgtcaggtggagcttgaggagctgctgcagaactccgacgtgggtgcagatggccgtttgttggaggatgcgtggtgtggtccagcttgcagggttggcttgttctgtcagcaggagtgcataggctgctgggatttcatcattgctgggggtctgcctttcctgcaagggacatcattcccattgtcgtccataccacatggggccgtacctccctcacccgtcccctcgactcccccaaacccttcctccctccaggtggtgagcctgcactgcgcgctgacccctgagacccgccacttgatcaacaaggagcggctggggatgatgaagcccgacgccatcctggtgaacgcggcgcggggccccaacgtggacgagaaggcgttggtggcgcacctccaggccaaccccggcttcagcgcggggctggacgtgtacgaggacgagccggccatggcacccgggctggcggagtgcagcaacgctgtgcttatgccccacatcgcctcggccacgctgtggacccgctccggcatggccaagctggcggcctgcaacgtggcgggcgtgctgcgcggctaccccgccctgaagagcgcgggcgacgtgctgcagttcgtggacgccgaccccgggcgcctcgcgcccaggcctgggcgtggaggaccctcacctgccaatcattttcgttcgcatgctgtgcacgatatccttgtggtgcatgctgtgaagccaccggcagcagcggatctccaacatgctggatccccgagattctccccgcgcccccccgccccacgatcatcagtcgcgaacggccggtcagggatcacaacgagccggcacaccgggggattagatgcaggtcggcgccaccaggaccctgttcaagtctccctcgacaatcaaacacccatcacccctcccgagacagcaggcggtacgcagatcgacgcgggccatcatggtgtcgtcggcatccggtgtggtgcttcccagagcgcccacacccctcatcacaccgtcacaggcgtagagcccctcccggccacggaccagcatgagctggagcgtgtggtggcctccctgaaggccaaggccccggagtgggtgggcctcgacccccccacccgcgcctcactcctgcgtgcctgcctccccaccctgctggccaccgtgccgggcgccgcggcggcgggggaggcggccaagggctcctacggctcggggcgcgcggaggaggccctgaactggacccccatcgccatctgcctgcgcgaactggccgaggcgatggaggcggggggcgcgccgcccacgctgggctcccgccgccgccccgacggccagtgggtggtcgacgtcttcccctcgggcctggagcgcctgctcaacgccggcttccggggcagcgtctgggtgaccccggggcaagagccgacccagggcgcgctgtacgcgcgcaaggcggcgggcgtgcccggcccggaccccggcgtggccctggtcctgggcgcggggaaccaggtgtcggtggccgcctgtgacatcctgcacaagctggtcgtggacgaccaggtggtggtctgcaagatgaaccccgtgaacgagtacatggggccctttgtcgcggcggcgctggcgccgctggtgcaagccgggtacgtggccgtcgtgtacgggggcggcgaggtggggagggccctgtgcacccacccagacgtcgactccatccacctgacgggagcggcggccacgtacgacgccatcgtctggcagggcaagcccaaggtgctgtgtgtgtgggtttttgttttaggggggagggggggttcgatgggaggcaaatgcgttcaaagggtcctgcaccatgcatgcatggtgcctgagggcatgcatcgcagcggggccagggcgctcagaatatacttnnnnnnnnnncgtgttttgttttttttggggggggggattgatgggaggcaaatgcgttcaaatggtcctggaccgtgcatgcatggtgcctga

SEQ ID NO: 6816 - DNA, 678 bp, Chlorella protothecoides
  modified_base (176)..(185): a, c, t, g, unknown or other
atgaggacgttcctggccctgcttaatgtctctggtggcaaagatgcttgcatcctagaaaggcatccagctttgaggagaattcttcagccgcccgcatttcaaggcgcccaccaagccagcctgctcatgcatttctcctggcgcagagcctctgcagccctcggaggagaccnnnnnnnnnngttgcatcctggaaaggcatccagctttgaggagaattgttcagccgcccgcatttcaaggcgcccactaagccagtctgctcatgcatttctcctggtgcagagcctctgcagccctcggaggagaccaatcaggctgacgcactgcgccggagggtgtgtgacgaactgggcaagcggcgggaggactttgagcccttcatcgattgcgatttcgatgcatacgtgcgtgatcagcgccgcccatccgcctggggcggtgagctttatttgtggatttcttaggagtgaacccgaactcgcttgtgcggccactgtcctggaatgtgttatccatgtgtaccagcagtcaacccagggagggctggggatgatctcacagtatggcgagttggcgaagggtggcagccgcccgcccgccatcaacctgctgtttcatcgattgggccactatgacctcctgatgcccggccagatacagtcgaagctatga

SEQ ID NO: 6817 - DNA, 1455 bp, Chlorella protothecoides
  modified_base (126)..(135): a, c, t, g, unknown or other
  modified_base (480)..(489): a, c, t, g, unknown or other
  modified_base (812)..(821): a, c, t, g, unknown or other
atgccggtactgcttgctggtgcaccctttggccagggtgtcatgatctgtcctctcaagactatcgagatgcactccatgtgtgtgcaggatgatacacagcacattgcaaggattcacagtctnnnnnnnnnnttctgtcctctcaaggccaacgagatgcactccacgtgtttgcaggatggtacacagcacattgcaaggattcacagtcttgtgaacgtcacagcagctagccttgcgggggacccatgtgaggcagatgtgtcccaggatgcattggcaggggctggtaggggggaggtgggggcttcccaggacccatgggagggggcggcggggggttggctggtggccttggcacagcaggcgctcccatgggcgggctctgggcctgcagtgaggtctgctccagggcacgtgcatagtcggccttgcctgaaaagattgctgtcaaggctcttgagtgctgatggggcnnnnnnnnnngggagggctcaatccagtcttgaatcactgaggcctctgcagtgcctcacaacgctgccaatcgaacaaccacctacttcgaaagccttgcatcgtgtcaggatggatgtacatgggagtaccagggggtactctttccagcttggtcacattgacatggcacctggtgttgattggagcggtagaattgggtgctctgagggcaggctcaagcatcttctacacagcggaccgggcgcaaaggccatcgagcactgccagaggcctgcccacgccatacccgctttacaagagcaactcacagtcggcatcgagccatggannnnnnnnnngccgggcgcaaaggccatcgagcacagccagagacctgcccacgccatacccgctttaatgaagcaactcacagtcggcatcgagccatggaagccgcacaggccaagcagaatgtgtgatggttggtgtgtcctacagcaaagcaagaaaaggcaccatgctactaggagtgtcactacgacaggggtcgcgcatcaacatgtatacatcacatgcttttcagcagtataccatacttccactgcacttgtaattgcgatgttcgcctgcagctctgaacaaacctgcgcatcgcccgcataccctcctcctggtccgaactgcccgagacaaagcacagctgtgatcgagcgggcaggcccctgggttccggccatgtctaacttgttgaagggagtgtcgagcctcaaggtgaaggaggttcccggcttcgtctccaagtatgccggcgagaacctgaccaagaacaaggtcgagggacggctgacgagctggtaccaccggtacaagaaggaggtgcgtcgaggtgctctggttgtcgtccaggccaggcctgcccggcagcaacatggtcagggtgtgcgccctggatccctcaggcaggccatgcctatgtcagaggcccagttgtag

SEQ ID NO: 6818 - DNA, 1104 bp, Chlorella protothecoides
  modified_base (563)..(572): a, c, t, g, unknown or other
  modified_base (820)..(829): a, c, t, g, unknown or other
atgggtgatttagggaaaggaggtgacgtcgaaggaggagagtttgatgctgccagtctttggtgggcggtgcctggtcctcacagatgggagttgcgagtgtcctcctccccaccctgcccccgcctccaggtgctggacaatgacttcttcctggtggcggccaaggaggcgttcatggacgcggcgcgcaccttcctgttcgagacctactgccgcgtgcaccagcagatcgacctggcggagctggcggggcagctgggcatggaccgagaggctaccgagaagtggatcgtgaacctcatcagcgtcagtggtcatcatcacaacctgacaaaatccaccgccaccctccacaaccaggaacgcgcggctgaacgccaagatcgacgccaaggccggcacggtggtaatgcagaccgagaccctgggcgccaacgacgcgctgctggagaaggcgcggggcctgtctgtccgcaccttcagcctggcaaacaccctggtcggcatcctcaaggcctagactttgagagattgcggcatgttgccctgctgcgtctgcnnnnnnnnnnacaccctggtcggcatcctcaaggcctagagtttgagagactgcggcatgttgccgtgctgcgtctgttgggtggccggggcgtgtggtgcctgatcgatcgctcctcgacggagtgccatgcgggccggtcccccagccccctcccctccacacacacacaccctcccttcctgctgtccccttcctttgctgccgctcctcgcgcccgggatctcggattcagttcggggatgccatcgccccatnnnnnnnnnnccatgggtgtgcacaggcgcccgggatctcagatccagttcggggatgccattgccccacagggaaggccaaaatccggcaacaaccaggccctagtgcgcggcgccgccggccagcttggcctcctgctcgtgcttgtagtgcgcgtactccttgggccaggagatgacgtaggagaagaggaagacgcccaccaccaggtcctggaagggcttgaagctgccggtgtcaatgtgctgcagtgggtgcagggggtgggagggacgatgttgtga

SEQ ID NO: 6819 - DNA, 465 bp, Chlorella protothecoides
atgatgctcaagagcaccatgcagagcacccggccggcatgcggcgtctgggccgtaggcccttcacccatgcggatgtggaggcagcccgccagggcacccgctgccgcgccgcgcatgaagcctgtcagggcccacaagtccatggatgaggccgccttgtccctcctggccgctacggggttcatgctggccctccctgaggccgcccatgccgacatcctgaccggcaggatcgccagccttgctcacccagtcgccatgattgcgctcttcgggtccagcgtgtacacagccgtcctggggttccaataccgccgcacgcgcgacctggcggcggagatcaaggacctgaaggcacaggcacccccgcctccaaagggggagggagaggaggcctcctcggccgtcgcgtcgccggagcagtccaggatcaaggagctggagcaggtgagggaggagtga

SEQ ID NO: 6820 - DNA, 297 bp, Chlorella protothecoides
atggacgtcaccactcgaggtcatctgcacactgcatgctgggtgcgccgccctgtcatttgcacaaagggacctgccgcgcaatccatgtggacccctggacctgatctggaggaccacgtgcacataacgttcccccccctccatcacaagaccaggccgttctcgcccttccctgggtgtgctgtgtgctgggacgagggtgacgagccccacaccctcatctgcgacgggtgcgacatcgagcggcacatgtactgcctacctgtcccgcttgaggaggtgccagaggtgtga

SEQ ID NO: 6821 - DNA, 1569 bp, Chlorella protothecoides
  modified_base (667)..(676): a, c, t, g, unknown or other
atgcgctcggcatctcgaccgggaaggtgtcaactgtccgctggacgccacctgacagcacagcagcctcgcagtcgcagtggtcgccgctcgatcctttgcttcccccgcttcactcagacaccagtgccccggctgacccctatcggggtcgaccgacactggaaccggtactggctgctgccccaggaagcttttgcagaggtgccgagcggaggcggcgccgccgtcctgggcgtcgaccgccccgcaccatctgacgcgagcgctcccgctgagcgctggactgcaggcatttatcccggcccggaggacctcgacaggctcctgcgatggctggacccgcgaggtgtgcgagagcgggctctggcggccgaggcgaggcgtcttcatgccgagtcgctagcttcacaggagcgggaggaagtgcgggaggctgaggcgcgcgcggcaccggcagaggcgcagcaagcgcaggacggggcagagcagggttttgacgccactgcgccacctgtcgcagatgtgatgcagcctggggaggatggcactgccttggctcctggggcggcacctgctcccgacgcggcacctgctcccgaggcggcacctgctcccgacgcggccacggccaccgacgccctcgagcccctgcgcagcgccgtgnnnnnnnnnnccactgccttggctcccgacgcggcacctgctcccgatgcggcgcctgctcccgaggcggcacctgctcccgaggcggccacggccacggacgccctcgagcccctgcgcagcgccgtgctggcgttgcaggagggctgggcggcggccacgctgcaggcctcggaggaggagctgatcgcgtggcgggagtctgtcgtcgtggcagcgcagccagtcgacctggcgcgcgccttgctgcgactggagggctgggtccggcccgagttcttcaaggtgcactggcgcttctgggcggccatcacgccgcacccccgcagcctgggtgagttgtgggaggggtgggcagggcgagggaacccacctggagccggccgcatgcttcccgacgacaccagctgctgtgtccggtcgcgccgatgcgatccccctacctgcccaccctcgacctccccatcttcagccaccccggccgccctctggatgcggtacgaggcgctcaagtcggcggtcaaactgcgcgtgacgctcaagctgcccggcaacgcaccgacggccgccggcgggacgacctcccgcccgccctcccgtggcagcggccggtatccgctgcgggagcgccgcgctgcggtaggtgccgccggctcgggccagaagaggccctggtgggacgccctggaggacggggagaccagcgactcgcccgccgcgagcgccgagcccgcagctgacgaccgcgcgtcccgcctggccaagcgccagcgcgcccaagaaagggaggcacaggctgaaagtgagcggggccggcgcatggtggagcggagcgcgggaggcaggagcctgcgctcgaagcccgccgacgaggtcgcccgcggcaggctgcgggaagggtga

SEQ ID NO: 6822 - DNA, 2958 bp, Chlorella protothecoides
  modified_base (47)..(56): a, c, t, g, unknown or other
  modified_base (209)..(218): a, c, t, g, unknown or other
atgggtggttggaggtgttcatgggagagtagagtcgcagatgggannnnnnnnnnccccccccccctgttcatccaagcggtggtggaccccttgtccaagcaggccgccatgctcaccccggtgtgttggagatcgaggttgggagtggtgccgatgagtcatccattgccctccccgccagttccgcgacgcctcctcctcgccannnnnnnnnntttgcagtatgagctgagtgggcgggggctgtgggagcgcttccccacggacgagctcaacaccgtcagggtcgggcggaacgactctgtccccccccccctgttcatccaagccgtggtggaccccctgtccaagcaggccgccatgctcaccccagtatgttggagatcgaggttaggagtggtgcctatgagtcatccatcgccctcctcgccagtgccgcgacgccttctcctcgcctggcccctgcctgcccacccttccccaccagcatcaccccccccccctttccccctttctccacaggtcctggcgtacctgcacgaggctctgggcgcggaggtcatgctgacgctcaaccccgaccgcggcctggctgacctcccggtcaagggcttcctgcgctatgtgctcccgcgcggcgatggtgccccgcccgcagcgcgcttcgacggcctgcccgccgaccagacgctgaccctgggcatggaggtgccggagccctggctcgtggagccggtggccaccgaccacgacctggacaacatccgcctggccgagctggggccaggtcagcgtctggctgccacctttgagctggaggccctgctggtcaccggcagcgccatagacctcggggcggccaggtcgggggacccgagccaagaggtgagacagggggggaggggcgttaaagggcttctttggtcttctaggggggctgggatcctgaacacagcggagaacacggcacctgctagggaaacagggacgtcaggggtcctaaaggcttcgagaggcccagcctgggggaggagcaggcacgtgcattggcacggcactgcgaaagccagcccatctcagcctcagcctgcaccactgggttcccagacttacaaggcgaaccccacctacaaatctccccgcaacacaacccaccatccacgtcaggtgcacccgcgaggcgtgaagctggagctgggcccggcgggcaaggtcccgctggtggacaccctggtcatgtccaacctgggctacttccagctcaaggcggcgccgggggagtggacgctgggcctggcgccgggcaggtcccgcgagctcttttccgtcgcgcgcgacgacgagctggaggccgaccatgggatggagggagcggcggcgccgaggaatcaaggcggcctcacctttgaactgccggtcacagtcgacagcctgatgggcggaactgctgcacgcgcggtagcgggcgcgtggcaaccttctcgcccgctcaggtcaccccccatcattccctcgtcatcaggtcaccacctgcgcctgttcctgaagaaggacccggcgcggttggatgaggacgtgctggcccccagcccgggcacagggccaaccgtaggtgcctggtccagcctcccggtctggggcggcaagaaggacgaggcccctgcccctgcgaaagaaggggaggatgcccgaatccacatcttcaccgtctcctcagggacaatccccgctgcgcagctcgtcagcctaccctgtcctcctcccaggtatgagcgcctgcagaagatcatgatcctctccgctgtcaaacgcacaagcgctcgcctgaagttctggttcatcaagaactacatgtcgccccaggtgcatgcagtaggcggaagtggggggtggtgtccactaatcgatgatgatgctattgtgatccccttccacccaccacagatgaaggctttcatcccggtcatggccaggcgatatgactttgactatgatttcattgccaggctcctgaccttcaagaccgcccatccctcaacccgccacccttgccacccctacaaacaggtttgtgacatacaagtggcctacctggctgcacaagcagagcgagaagcaacgcatcatttgggcgtacaagatcctgttcctggacgtcctcttcccgctgggcctcaagaaggtcatcttctgcgactccgaccaggtggtccgggccgacctggcccagctctgggcaaccgacctgcagggggcgccctacgcctacacccccttctgcgacaccaacaaggagatggagggcttccgcttctggaagcagggcttctggaaggaccacctccagagatcaatggggcgatgcatgcattcaaggtaaagtgttttgatgtcacgagagactctttggagggttggggtgcgattgacaacacgctggtctcttcggcccccacccccaaccccctccaccaaatcctcccagggcctgccctaccacatctcggccctgtacctggtggacctggatcgcttcaggacgctggcagccggggacaaactgcgcatcctgtacgagcggctgtccaaggaccccaactccctgtccaacctcgaccaggtgagagattgggctctttaaggagggaatggggggaaggtgcgcagggattcgtctccaagcctgtcgatcagggaccctcggcgggtagcccaccagactcctcgcgccatcccacctccctcagcccctgccatccctcccccttcccctccatgaccagaccccctctgttcacacacacccacacaaaacaccacaggacctgcccaactatgcccagagcatcgtgcccatccacagcctggaccaggagtggctgtggtgcgagacctggtgcggcgcggccagccgccccgcggcgcgcaccatcgacctgtgcaacaatccgctga

SEQ ID NO: 6823 - DNA, 657 bp, Chlorella protothecoides
gcgccgcgcggcgctgaggccgggccccggctgcgcctggcctccgggcgcgccgtcgcccggctgaacgacctggagtccgacgcgcgctatgcacgctggccagcgcgcctggagtcgctgctggtgccctccttctcggggcgcctgccgggcctgcggcgcaacctgctcaccgccgtcctgctgttcgatccggccagcgattcggccgccgacctgggcgaggccgcgcgcgtggtgctgctccagggctggcccctgcgcctgggcctggtgccgctcgtcagaaatggagccggggacgaagcgggggccagggtcgcgcgcctgttcctgggtgtgcacgccaccctggggcccgaccccgccctcgccttcctcgcaagcctggctggagtcgactttcagtccggcgacgaggcagccgcctggaagcaggtccagctcgcgttcaagagacactggccgaagtgggtggacaaggcctccgaggacgccgagcctcaccccgccctgcagtggaccgcagcgcaggcgctggaggcctatgtcgatcagcccgacgccgccacgctgcgcacgctgcgcgccggcgtggccctggcccgctccacgggcctcgccggtgaggagagggggcggggtcagagtttg

SEQ ID NO: 6824 - DNA, 735 bp, Chlorella protothecoides
atgtggtcacccgcgcgatgctgggcgtggccgggctcgcggtgtcccgaccgtgatggcctgaagccggctctacaccaaggcttccgacaccatccccgcctgggccaacccactgcctggatacgaacatacatccgctcgcaggtgcccgactccctggtggctcgacgacaggaggtggtgaacaagctgcgcaccctggagggacaggtgaagaccatcaccgacttcctgagcaatgccgacaatgtccggctgctcaagcaggacaagacgcagaaccaggccttcctgcagtccgagttcggcattggccccgaccaggtggacgcactgtaccacctggccaagtggaactttgagtgcggcaactacagcgcggccgcggagtacctgcaccactaccgcagcctatccactcacccagaccgctgcgtatcggcgctgtggggcaaggtggccgccgacatcctgctgcaggactttgaggcggccatggaggacctgctgaagctcaaagacctcctggatctggacacctttgcgcctgtggtcaagcagctgcagtcccgctcctggctcatgcactggtccctctttgtcttcttcaaccacgagaacggtatgaacgccctcatcgacctcttcctccaggacaggggtccatggacattcattacagccgtgggtccccgggcatggctgtgttgcccatgcactggcggcctttga

SEQ ID NO: 6825 - DNA, 840 bp, Chlorella protothecoides
atggagggcttccaccaggccagtgccccagacgaggaggtgcccagcccctacacactgctctgcatggcgctgtgcaacctcctctgcatcgacctgtttgatggtgccatggaagctctggaagagtcccggcccgaggtgagggaggccgactaccggcccagcgccaaggcccagcatcccctgcccgtgaccccggagagctggccggaagctgccgcccgcatcctgcgcatccacgccgcggcggcccgcgctgaccgcgggctcgcatcgagggccaagggaaccgcggagccgttggctgtactgggcccggacctgctgctggacctgctggtggcggggctggacgcggccaccgcccagcgggtgggcgggctgccgccacacgctggccctcagacggccgcctcgatccgcgccgcggccgacgccgccggccgagcagctgcgattgctggggacggcaagctggggccgggggtccgggccggtgagggctggcatggctccaccccgctgctccgcgcggcgctgctccggctgtgctcggggcggcacgccagggccttggcgtggcacggcgcaggagccgccgccgccaccagggcgccgcgggagctggacttggccggcgtgggacggcgtgtcgaggcgggggcgtacgctatggctgcgaatcccctagaagccctggccgtcgacgtggaagccgtggtggccctgcacgccggcctggcggggaagcaatcggaggcagctgtggcgctccagagtcagggtgggcgggggggatcgttgagattttggtgcctggcgcggattgaatggtga

SEQ ID NO: 6826 - DNA, 333 bp, Chlorella protothecoides
atgagcacctccatccaggatctggccgtagaggtgcgtgagcgggatgcgtgcgcaatacgtgtgccagggagaaccacgcacaacaagggcggcaagtttcgcgtcttggtcaccaagaacctccccggcgaggactggctcaaggtgctcacgtctgccggcgctcaagtggacatctgcactgccaagcagaccatcctcgacaacgccagcatcaccaagctcgtcggcaataagtgtgatggcgtgatcgggcagctgaccgaggtacggctgggaggcagcctgcgtctggcgcaagggtgtggtgccgcgatgccagggctgtga

SEQ ID NO: 6827 - DNA, 1383 bp, Chlorella protothecoides
  modified_base (304)..(313): a, c, t, g, unknown or other
  modified_base (542)..(551): a, c, t, g, unknown or other
  modified_base (827)..(836): a, c, t, g, unknown or other
  modified_base (1367)..(1376): a, c, t, g, unknown or other
atgggtctgggcacccgcgcaggtcaaggaggagacgagagaggagcaggcggagagggagcggcaggagcgggaggcagaggcccgcaccgagttcgagcagatacaagaggaccgccggcggctgcccatgttcccctacaggcatgtgtggggggtcgggctcacagaggcccaggtagcctcgagacgcagcgcacgagccgtgtgcagctcaccattcttgtctgtggcggttgttgcaccaccctgtgcctcattaatcagtggccacctgggtgcagggaggatctgctgaaggccnnnnnnnnnncgtgcctcattcaccagtggccgcctgggtgcagggaggatctgctgaaggccattgcggagcaccaggtgctcatcatcgtcggcgagacggggtcggggaagaccacgcagatcccgcagtacctatacgaggcagggtatggcaaggccggcaagatcggctgtacacaaccaagcgcaagcgtggcgcgcaccagtggaccttggttcttgagcatggtgatgcnnnnnnnnnncgggcctggagagggtttcttgagggggttgtgtgggaattcctgcacgccggctgtctcctggtgcgacgcagcgcaagcgtggcgcaccggtggaccttggttcttgagcatggtgatgcctgcccatgccagccagcggcaattgccgtggaagcgcttgggcagcaatgcctcctgggagaggccgctgcgcctctcatcatgctgctgcggggtggaactcgaacctctgaatctcattgtgccttgctcagtcctgccctcgcgaccctnnnnnnnnnngtcggtggcggcccgtgtggctgtggaagtcggcgtgaagctgggggccgaggtgggctactccatccgcttcgaggactgcacgagcgacaagaccgtgctcaacggcaatcgccgtggaagtgcttgggcagcaatgcctcctgggagaggccgctgcgtctttcattatgctgctgcggggtggaaccttgaacctctgaatctcattttgccttgctcagtcctgccctcgcgaccctgcagctgcatgatggtggatgaggcgcacgagcgcaccctccacaccgacgtcctctttgggctggtgaaggtacgccgggcagggtttttaaattatgtctgcagaattaggagcgcgatgcttggcagtgtgcggctagagtgtaacttagatgggcactctcaccaccacataatacgggcctctccagacgtccagcccctcagcatactcatccccgtcacatccggcgtggtcgcaggacattgcacgcttccggccggagctgaagctgctcatctcctctnnnnnnnnnntggctag

SEQ ID NO: 6828 - DNA, 456 bp, Chlorella protothecoides
atgcagtacgtgatagatcctggcttctgcaagcagaactcgtacaacccacggacagggatggagtcgctgcaggtcacccccatctccaaggcgtcggcgctgcaacgtgcaggtcctaaattcagccccccctctctacctcagggcgcgcggggcgcaccgcgccgggcaagtgcttccggctgtacacagcctgggcgtatcagcacgaactggaggactccacggtgccggagatccagaggactaatctggggaatgtggtactcatgctcaagtcgctgggcatcaacgacctcatcaactttgacttcatggacccgccgcccaccggtgggtggtgaacgggcgggggggcctctggcggcagccggggcagggggagggaggattgctcgaggctccagggtaacacccagcgctgtattaccccctgacgattgctggacgtag

SEQ ID NO: 6829 - DNA, 381 bp, Chlorella protothecoides
  modified_base (217)..(226): a, c, t, g, unknown or other
  modified_base (320)..(329): a, c, t, g, unknown or other
atgctgagggcgctggagcagctgtatgcgcttggcgcgctgaatgacaagggcgagctcaccaccatggtaaggggcagctttggcgataaaattgcttctggaacaacagcacccctctcacctggcagggcatgctgcatgctggggactagcgtacgtcaccttgcatccctctcgtttgttcccctctccatcccatggcaccctgtcgccnnnnnnnnnntgtgtggctggggtggttgtacatcggcggtgcatgctgcattgatgcctgcctgggtatgggaagcagatttggcagagcgcacaggattttnnnnnnnnnncaggggttgtgtggctggggtggttgtgcatcggcggtgcatgctgccttga

SEQ ID NO: 6830 - DNA, 402 bp, Chlorella protothecoides
atggcaccctgtcgccacgcaggccgcaagatggccgagttcccggtggaccccatgctggccaagatgatcatcaacagcgagaagcatggcgtgtcgggtgcgcaaggaggaatggagtcacgagcggccaggtgtcgcgtgcacatgcgggggttcccattgatttggatgccctgcgccagccccatactcatcgccgctgcctgctggcctctccccctgaacacagaggaggtggccaccatagctgccatggtgtccatcggcggctcggtcttttaccgccccaaggacaagcaggtgcacgccgacaatgcgcacaaggccttctacagaggcaacgtcggtgggtgtagggggtggatgatgtggaaaggggtcccttcagccacacattag

SEQ ID NO: 6831 - DNA, 450 bp, Chlorella protothecoides
atgtcgggagacaaggcgctgaggggctgggtggaggagaggctccatgcccttctcggcttcgctgagcgggcgttggtggactacgtggtgtccatcgctcgccgtgccaagcaccccgacgctctctgcacgacccttgaggctcaggggctgccggcttcccaggccacccgcagctttgcaatcgacctgctgtcgagatgcagcggcgcaggtaccagcggcgcatctgctgcggtctcggcgcagaggcaggcccacgcagaggccgtggcagccgcgcggcggaaccaggcctacagcctgatagtcgccgacgacgacgcgcccggggagcagccccgcaccgccccctcccctggtggccccctggagggcagggatgggggttcagatcgcgggagcaagagctccaagcggcgcagcacccgcaaggtgggctgctga

SEQ ID NO: 6832 - DNA, 273 bp, Chlorella protothecoides
atgtcgaggcaggagtacctgaagaagcgggaggaggccaagctccaggagctgaaggacgcgctggaggacgagaagttcctcttccagggcaagaagatgacagagaaggagcggcgggacctggcatacaaggaggaggtgtatcggctggccgtggagaggaagaagcagctgggtgaggcaggggggtttggcgtccattcatcatcaaaggatgggaggggatcatcagaggatgggaggggtttgggtggcttggaggtgccatga

SEQ ID NO: 6833 - DNA, 420 bp, Chlorella protothecoides
atgggcactctcaccaccatattgtacgggcctctccagacgtccagcccctcagcatactcatccccatcacatccggcatggtcacaggacattgcacgctttcggccggagctgaagctgctcatctcctctgccacgctcgacgccgagaaattctccgagtactttgacaatgcccccatctttcgaatcccgggccggcggtacccagtggacatcctgtacactaaggcccccgaggcagactacctgcacgcggcggcggtgaccacgctgcagatccacgtcacacagccgccgggggacgtcctcatcttcctgacggggcaggaggagattgaggcctgcgaggagctccttcgccaggtgggagcatgtgtccattttggtgaatcgggccttggtggttggccttga

SEQ ID NO: 6834 - DNA, 1533 bp, Chlorella protothecoides
atggcgcagctcccctgccgcgtgatcagctgcgtcccccgcgcccagcacacgccctacccctgggcgaccccgcccgacgcaaagcgccacgcgcgcgtgaccacgctcgccctctgggccgcggccgaggccctgctggacgcggggtggcgcccgcagagcgaggcggagcgcgacgccacgggcgtggccatcggcgtgggcatgagcttctccaccgacctggccgaggccggcgtgctcatgtgctgcacaccccgggtcacgttctccacagtcctggaccccctcctgagcgcaactcgggccccctccctcaaacagccccccccccctcttccaccgcagtcccagggcaggctgcggcggctgagcccccacttcgtgccccgcatcctcaccaactcccccgccggcgcggtgagcctggcccacggcctgcgcggccccaaccacgccgcctccaccgcctgcgccacgggcgcgcacgcgctgggcgacgcggcgcgcatggtcgcgctgggcgacgccgatgccatgctggcgggcggcgcggaggcctgcatcgacgcgggcccgcgacatcctgtttccccttccccatcacgcacccacgcccgccaccagggcggaggcgtggtccttggacagcaggatcctctgcacgcaggccagtgcctggcgctgcacggcctggtcggggtgcaccatgaggcgcatgaccagttccttgccacgcagctccgtgacgatgccacggccgtgcgggtaggcggccacgaagcgcgccacgtcgttgcagccgacggccagcgtggtggcgtcgcgcgacgactccaccagcttgagcaggacgcgcagcagctggccgttgccctcggccaggcgctccgcgttctgcgcccagaagtcgtcggcggtgtgcagcgggccccaggccagctggcccagcagcagctcgcgccggtagcgctcaaaggaggagagctcgcagacgccgcgctccagcgaggcgcccagcgccgccagcagctccggcacgtcgccgtcgaaggaaagcatgcacacgaacacacaaccccacaagcccccctcaccggtgttggccaagaggtcggccgcaggcttgtggaaggacagctgccaggttccgagcatggcctcgtacaggagctgggggttctggatcacgccgccggcaggcacgcgaaccagtgcgcccagcagccccgccgcgccggcgcgcgtggccagtggcctgacgccggggtcgcgcaggagcacgcccaggcagtgcgccgcggccggcacgcccagcagcgggtgggtggggcgccgcagctgcgcgcacagccagtccacaaaggcggtgagggcggaggcggccgggctggccgccgacacgtccagcgtctgtgccgcggcgctgggccgcagctggctggccaggatggcggtcagcaggcgcgccgctttctcctgcgtgaaccagtcggggcgctgcagcagcctggggtgggggtgggatga

SEQ ID NO: 6835 - DNA, 1098 bp, Chlorella protothecoides
  modified_base (658)..(667): a, c, t, g, unknown or other
  modified_base (836)..(845): a, c, t, g, unknown or other
atgtggacatgtgtcccgctgacaatcgagctcaggggagcaaatagcggtgtcctgcggtggggaaacgaaatctcggggcgaatcttaccccgtgcgacctcacagcaggcggaacctaccggcacccatggcccaacgatgatccgtacccccaaacatttcgtagagttatacaacacattatctctccttgtgcccgcttgtgagcccatcatggcgccgtctaattacaccgtcctctgctccaaggccctgacgcactctgacgtcaccacggagattgccaagtctgggcgcctcgtgctgcccagggcccaggtcgtgagctgtctgccacgcctgcttcacctggggggcgctgcgccagcctccgccaaggcccgcccgggcgggcccacccccgcgatacccctgtttatgtatgacatgaccggcaagatgtggcgtttccagatgaagacctggcacaatgtggtggcctgcggtggccgagctacttacgttcttgaaaacaccggtgaggggcctgggatagatagcatgccccgtgcaggtggtgtggtgccaccttcacagtgtggggatgcatgctgttgttggaatctcgacttgcgtcctttcgtcgggctgtggtgcatgagcgccctggccgccnnnnnnnnnnataatctcgatttgcgtcctttcgttgggctgtggtgcatgagcgccctggccgcctgcccctggatcgaggtactgcaccactgccggggccatccagatgttgtcagacacttgagacctcccgtcccacaatcctacgcaaatctccagcacccctctccccctcnnnnnnnnnntctggatcgaggtactgcaccactgccgggcccatttcagatgttgtcagacacttgcgacctcccgtcccacaatctcacgcaaatctccagcacccctctccccctctccccacgccatcctccagccggctttgtccaggagtttgggctgcagcctggggcctggctggccatctgcgagcaggaggggcggctggtgctgcgcaccgaccttggcggcgtgcgcacctcggcccgcgcgccgcccgcg

SEQ ID NO: 6836 - DNA, 2877 bp, Chlorella protothecoides
  modified_base (461)..(470): a, c, t, g, unknown or other
  modified_base (1477)..(1486): a, c, t, g, unknown or other
atgaggagaggggtgcctgggagtttgcgactggaggcggaaaccttggatcagtgccccgcggcatgcgtccagatccaggctcctggttcgcagaggcggcaagtgatgccgggcaagacggttgccacttcacacccccttcctccccctcccgaggctcgcaagccagcccacgcggaaaccttgatcagtgccccgcggcatgcgtttagatccaggctcctagttcgcacagaggcggcaagtgatgccgggcaagacggtcgccacttcaatacccccttcctccccctcccgaagctctcaagccagcccatgtatgttacctgcttgcaggcggaccagcatgtcttgggcggtggcggacttggagtcggtgaccttggccacgagctgcgtcatcgcgtcagggcaggctgcgcatgcgattgccctgacagagaaccccagcatgctgnnnnnnnnnnggggccacaaaggactggcaggtcagggcaggctgcgcatgccattgccctgacagagaaccccagcatgctgctatttcccccttccacaatcccccatcaccgcaccgaagctggcgtcccagttgtcatcggtgcagccggtggactcctgaaaggtgcgcaggcaggcggtgaggtggcccgggcgcgacaggtccacgatgaagtggccgcgggacacgccgctggccctcacggactcgttgtgctgagcataagccttctgcatgctcagccggatggtggtcttgccgcttccccgcctcccgaagaagatgtaggtggtctctgcacgcagggcatgggaaatggctcgcactggggtcggggtgaagccatgcaggtcggagtggacgtacagggacaccgggtccagggaggtcttctcggcggtgcgatccacaaacggattgcgtgcgagcccaaactggcgcaggaggtcggtgtgattgccctgggccatcctgacggactcaagtgcctgatcgcttcagcgcatgtgccgggacccccaacgtcgtccgagaggctatgccgacaatgcagcctgggcctgtcgagctctgacatccgggttacaacagccgctgtgctcgagttgcatgaagtaaggcgttgttactcctccgtgaatacacagcagagtgcgggggagccggctcctgtctatgctccattgcgggacctgctggtcgagtgctataggaggccgggataccgaggccagggcgccatgagcgaacagagcgccctggctcccgtggcgaacactgttgtagagattctttcagacacagattcagaagacgacgcgctgaggatacgggtgagtggcaggcccagagcggaggttgggtttctttgccgggcatgcacacgcctggtcctgattcgtggctgccctacctgccccacacagcagagaagggtgccaggagagttctctgggaggtcccacggcgttnnnnnnnnnncagtcctgattcgtggctgccctacctgcctcacacagcagagaagggcatccggagagttctctgggaggtcccacggcgtttcggtgccaagcacggtgtcccctccgctgcggattcgtcgagtggtccctccccggccctctgtccatgaggtggccctcgacgggtcgcctcccgcgtcccaggaggacctagtggtcctctcctccactgtagtccccgtgcagcgccccgccttcaaacgccgacgagaggggtctggctgggggcccctgaagctgccggctgtgccaagggccaaggcggctccacctgaactccagcaggcagtgctcgatcccgtgcagcccgggcccaaggcaaaggcggctccacctgaactccagcaggcaatgctcgaccccgtgcagcctgggcccaagtgcggcatctgcatggagcccatgggagggagcactgggagaagtatggccagtggaccttgcggaggctgctctgacaaggggtggaactgggaaccgcagagaggggtcgctgtgaaagtcagtctagcatgcggccttccttcatgcacgcctgataccaagcatggtcaccaccaccccactccaccacaggcatgtatactgctcagcgtgtctgatgagtgccatcaaaacacagaaacggtgcccgacctgtcgaaaaggcctcaacccacgccaaatacacaaagtatttgtgcagttctaggagttgcgtcgccactacagacttgggagcgcggggagatgtctctgcctctgtcaagaactgatactcccaataggtttcgagctctcgagctggtacgtgttcaccaggacgaacctgttacaccacaggagagtgcatggcatgatgcatgcccaatccagtccagcaagacattgagggggaaccgctcagatgcccagcttggtgcggcgccagtgcctccgcttggcgttgtacctaagcgcgaaacggggaaggagaggggttatagaccagacctcgggccagcgggaaataactccttcacccggtgggtggtgcccgggcctacgtccccggctaccaggctggcaacgactcctcctcagcccatactccgcagctcccttgtatttagtttcctgcttaggatgcagcactcaccggatcttgttgtcggtcttgaagcggaaccacggcgcaatgggcctgttctgcttggccttcttggccagcttcttcttgatggcgaacgacttctgggacggctgcaaaaagggaagttaaagagcgttttgagccaatcactggatgctctaagcgcagtcagggcctccagcagggtcccgaccacgccaggccctccttcgaggccgcacggtgcgccaagctaa

SEQ ID NO: 6837 - DNA, 1353 bp, Chlorella protothecoides
  modified_base (292)..(301): a, c, t, g, unknown or other
  modified_base (565)..(574): a, c, t, g, unknown or other
  modified_base (1308)..(1317): a, c, t, g, unknown or other
atggagcggtgggtcggggctgctcgcccggtgtttatggggaatcagctcggtggtgaccctgttcctgcgcaccgtcaccttcttcaaccccctggacaagatgctgaaggacctggtcttgctccccacccgcctgctattcaagtccaatgtcgaggaggaggtgcgaggggtgctgcagcatgtcgttggaattggggcttggttgaaggggtgaattcctccctcgcccgcctgctcctagcagctagcacctcaagcctgtggcgcgggttcttggcacctgatnnnnnnnnnncggctccccacccgcctgctgttccagtccaatgccgaggaggaggtgcgagggttgctgcagcatgtcattggaattggggcttggtggaaggggtggcttcctccctcgcccgcctgctcctaccagctagcacctcgagcctgtggcgcgggttcttggcacctgatggccttgtgccgatgacgtcctacattcccctgaggcctacgtctcagcttcccctgtcgtgccccctccgccacgcagtcgccagcgccctcnnnnnnnnnnttgcgtctcagctttcccctggcgtgcccctccgccacgcagtcgccagcgccctccgcagtcaagctggtgaacgcggggcgggagggccccggcccctcaggaccagccgtccttctcctgggcgccgacagcgacctgggcgcccgcctggccacgaccctgctggaccacggcaggcgtgtccagatcctggaacctgccgccgcccccgccctggtatgtgctggggagcgctggatccggggcagtggtttccacccccccccaaacaaccatccacccaggcctcgcactccgcctccggccccggcaccgttgagctggtggaaaacgggaacggcctgcagcctgggcagctcgcggacgtgcgcttcgtggttgccgtccccggacagggcgccgagcgccagctgcgcgccgcgctctccgcgctgagcggcggcgacgtgacgctgtatgacgcggctgcgggagcccagggcgagcccacctggggctcgctggacgacgtggtcatgggcggcgccagccgcagcgcctggagctgggaggatgctgggggcgagggcggagaccgccccgccggcgtgttctccggcgaggtcaccaccgccaacagcggcggctttgcctcggtgagaatgataaatatgaggggaaggaggtatcctgagcaagagggtggggtgaaatgggttgcatgtgttgatgagccgaggagcgggctgcannnnnnnnnnaagaatgataaatatgggggccaggaggtatcctga

SEQ ID NO: 6838 - DNA, 1470 bp, Chlorella protothecoides
  modified_base (1414)..(1423): a, c, t, g, unknown or other
atgcgacctttcgtctggagcctacacatgattacagcaggcaccaaggtgctgcttcccatcttgacgggcccgtgggagggtgattactgccctggtcttcaacaggacctcgtatttccctgccgacggccagggaccagctcttgctggccagcccagcttcgaacacccatctatccctccacttgccaccctgcccctcaccaccacccccaacacaggaacctggcgagcctgtttggcgcggaccgcgggagcgggggcgcccccgccccccgaccgctcgccggccgcgcctgcgccggcgccagcctggacgaccagttcgacctgcgccagctggcggtgtgcgtgcgcatccgcccccccatcaccgccggcgcgccgcgctgggacagcgagaattgcatccacgccacctcgcgccacggcctggcaatcgcgccgccgcccggctcagcggcctacgcagcgggcgaccgcggccagacctacgcgttctccgccgtgtttgacgagcacaccagccaggccgactactacgcggccaccaccgacgcactggtgcgtgactgcctctccgaccccgcccactccagcctgatcatggcctacggcatcaccgccgcggggaagaccttcacgctggagggcagccgccgcgcccccggcctggtcccgcgcgcgctggaggcgctgttcgcggggcgggacgcgcgcggcgccgcgctgcgcgtcgtgctctcctactttgagatctacaacgagaccatccacgacctgctggatgaggcgggggcggcggcgccgggcgcccggcccagcctgcgcctgaaggaggacgccgaggggcgggtgttcgtggcggggctgtcccaggccgaggcggccagcgcggagcacgcgctgtgccttctgcgcaggggcgcgcggcagcgcgcgcgcgccgagacggggctcaactacgcctcctcccgctcccactccgtcttccaggtggggaagaccttggcttatgagtggaggtggtgtggggacgaggtagggagtgactccgggagtgtgcggaacaagaggtgcatcttatgtgcaggcgaagcacatgagcaccagataagaccttgtgaccctaacaaactctgtcctccgccatgcacagatcacgctgtacccgcctgcgcggctgggggagccggccaggaacgaccccggcgagcggctggggaccatgtcctttgtcgacctggccggctcggagcgcgcgcagcgcaccggcaacgtcgggctgcgcctcaagtgggtggcgggtggggaggccgggtttgtggagagagatggaaaccccataggcggaggtggttgttcccccaggcgccagcgctcatgtcgattgccttccaccaccctcgcnnnnnnnnnnggctcgcggaacaagaggtgcaccttttgtgcaggcgaagcacttga

SEQ ID NO: 6839 - DNA, 639 bp, Chlorella protothecoides
  modified_base (352)..(361): a, c, t, g, unknown or other
atggagttcgaggtcagggcggaggtggccgcggagatgggggcgctgatggaggagatggagcgcaactactctgcccgcctggccgccgaggccgggcgcggcgccgaggcggggccccgcggcggtgacgccggcgcggggctgtctgcgcagctggccgacgcacgcagcacggcggcgggcctccgcgccgagctggcagaggcatgcgctgcgctggaagagactcgccccgagctggcagaggcgcgcgccgagctcgaagcacgagaaatggagctggaggggtgccgggcagagctccatgacgcgcgagatcagctctcgcagaaggcggagcagctgtcgnnnnnnnnnngcgagaaaaggagctggaggggtgccgggcagagcttcgtgacgcgcgagaccagctctcgcagaaggcggagcagctgtcgagtgcagaggcggcgctggcctccgagcgttctcgttttcgagcagagctggtcgccgcggaagcaagcctcggggcggtccaagccgagctggctgaggaaagcgccgcccgggaggcactgcggcgccagctggcagaagaaagcgccgcccaggagcggcgccggcaggaagagctggagcaggccggggtga

SEQ ID NO: 6840 - DNA, 459 bp, Chlorella protothecoides
atggcccagggcaatcacaccgacctcctgcgccagtttgggctcgcacgcaatccgtttgtggatcgcaccgccgagaagacctccctggacccggtgtccctgtacgtccactccgacctgcatggcttcaccccctctgagaccacctacatcttcttcgggaggcggggaagcggcaagaccaccatccggctgagcatgcagaaggcttatgctcagcacaacgagtccgtgagggccagcggcgtgtcccgcggccacttcatcgtggacctgtcgcgcccgggccacctcaccgcctgcctgcgcacctttcaggagtccaccggctgcaccgatgacaactgggacgccagcttcggtgcgctcgtggccaaggtcaccgactccaagtccgccaccgcccaagacatgctggtccgcctgcaagcaggtaacatacatgggctggcttga

SEQ ID NO: 6841 - DNA, 270 bp, Chlorella protothecoides
atgaccctgggccgctgcctggaggccctgcgctggaaccagcagcaccgggagggccccctgcgtgtactgccataccgcgagagcaaggtcacccacctcttccgcgacgcgctgcacggctgggggcaggtggtcctgtccgtgaacgtctctccctgcgccaaggactacgacgagaccacccacgtcctgcgggtgcgtgttgagggttgcggtgtggcccggggaagagcacagtggctggggggaaggggtatgggggggtag

SEQ ID NO: 6842 - DNA, 213 bp, Chlorella protothecoides
atgctcatccccaagctcccctttgcccgtctgacaagggagatctccaatgagatgagccccgagccgttccgatggacggctgaggcgctcctcgcgctccaagaagcatccgaggacttcatcgtgcatctcctggaggacaccaacctctgtgccatccatgcgaagcgtgtcacgatcagtgagttgtggggacccaacgatgtgtga

SEQ ID NO: 6843 - DNA, 1221 bp, Chlorella protothecoides
atggccgaggcgccctgcgcctcaggccccactgcccagctcgcagcctcgccgcatgacgccgtgagatggaagatcacatgcatgtaccgccaactggaaagggttcctagcattctcgaacgcctgacttccctcgggcagggtcagctcagtgccgaggtccaggagtgggtggtgggcgccctgatgcgggacccctaccatgcctcccacgtcatcgacgtcgactaccacaggcggttgtgcaaggccttgtttgcggcggcagagcgctccgacgacggtgtgacagatgcgctggcggacgaatttgaaaaacggcagtgcgcggcccagcagagccgctccggctggtgccagaaggtctggacctacggcgtcacggggcccgtgccgggccacctcggcacaacagcctcagacggggcgagcggctgcatcgcccttggcctgtctcacgacatgctggcaggcagcacggggtgccacgagtgggaggcgggcttctggctggcagagtacgtgctgagcaacctggccgcctttgcaggtgggcgcaggaagcactgcgtggagctggggtgtggtgcgggcgtggtgggcgtggcactggcccgcgttggcgcggcgtcggtgctgtgcaccgacggctcgcccgaggcggtggccaactgcgacgccaacctgcgcctcaacggggtcggcgcaggtgacaacgtgcgcacggcgctgctgcgctgggaggacgacccggcgggcggccccatgccggactgcatcctcggcgccgacctgctctatgacccccgcgctgtggcgcccctcctgcacgcagtgacgtggctgctgcaaaacacagcaagccatggaggaaagggcgaacgccgcgcccccgccgccgcgctgatcgccaccgtggaacgcaacccggacaccctggcgctgttcgagcgggaggcggagcgccatgctttcttacaagcgaggcgggtcgccgtgccgagggtgcaggccgtgtcctggcacgagttcgaggccctggaggcggcgcggccgcgcctgttgctccatgagctggcgctgagggccccggggggccagagtccagactgcaggacagatccgtctgcatgtctgcgtgacttcacagcactgacttttaccacaaagggtcagcgcgatccttctgtctgtaatgacccacagctttgtgactga

SEQ ID NO: 6844 - DNA, 546 bp, Chlorella protothecoides
atggatacgtttaactatattgtgccggtgtatgtgcgcctggctgcgcccttccctgctcgccatctgtgtacggcccttggctggcagagtaaccggtgcggcgcatgctgcagtcaatccgatacacatgcgctgggcacgtacccccagatgggattcacatgtgcctctgcgtcgctgtttgggcaacactctgccggcatgagccctgtaatgatgcattcttcgtgcagggcgaccgctatgccaccggcttgcgctggagccggaaggcccctgcaccaccacacggccccattgcccacccacgccgcggttcatcggctaccatgcggcatggcgccgcagggaggtccccacggccacccctcgtgggtcacgtctgcctccccattccgggcagaagatcagagcattgatctagattctcgcatcgcctccggggagttttctgacacaggctccaccaaggagcgcctcacccggcccctgcgcaaagcccttgccaaggaccccataggcccaggtgaggggattatgtga

SEQ ID NO: 6845 - DNA, 657 bp, Chlorella protothecoides
  modified_base (503)..(512): a, c, t, g, unknown or other
atgacggagttcctccggcgaggcgcgccgggaatgaagggcgtcactgctgacgccgagtacaccatgctcacaccgactcccctccctccctcaccgcagtccgtgaaggacatgcccatagtgcaggacggacccccaccaggtggtttcccggcggtgcggtatgcacgaaggcttccaaactccggacctgccggctttaccctgtttggtgtgggagctgctgtcatggcatatggcttctaccaggtgggacagggcaacatcaagcgccgggatgagaagcgggagaagctggattcccgcagagctctggtaccgttcctgcaggcagaggaggacaggaggtgggtggctgccaacgaggagttcctgaagaagcagaaggagataatgaagaatgtgagttcaggaacattgttatcagtgcatgacgcgcctctccatgcagttctgaatatcccctgctatcgtgctgctcaccctctgattgtcttcannnnnnnnnnagaagaagcagaaggagatcatgaagaatcaccccgagtacaaggcagaggagagcgtgtacaagacgcgctgggtggcacccgcccagaaggtgggcttctggggcgaggcatgagccggcccaagctgctcaggtggacgtag

SEQ ID NO: 6846 - DNA, 1128 bp, Chlorella protothecoides
  modified_base (506)..(515): a, c, t, g, unknown or other
atggggtctgggcagatagtcacccctgtccggtatccaatccccgcccacctgcgcagcggaggacccgggccacccgctgcaccgcgaggtgcacattccttctttctacctgacgggaggcatggacgaggtgtgccggccccaccacgccccctgcccctggctggccgaaaccaggcccgccacccaggacctcatgggcgcactgcaggtggggcctgcttgtggttgtgcagggggcagactccaattgccatacgtcgacagtcagcagggtcggcccaaaccttgcactacaatcctcccgagccctgccctccagggggtggccaacgctgcggtggaggacctggagcggccagaccttcagttcaggctgagcccccatgcgctgcatgccctgggcctcatcctggaggaggcggccctggaagagctggggagcaggcttcggacatgaacagggatgtttaccgtgcagagcgcgcgcgccccatcgctgnnnnnnnnnnatggcccactagacgggatgttgaccgtgcagagcgcgcgcgccccatcgctgctcgttatatagtgcgtcgtgacgccgcgccggtagacggctcccaccgaccttgccgcgcaacccagggcgggccgggagggcagaccatggcgatcgggccactctccaacctagaacgtgatttcatccagaatgccatcgccgcgggcgtgcgtgaggacgggcgtggcccctacgactcccgcaccccctccttctcctttttccccgacgactcggggtgcgtggtggcgctgggggacaccctggtctccgccggggtctccgccacgctgcgcccgcccttccccgaccgccccaacgagggctccctgcgcgtctccgcgcgcctgaccccgctggccgccccggggtccgaccccggcgcgcgctcggccccggaggccgaggagctggcgctggcgctggagcgcggcctgcgcgacggccgcgccgtggacctggaggcgctcaccgtcctccccggtcgcaaggtctggcacctggacctggcgctgacggtgctgggcgcgggcggcggccttctggacgccgcggggctggccgcgctggcggcg

SEQ ID NO: 6847 - DNA, 1044 bp, Chlorella protothecoides
atgggtcaaggcctcatcccggcagacggtgaggtgtggaagatccgccggcgggccatcgtcccagccctgcacagacagtacctgaactccatgctcaacatgtttggcgagtgcagcctgcacggcgctgcggtgctcagcaaggcagccgaggaaggcacaatggtggagtttgagaacttcttctcccgcctggccctggacatcatcggcaaggccgtgttcaactacgacttcgactccctcacccacgatgaccccgtgatcaaggccgtctacctcaccctgcgcgaggcggagtaccgctccaccttccccatcccctactggaacagcgccctgctccgccagctggtgccacgtcagcgtgaggtgcagtcggcgctccagctcatcaacaggaagctgggggagctgatcgagaacagcaggagcctggcgttcgaggaggagttcctgtcgcgctccgacccctccatcctccacttcctgatcgcggcgggggatgacgtgaccagcaagcagctgcgggacgacctgatgaccatgctgattgcggggcacgagaccactgcggccgtgctgacctggacgctgcactgcctggccacccacccggaggccatggcccgcctccagcgcgaagtggacgaggtcctgggcgaccgcctgccggccctggccgactaccaggctctgcgctacacgacacgcgtgatcaacgaggcaatgcgcctgtacccgcagccccccgtactcatccgccgcgcactgggggacgacacgctgcagggcttccgcctgcccaagggctctgacatcttcatctccgtctggaatctgcaccgctcccccgcgcactgggacaggcccgaggcctttgaccccgaccgcttcgacctggcggggcccacgcccaatgagatcaccaccgggttcgcctacctgccctttggcgggggccgccgcaagtgcataggtgagggacggtggacgagtggagggtttcttttgtgtgtgtgtgttctgtggggagtatga

SEQ ID NO: 6848 - DNA, 216 bp, Chlorella protothecoides
atggagtcagtggtcgccctggccgtgctggcgcggcgcttcgacgtggcggtcccgcccgacgcgccagaggtgggcatgaccacgggggccaccatccacaccgccaacggcctgtggctgaacgtgcggccccggagcctggcccgccaggagaccagcgtaggggagggggaggtggcgggcctggacacatccatgctggtgggaaaatga

SEQ ID NO: 6849 - DNA, 1089 bp, Chlorella protothecoides
atgaccagtgacgtgagcagcctcccgctgtgccccactctgcgctccaagctctcggctgcgggttttaccagtgctgcagctgtagctcaggctgacccagcgaggctggcagcagtgacgctggaggatgcccagagggcacagcatgcggcagatgccaggactcgcagcggcctggccggcgccctgtcagccaaggccctgtatgaccgcgagcggcgctcccagcgcatcatcaccttctgcgcggggctggacagcatcctggggggtggcgtgggtctacagcagatcacggaggtctgcggcgggcctgggctgggcaagacgcagctggggatgcagctggccctggacgtccaaatccccgactgcttcggggggctgggcggggaagcgctgtacgtcgacgccgagggcggcctgaccctggagcgcctgacgcagatggccgacgcgctggcggcccacctgcgccgcgtcgccgcggcgcgcggcgacgcgcgtcgcgcccaggcggccgccgccctcactcgtgagcgcatgttcgacgcggtgcacctctaccgcgaccacgctgacctggcggcgcggacgcgccagctggcgcagctgggccagagcctgatggaggtagccgtcgcgcacgatgtcgcggtgcggcaagggaggttggcggccaagtcgtgggaggatctcgcaggtcaaaagcgctgcggcctccatggcaggcctgacctccattctcctggaggctgtgctgtcccaccacaccgctgccactccccccccataaaaaatgcgcaggtggtgctcaccaaccatgtcaccacgcggccgggggaggacgggggggtgccgccccgcctgattccggtgcttggggacacctgggcgcacgtcgccacctcgcggctcatgctgtactgggaggcgggggcgcgccgcgccttcctgtacaaatccccctcccagccccccgcatcctgcgagtacctggtcacgggcgaggggatccggggcaggaggcagcctgccaagcggggccccgagggcgagtgccgtggggaggcggcgaagaagtga

SEQ ID NO: 6850 - DNA, 1008 bp, Chlorella protothecoides
atgcgcttcgagcgccgggcggtgggccccaaggacgtggccttcgcaatcacccactgcggcgtctgccactccgacctgcaccagatcaagaacgactggggcgggtccaccttccccatggtccccggccacgaactggtgggcatcgtgactgaggtgggtgccgaggtgaccaaggtcaaggtcggcgaccgcgcggcagtgggctgcatggtggactcctgccgctcctgcgacgcctgccagcaggacctggagcagttctgcgacaacgtcacctggacttacaactccacgggcaaggatgggcgcgccacccagggcggctactccacccacactgtgacggacgagaagttcatcgtcaagttcccagacaccctggacctggccgcaggggcgcccctgctctgcgctgggatcaccacctactcccccctgcgccactggggcctggacaagcccggcaccaagctgggtgtggtgggcctgggcggcctgggccacatggcagtcaagtttggcaaggcctttggcgcggaggtcaccgtcatctccacctctcccgccaaggagaaggaggcgctggaggagtttggcgccgaccactttgtggtgagcagcagcgaggaggacatgaagaggcacgccaccacgctggacggcatcatcgacaccgtgtcggccaagcacgacctgaaccagtacctgagcctgctcaagctcaacggcgcgctggtcatggtgggcctgcccaacatgcccctgcccatcgccgccggcagcctgatcttcaagcgcaggaccctggggggcagcgccatcggctccatcaaggagacccaggtgggatgtgcagggggcgggggggggggagggatgggatcatggacgctgcttcctgccatggaatctgattcgaacatgcagtggagggggatggtggccaaagccttgcgcctggttccaacggatgccacgccccctcgtgcaggaaatgattga

SEQ ID NO: 6851 - DNA, 1179 bp, Chlorella protothecoides
atggaacaagcactgaagtacacgagcattggacgggcgggagctataagacgagaaatgcaagcgcatcgccatggcgcctgggtcggtggatatcaacgtgctgcccggcaaggaggccggcctgttccgccagctggtgaagcagtacgaggtggggccggtggatggttgatgaataatatgcctaaattgtttgatctgcatatcagcccgggagggatgaggctccacaccgagcaggcgcctgacggcgatgacgccgctgccccgaggtactcgatgatggaacgcacagcggcacctcgctggcaaaatccgacgtacatcaagaggtccttgcgccgagaccaagcatctcttggcctgatttcaatcaccccctccgtcgtctctgcagaccaagcagtacaagaaggggctgaagacggcagacgccatcctcaagcgcttttccgagcatggggagacgctggccatgaaagggctgctccagaattgcctgggacacaaggaggttgccatggacctcgtcaaacggggcgtgaagaacaacctgaggagccacgtgtgctggcatgtctttgggaccactcccagcacctgaacaagcacatccctcccctccccacacccagcctcatccagcaatcggatgagaactttgacgaggccatgaagtgctacaagaacgccctgcgcatcgaccgcgagaatctgaccatcctcagggacctggcggtgctgcaggtgcccagagagttggcggggggggctggggtgctgtggggcaggctctgcaggttgcagcaacggtcagcggtgcggcctgggtgtggctgcagcacctcatctgtccctatgacgctcaaccggcgattgggacgtccagtttgcactctcgttctgctcctcttcgtgatgggcatgcctcccaaaggcgctcaaccgctccataccccatcccctcccaaacatgatcgccccttcgcagatccagatgcgcgacctacccggcttcctggagacgcgccagacgctgctggagctcaaggccaccaaccgacagaattggctggcctttgccgtggcgcaccacctgaacggcaaccacgatgtggcagtcaaggtgctggacagctatggggccaccatggacgaggaagccgcggcgcatga

SEQ ID NO: 6852 - DNA, 447 bp, Chlorella protothecoides
atgtcgggacggtggcgtggcacctcagatggtcgtgaggccctcgagcgcctgcaggaagatacacccgtgccgccacgcctcaccccgcgcgctcaactccaccccccttccctgcctcacagggaccccgacccggacggcgtgcagctggccgccgcggcagaccccctgggggaggccgcggccttggtgcagcgcctaacgcagtgcgcgggcgaccggctgcagacgcaggcgctggcagcggaggtgcagcttctgcgcggccgcctgctcctggcgctgcaggccgtgcagcgtgctgagcgtctggccgggcccggcgacgcgagcgtgcacctgctggtgctgcgcctggcgctggcgcaggaggcgcaggcggcggcagggccggcggcgggggagggcgccgaggcgcacgtggcggagctgctgcgggagggc

SEQ ID NO: 6853 - DNA, 354 bp, Chlorella protothecoides
atgggggtgctcatccgaggcaagctcctgcctgacctaccccaaccctcacctgtgcggtccccacctcgtgccagggagctgctgggaatcaacccggagaaccaccagtaccatgctgggttgcggacggcgctgggtctcgacacccctgatgtccagctcaccgcggagcagcggcagaggctgtctgacatctacgcccgcctgcagcgcaagttcccaaagagcactgcagccaagcgcatccccctcgacttcctggtgggtgccatggactggctgttccgttgtgctcttgggcaagggccgtatgtcgtttcccttttaggggagttggttgtgtttgaatag

SEQ ID NO: 6854 - DNA, 795 bp, Chlorella protothecoides
atggaaactccacccatcattttcgcaccacccccttcccccatcccttcactcacagacctgcggccgctgcttgccgaccctgcaaagtctgcagccctggatgcgctgtttgaggggctggaggcatcgctggtcgaagggcggggcctcccgccgctggagactgcatccccagcctctgccacggctccctccaccaccggacccccctcccccgaggacaaccccctggtgtgggtgcgcctattccgggcacaggtggcgaacttggcggggcgcagccgcgaggcgctggcggcggtggacgcctgcctggccgactgcccgggcctgccagacgcgctgaccgtgcgggcgggggttctggggcgcgccggcgacctggcgggcgcggccgaggccgccgacgcagcgcgtcgcgccgacctggctgaccgctttgtcaactgcgcggcggtggccgccatgtttgccgcggggcgctgcgccgacgcggaggagaccgcggcgctgttcacgcgggagggcgagcacaccaacaacctgtacgacatgcaggcgacgtggtacgaggtggcggcgggccgggcctacctggcccgcggtgaccacggcaaggccctgaagcggttcctgaaggtggtgtcccacttcaaggagttccgggacgaccagtttgacttccacaactactgcctgcgcaagcacgtacgtgtgggccttgggaacgggggggccggcatgctctgggagcgagcctgtgtgccatctggaagcatgccaggggtgtga

SEQ ID NO: 6855 - DNA, 699 bp, Chlorella protothecoides
atgtctctcccgacttccagcctcgatcgagatcaggcagggagggagacaggggccacctctccctctcccggccctgtggacgtccccgtcctgcgcgccccgccggggaaaaccctgctcccccaggatgccttcccgaacggcctgccccccgcattgccccgtgccgcgctccaggtgcaccccctgcccctgcagcgcaaggcgcggcacccccccggcccctccacctgcagcgccgctacgagcacctccaactccctgagcgggggcgggagcagcctgggcctggggcggggccccctgtccagcagcgagtcgccctgcgcgccaggggtgtcctcccccgtgtccaccgccgacatccagctggtccagaacctgatcgaacgctgcctgcaggtctacctggcgcagggcgaggtggtgaagatcctgtcggcgcaggccaccatagagccgggctttacgcagctggtgtggcagaagctggaggaacagaaccccgacttcttcgccgcctacaacctgcgcctgaagctcaaaggccagatcatcatgttcaaccacctgctggagcagcaggtccaagtggtgcagattaggacagatcgactgcaagaggacagcgggggacccctgtgcggtgcatatgtgcaggcaaaggcaggcggttggcgccttgtggctgtctga

SEQ ID NO: 6856 - DNA, 957 bp, Chlorella protothecoides
atggaggcaccgcctggctgccagtcccccaggctggtatgcctccctgcgctgcttccccctcccctggcagcctctctgtgcaagggcttgtcgcctgcgagcccctactgggctgcgcatggaggcaggggtatgcctttttcctcccacctcttcccgatcccacggcacggtcccgatgaggccgcgatgtatggccatccgctggaggagactgtctcggccctggcccggtgcatagcctcatcccctcacccgttggcgggggcactgcagcaggccacgcatgcagaggtttgggcccactgcagggcgagcgacgaggctcaccagctccattatgatgtcgatctcggggcgtggccttgtcacaaggcggccgctgtagacccgcaccaccctccccatccctgcccgcccgcagatgagcggtggctggggcacggcaagagcgagtatcgcgtgcagcatccgctgctgagcagcgtcctgttcctggcgggggagggggccggtgcgacgctggtgctggaggagtggctggggaaacccgcagcagcgacgcgagcgtggctggtgcctccctttccaggctccctactcctctttgagggcaggctgctgcacggcgtcctcccaaaaccaggtcggtcaggtggctggcatgcagaggggacaggggtgtggcctgtgggctcgaacatcgaccgcttgtctctccctgccactctacacgggatcagcgtgccgaaaggatacgatgccccagatttggtgcctgacagccacaggaacgattctgctcatgcacgcagggagagggtcctcgcatgtcgagccacgcatcaccctcatggtggcatggtggggcgaggaggtggtggggcatcgggccaggcagagggacgcatcagcccctggaccaatgatgacgcctccctggaggcttcctga

SEQ ID NO: 6857 - DNA, 834 bp, Chlorella protothecoides
atgcgcgtcgcgctctccacgctggcggtgtcgctgaactacgagggcgccggcgcgcgcatgctgtccactgccgccgtggaaggcttctgcttcggcctggacgtcgacgcgcgcggcgtgctgagcctgacctcccgcctgggcaatgcggaggtgctcgacggcacgctgccggacccgcacccctaccgccgtgcctgcggcctgcgcggcgacggcaccgcctcgctggtggacgtggagttcaagatgtacccggcgggcgcacgcgccgacccgcgcgtgccccccggcctggcctgggcgcacctgaccgcgcgcctgagccagctgcagctggtcttcctctaccgcctgctggcggagcacctgtcctacgtcagcgtcatgctggccatgcgcctggatcaggcggggggcgtgcccctggaggaaggacgcgcggtcccggccggaggaagcggtggagccacaccacgcgcgtcaaccccgcgctccacggggtccgcctcgcgcccggcgacgccgctgcggggcgccagcagcggacccgggcgcaccgccagcgcccggacgaggggcgccgcgccgccgccgctgcccctggccgaggcgcagcagccctttgtgctggtcttggacgtggagatggatgcgcccatcatcgtgctgccccgccagtccaacagtttggatagcctggaggtggacctggggaacctcagcctgagcagcaaggtggtcgaggtgcccggggaggaatgcgggaaaaggggcgtccaggtgctccaggagcaggccgcgctggccttctcaggtgggcactggtga

SEQ ID NO: 6858 - DNA, 1401 bp, Chlorella protothecoides
atggcggtgtcggtgtgcctgccgcgcgtggagggcgtggacttgcgccccgaggtccccacctcccacaaccgcgtcatcacctcggccaacaaggcctctttcttgatcatggaggtgggtgtgaaggagaggggtgtggtggaggcgaaccccggcatggcgcggcagaagctgggtgtcacgctgcagaagccagagttggtggtggagctgtctttcctgctggccaccgtcgcctttgtactgccgggccttgcagtggtgggcaaccaccccatcccttatgcaagccaggacttcctgctgggcggccctgacccccccggcccagcaggggcagacctctggctctcgccctgtgcgcgcctgctggcggaccgccccggcgccaccgagtttgagtacgacggcggcgggcatgcgctgatcctgccgccgccgagctccctggacgagccgctgccgctggtgctggtgggcaccgggtgtacgctgcgcctgcgcaacctgcgcctgctccacgccgactcgctggcgctgtgcctgcggctcgccccaggcgcgcgcctgctggcggagccgcgcgacggcgtcgagctggtagagggcgcggcagcgcacgcagcgctggcgcatgctctgctgccggcgccgctgcaggacaaccccaccgccgctgcgcgggccatgggcgagtgcctggcagcgggggaggaggcggcgtcgggtggtggggagttccaaggcgatgtgatccaaggaggggtggggttcggcggggaaggaaacacgtccgacgcccccaccaccccgccgccgtgcttcgaggtcagcctgtcagccgtgggcatcgggctgcagctggcgcagctggacgtcgcggcacgctccgtgcacgtgctcgcggcgaccatggacctgggcgcgtcggtgcggctggagggcgctgccaaggctggccgcctggccctgcacgggctgcacgtggagagccggaccctggacggggagggcgcggatggggagggcgcgagggatggcgatgccgagggcggccaggcggcggcggcgcggtccggcagccccgacggcaagaagcggcgacgcaagaagcggcgcggcagcctggacgcgccggtgctggagccctgccacgtcagcctggactttgagctgcgtggcccgggtgcagacccggggtcaatcgtcagctccggcactgccaccaccaccacgccgctgcccgccgcggaggtgacgctggcggtgtccgacctggcgctcaccctggctcccgacgtgctggccctggcggcgcacctggccggcggcgcgctggagccgctgcgcgcgcccgacccgggcgcgccgctgctggcctgcgcgcgctacgagcga

SEQ ID NO: 6859 - DNA, 489 bp, Chlorella protothecoides
ctgcggcgcgcgcgctgggccgacgcgcgcgccgcgggcgggcgcagcgtgcactcgccgcaccccgggcgcggctccggcgcgaccccggcgccctggcgcttttgggtcaccgcgcaggccgacttccactccggcgacctggagggggcgctgggcgcgctgggcacactgcggggcctggcccgatgggacggcgatggaattggctccgagggccccggcgccgcgtcggcggcgctcctgcgctggctggtccccgtcccccctgacgccgaggtggacgagctgcgggctgggctgagcgcggtcctggcggccaaggcggagggcaacgagcacgtggcggcgcggcgcttcgacgcggcggccgaggcctatgcccgcgcgctggccgcgccgacgctctcccctgccgccgcggcggtgctgcactgcaaccgcgcggcggcgcacttgggcgccggccggctggcgctcgcggtggcc

SEQ ID NO: 6860 - DNA, 552 bp, Chlorella protothecoides
gccgcggccacgccgtccacgcccgccgacccgggcgcgctgttcgcggccatcaacgccgacgctctggaggcggcggtggcgcgtgacgtggactaccccgtgcccgacccggcgctggcggaccgcgtggggttcatcttcaacaacctcacgcgcgccaacctggacgggaagctggtggagctgcggcgcatcgtcacgcccgacctctacccctggttcgtcacctacaccaccgtccagcgcgcggcgcaggaggccaaccagcaggacgtgtacgtggcggacgtgtatgtggcggtggtggatggctggggcgaccgtgcgctggccgcggctttcgtccgctcctccatcaagtatgtgcgcgtgatcctggactcgcacgccgtcatccgcaccagcgagcgcacgctgctgcgcaacctggcctcgttcctgggcaagcagacgctggccaagaacaagcccgtgctgcaggtgggtgagagcgggggggagggggggtccaagggggggctgattggggttcgagagggggctgattga

SEQ ID NO: 6861 - DNA, 1005 bp, Chlorella protothecoides
  modified_base (782)..(791): a, c, t, g, unknown or other
atggccaacctggtggtggcccagctcctgtatctggacagcgtggaccccaaccacgatgtcaccctttacgtaaactctcccggcggctccgtcaccgcgggcatggcggtgttcgacaccatgcgacatgtccgccccgacgtctccacggtctgcgtgggcctggccgcctccatgggcgccttcctgttggccgccggccagacggggaagcgctactccctcccaaactcccgcatcatgattcatcagcccctgggaggggcccaggggcaggcagccgacattgagatccaggtgagtggttgcgggtgtgtggatgggggcggggaagaccagcgggtggcaggtgactgtgctgagggagacggagggcggggtgctgcctcgtgccgcgcagggcacgcttcgtggtggtggacgcaagaacctgccaatgagatcctgcaccacaagctgacgctcaatgggtacctggcggaattcacggggcagagcatggagaccatcaccgccgacacggatcgcgatttcttcatgggcgcgcaggaggccgtggaggtgctcgatgacatgagcgagtggagtgcggaggctgcggccctgcgcctggaccagaatttctctgtgcggagggcatggcatgcccactgtcctgcaggcaggactggcactgtatcagtaacaatctttgccagcacaagaagcacgtcatgtgggatatgtgacgagtatgctcctgggatgcccagggagggaggcgtcctgcatcaggtacnnnnnnnnnnttcatgtgggctatgtgacgagcatgctcatgggatgtccagggagggaggcgtcctgcatcaggtacaaggcaaggccggaggcacaagcagcagatctgctcaggtgcaaggcattatgacaggcaagctatccatgaagagcgcgtcagagaccgatgttcagtccgccgccgacagagatgccgatgagctgcaagagcccgcggcctga

SEQ ID NO: 6862 - DNA, 1671 bp, Chlorella protothecoides
  modified_base (547)..(556): a, c, t, g, unknown or other
  modified_base (932)..(941): a, c, t, g, unknown or other
  modified_base (1153)..(1162): a, c, t, g, unknown or other
  modified_base (1245)..(1254): a, c, t, g, unknown or other
atgctccccggaagcggaccacagaataaaaactatcctcaaaccccttccttggccccccccaccacacacacaaacacagacgagaagctgcctgtgtttgtcgagggcgtcgactcgctggcgctgctggcgtatgacaacggcgacttctaccgctggcagaaggaggtcgaggcgggggtggccagtgcggccgatgcggcgccctacccgctcatcgtccaggactctgacttccgcacgctgctggagatccggcccggcgggggcaatggctgcgaggaggcggggtccggcgccggcgcagcgggcgcagcggcgccagggtgtggcagacccggcccccgcccggggtccggcattgccgtgcctcgcgccaccctcctgccccccgccctgcagcccgacgtcatgctgctggcgggggaggggccccccatcgtggagcaccgcatgggtggcgaggatgcgaccccgggcccggcctccgaggcgaaggggggacggggcgacggaggctcgggctccgcctcgcccccgccgnnnnnnnnnntgtggagcaccgcatgggtggcgaagacgcgaccccgggcccggcctccgaggggaaggggggacggggcgatggaggctcgggctccgcctcgcccccgccggccgccgcagcggctgcggcgctccctccccagctgcagcgggacccgccctacacacgctacgtccaggtggcccacgcctgatgagctggagctggcgatagaatatgacctggatgaggaggatgaggagtggctggaagctcacaatgccgagggagcacgagcgtatcaggtgatggtgctcgggtgcatcagcctgctcttccacccatgcgcccctcccccccctcatcgattcacccctgcaggcccggcgcgcacggagccggnnnnnnnnnntctgttgccccgctgcaatcacggccgcctccacccatgcgcccctccccccctcatcgattcccccctgcaggcccggcgcgcacggagccgggtggcgcggcgcaccctggctggggagtggatggaacacctcattgaccgcatggagaaggagtacaccgccgagctccaggtgcggggaggagtcacgccggttgagtcatgccggnnnnnnnnnngggtggcgagggcccgccccagctcggcatgcggccgtctgcagaggctcgaacctgctcgctcctcaacccccccttgtcgnnnnnnnnnnaggcggcgagggcgcgccccagctcgacatgcggccgtctgcagaggctcgtacctgctcgctcctcaacccccccttgtcgcaccccccttgcagcgtcacccagagctgtggacgctgacgcccgacccagaccgccccgatgcgccgcccagcgtgggcctgccgcccatcgcccgcatcttccccgtggagcgctgcctggccgtccccggcatcaaccactacgagccggtcatccggcgcgtatacgagtactggcagcgcaagcacgaggcgcgcggcgcgcccctcatccagcgcctctggtacgagccgccatggcaccgccgccgcgcggccgaggcggtgggcggcgacgcggcggagggcgaggagggcgaggccggcggcgaggcggcggcgcacccctttgcc

SEQ ID NO: 6863 - DNA, 318 bp, Chlorella protothecoides
atgaggtgcttgacgggcaatgcccgtctcatcaatgcaaccgccccaccaccacaatgtcagggtgttgcacagcccaaggtgctcccgaccttgcctccccccaagttcgggtgggtggactacgctgagcgcctgaacagccgagcagccatgatgtttaatcgcaaaggaaacttattcaccatgggcccaaccctccatttaccgcgacagatcgggttttttgcactgctgctggtggaggggatctcaggccgcgggctcttgcagctcatcggcatctctgtcggcggcggactgaacatcggtctctga

SEQ ID NO: 6864 - DNA, 1722 bp, Chlorella protothecoides
  modified_base (1087)..(1096): a, c, t, g, unknown or other
atgcctgaactgccagacccctccgggaccgatccaggagctggcgtgccgctggagagccatggtgtgacgaaatcaaggggcgttatcttgagagtgttcaggcaccgacacaatgttgaggcaccgacacaagagatcgccccctccagtcacgggactgtctcacctctccgtcgaggtctcgcggtggtgaaatacagggcagaggacccagcaaaggctctgggaccctcgttggaagatgtgcaatgcgataatcgcggcctgcagcagatagactgcgttccggtgcgatgttgcatttgcatggcggaggggccccacattgggcaggaggattcccttgaacgcctgggctgcccctcgatgcagcaggggcacgatcccggcccaacgcatgccgtcccggagcccccgaatcctcgttatcatgcgtgccgtgcatgctgcgcccccgagctcatgatgatgaggcacgatccccccctactccgtcttgtcgagcgagaagtcgcagcaggtgcccactcctcacaaccacatggcatttgcgtcgagcaagccaatggaggccagtccctggcctgccggcagccccagcccgcctcccgccacctggcctcccgccccgcccccaccactgccaagggcgagggcatgaagcccttcgacggcttccgcaaggtcgggggccagagggggaacatgaagcgcgacgtgactgacggcaccaagcgcatcaagctaccggtgggcaccattccctttgactctggggagcggcgcggggacaacaagaacctgaaggccatcgaggtgtacaacgggcgcagcggggtgttcaagcagagggaggtggcgggcaaggcctcgccacgcatcctggggcgcatcgagcaactgcgcctgttgagcaagctggagagcgcgggcctgctctccgccatcgagcgcggcggtttcacgctgtccgacatcgagaagtacggcctgctcagcacgactgagagcctgggcctcatctccgccgcggcagacaggtgggcctggcaggggtatggagctgcactcagagctactcccnnnnnnnnnngcttgggcaagcgttgtggtggcactggatcaaccccctctgctggaactaatactgtgggtcagcatggctctgtacttcaggagctgcactcagagctactccctatccaccatcctaatctgcaggaacacgccacggctcctgttcggtgcagctgcagccctgctggctgccgcgcctgccctggtgtactttgtgcccgacaccagcaactggctgattgctggacaggtggcggcagccgtcctcctggtcctgggtggcaccgccgcttatggcggagctgcgctgctcaccgccctccacaaatgagcctggaggctctcatgatccgagcagatgtgtcagagtatagcgggtgcagaactagcacctgcactcccagcaaggctgttaaaggtggggcggagtcattaagctgggcctttacgagctctgactggagggagcagatgtgtcagagtataatgggtgcagaacaagcacctgcactcccaccaaggctgttaaaggtggggcggaatcattacgctgggcctttacgagctctgagtggagggaggtgcatcaagggcatcaatgtgtgtcgtgatggatttcgaaagcctggaaaggacacctaa

SEQ ID NO: 6865 - DNA, 1116 bp, Chlorella protothecoides
  modified_base (154)..(163): a, c, t, g, unknown or other
  modified_base (270)..(279): a, c, t, g, unknown or other
atgccatgtcggagaaaagcgatcattgatgcgatcctgcgggacagaagacccaatatccattcacttgagcatcacactaggaacaggaattgttcgataaaacaggggatcccggtccagcgcatcacaattatgtccacagcacatccgnnnnnnnnnncgttcgaccaaacaggggatcccggtacaacgcatcacaattatgtccacagcacatccgcatcatactcaatcccccatgccactgtacctgggcctcgatgtggnnnnnnnnnncgcgcaataccgatcccacgcactaagcctccattcaaaaacaataccgatcatactcaagcctccatgccactgtacctgggcctcgatgtgggaacatctggtaccaaggctctcctgtatgacccagacaagaagcaggtgttgggtaggggatccgttgcctatggcgtccagagcagtcgcgctggggaggcagagcaggaccctgcaatctggatagaggcggtctgcacggcgagcaggcaggcactgcagggcctcccggcggaccaggtcaggggtatcggcgtcagcgggcagcagcatggcatggtggtgctcgacaaggacaacgtggttctgcggcctgccaagctgtggtgcgatgtgaccagcgctgaggaggctgaggagctctccagggtctacggcaccaccctcgtgccctccttcacaggtgggatggttcaggatgtcaatgctgacctcatgcctgtcttccttgtcatgtggatagacaaagggggtggacagctcgttcagccgtcagggtgcagggaatggtttctatggagaggaggggcaccatgctcaactcatcccgtggccttggaacggcaacctctgggactcccactcaccgcgtgcatcaccactctgtgctgcagccaccaagctcctttggctcaagaggcacgagccagatgtgtttgcccaagtggccacggtgctcttgccccacaactacatcaatttctggctgactggcgaggctgtaatggaggtgagggggtgcggggggatttaaattctttcctttgtcgtgcgcgtgtaatcaatcacaccgaaagctag

SEQ ID NO: 6866 - DNA, 531 bp, Chlorella protothecoides
atgcaagcttacccctgccaggctgctcccttgagctcctcgcacacactggatcccactcggcacaccctggccacaggcagccaagagtctggggaagacgctgcgtacgagctgacccaggtgtctgccgagctgcgcagcacgctggaaagggagatcgggctggacgaggtgagggaggacctacgctccgtcactcggccccgggcgcccttcaagaccctggagctggacgaggacgatcgcggcgtgggggaaaagggactagcgagcgtgggccccccagccgcagaggaggacgtcgacatcgaggccaaacggcgagcctctgccgagctggcgtggggcaaggctgggggccaagggggggaggtgactcaaggggcagcaggtcatccagcgaaaactagggcaaacttgcaagagctgagcgaagaggagctgctgggcgagctgaggcggcggaaggctgagatggaggccgcggtgaagaaggatgcccaaccagggagtgtcgatgggaaatga

SEQ ID NO: 6867 - DNA, 459 bp, Chlorella protothecoides
atggggcagggtgggggtttctgccctgtggcccggccagccctacacagctccaaacccactcctgaggccccaatctcaccctttcctgtggcggctgcaggtctgcgcgtcggcagcagcaggcccggcctggtctaccgcgccgcgctggagggcgtcaccttcctgctggctgccgggaaggagcggctgcgtgcgcatggcctcgtccccgacgagctccgagtggtggggggcggggcgcgcaaccgtctctggcgtcgcattgtggccgacgccttccagctgccgctccgttttcctctggagcccgaggcggctgcccttggcggcgccctgcaggtgaggcaggaaactcgggatgcacgtgccagggggtgggggtggcgtgtgatgcatgcagtgcctcccgtacctgccatgtgtgcaccgcctgccaggggaacggctgcgtga

SEQ ID NO: 6868 - DNA, 450 bp, Chlorella protothecoides
  modified_base (126)..(135): a, c, t, g, unknown or other
atgggccccagcatcgcgctcgggtggcacgaccagcgcgctctgggcgcatgggggcttcaccgacaccaacaccgtcccgcaagggcaagcgcggtggggcgacatgacccactcgcccctggnnnnnnnnnntgcgctctgggcgtatgggggcttcaccgacaccaacaccgatccgcaagggcaagcggggtggggcgacatgacccactcgcccctggaccccgtcagcccgatggcgtatcgcgagggcgcatatcgatggcggggcagtctcccacttacctgtccgccgccctccccgagtaccgggccaaactcccggccttctcggtatggcccggcagggccaaggtggccctgcagacgggggcttacatcggcctggcgggactgctccttttcgccaagcctggactcttccccatcatcttcgagacggagtga

SEQ ID NO: 6869 - DNA, 1566 bp, Chlorella protothecoides
  modified_base (1171)..(1180): a, c, t, g, unknown or other
atggtttcagtctcttgccagccgccagctgctgtgcgcagtcctgagccttggtgcgggctgccccccccacccatccttttattgatccaggccttgaccaacacacccagtgccagtgaaacttcctgcaaaccgttggggcaactcatgcatgtgccgctgctgctgatgtcacagctatcatctcatcctgtacctggatcatgtaccaatgacactcggcgctgcctggacacacacatgccttggagtgtgtgggcgccatctgccaatgctttgggaggtcaaacaggacattcatccttcatggtagtatgcacgcctttcgcaaagatgcaatcagcgattgaggactctaggagttgcatctgtgatgttgttaggctccatgaccggatctacaaacccctcgcaaggcatcccgagaactggcagtcaagaggaggagcaggcccaccacctacaacaacactccccagcggctgcgctgaagtaagaggaggcaccagcgatcctcggctgcgccgtagtggaattgacaagccatgggaaccccgaatccggaggtccttagggccgtcatcaggtgagaaaggtggagcctccggcgatggctcgtcgcactctcgccgcgcaggccatcgagcgctcctcgatctgcgtggccccattcctctcgttcctcgccacagatcctacagctatgtggtgctgtggatgtccatctccatctccgtcatcctcttcaacaagtggtgcgcctgcgtccgggccgggcacccctacccctgcacccctgcccaccccttgcaaccctccaccttggtctgccctattgctccccgcacgcccctccagaggccccagcccctccatctacaggttgctcgccttcgccgggttccccttccccattgccctcaccatgtggcacatggctttctgctctgcggtgggcttcttctgcatcagggtcctgggcatcaccaagacgcacaacctgagcgtggaggagtactgcagacgcgtcctgcccatcggggcgacccgccactcgttcggccggtgctcctcccatgcgcctgtttctcaccacatcaccacacctatgaaaaccccgccctccccctcccgacgccccccctcacctctcttcctccccccaacnnnnnnnnnngccatgcgcctgtttctcaccacatcatcacacctataaaaaccccggcctccccctcctggcgcccccccctcacctctcttcctccccccaaccccttccacctgcatccaggcatgctgtacgcggcgtcactctggcttagcaactcctcctacctctacctctccgtgtcattcatccagatgaccaagtcgctgatgcccggcctggtctacgcctgtggtgtggcgctgggcaccgagacctttgccgccggctctgcgctcaacatgctgctcattgccgcgggcgtggtggtgtgcgcggtgggggaggccaacctggtggtaaagggtctggtgcagcagctcgccgccctgctgtttgaggtgggcagcggatag

SEQ ID NO: 6870 - DNA, 315 bp, Chlorella protothecoides
atgctgcggccgggggcgccgcccccctcccctcacgatctggggctcgccatcgctgtgcagggtcgccaggggctactgctgttcggcgcctactacctgggagctgcctgtgatgacgcggcgggtaggccccccctgttcatgtacgccgccacggtcgcgggccgggggctcctctccgcggccttctgctggctggtgtggagcgggcagtgcgccgtgcccctgctgtggctggcgggcctgaacgccctcagcgcggctcgactcttgcgggcgctgatccggccggacgacgccccggccgggtag

SEQ ID NO: 6871 - DNA, 2124 bp, Chlorella protothecoides
  modified_base (185)..(245): a, c, t, g, unknown or other
  modified_base (953)..(962): a, c, t, g, unknown or other
gggcgccggcgcggcccctgcacggcacgtggccggcgcggggggcggggctgggatcgccgccgcggccgccgcccaacccccgccgctcccggcctcgctgacggcgctgaacctgacgcagaccctgttcctggccgcgcgcgccggcgggctggacgtcgtggcggggcccctccgcccgnnnnnnnnnnnnnnnnnnnnnnnnnnnnnnnnnnnnnnnnnnnnnnnnnnnnnnnnnnnnncctgcggagcgcgagcgatgcacgaggcgatacaaccggcgatgcacaggtcggtgcagccgacggtatgcccggcagggcagccggcagcacgcccgcccaccccaacgagaccgtggcgtggctgcgcgagcgccagggcgcgtactgggcgcggcgcctggccgaggcaggcgcgcacgcgcgccgctcgccggagctgcgcctggtcccgctgtaccgcgcgctgcacaagcatgcgcgagagctggcgcacatgcgcgaccagggccaccgccgcctgttcccgctggtggagctggcgctgtgcatcatgcgcctctcctgcgaacgcttcttcacgctgctggccgtctgggcggggtacctcgccttccgggacccgcccgcgcctgcgcgccgcgccatcgtgaccgtcgcgcgcctggccgccgccttccagcgcgccgtgctcctcgccttccccgccgtctgctgggtctacgatgccggcatcgtcttctccacctttgcctccatcgttttctggagcgggtgggtgttttcttgtttgtgcatcttgttttggggggaaagagggggaagagattgtgcagtgtcgccaagtaatgggggggaggggagtgcaatgggttggagaggcatgggggttgatggaggggtcaatagtaccactcgatggccaatgcacgtcacccctggcctccnnnnnnnnnnatgtgcagtgtcgcctacttcccgcgaatctttggtcccggaaagtcaggctgcgaggaacctgttctcaccagtcatcccctctgagcctgacgagccgggaagagctgccctcgtacctcctcctcgttcatgccacgctgcgaggaacccgttctcaccagttgtcccctctgagcctgacgagccgggaagagctgccctcatacctcctcctcgttcatgccatgtgactcagtgtcaaccccaaacccccaattccaccttggccccctccgccccgcaggcccctccgcggcgcggtggaaaaggtgcggtccaccgccgccagcgtggagccgcacggctggcgccacgccaccgctgccgaggtggagcgtatgggtggccagtgcgccgtgtgctggggcacgctggggccagaggccgcagaggtggcggaagtctctgcgccggcggccggcggggacactgccggcgccgagggcgcaaactccgagcccggctccccccccggcgacgagcgtgcctcggagcccgcgccccggccggcccgcagctggctgtcggaccggtccgcggcgctgcgccaggcggcctccgccgcactttccgggcgcgggccgctggacttgcggaccgaggaggaggtggacagcgcggagagcgcggcgcgctgggcggcggtggacgccatggcgctgccgtgcgggcacgcctaccacgccgactgcatcctacagtggctgcagcagtgcttcaggtgcccaaggaggggaaaagagggcgggggaaggggagtgggagggaaaatgaactgcctggccatttccagggcttgcctagtctggggagggcatgcttcaaccctcccagtgatgtggcgcgccagggtcgcgtgcccacgtgccccatgtgccaggcgaccatcgcgctacgggtgcggtatcactggcccttccgggcggtaccgcgcagccgtctgcatgatgagcctgtgcagccccagtttggcgtggagggcgacggcggcctggaccccggcatcaggggcattcggatgctcacccacgtcctcaggggcatcggcgactcaaaggcatacatgtttgcggtttgggattccatcccctctcgtcatcagaagacaatccctctctaa

SEQ ID NO: 6872 - DNA, 1629 bp, Chlorella protothecoides
atgccttgggggtggcaaccgacaggtatcgatcaggaatcaccatggtcatcagcagcagctgcccccaaacttctctgccaccaccctcttcccccatcgcccaggagcactgccaaagtgtcccatgtgccgctctccagcgatggtgcaccatcatacatgctgtcatcctttctgtacaatgcatggtacggcggccctgacgccacaccttgtccccagatcgattccccccctctcccaatcaataagggcctggccgaggcagtgggcgtcagcaactacggcgcggagcagctggcgcgcatccatgactatcttgatgcccggggggtgcctctggcgtctgcccaggtgcagtactccctgctgagcagggggggcgctcaggagagcgtgcggcgggaggccgaggagcggggcatcgccctcatagcctacagcccccttgccctcgcgaaatggtccagccctccgtcccgcgctcacgtgctccttctcaggcatgctgagtggaaagtatggagtggaggatggcgaggcagctgcgtccctgccacagggccctcgggcgctgctcttcaagcagatcctgcctggcgcggcggacctgctgcaggagctgcgccagatcgcacaggcccgcgggaagacggtgcctcaagtcgcgctcaactggtgcatctgccaggtgcgctggcgtcgcccacacatcaggaccgcccgcaccatcctccagggcacgattcccatccccggggcgaccagtctcgcccagttccaggacagcctgggggcgctggggtggaggctgacacgggaggagtgtgggcgcctggaggaggcctcggacgccgtgccccgggccatgctgcaaaacatctttcagacggcctgacccagcccttgcgcggctgcagcaacgctgagatgggtcgatgcaggggcgtgcacgtccagtttccaccaaattacggtgccaatgcattagtcatccaacgacggcacttggcctggcccccgcatcgattccctcgccctgggttacgaaggggcgagctcttggttttctcgagtttcaggttcatgatgggacaacctattctcttctttaattgctcgttcccaactttttgcatgctattctgtattggccgccacttccaatggcagattgtcaacacatcacacgggagaagaagaaagcgctgcatgcaggccagaccggagcagggtcacctacaccttgtgtgccaatctgaaacgagtgatacatcttgctcgagagacgggcggcattcgttggatttatcagtgagtcggccgatcagcagcgtcgtaccctgttgtcgcgcagtctggtggatcacttcattctcggcatacggcaatgaggggagcagagctagcccccttcctgggaccgtaagtcgcgctgatcctccatgcattgggagaatcacacctcgagaatcgacaaccgagacattattccacgccgtggatcccagactgactcctgtggcggtggcagatagcattctggccgcaccagatgattactacaccattctacaagcaagtgttgggaggccaatcataccatgctggcaggtccaagcttga

SEQ ID NO: 6873 - DNA, 609 bp, Chlorella protothecoides
atgctcctactgcagctacgggacatccaggatgcacagaatcagcgcagcgccgaagaggttgctgcctccaagcctcttgcggaggtgctgagggaggccaaggaggccaaggagtcggcctttcaagaaacatggaagcagatgaagacggtgggtagcgtggctgtatcgaggcctgggagtatgggcaaaaaccgccctttggatgaggaggagctggagttcttcgacgccgtcgcggaggcggaagccctgaagcgacggcgggagcaggaggaggaggcggcggagctggactccttccgccggctgcgtcaggagcaggaggagggtctgcgctctgacccccccggcgtgctcatcggccccgccgcgccgccgccagagaccgcgggccgcgccgcgccgcagcagaccggcccccggctgccccagaagaggggcctgggcgcagtcctcaagccaatgccccgacgcgtcgtgcgaaaggaggatgacgcggccgaccctccggccgcctccgacccagagggcgacaccggcctggctgggctcctgggcggctatgccagcagcggcgacgagggtgcgggcgacttggcctga

SEQ ID NO: 6874 - DNA, 1752 bp, Chlorella protothecoides
  modified_base (387)..(396): a, c, t, g, unknown or other
  modified_base (809)..(818): a, c, t, g, unknown or other
  modified_base (1095)..(1104): a, c, t, g, unknown or other
  modified_base (1160)..(1169): a, c, t, g, unknown or other
  modified_base (1365)..(1374): a, c, t, g, unknown or other
  modified_base (1586)..(1595): a, c, t, g, unknown or other
atgggcgaagagagcgggcatgctgctctgcaggtgtccctcttctcaggcacctgctacctgacgccgctgttgggggcctggctggcggactccatgtggggcaggtacaagaccatcatggtcttctccctcatctacttcctggtgcgccaggatctacactgggtggtgatcctgtccagtaggagcgccccaggatgggatctaagcatcatgaccggcacctgcctgcacctccctggggccgagcggtgcactggacttctgcggaggagcgaggatgcagctgcaaaatgcatagcatttggcaccctcctcatcacaatgccaacagctcatcatatctggttacacgccgctgtgcactgccacacttctatgatnnnnnnnnnngcaccctcctcatcacaatgccaacagctcggcatgctgctcctggcgacgacggccctggtcccggcgctcacccctcccccggacctgtacccgacccggctccagaacgccgccctcttcacctccctgtacattgtggcactggggacaggcggcatcaagcccaatgtgtctgcctttggcgcagaccagtttgacatggcagatccgcaggtaggtgggaggcctcctgtatgggcgggggaagggggcggcctggacaagcctgcggtgccctatggccagaccatgccccacgccctgcctggtctggcacggaaagcacggaggggcggcgccagtctgcctcaattctcttttgtgcatcgccaccaaacaccgcatacccacctcaagctctcttcatttannnnnnnnnnacggaggggcggcgccagtctgcctcaattttcttgtgtgcatcgccaccaaacacagcatacccacctcaagctctcttcattttcgaccacccgctgcaggaccgcaaggaaaagacctccttcttcaactggttctacttctttgtcaacatcggatccttcattgccgtcacaggtacaagttgtactttgcagcagcaagccgccctatgcagagtgtcagtggtgtctcaatctcttcccaccacatttcacctacacctccaacgtcctnnnnnnnnnnggcagcctgcatgggcctggccatcctggtgttcgtggcaggttccccgatgtatnnnnnnnnnngagtgtcagtggtgtctcaatctcttcccagcacatttcgcttacacctccaacgccccccccatccctttcagtcattgtatgggtccaggagaacgtgaattggggcgtcggtcccataacccgcgtgtacaacgtggtgatgagcgcctggtgggagaagcggcgcggtgggaacgtctcccccgacgagtannnnnnnnnnggcagcctgcatgggcctggccatcctggtttttgtggcaggttccccaatgtacactcacgtggtgccgacggagaggtgaggtggggcgcccgaggggtcgggcatgtaggagtacagggtgtggagcattcgtgggccaggttctctgggcgcacgcactgcctggattccgcccggctgccacttcccatgacccccaccaatgattnnnnnnnnnntgcaggaggcagagagggggtgcctgaagggtgggtgtggggtcgctggagatcgggcgcagggccaggcgggcggtggtttggcgcgagtctgtgcgccacgcaagacgcccctcagatcgtacacggaacagtttgtctcatccgatgcttgtag

SEQ ID NO: 6875 - DNA, 558 bp, Chlorella protothecoides
  modified_base (256)..(265): a, c, t, g, unknown or other
atgtcacagagttaccctacccccacgcagggagggcaggcgcggtacatcaaccacagctgcgaccccaactgctacaccaaggtgggcaaggggggattgatcccggcccctgcgtgtgcgaagtgtcggtgttgtgcgggcatcgcgcctgagcacctatggagtctccaagatggatgcccttggctgcatggagctcggcatcagcatccccgcctgcggtcatggcagagacactcacgaactccctcannnnnnnnnnatggagctcggcatcagcatccccgcctgcagtcgtggcagagacgctcacgaactccctcgatatggcatgacatggtgcaggtgcagatggggccggatggccgcaagcacatcaccatcgtggcgaagacgcacatccctcgtggcagtgagctgtgctacgactacctggtgagtcaggctggcttgggggctagagtagagtggactacgagcttggttgatgcggtcgcatgcgatggtcctggatgtgccccgatgaaggtgggagacaccctgagggcgtggtga

SEQ ID NO: 6876 - DNA, 1197 bp, Chlorella protothecoides
atgccggtcctcgccacacacctcggggccccccgcctccgccccgattcctgctcccgtttgggttccaggaagtccatccgggcccctgcccggtcgggcctgaggatccgggccgtgctcgacctgcccaagcccaccatcaccaacggcaccagccccgacaaggaggtggaggctctacgcgccgacgtcctgcacgagctgcgctaccgagtggccccacagagcatcaacgaggccaagctgtacgagtcggtggcctggagcgtgcacaaccggctggtagaggggctggatgccaccaacgaccactggcgcgaacaggatgtgaagcaggtgtactacctttccgccgaattcctcatgggccgcaccctgacctccgccgtgcacaacctgggcctgggcggcgcctatggtgcgatcctgaaggactacggcgcggcgctggagacggtggcgtccgaggagcgcgatgcggcgctgggcaacggcgggctgggccgcctggcggcctgcttcctggactccatggccaccctggacctgcccgggtgggggtacggcatccgctaccgctacggcatgttcaagcaggtcatccgggaggggtatcagatcgaggtccccgactactggttagacgagggcaacccatgggaggtgcgccgccccgacaccacctaccgcgtcggctttgccggcacctccgacggcgcgtcctggacgcccggcgacgaggtcatcgccgaggcctacgacgtgcccatccccggctacaagaccacgacggtggggtcgctgcgcctgtggaatgccaagcccgtcgccgagttcgacctggacgctttcaacgtcggcgactatgacggcgccacgggggccaagcgccgcgccgacgacatcaccgccgtgttgtaccccaacgacgccaccgagtacggcaaggagctgcgcctgcgccagcagttcttcttcgtctccgcctcgctgcaggacaccctggcccgctacctggccacccactctgacctggcggggctgccggacaaggccgtgttccagatgaacgacacccaccccaccatcgccgtggcggagctccagcgcctgctcaccgacgtgcacggcctggcctgggacgaggcctgggccatcaccaccaagtccctggcctacaccaaccacacgtga

SEQ ID NO: 6877 - DNA, 1407 bp, Chlorella protothecoides
  modified_base (1037)..(1046): a, c, t, g, unknown or other
  modified_base (1207)..(1216): a, c, t, g, unknown or other
atgccagacttcaactggaccggtcccctgcggccctggcggataggcccgatgcgttcggtgaggtgtgggctggattcacatgttctggggctcatgttgctgatacccaccttccatttcgaacgagctccgcaaaccgacccagccaatgccacgcagatcccggactccattcccaagccggagtggtacctcaccggtcgagcagatgtggaggtgtccagccgtcagcagcacactcgtgagaggaggtgttgtggctggtctcatgggataggagttggggctggaaggcaggggtggtgtgttgaggtgttccatctacgattcgaatgtcaagggatgccctgcggcttaccagcaggggagcacgcatttctacccaagcatttccaccatggcctcgcctcggtgccccacagccatcccacgcttcggcaaggcggccgagggcatccgcgcagcgtgcaccttggggaggaaggtgctggacctggcacacgccgccgtcgccccaggcgtcaccacggacgagatcgatcgcgtggtgcgtacggggcggagggaggagggaaggcagcgtggtgcgtatggggcggagggaggagggaaggcagcgtgggcatgggcggcggcaggaaaggcttcccttgtagctggccgtttgacaacagcgcttccaggaggcacatgccaaacgcgcggcggggtggctgggctcacgctctggcgccattgcctcaagggcgccctgtgagtgatgaccccgaagcacctgcagtgtgcaccgggcaggggatgaccaaaactcgcgtgcctcaactccctgatgccagatgtccccctttcctccaggtccacgaggccaccatcgcggcgggtgcgtaccccagcccctacaactatttcaacttcccgaaatccgtctgcacctccgtcaacgaggtaagggggccggtcattactgcaaggacgtgcaccctgcagagctcagatgtgcatatgccccacagctgtcacagcaagcatggctnnnnnnnnnntacagcgcttccagcaggcacatgccagacgcgtggcgaggtggctgggctcacgctctggcgctactgcctcgagggcgccctgtaactgggtcggctggtcgccccaggacgtcctaccctcttcattcatgccctccccaacaaactcagccccctcnnnnnnnnnngtccgacatgccctcgggcacgcacccagtccacacatcccacacatcctgctgccgcagatcatctgccacggcatccccgaccggcggccgctggagaatggcgacattgtgaatgtggatgtctcggtctacctcaacggctggcacggggatctgaacgagactttcgtggtgggggaggtagatga

SEQ ID NO: 6878 - DNA, 2565 bp, Chlorella protothecoides
  modified_base (35)..(44): a, c, t, g, unknown or other
  modified_base (1959)..(1968): a, c, t, g, unknown or other
atgtctctggggggtggcgccattgccaagatacnnnnnnnnnngccacccactcattaccttccagagaagagaagggtgcctgccagagaaaatcccccgaccagcgcaccatcgacccttcctaccgagctatgggtgcaagggccatcaaaattccgccatggatcatgtgatacttgttggccgtctcgaataccgtccgatacgtgggcgccaggtgggctaggccgtgcgagccataagcgccagctgcaaccgcggtcgcgccgcccactgcggcgactttgtgccagatgcttgtcatttgtgatcaatgctgccgctggctcccgatcagggtgccccgcatcgcgggtgaggattgtccatcttgcaaacgtgggtcttcaatcgagcgggtcatttgaccctgagggtcttgttgggggccaccagtatcccgaatcaggtcatgcggatgacattccgtcgtgccagtcgatcagcgcgcgatcctttgctggccggaccggcaagctcgcctgtcccgcaggacctaaagccgggaggcatgtgaggctggtcgttcgggcacaggagaagcagactcccgccaaggggcagccctctgacaagccggacacgaagagcgagaaggcggagaagaagcccgagattgggcccaagcgcggctcccaggtgtgccctggggagggttggggtcctgtgctccaagcatccacatctgactgtgcgtgttcagctggctctcagcacctgagacaatggggagcacatagctcaccaccccgggtcgctcaccacccctccatctcccctccccccactgggcaggtacgcatcaagcgacccgagtcctactggttcagggaggtcggcaaggttgtgtcagtggaccagagcggcatccggtacccggtggtggtccgcttcgagcgcgtgaactacgcgggggtgacgaccaacaactactccctggacgaggtggaggaggtcctgggctggttcccggagtccagcagtccttggaatgacttgaggctgccagtcccaatatcctgggtgcctggatggatggtgtcgttctaccgcacgcccaagaggatggtgatcccaggtccagcatctgttcgcccacttgaccctcctctcccctttcccatatggcgacagctgcggaatactctggtacgagaagaatgctcaacattgctgcggttctcttgcctcgcctgcttagagtttgaaccttgggcggtttgggtgagccacgtctcctgtaaatcaagtacagatactactgctgtcaggcagaaggggacagggtgggggggtgggggggtgagggggaaagggagagggggggcactattggagcagagtctcactggtgcaaaaggagcaggtatcagggaacctggtgggcagcgccaggcccccagccggtgcctgtctgacactgttgcgtcagtcccagtctcaaacggacaggacctgccctgtcttggctgccaggcttgcatcctccacctcccaccaaaggggcggggaggtgggcagccgggctgtcaggacctcgcaaccctgaggcgtgatgagcagctggtgctcgaactgggcggagcgcaggccgtcctccgtggcagcggtcctggggaggcaggggggggatatgtgtgttggggtgggggggaggggaagcggagactcgtgcggcgccgtctcaaacataatgttggctcactgctgcggccacacgctcgcatccgaggaaccccaggcgcactgcagcaaggcaccgcggcccctggatgtcagagaccccatccccttttctgtcagacggctcctcagcacgatcgccaacagtattgtatcccaaacgaccccataagacacccgccccccaaaaacaaaaccataaacaccaacaaaaaaagtaaaccccaggccgcnnnnnnnnnntcagagaccccatccccttttctgtcagacagttcctcagcactattgccaacagtactgtatcccaaacgacaccataagacacccgccccccaaaagcaaaaccataaacaccaacacaatgagtacaccccaggccatcgcccaccagccatcgggccaggtcttgtcgcggtgcgagcccacgcagatcatgggctcgatggtgaacacctcgccctccttcatcacaccccgcgccttgttgtgcgcgtagtggtgcacattgggcgcgcagtggaagaggtcgccgatgccgtgcccgcagtaggccttgaccacgctgaggccggcggcgctggcgtggcgggtgatgatgtcgcccacgtcgcggtaccgcatgccgggccggcacgccgcgatggccagctccaggcactgcggagacatggggtgggggttggggttgggtggagggggctgagtttgttggggagggcatggatgaggagggtagaacgtcctggggcgaccagccaaaccagttctgaccacaagaccggaaaccacaaacaaaaccagggctccaagatcaacccacctcgtgcgtggtcttga

SEQ ID NO: 6879 - DNA, 1446 bp, Chlorella protothecoides
  modified_base (561)..(570): a, c, t, g, unknown or other
  modified_base (797)..(806): a, c, t, g, unknown or other
atgccagcaaatttagtcgacaaagctgctcgccattcttcatgtttctacagacggatgatgttggcattgcttgtgtgcgccctctgcctcctcacgggcgcgtctggggaggccctgcccagcccagggtttgacctcctcctcctggcccccaccttgtctgtctcattgggcgagagccctagattcgaatcttcccctggccccaatctcccctcgcgcagctcctcgttcaccatccatggcctgtggcccgagtacaagaccgggggctggccccagttctgcggggcacacacgacccaccaggccgccgggccgcccacccccgcccagaactgcctgtggcccagcctgatcggccccagccccgggttctgggagcacgagtgggccaagcacggcacctgcgcggctccgctgctgggcaaccgcaccgcctttgtggcgacggtgctggagctgcacgaaaagtacaacctggaccgctccccggcgcacgcgagggaggggatggcgcacgcgacggcgacggcggcgacggcggcgacgggggcnnnnnnnnnnggacgtgagcggggcgggcagaggaggggtcgagctgctctcaggaagattgttcttgttgctcgtgcctcgggacatcagggggagttgtatcgtttgaggcagctggcacggccctgtggcaagcctaatccacggcgcagtgccaacttcccacccacttcctggaccccagcgttccaccagctcgctgcccttcacatctcagcctcccatcacacctttcnnnnnnnnnntggaccccagcgttccaccagctcgctgcctgtcacatctcagcctcccatcaccccttctccctcgctctcacacactcccccctcccccccccaaaacctccgccaggtggcgctggggaacgcgggggtgctgccctccagcagtggcaactacgccgcggaggacctgcaggacgcggtgcgggccgcctacggcgccgcgccgctgctctcctgcaccgccggcacgctggtggaggtgtggatgtgcctggacctggagctacgtgtcatggagtgcccgcccgcggtgcggccgggcccaaaatgcggcgcagacgtgcggctgccgcgcggcgccgaggtgccgccccgctgccgccctttctccccgccctggggagcagcgctccccggcgcacgcaagggaggggatggcgcacgcgacggcggcggcggcggcggcgacggcgatgacgggggtgagcagggcgaccggccctcctggcgcgtggccgcggtcctcctcctcgtcctggccctggcctacgtggccatgtacggggtgcagcgcctgatggcggagcgggtggaagccgaggagcccctcctcctcgtcggcagcggctggcaacaggggggccgggcagatccctga

SEQ ID NO: 6880 - DNA, 555 bp, Chlorella protothecoides
atggcgggcctacacgacccctgctcccaccccgctgccacccgcctggccctcaaactggtggaggagcagtttggcgagacgcctcccagcctgtaccttgtccagagtccactccccgagtccttcgccgctgtgcacctcccacctcccctcattccccgttccccctcggttccacgccttcatcagaccgtggcaagggccctgctgtaccatggcacacagagcctgggcgacctgcgacgctccgccggcctgccgctgccccacctgaaggcggcgctgctagtgctcatgcagcacaactgcgtggcctcctggctgcacgccgagccccccaacctgaggggcgagtcgcgcgtggagcagctgtatgaggcgctaccccgggccatgctgcatggcctgcatgccccgcgctacctcatccacgtcaaggacagcctgggcgccactgcggaggcagtggcgctcaagctcctgcagcatgggcgtctcaggtgcgggaggggggtaacggggggtgtcttgacttgcttcatcatgcggtga

SEQ ID NO: 6881 - DNA, 483 bp, Chlorella protothecoides
atgtctccgcagtgcctggagctggccatcgcggcgtgccggcccggcatgcggtaccgcgacgtgggcgacatcatcacccgccacgccagcgccgccggcctcagcgtggtcaaggcctactgcgggcacggcatcggcgacctcttccactgcgcgcccaatgtgcaccactacgcgcacaacaaggcgcggggtgtgatgaaggagggcgaggtgttcaccatcgagcccatgatctgcgtgggctcgcaccgcgacaagacctggcccgatggctggtgggcgatggcctggggtgtactcattgtgaccgctgccacggaggacggcctgcgctccgcccagttcgagcaccagctgctcatcacgcctcagggttgcgaggtcctgacagcccggctgcccacctccccgcccctttggtgggaggtggaggatgcaagcctggcagccaagacagggcaggtcctgtccgtttga

SEQ ID NO: 6882 - DNA, 1173 bp, Chlorella protothecoides
atgaaatgcagctacacctggggccctgcgccccctcctgccccccccacacaccctaccccccacacacacccatcaccacccaatacacgcagcaccttctacgaccggctgaaggaggtgcttgcctaccaccgccgcttcccgtccgaggacatcaccgagggcgacggctccgaggcgctgctggcggcggctgagccggcggtggccttcagcggcgaggaggccctggggcggtacctggacctgcacgagctgcacgccgcgcacagcaacggcgcctttgccggccagcccctggactaccacacctacgtcctggcgctggcggactggagccgcgtggcgcgccccgcccgcacctcgcgcgcctaccgcgagtacctggagcgcctggcggcctacctggagtccttccacgctcgcacgcagcccctggccgacctggacgcgcagatgcggggcgcggtggccgagttcgaggaggcctgggccaggggcgccgtccccggctgggaggaccggggggcggggggcgccgctgctgcgggcggtcgtggagaggcccccgagggggccctggacctggatgcctttgactccgtggacgaactggagctcctgggtgggcaggggctgggagtgggggatgcgggaaagggcggcacccgatccatcgacggccggaggagcctgccctgcccaccaacccctgccatccgcctgcagcccacctgccacccatctcggccccggcgcccactcggacaccgcacacatgcacccaaagcctcacccccccgccccgcagacccggagcgcatcaagcaggccctgcgcgcgctgcacctgaagtgcggcggcacgccccgccagcgcgcggcgcgcctcttctccacgcggggcaagacccccgatcagctggacccggccctgttcgccaagggcgccgcgcccgccgcggcgctgagccaggcccagcgcgagcgggccgaggcagccgcgcgcggcgcggccctgctggaggcccgcgtctcccgcctgctgcgcctgctgggcacggtgcaggccgacaccgcgggtcgggtggagaagcgccaggcgcagacctacgaggagctgctggcggagcaggccgaggccgaggaggtgagtgcttggagggggtga

SEQ ID NO: 6883 - DNA, 291 bp, Chlorella protothecoides
atgtgggagtccgcctgcctgccgtctgcatgcctgcccgtcactggttctccactctgcccatcctctggccccccccatcgcgctctcctccagctggagcagctggcgatggagaagaacaccatgatgacggagaagctggagctgcgccggcaggtgaacgagctggccgcctcggtggacaagctgaacagagagaaggtggctctggaggcccaggtgcgatggctgggaggggtccacgggtcccggggaagcagggccaggaggtggagggtgggctggtag

SEQ ID NO: 6884 - DNA, 573 bp, Chlorella protothecoides
atgaggagccggctcaaggggacgacgctgcctttccacgcaagggtgcacggcggcatcagcactcaagggcaatcatcgccccctccgtcacccgcccaccacccatcaaccccaccaaaccccctctccccttccaccctccccccccaacaggagggcgacctggtcgaggaggactcggacgaggaggcgcccatctacaacccgctgaagctgccgctgggctgggacggcaagcccatccccttctggctctaccgcctgcacggcctgaacatcgagttcaagtgcgagatctgcggcggcgcctcctactggggccgccgagcctttgagcgccacttcaaggaaccgcagcaccagcgcgggcttaagacgctgggcgtgccgtggtcacgcgagttctacgagatcacctccatcgccgacgcgctggcgctgtggaagagcatgcgcgagcgccagcgctcgggcgcggccccggggacggaggaggagtttgaggacgacgcggggaacgtctacaacaagaagacctgggaagacctgcgccggcaaggcctggtgtga

SEQ ID NO: 6885 - DNA, 231 bp, Chlorella protothecoides
atgtcgggcagcaccgagccatcttcctgggcagaggagaggaaggcgctcgagcttgagcttgcggcggagcgacgacgctgcgcgtcgttgcaggaggagctgaagaaggagaagcagctggctatcgcgcgccagctgcaggcggaggctgaggaggagaggctgaccaacaagctcatgcagaggttggacgagctcaagacggtgagcgggggaggggctgagtag

SEQ ID NO: 6886 - DNA, 576 bp, Chlorella protothecoides
atgatggacgccaaggacgccaaagtcaagctgcacgccatgctcaaggccgggtgcgcagagggggggctggtctgttctgcgtccttgggggtgtgggcgcgggatggtaccctggtcctcttgcctgcctgtgcctcactcggccccccacctcccggcccctgcgtcgtgacgtacatcgcgctgcaggacgtgccacgcaccgcggaccgcgcgccctctcgcactttctacctgtggcgcgccgacgtgcgcgccgcctgcgcggccttcacgatcgagctgttcctggcggcgggcaacctgcacgcccgcctggcacacgagctgagtcagcgtgccgagagggaggggcggctgcaggcgcgacggcagagaggagccctgcagcggtgcccccggcaacccgtcccgctgctccgcgtgctggacctggtgaacgcggggctggcggggccgggcgcgctggcggagcgcgcgtccgacttctccaggatcaagcgcgtgacgaccctgctggaggccggcctgctggacgtgggcgccagcctggccctcttcctcggcgactga

SEQ ID NO: 6887 - DNA, 1425 bp, Chlorella protothecoides
  modified_base (1160)..(1169): a, c, t, g, unknown or other
atggccatgggtccggcaccccccgcaagagcggagactgtaccgttgatgcgagctatggtgcgttcatggagaggtgtggcgctttctctcggaatggctgagatggaaggcccctcccagcagcacctgcacctggacggaccgatgcaatgggacgagatggagctgcacctcgccctggacgagctggtgaaggccgagagctgcccctcgccgggccccgcgcccagcgcggtgcctgccgcccacccggtcctgggctccgggggcgcgcccaatgcactggacccgggccccaagctgcaacacgcggcccccggctacccgccgcccacccccggcctctcctccgccacctgggacgagcagtcggtggacgagtccagcggcgggcgggggaaagcgcgtcgcggcccccgcccgcgcatgttcaagaagaacacctgccaggcggacaactgcaccgccgacctgggggcctgctccttctactaccagcgcaaccacatctgccccgcacacctgaaggccggggcctacgccgtgcgcggcgtgtccacccgcttctgccagcgctgcggcgtgggccacccggtggaggacttctccggggccaagcgctcctgcaagaaggcgctggagcggcacaaccagcgccgacgcgagaagcagggcggcagcgagggcggccagacgggcgaggacggcggcggccctagccacgagggcggccagacgggcgaggacaccggcggccctagccagtcgcgcgcgacgccccacgcctcccacgccaacctagccgcctgctccgccatgcaccccgcgccgccggcgtgccagccggacgccggcgcggactgggaggctagcagccggttcggaggcggcgcctacgctgccgcgcagccctggaacctgcccccggacctcctgcccctgctgggcatgagcccgccggagggcgccgtgtacggcggggcggggccgggcgcggcggccccggcgcagggagcgagcgccggcgaggtcgcgcacctgcagcactggctggcggccggacagggctggggggagttcccgcaccaggcggcgcagcaggcgtggcagcagccgctgcagcagcccgaggatgccagcggcgagagcggggcgcnnnnnnnnnnggccggacagggctggggggagttcccgcagcaggcggcgcagcaggcgtggcagcagccccaggatgccagcggcgagagcggggcgttcatgcacccggcggcgcccccgcccgccccgtccagcctgtacgcggcgctgggcgagccgagcctcagcgtgggcagcgtggccatgcccaccctggacccgggcatgctgtccatggcgcccatgccccccgagcagctgtcctggctcagctcgcagctctga

SEQ ID NO: 6888 - DNA, 1602 bp, Chlorella protothecoides
atgcctatctccaccatcccaccgcctccgcaggtacctcctgtacggcaacgtgtcccgcaacgccgccgcggagctgctcaagcccgaggtggcagaccactttgcgcgcctgatccagcgcgtggcgcccaagtcctacccccaggcagaggcggaggtgtcggtcacgcgcatcttcctggagaacttctcgggcgaccaggtccgcttcctggcccgttccttcggcgtgcccggcgaccaccccggccagcagagcaacggctaccgctggcccttcgggcccgtggcactcatcgccccgttcaacttccccctggagatccctgccctccagctcatgggcgcgctgttcatgggcaacaagcccctggtccatgccgaccacaagtgagcagactggctgttgtgttttttttggggggggggatgcaacaggctcccatggctggggtacaggaggcgatgaagcgcttccgtgcggcggaggcccggcagcgcctggcaggcgacgtccggggttggtggtgtgatcgccctaccagcgcagtaccgtttcctggccgacaagggtggccttcatcaaaacgcacacacgcgcgcactcaaacaccccaaccccctggcccggccagggtggcggtggtgctggaggagtttgtgcgcctgctgcacgcctgcggcatgccacgcgcggacctggacctggtgcacggccgaggctcgacggtgaacgagatcctgctgcgcggcgagccgcgcagcacgctgttcacggggtccaagcgcgtggcggagaagctggcggtggacctgcggggcaaggtgttcctggaggatgcggggttcgactggaagatcctgggcccagacgtgcaggccttcgaccacgtggcctggcagtgcgaccaggacgcgtacgcgtgcagcgggcagaagtgcagcgcgcagagcatcctgttcatgcacgacgcctgggccgaggcggggctggaggccgcgctggccgcgcgcgccgcgacgcgcgggctggaggacctcaccgtggggcccgtgctgagctggaccacggaggccatccaggcccacgtggcagacctgctggccatcccgggcgcgcgcctggcctggggcggggaggcgctgaccgggcacgccatcccgccgcgctacgccgccatccagcccaccgcggtgttcgtgccgctggaccaggtgctgcgccccgagcactggcccacggtcacgcgcgaggtgtttggccccttccaggtgctgacgcgctacggcgacgccagcctgcccgacgtgctggccgcctgcgagcgcatggacgcgcacctcaccgccgccgtggtgtccaactccatccccttcctccagcacgtgctggccaacaccgtcaacggcaccacctacgccggcatccgcgggcgcaccacgggggcgccccagaatcactggttcggcccagccaacgacccgcgcggcgcgggcatcggcacgcccgaggccatcaagctggtctggtccactcaccgcgagatcatccaggacgtgggacccgtgccggacgcctccaaccaggtccagtcctga

SEQ ID NO: 6889 - DNA, 2847 bp, Chlorella protothecoides
  modified_base (1313)..(1322): a, c, t, g, unknown or other
  modified_base (1482)..(1491): a, c, t, g, unknown or other
  modified_base (1804)..(1902): a, c, t, g, unknown or other
  modified_base (2362)..(2448): a, c, t, g, unknown or other
atgacgccgtctgcacccacgccaaaatgcctgtcgcaggccttggccgcctgggagggggtgaccaggggcgtggccgagtggcggttgtccacctgcaattatgaggggaggtggagggccaggcgcttgtgtttgggtggcaggctgacggcatcaggaagggaggggggagcccctcaggcagcacccaaggcaacctggcccccctatgatggaatgttatgcgcccaagaacatgtgaaatcccagtcctgtcacaaggaacctgtctccaaggtcctcaccaggatgaagtcgttgcccaggccctggtacttggcgaagcgcagggtggtcgccggggctgccacggcaggggcagaagtgcagcgcggccgacacacacgcatgacgcgagaggcagggcgagctgagagatggaagcggctcaatcccccagagcagtgtgcggagtgggtcagccccgacatggcgcccctgtcccgagcagggatttgggcagccatgcacatgcgcgcacgtgcgaatttcggtcgcagcgggcagctcctcctccctcgccacccctcaacagccctcgcccctgtggacgatgaggaggttgagggaccctcaacgctgcactctgacagtgcaggcaggcccagatacgagacgagagagggatgggacgagtctgcggacgtgaagcggggagtcagccgtcagcgactggatctgactcatggattccatcgcgagatcgtgagtggatgcgggatcctgcgggcaggggttgtctgcggaagtgtgcccaacggcgcccggcgtgtcggtgcccatctattgcagcgactggtgcccactcacctcgcaatccaggtcaagaaccagaaactgcggagccagtacgagcaagagtgtcgcgagggcatggcaaaggccagcgactaccaaaaaaggtggagacgctcccccgtcgagtcccgctcaacctcccgacacggccttgcatcatcatggacccactcccctcacaggctggagtcagtggcgcctcctcaagatgtcgagaacgtcacaacggccccccggcaccgcccagagacacgcgtgcgggaggggttcgctgcgtatcgcccgccgcccgctttggggtcccagcccaagctggacctggaccgaaacgggaaggtatggcgggtgtacctgctcgtgggggttgaagagcatgttgaagtgaatgcagtgcaaacagtaaaccttgctcactgtgcatctcaccctgggagtctgcccctgccctgcgattctcacgttccctcttccgnnnnnnnnnnagggcggggggagcgtgagcgcaggcgggatgctgcgggaggggatgagcacctcgaagcccgacctgtgccccgggcgagaccccgcccggagccccggccgcagcatgccgagcggcctggggaggcagcgggcggggtcgccaaggcccgcgagcgnnnnnnnnnngtgcaaacagctgagcgggctctggacgatcagcgccgcccccctgcacaaccccatcggggacaggccgtgcgggaggaggcaagggacgcacagtccaccggccccccccagaccgagcccacaggccgtcagaggagagggcggggggagcgtgagcgcaggcgggacgctgcgggaggggaggagcacctcgaggcccgacctgtgccccgtgcgagacccggcccggagccccggccgcagcatgccgagcggcccggggaagcagcgggcggggtcgccaaggtccgcgagcgtcgcagcgtgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggcgggccggcgcccgcggacccgccctcgcgaattctggtggtcccccgccccaaggccccggcccagcaggcgagcgcgcctgcccaggacgtgcccgagcaggagtcgagcgcggggggagagggcgtggatgcggtccccgccgagcccggtgctgaggccaagccacggaggtcgcggcggggggggcgcaagcgccaccctcggcggcaggagggcggcgaggccgctgcgcacgagcgcggcgcggcgggagggcatggcgatgagggggcggcagaggcccagaccgacgagaccctggcaagtcatgccgtggcggatgtcgggtcggaggtcacagactcccccgggtcagccgaggagtggctggggggcagcgctgcggcggcatccggctcggaggtcggcgcggcagtgtctgggccgccgcctggggtcggtgcaccgccannnnnnnnnnnnnnnnnnnnnnnnnnnnnnnnnnnnnnnnnnnnnnnnnnnnnnnnnnnnnnnnnnnnnnnnnnnnnnnnnnnnnnnggtgcggggccggcgccggccagcccgcgaagcgcggaggctggcggcgccgccgcccccgcagccgtgcagccgcgggacccgagccaggagcggggcgaagccgcagacctgggcgctgcgtcggccctgcctgggctccagggcgtcatcgacggcaccaagctgatcgatctgaaggccgacgaggtgaaggggcaggggaatgggtgggtttcagggtgtggtacctcatactacgatggcaagccacgcccaccgccggtaccgatgctgaggaagtggggcgccgacgacatcagctgtcctcggtctcacctttcgccacacccgccccgtccctcgctgcaggccaaggcgggcggggacggcaggccccaaaactgctccatccagtga

SEQ ID NO: 6890 - DNA, 651 bp, Chlorella protothecoides
atgtcggggctgacccactccgcacactgctctgggggattgagccgcttccatctctcagctcgccctgcctctcgcgtcatgcgtgtgtgtcggccgcgctgcacttctgcccctgccgtggcagccccggcgaccaccctgcgcttcgccaagtaccagggcctgggcaacgacttcatcctggtggacaaccgccactcggccacgcccctggtcaccccctcccaggcggccaaggcctgcgacaggcattttggcgtgggtgcagacggcgtcatcttcgccctgccgccccaggcccccgactccgactacgccatgcgcatctacaactccgacggcagcgagccggagatgtgcggcaacggcatccgctgcttggcccgcttcgtggccgagctggacgcggatgcgccaaggcgataccgggtggacaccctggcgggcctgatccagcctgagctgctgccggagggaagggtgcgggtggatatgggggagcccatcctggaggccaacgccatccccaccaccctgcagcccaccaccccggtgaggagaggatctggacggtgtgagcgagtttgggaggaggggggggagggcgggggtgatgatgggagcgaagaatctgggttcgactggtag

SEQ ID NO: 6891 - DNA, 372 bp, Chlorella protothecoides
atggctcccgtcgccagcaagaagcccgtgtcggccaagaagcccgtcgcggcgaagaagcccgcgggcgacaagaagaagaccagcaagaagagcgtggagagctacaagctctacatcttcaaggtgctcaagcaggtccaccccgacaccggcatctcctccaaggccatcaccatcctgaactcgttcatcgtggaccagttcgacaagatcgctacccaggccgcccagttgtcccgcgtgaacaagaagcccaccctgaccagccgcgagatccagaccgccgtgcggctggtgctacctggcgagctggccaagcacgccgtgtctgagggcaccaaggccgtgaccaagttcacatccgcctga

SEQ ID NO: 6892 - DNA, 561 bp, Chlorella protothecoides
atgtctctccttccaatcttgtgtttccgagtgcggagttgtgcctatccccggggtttcttaattcttggcctcccggaccggtctgcacatgttccagaagaggtttattacaagatcaagttcgcccaactcgagcataccacgctccaatatcccgcacagattattagattagtaaccatgtctggacgcggcaagggaaagacctccggcagcaaggccgtgagcaagtcctccaaggcgggcctgcagttccccgtcgggcgtatcgcccgctacctgaagaacggccgctacgctgagcgcatcggtgccggcgcccccgtgtacctggcagctgtcctggagtacctggcggccgaggtgctcgagctggccggcaacgccgctcgcgacaacaagaagacccgcatcgtgccccgccacatccagctggcggtccgcaacgacgaggagctgtccaagctgctcgccggcgtgaccatcgccgagggcggtgtgctccccaacatccagtcggtgctcctgcccaagaagaccggcaagaaggacgagtag

SEQ ID NO: 6893 - DNA, 1191 bp, Chlorella protothecoides
atgggcaacatggatgccaaaccggacccagccttgaccatgagtggcgcagaagcgcgtcgctcgccgggcgaggctggtggactcaacacctctgtcgacaagtacaggtatcgcctccatgccgtcgtcgcgcagtaccgtgcggcgcagcatgaggtaccaggggcgccagggcacctcgatgctcagcttgctgcggtgcgtgcgcagcagctgctgcagctgcagtgcccaccgcgtctgcaccatgaggtcgccctcaccctgcgccaccatttccagctggcagtgtaccaggtcatgcagggaggtgctgtcgagggacttcaccccagccatgcgccgcccacagtcggcaccatcacagcgcgatctcctccaagtcatagacactcacgtcctacagagggcgatgtagggctgggtggcccggagggcctcggcagcagacagggtgcggctgtcgcgctcccactgcgccttcagcgccgccaccagggcagcataccgcgctggttcctctgtgtcacggtggtacaggtggagcagtatggcgtggggctctgcaggggcaggctggaatctctgtgctctggcaacataccccaaaaccctcacgcacctgtggcgacacgctccgccagtcgattcttttgtgccgtagttcctgtgggcaaagaggaacacctcaagtgccagcgtgaaatgagcacaccggaggagctgcctcctgatggcgtcaagattatatctctccttcggagcatgagtgtcacggcatacgagcctcgtgtgatccagcagctgctcgacttccagtaccggtacactgcggagtgcctgcaggacgccgaggccattgctgagaggtcgctgggaccacgaccagaggtgaccatgccacatgtagtcttggcaacagagctggcatctgcccacaccttcaccaccccgccgtcgctgaaggtcttgcaacagcttgccgcagagatcaatgcccaagcacttccagagatcaaaccacactatggcctgcgcctgccccctgagggcgattgcctcctggcacccaactaccagtttgacccccgcactcccgcgatctccgaacacgcgctggacggcggcgctgcaccgttgaaacaagaagctgcgagcagtgacctaggtgctgtgcctcccacatga

SEQ ID NO: 6894 - DNA, 1932 bp, Chlorella protothecoides
atggcggggtgcctcccaagtctgggggtggaggaggtccggcaccaggcacctagtggcctggaccgtttggtgtggtccgccccgagggcttttcctgtgctgccggctcgtcctttgcgtgagggccctgcctgggtcgcggcgtcgtcccctcattgccccaggctccgacgagcacaccaccaccgcccccctccaggcctgatcgactggcaccaccacctgcccgagctgtacacccattttctgtgggccttccgcgtccccgtgggcacctccttcgccgacccccccttctccttcgactgccccaagcactgtcaggtgctgttcgccaacgagctggcctcccgcagcgagtgcgccgcccacgccgccatctacatgctggggcacggtggcggcccccccggcgccgactccgcgctggcccacctggagggcctggtgggcctgctggagcagtactaccacccctccaacggcgggcgctggaactcgggcctggcccacctgttcaagacgctggcctccgccttcggcgcgcggctgctggccgagagcaacgccgcgcggcgcaccgcggagcgcgcacgcggcccgcgcggcgcctccgccccgcccgacgcgccagcgggggacgcggaggcggaggtggacccgggcggcgcaggcgcggaggaggacgccagcgtggacggcgacgacgccagcgaggccagtgaggccagcgacgacgacgtgcaggcctcgggttcggacagttcgggcgaggacgacctgctgccagtgccgccgggcgggcggcgccgcgcgccgctcaccgacgtggtagtcgaacgggtcgtgggggctttgctgaggctggcctccaaggcccagttcagcaaggtaggctttacatttggtttggggggtgggagggggaagggatgggggaatggaccatgtgagggagaagaggatcaggaagggggtagtgacagacggaaggcctccctccgggtgaccaatgcccgccttacgggagcttggctgaccgtcccgagcatgattctccatgcgatgctgtggctctcgcacatggggcgagtccttgcccgaaatccaaggcacgacaaggagcttcggcgcagcgccacgcgcatcctaggcctgctggcagaggtgtcgccgcgcgcggtgctgcccggcgtgcacgcgcactttgtggcggcgctggagacggtgaccagcaccagcgtgctggccagcgccatccagacgctgagcctctgcgtgcgcccgctgctcgtcgccgggctggtcctgcctcccgaggacggcggcggcggggttgaggtcgctgtgggcatgaacggggatggtgaggtaccagggggcgccgatgccgcgcgggccaccgccggcgcctcactggccgccgcgctgatggccaccgtgccgggcatcgacgccaacgacccgcccaagagcctggccgtcttcaggttctatgccatcgtgctttcctccctggcccagcttccggtagggcgaggaggtgtctgtgtgaggagaacaaaccccagtcttgacgacagtgtctgcttcaggaccgagctgccgcactcctcgaccgccactgccggctacattcgatgccggtctcaaggtaccccctcaatgcaccctttccaggaggtggccaccccaggcttcccgctggagaccgagatctgggtggaggagctgctgtcccacgtctttgccgtcatctccaacctggacgcgcctgagcacaggggtgcgtcggagggtgacaggagggagggccgcaggggctgggtgagagcgctgctgctgcgaggggccggggcggctgtgtgtgagtgcctgactggccgtgcgcggacgattgattgcgacatggaacgcgtggtagggtag

SEQ ID NO: 6895 - DNA, 1257 bp, Chlorella protothecoides
atgtcgtgcgggcgcgtgaggctgctgaccctggacggcgacggcggcctgcttgcgcagcgctgcgtcctgccccccgacctgagccccgtcacctgcctggccgcggcggccggctgcgtcgcggccggcaaggccgatgggaggctgcacgtgtgggcagcgccgctcagggaagcggtcgtgtgtgggagccaggtcgccgtgcaggggcctggggacgatgctgtcgaggacctgcgagcgagcacagagcgcgacaccgtaggctgccccgcagccgcgcacgggcaccgcccggcgacgggggttgcttggggccaccgagggatggaccccggcgccctgcccctcctggtctccgccgggctgggtggggagctgtgcgcctggagggtggagcgaggagtccacgaggtgaccctggccccagcccccgccctctcgcccgccggcagggccaaggatgcggggtggggctgcctgggggtggccgcttcgggcagcggactgctaattgccacgctgcgtcacgcccgtcaccccgccacagagctcgtcaagcagctccaggtgcaccagagggtggtccagtcggtggtgcggctgtattgcctccccgaccccgaccagcgggacctgcagcaggcagcgcgggcctgggtggctcggggcgcgggcgccggaggcgccatgcccttgccctccgccctctgggacgtgctatgcgcgctgcgtcagcccaccgagaccgatggcgaggaccccccggcgcgcctgctgagctggctgtccgccggcgcgggggaggcgcacggccagggcgccgcgctgcgctgcgccgtggccgcgctgcgcgtgctgagcggcagggagcctggcgccggggcggctgccatggagctggacctcctgctcaggcgcgcgcgtggggcgctgacggccgcgctggcgggcgatgggaggggcgcgacagccaactgccctgtcgaagatgaggccactgaggcggtgctgggccgggtggcggcgtgggtgctggccagcgctggcgagagcggagtcgacgaggagctgctgggcctggccgctgcggtcccacagcgtaacgagctcgacgcatccgcgcccctggcggggggcatggagggggccaccaccgccctcaagacgctcaaggtcagattttggggaggacggcgcatggtccatgtgtggggatgcccgtcgcttgagatcccaggttccaccctttag

SEQ ID NO: 6896 - DNA, 321 bp, Chlorella protothecoides
atggccgagaagccttggactcgcatgctgggcgtgcgccgaggcctcacacccatctcccagaccatctgccccgcctcgctcaccattgcttaccccccccacacacccatgcccccccaggccctgggctggctgaccatgctgctgccgaccacggcgctcaaggccggcgacggcgactggggcgcctgggcagaggagtgggtcgctctctggcgcgccgtgccccactgctcctactgggacgcgctgtggggcgcgctcttcgcgcgcctggcctcccacgacgccttcggtgggtgccgggcggggggctga

SEQ ID NO: 6897 - DNA, 2565 bp, Chlorella protothecoides
  modified_base (313)..(322): a, c, t, g, unknown or other
  modified_base (750)..(759): a, c, t, g, unknown or other
  modified_base (842)..(851): a, c, t, g, unknown or other
  modified_base (1936)..(1945): a, c, t, g, unknown or other
gggccgagcgccgcgccgccacgctgccagagaccgcgtcccaggcctctcttgccgcgccgagccacgcccggccggaatgagggtggacttggcgccgatgcttcacgtgcgctacggatgcagcgtggggcctcagcaccttgcgtctcaattcctccccgcagcagcgaactttctttttccccgtcgccccgtgctccgctgcctggcgcacccccctcccccatgcgacactgttcgtggttgacgtgcacccctggcccctccccatgtgcttcctgcaccacatccctacggtttgacagctggnnnnnnnnnnggagaccgcgtcccaggcctctctcgcagcgccgagccacgcccggccggagtgagggtggggttgtcgcggatgcttcgcgtgcgctgcagatgcagcgtggggccccagcacctcgcgtctcaattcctccccgcagcagcgaacttgccttttccccttcgtcccgtgctccgctgcctggtgctcccccctcccccatgcgaccctgttcgtggttgacgtgcgcccctggccctccccatgtgcttcttgcaccacatccctacggtttgacagctggcagcagtgttcacaccacagacagggtgacaggcggggatccacagggggagggggcggcgtgggcgggaggggtgcgggcgcgcgccgcgcctccggtcgggggtgcctgggatctcgaccccggcgtgccgcgcgcccccgcnnnnnnnnnnatcgtacaggaccaggacgaaggcgccgccggcgccgcgcaggacgttggacagcgcgcccttgaagaaggcggaggagcccnnnnnnnnnnagcaggcggggatccacggggggagggggcggcgtgggcaagaggggtgcgggcacgcgccgcgcctccggtcaggggtgcctggggtctcgaccccggcgaccagcacgaaggcgccaccggcgccgcgcaggacgttggagagcgcgcccttgaagaaggcggaggagccctcctgcgcggcgatcttgcgccagcagtccagggtgccgttgtacacgcgctcgccgccggactgcatcatcagcctgcggcgcacggtgtcgaaggggtaggacagcacgccggcggcggcggtgacggcctgggcgatggcccacttgcccaggaaggaggcgttgcgctcgtcctcgaacaccgcgcccttggcggtgtcgtacaggccgaagcagtcgatgaggcccgtgaactcgcggttgccgccggagccgacatcagcggcgaggcgcgtgcgcgcaaagtccaggggatagacgatgagcagggagccggcgccagccaggccgccggaggccaggttggtggcgaagaacttccagaagtcggccttgggggagtagcgcgggaacaggcccttgatggtgtccttgaacgcaaagttgaaggcctgggtggggaagtagcgcaccacgttggccaggttgccacgccagaaggaggcgatgccctgctccgcggccacgcgggtgaagcagttggcgatgcccgtgtagcgtgggatctcgcccgacttgatgcgcgggttggagtcctgggtctgcagcagcagcttcacacgctcgatgggggccacgatggtcttggacaccgcgccggcggtgccgcccgcagccaggtcggccaggaaggcccacgcgttgctctcactgcgatatggtggtttgtggggaaatttgagttcacagacgagcggggggcggggcggggcggggcggggcaggtggacaaggcagccgccaggggggcctcctcaacccaaacacacccagctggcaagtgcgatacggatgatattgggacgaggggacgtggcggataccattggagacaggcatcatgcaggtgcacaccccaaaccccagtgnnnnnnnnnnaattttgggacgaaaggacgtggcggataccattggagacaggcttcatgcaggcctgggaagacagcatcctgactgcaaggggaaagggcgaccgcgcgtcggcttgggcagcgggcatgcgaggcaggaccgggggcagagcgaacccggagggcgaagccgggcacatagtagccatgcaaacatgccgtgtgatcaggcgtaaggcgactgcgtcgagccaggggaccgcggcgctgacgccaggcgcagcgggagggcggggaagggacggggcaaccacttgcccgtgtgcaaccctacgacccagcgcccccagggtgcaagggatctgttgcccagcacactccttcaaggcatcgcaccccctcccgagccggacagtccccctgtcatcaaccccaaggtgtcctgcaccaagctgccacactggggcgcaccttgcgaacagggaacacctgccccgtccaattcctgagaagccgagttgcgcctcgacgagatccagaaaaagaggggcgccttcaggttcacgggacgtcatgagcagggacgccctcctgtacgctcctgccgcactgaccccggggtcgagtggcccgggggggcgccgatga

SEQ ID NO: 6898 - DNA, 798 bp, Chlorella protothecoides
acacacaaccccccccaccccccaacacacacactcgcatccacagaggcttcttcacatggacctggcgccgcccgtggagtggctgcgccggccgcgcatggtgctgctggatgcggggatggccatgagcctgtcgcccaaggaccacaccaacatgtgcgggctgttcgacgccttctcgcgcctggacggcagcagcgtggcggactgggtgctgcgcttctccggcgaggcgcagacctgccccgaccccgccgccttccgcgcggacctgggcgcgcgcatggaggaggcgcgcaccgcgcggcgcctgggcgcagggtccgaggccgacggcgcggaggagctggcggtggtgctggacatgtgccgccagcatgcggtgagcctgccggggcacatctgcgccacggtggtcaccaccctggtgctggaggggtggagccactcgctggacccgcgccactccacgctggccgaggtgcggcggctgctggccgcaaagcgcggcgggctgctggcctggctggccaccgtggccgactcggagatgctggagcgtgtgcccaccttcgacgacccgctggccacctcccgcttcgacctggcgcgcgtcatgtcctggagggcatagcgcacgcggcggggcggtggcgcggggcgcggggagtcgcggagcagccctgctgggcaggggggccggcggccggcggcgccggggtggtactcgctgcacgtggcgtgagggctcgcaaccgccctcgtacccaggagcaagccggaaagaactggtga

SEQ ID NO: 6899 - DNA, 588 bp, Chlorella protothecoides
cccccctatccccccacacccgccctcgctctgcagctacctggaggcctgcgagtctgggtccatgttcgagggcctgctgcccgaggacatctcggtctttgccaccacggcagccaacgcgcgcgagtcgtcgtggggcacctactgccccggccagagccccagccccccgcccgagttgctcacctgcctgggcgacctgtacagcgtggcctggctggaggacgccgacgaggccaacctgagcgtggagacgctgaaggagcagttccaggcggtgcgcctgcgcacctcccagaacttcacctaccagcagggcagccacgcgcagcgcttcggccagctcagcatgggcacgcagtccgtggcggagtacctgggcgacgccgagcaggggcctgccgcgtggcgccacgccggggccggggcgtgggtgggtgcccaggtggccgacgccggcgccgagtcttctcggcgccggcgcctcggtccccagggcgctgtgccgcagcgcgacgccgacctggcgccgctgtacgcggcggtgtggcgcgagggaccggcaaacagcgccaagcgcgctga

SEQ ID NO: 6900 - DNA, 414 bp, Chlorella protothecoides
atggggggagcggggagaggtgacgagccgtgggactttgggagaggggtgcttggggtggggcatggctggcacccgaggctcaccttgccccgcagatacccgctcgcggcgttcactcatccctgttccccgcgacgtgccctcaccatgacagcaaagctggaccaccggcggtacagcagcctgctggagttccgggacgacgtgcggctgatctttgccaactgccgccagttcaacccgcccggcaactttgtgcgcaacatcggtgaccaggcgtcggagaagttcgagaaggcctgggccacgcgcggcctggaggcggcggcggaggccgaggcccggcgctgcgcgctggagagcgcggcgctggaggccgaggcctcggcgctgccggacgcgctgcgcgcg

SEQ ID NO: 6901 - DNA, 1947 bp, Chlorella protothecoides
atgaggctgagatcctcccgcagctggcgcttcctcgtctgtccatcggggttggtagctgctgccatcatgttctgcgctcgaagggaagggtggaggattcctcagctcatcctcgagttgaactggtgtaggcacgggggcaggggtagtgcgttggagcagctggcgcagctccgcgcacggattgggcagctgacggcgtgtcttgggaaggagggacagcctagcttgtacaacgcctgtcggctgtcatccttttgccgctgtctcgggaaggccgctccagcggaggacgagcatgggggcccggacaccctgagcagaattcgctccatgctttctatcgatcccaattttttggcgggatttgaggactccatgcccggatgcacgcccatgcatgaacgggcctctcacatcgaaagagcaagtgtgatgccttctcccatgcgcagtctgaactgcggcgcatcgtccacacacagaattttgattgctccagcttcttttgcgcatgctgggcgcccatcgaggactcctcttcgccccacctccagtctcatcaagcctcccttcaatgtcgtcatcacgggaggcaccaagggcgtgggaaaggcgctggcatccgagttcctggcggccggcgacagcgtggccctgtgtgcgcgatcggcggaggctgtggacgccatcgtggaggagctacgatcaaaagggagggtagtcgggcgcgcctgtgatgtagcacgggcggctgatgtggaggccttcacctcctttgcacaacagggtgatatgcggttgggagcgcgcgtgggcatgccttggcgagggctgtcggctttgcattgcaggcagagcatgctcgtgttgcgccaggggcctggcgattgcttcccaagcgcaatggcgtgccttccaatcctcttgtgcccccacctcgcctgcagagctggggcgagtggacatgtggatcaacaatgctgggaccaacgcctaccgctttggtgcgctggaggaccaaccgccagaggacctggaggccatcctgacgacaaatggggggtggaagggcaatacggaatcgagggtgaccaagattatgatcaggaactggacagggcccatactgcgtacacgatcaggcagaggatgcaagcttgcacaccattgttgcaggatgtggaagtccttgtgtgcaccctcgccgtgcctttggggtttttcatttggagttccccaccaatcgtgaacattgttatgccgcaggccatgtctgtgatggcagggcaaccaagcggagggcacatcttccttgtggacggtgcagaggatgaggtctcaacattgcacacctcttcactcggcgcccaccaaaaatccgtttgccagccagaactcgtcaccgtttccgagtccaacatcatactccccacaggggcggatgggggcgccacccctcgctttgcagcctatggtgcctcgaagcgtgccctgagccagctgggcaagagcctgaatgcggagctgcgagggtcccctcgccggggacgaatcacggtgcacacaatgagccccggtatggtcaccaccgagctgctcatggcgggggctgacacccgcgtcgcgcgcttcttcataaacgtcctggctgagacgccagagacggtggcggccaacctggtgcctcgcctgcgccagggtgagagggtccactgtctgttgggaaagggggaggtgggagtgggggcgcgcacaatgaaggagatggacggggctgcgataacgtcagatgttgatgcggagaaggtccatgtctatgtcaccaacttgccatatgcggtccctcttaccaggtatctgaccaagcccaaggcgtatggtcagattctgatgcgactcctggccaagcaaaggaagaacaagtttgtggaggaggagtga

SEQ ID NO: 6902 - DNA, 684 bp, Chlorella protothecoides
  modified_base (251)..(260): a, c, t, g, unknown or other
atggtcagccccctcccggcacccagtgtccctgaacctggctgccatgcagtggatctgattatgccggcgaatccagcccagtgcctcgctgtcgaattccctggggtggtggagaacccagacaaggcgctggcaatgatgggtggcctggaagccatgtcccgccacctccaggtgccttgggggtggtgggttgtgcgccttactacaaattttataccgaggcaccacaggggtgcgcttttcannnnnnnnnncgccacctccaggtgccttgggggtggtggattgtgcgccttactagaagttttataccgaagcaccacaggggtgcgcttttccggtgtggctgcacctctactcgatggcctttccatcctccagcttccttgcatgcaggaaaatcccatgactctgcccttgtactttcgacctgaagacccctactgccacccagtggtgggcaacaggacccgggccaagaagctggccgtgaggctgaggagaagcgcagatggggaggtcagcgcagccgtgattggggtcgtgaaatcagagtacaggtgtgtgagattcggaagaatcgagcaagtggtccggattcgaaaggaagggtcgaaaagcaatggctgtggaagtgagggtccattctttctgaatgacagttgcttgtctggatga

SEQ ID NO: 6903 - DNA, 435 bp, Chlorella protothecoides
atgcgtcacgtctggacattcctcccctgctgtctcttgtcatgctacctgggcaacgaggttgcctgggagtgcaaacaagcagcccctgcagcaccctcaaaagccaggcagacccccccaccgcccttcccccgaccctcaccgcccccaaaggtgctggccgcgctccccgtccagcgcctcaagcgctccacactcttcgtggacgtgctgagcgtcaaggagttccccaagcaggccatgctgcgcatgctgcccgccgacgccgacatcctgtgcacgcaccccatgtttggccccgactccggccagggctcctggtcgggcctcaacttcatgtacgaggtggcgcgcctggtgccgggggacgccgcccgccagcagcgcatgcagaacttcatacgggtgaggagaggtcttggaaaggggtaa

SEQ ID NO: 6904 - DNA, 2619 bp, Chlorella protothecoides
  modified_base (390)..(399): a, c, t, g, unknown or other
  modified_base (2470)..(2479): a, c, t, g, unknown or other
atggatgccttcccggaagccacacctgggacctcgggtcgaagcgatcaggaagccctcaagatcgcactcatcaacgagaagtcttctcccgagatcctaatgttccaggaagaccttgtgtcgcgcatcgaggcccaaatcgactaccaagtccgtcgggaggaggggctggccacgtcatcatttgccagtcgaagagcagatcgagctcatgcgaggcaaccaagacctagagctcttgcggaccatattcacgacagagctcgccagggtgtgtatggggtgggtagagttggtggatgcagactaaattatggccaaggcttggagagcgcattctcgcatggcaaggcagtctgtcgttctaatgccttggcccacgcattnnnnnnnnnnggtagagttggtggatgcagactaaattatagccaaggcttcgagagcgcatcatcgcatggcaaggcagtctgtagttctaatggcttggcccacgcatggcacctgcctcctctttctcgcgtctccggctcagccagcgcatggttccaccctgcttgggccgtgcttgcagacagagatccccttcttctacttggaatgcccctgcctgccaaccccagcccactcaagaaatctcaaagctcctgccacctcaaggatccccctccaccttttcctccccattccccgtctgcaggtacggtacctgctccgctgctactaccgggtgcggctgcacaagatcgaggagtatgccatgcacatcttggacaccgcggaggtcaaggagcggctgtcagaccgggaggacgcccatgcccaggagttcttcatgctgcagggcacccacctcaagatggcagtggggcggcagctccccgaagccttctcctcgctggtgcgccaggcggcggcccacccggagaaggacatggtgccgcgccccgacctggacaagcatgtcttttgccgcgtgctggaggacagaggtcaagtgccggtggacgacgccgggtgcgttgtacaggggtagtgagggggcagggggaggaaggaagccattccccagcaggagcagtccgcccatgctctccctcccatgggtcctgcccgcccgagcatcaggcatgtagctcaacgaccttattcagatctttctcaacaacgacccctgccttacaggaacacagcccaattcaacaaggacgacgtgtttgtcatccggtaccagccgctgcagccactcctggcggagggctccgtgtgcctgctgtgagggacacatgcttccaacacatgtcaacaccatcaccaaaccgccagggaggcatcgctctagcacatgtcttactcagcccgcacaatgaggggcaatcaaggcaggggcggggcccagtcgattggtttgcgccgcgccaagcgcatcggcatccaatgcaagtaacgagctcctcccctggctcacgacccattctccaggctggctcgtttcctgctccgagagctgacgagctcagcctctcgctggctgcctctcggcagcactccaattcccggctccagggccggggccgcaggcggtgcggcaggggcttccaggaacgtcccctctgggcggggcgcggagggggaggggaagagctggtcccgcagcttggcgtgcagccgcctgaacagctgccgcttcacgctgtcaaaggcgtgctccaggcgctccagctcttgcgtcgcattctacagagggggcatgggaaaggaataggggggtggtggggcccagggtgccgcaaatgtgcatgcttgtggggccccagttcaaagaacccagacaggaccaggcttgatcagggggcacctcccatcgagatcccgccagggccagttgtgagcgggtgggtcgtgccacagcagggccttgttgccctgcatcgcggtcccccgactcaagctgcagcaactcaccgggttgtacatgaagaggccgtagtagagatcaaaggaatcgttgttggtgttgcccaccaggctgaggagcgactggaacccccgggtgtcgatgggcgtcggttccaactgcgagcacgggaagcgggggggaggcagctcgtccacgatctgcgtcaaggggtcccagcacacggcacatcatcccgcgcacatcagccctgcacagcacgagcacagtcccaccccaggtcctgcccctcctcctccacaccacaccttcatctcgcccagcatgcggccaacggtgtgggtgatgaactgggtggaggccgcctgcctgtcatgctcctcgcaacccagctccaccatcgtgcagccctcccgcgcgaagaactgtggggcggcggtggcttgccatgtgatcgtcggcagagtcgctgtggcaccaggctcagcgtttggcgggcgggcatcagaaatggcatgcagtcattgaagggcagcgtgcccacgaacgccnnnnnnnnnncagctccaccatcgtgcagccctcccgcgcaaagaactgtggggcggcgggtggcttggcatgtgatcgtcggcagagccgctgtggcaccaggctcagcgttcgacgggcgggcatcagaaatggcacgcagtcattga

SEQ ID NO: 6905 - DNA, 2139 bp, Chlorella protothecoides
  modified_base (60)..(69): a, c, t, g, unknown or other
  modified_base (207)..(216): a, c, t, g, unknown or other
  modified_base (336)..(457): a, c, t, g, unknown or other
  modified_base (1282)..(1291): a, c, t, g, unknown or other
  modified_base (1979)..(1988): a, c, t, g, unknown or other
atgcaggcggccgtcgcgccgcaccccactgcttccccacccccctgcgcgcccctcccnnnnnnnnnnggcggtcatcgaccggctggaggtggggcggtgtgtgggtataattgcctgctgcatctgccccggagtggggggatgcaggcggccggcgcgccgcaccccactgcttccccaacccccccctgcgcgcccctccgnnnnnnnnnnaagtgctgtcgtcgtcgtcgaggcccaaatccatgtgccactgcccactccccccaggtccgggccgcctacatcgacaaggtctccgccaaggtcctggacctcttccgcaactactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacccagcgccgccgtgtgacctgcccagacctcatcctcagcccttccaagcctcccttccctctcattcaacatcacaaccaccacaggagaaggtgctgacggaggccgacacgctgggcgcggccgaggcctcctcctccggcggcgtgctgtccttcttccagcgccccgcccccgcccccgccgccgcggcctcggccggcggccgcgccgacgccttctcgctgcaggatcgcgcgctggtgctgagccacgtggagggcccgcccctagtgctgcacgcggcggaggcgcgcggcgcgcgcttcccttacgaggtcctcttccgctccgtgaacaagctgctgatggacaccgcggcgcacgagtacctattctgcgccgagttctggggcgatgcgggcgtgtacgcagcgctcttcgcccccgtcctggccttcgtggagtcctcgctggcggcggccctggccgagctgcatgaccccatcgccctgctgctcatggtgcgcctgaaccgggagtgcgggcttgccatggcgcggcggcgcaaccccgccctggacggcttctacgaccgcatcaacctgctgctctggccccgcctcaaggtgttggggttgtcggggcggggtggagtggggaggggggtggggttggggcagggaggttggaggatgtgggatggggagggggcaatcctcggggcagggcaggggacctgggagtcggcatgtgctggaactcatgggtcgcaggcgactggcggtgtcaacgacggatgggccagaatgtcaatcaggacctggggcatcacatgcnnnnnnnnnngtggtgtgggggtggggcagggaggttggaggatgtgggaggggcagggggcagtcctcggggcagggcaggggacctgggagtgggcatgtgctggaactcatgggtcacaggggactggcgatgagcatgcaaacggtgactcagtcatccctccccacctaaccctcccaccccccccaccgcacatccctttaggtgctcatggacgcccaactggcgtcggtcaaggcgatgccagtcgacccggggtccactgccgtccccatccccgccgtccacctgctggcaggtggggcctggagggccgtgcagcgagaaggccttttgagcagtatgatcctctgcagccacaagtgcagcctccctgtcaaaagggggtcctttgggtgtttgaacacgcatccagcgccccctcctggcagctcaccgtacactcctttccccacccggataacgatggcacagagcggtatgctgccctcacctcggccctgctcctgctccaagcggacctgcccgaggagcccctggaaagcaacacggagcgcctgcgatacgcaggtaaggggtcaggtacttgtctgccatccgccggctgtcagctcggggaggggaagcagccagggatggatctggcggccaggggcagcagagcacatgcatgtggtggtctctcagctgttannnnnnnnnnggagcgcctgcgatacgcaggtaaggggtcgggtacttgtctgccatccactggctgtcagctcgggaaggggaagcacccagggacggatctggcagccaggtgcagcagagcggatgcatgtggtggcctttcagctgttgaggtatga

SEQ ID NO: 6906 - DNA, 609 bp, Chlorella protothecoides
atgcctgcgccacgcaggaagggcatgctgcggggcgcggccgaggggcaggcgtctgcgctgccgtgcgctccgcgcatgccgccctccacgccaccgctcctgccctccctgcccgggtcgctggcggccgcacaggcggccatcgcccccgccacgatgcgggaggcggtgcggctggagggcgagagcgcgcccgacgcggccgggtcctacatcatcaacatgctggagggcaagctgcggcggctggcgcgccaggcacgcgcggagcgtcgtgcagcgcagcgtgcgcagcgcgaacgccagcgcgcgcggcaggccgtcgccgcggggggggagtccggggcgggggaggccagggatggccctgcatcaactgggcctgtccccaccgactccgacacggcgtcggcggcggataaagcagggctggactccgccctggtcatggaactcgccccgccgggcccgccccccagcatctcgctcctcctgcgagatccagaggtggtcttcttcttcgtcctgaccaccgtcatgggcctgggccatgggctcatcggctcctacctcttcatgttcatcaagcacacgggtgggtgttga

SEQ ID NO: 6907 - DNA, 459 bp, Chlorella protothecoides
atgaacgccctgctgagcctgagccgcttgctgcccagcaagcgcgccggcaccgtcttcctcatcctgaactttgggcacattgtcggcgtgctgcgtggcaccgcggcccggggcctgccccgcacgggatccctgtcgcagcaggccatgagtcaggctgcgtcgggcggcggccagggaggcgcaggggccaaccccgccctgcaccggaccagcagcagccacggggcagtggacgcaagccaggggctgggggcctcgggcgcggccctgctcaaggagattgaggaggggctgcaccgctgcaccagcatctacgtggacgacatgctgggcggggcgctgcctgagctggtgagtggagcctcgaaaccgagggttttaaaccctgggagctcggggccaactgcgcttggccatgcgcggaatcgcgccgaggggcgcagcaaggcatga

SEQ ID NO: 6908 - DNA, 765 bp, Chlorella protothecoides
atggcccctgtggctggctttgtgaatgggaggtggggcatccgcgctgggatcgcggcgtacacggccctcgccctggccgcccttcccgcggcccttaatttgccgctggaggccctgcagggctcccatggacccgcctcgtccggcgaggctctcggcccaaaggatgtggaagatctgcatgcccccctgctcccacctgggacaacagagcaggagcccccttctccaaaggtggacgtggaggcccctcgctcctctgccctggcctccgccctcgcaatcgtacgctacatagagtccatcacggagatgggcctggtggcgccgacccccgggctgtacggctttgccgaggtgtcggggcccttcatgcagcgacacctggcgcccccagagctggtggcaggcttcgaggcggaggaggaggctcagcgcgaggcgtcaaggcatgttgagccggccagcccctcccggctgcccaccatccgtgaggccccctcgcagcggtccctgccgctgcctgctgagtccctgccccgcgacgagcgcacgctgagggaggcggcctcactcctcagcgcctcggtgccggccgcgctccagcgccagccctccctgccccgccccatcagcttgggcaacctgcgtggggcagggagggcccagcgccacgtcctcgccacctccgaggtgggcgggtcggcctggcgctcgtgggcatgttgcaaggtcctcagcgggtcgtcacagggcaggtga

SEQ ID NO: 6909 - DNA, 372 bp, Chlorella protothecoides
atgcagggcaacaaggccctgctgtggcacgacccacccgctcacaactggccctggcgggatctcgatgggaggtgccccctgatcaagcctggtcctaatgcgacgcaagagctggagcgcctggagcacgcctttgacagcgtgaagcggcagctgttcaggcggctgcacgccaagctgcgggaccagctcttcccctccccctccgcgccccgcccagaggggacgttcctggaagcccctgccgcaccgcctgcggccccggccctggagccgggaattggagtgctgccgagaggcagccagcgagaggctgagctcgtcagctctcggagcaggaaacgagccagcctggagaatgggtcgtga

SEQ ID NO: 6910 - DNA, 393 bp, Chlorella protothecoides
atggccgcgaagaaggcccaggtcctgaacgatatctttgaggtgctagagatcgaccccgatggcaagaagtttgataaagacatctaccccgtcgacctgggcgacaagctggccctctgcctggccaccaccctgaacacggacggcaccccctccggcgccagctacgactccgtccgccccaccgcgcggcgcaccctggcggacgacttcgagtacgtgatgcacggcaagatcttcaagttcaaggacagcagctctgggggccaggtcagggccgaggtctttgtcagctttggcggcctgctcatgcagctcatcggcgaccccaagcgcctcgctgacctggacgtggatgaggacatcttcctgctgctgaagaaagtatga

SEQ ID NO: 6911 - DNA, 408 bp, Chlorella protothecoides
atgcccgtgttcaaccaccacgcgggccacctgtcggtgaactggagcagcaactacttcctcgccgcgcagcgccacccgggcgtgccggccctgaaccccgcacacctcgaggccatcgcgctggtggacgcactggccgccagcgacgcgctgcgcctggacgccatgctggcgccgggggacgtgcagctgctgagcaaccacaccgtgttccacgcgcgcagcgccttcaccgactcgccggagcgcaagcgccacctgctgcgcctctggctggcgccggaggacgaccggcccctgcccgaggcctacagggagatcctgggcgggtcggtggaggtgggtcggcgtggcggcattgtggtggaggggaccagactccacgtccccctggaagccgcatga

SEQ ID NO: 6912 - DNA, 876 bp, Chlorella protothecoides
atggtgcagacggcagtgcaggcaggcgtggatccgatggatgagccttccagtattccagcaggctacggcgctgaaaatggggaagacctgtctctggggctgggcgaacttgatctcaccaccgagcacctgagcctggcggggatagaaaaggatgtagaagctctagccgaccacgaaggctcgtctcacacccaccctccccatggcctgccatcagggctggaccctcgcgagtatgggcgcaggtacgaggacgagctccgtcaagctgagctggcctccatcgaggactacatcgcggaggcagacaccctcatcgcccttcacacagacgcaggtgacacgcgccgcgctcatgcgccgacacacctgcagatcaaggagtgcgacgacatcctccagggcgtggaggccacgctggcgcactttcagaccgacctggggagcatctccagcgagatccgggccttgcaggccgagagccagagcatgaatgccaagctgcgcgaccgcagggcgctcaaggtgaagcctggactcctggggcgtgcagggaggcgggagtctctggaggactttgtgggtcgagtgagcctgacgccggacctcatccatggcatcgtccagtcggatgtacagagcgaggagttcctgagcgccctgcaaaccctgggccggaagctggcctctgcagctcgggacccggacctccaggggacagtggctctcagagatgtggcgccagagctggagaagctcaggatcaaggcagtcgtgaagagcagggacttcttgttcgccaagatctgggacttccggcgtccccgcaccaacgtccaggtgcaggggtggtgcatcctgctgcgatga

SEQ ID NO: 6913 - DNA, 963 bp, Chlorella protothecoides
atggcggcatcattcccaacagcagtgcaccagaggcacaatgtggctccaggatcccggtctcggataccaggtatcacttccgccagcaatgccaaaactggactggcgcgccgtggcgagcagcccctgcatgtgaagcagcagcgggccacccagcagcggttgcatgcgggacgacaagccggcggtgttctcgaacgatctgtggcacccaccgaggctcccgacacgcagctgcgccccgtgctcaccgctgccgcatggaccgcggcggacatgcgtgccagggagcacgagtggacctaccacctgacccccaatgacatccaggagctggatgaggctctggttctcgccagggcgatggggaagcccatccatgagctcacccaggaggactttcccctgcccttgctggcacccaagctcagggccttgggctccgaggtggtccacggccgcgggttccaaatcatcaaaggtaatgcagacggatattgggggcatgaaggagtgggtcaggcttcagtgctgctcccaggggtgatactgacgtccgcaaccagtgcccctcgtccagtttatgatccccccccctccttctctataccaatttcccccatgacaggcgtccctgtggagcgctggagccgggaagagagcgtgacggcatactggggcatgggtctgcgctggggccgcgccgtgtccaacaatgccgcggggcacctggtggggcacatcaaggacattgggcacgacccgctggaccccggcacgcgcctgttcgcgacgcgcgcggcgcagcccttccacaacgacgcggcggacgtggtgggcctgctgtgcctgaccctgggagagtccggggggctcagctcctggaccagctccgtgtcggtgtacaacgcagtgctggccgcccgccccgacctggcgcgcctgctgacccagccctag

SEQ ID NO: 6914 - DNA, 306 bp, Chlorella protothecoides
atggtggagctgggttgcgaggagcatgacaggcaggcggcctccacccagttcatcacccacaccgttggccgcatgctgggcgagatgaaggtgtggtgtggaggaggaggggcaggacctggggtgggactggctgatgtgcgcgggatgatgtgccgtgtgctgggaccccttgacgcagatcgtggacgagctgcctcccccccgcttcccgtgctcgcagttggaaccgacgcccatcgacacccgggggttccagtcgctcctcagcctggtgggcaacaccaacaacgattcctttga

SEQ ID NO: 6915 - DNA, 1182 bp, Chlorella protothecoides
gcccgccgctggccgccggcctgcagcagccgggcggggcgccgccgccgcagctggaggccggcgccccggtgcgccgcgcgccctgccctccaccgtgcgcctgaacgagccctgcctggaccggggtgcgctggacacagtggggttcctggaccacctgcgccgcctgtcctggtaccgggaccaggtggtccactgcgagtgggtgccggcgcgcagagcgagctttgcggagccttcgggcggcctgtcgggggcgctggcggcggcgctggcggcccagggcgtgacgcggttgttcagccatcaggcccacgccgtggacctgctgcgccaggcggggtgccaggaccttctgaggctcctgggccactgctgcgacccactccctgcagggccagcacaccgtcatcgcaacttccaccgcgtccggcaagtccctgtgctacaacgtacccatcctggaggccatcgccgcggacccatccgccaccgccatctacatgttccccaccaaggcactggcccaggtgggtggtcgggtggagggcgggcaatcctgtcgctgtgtccaattgcggagcacgaaatgccccgacgggcatgagcaccttgcacatgcacaccatgatgctgggccagctcagcctgatgcgcaatccctcgcctgcatcgccggcgtcgcgcgcaggaccagctgagggcgctgcgcacgctttgtcagcgcgtcttcggggacgccgctccggcggtggaggtatacgacggcgacacgcccaagagcgagcggtgaggtcggcgtgggcttgcgctgaggtggtcaggttgcttgctgggaaaggggccggtctgacgtgcgggtggcggcgattcgcagcaggcacactgcggaattggttgagctggtccgtgcaacgcgcccaggtgtgcacgcttggtgcctgcccagaatgtcatcaacatcctcagcaccccaccgccccctacctcctctatcccaggggtcctatccgagaccgagcgcggttgctcatcaccaaccccgacatgctacacatgagcatcctccccgtgcatggccagtttgagagcctgctgcgtggcctgcgatatgtggtactggacgaggggcacgcctacaaaggtgcgggaatggggggcggggcaggaatccggtga

SEQ ID NO: 6916 - DNA, 1677 bp, Chlorella protothecoides
atgacagaggtgcaggcctgggaaggaaggtgtcgggcagaggggtgggcgcgtgagcagggaccttgtagaatcgtcgtcgtctgtgcctgcttgccatgcggcatacaagcctccctgctatggcaccctgtgcaagtccagggcggcatgccgtctttccccgctccgccagccgccacgcccccacccctagatccaggcgtggacgccaaacccgaggaggctgtgcacctgctttccacctctgccacctgcgcacctgccaccatcaccatgcggttcctgggtttcaaacgtgtctggcgcggcagcggcgtcggtgagcacaaagctggaaagggaggattgcttgggacatgggtcggcatgtcacttgcaggttctcctgaccttgcttcctccctctgcttgagccgttttagatcttatcgacccctggctctccccatcatccgtgccacgcagtgttcgaccgtgtggagctcttcctcccagacatgcgcttcagcacggatgccacatacatccgcctgccccacatagcaattcagctcctgtgtttggggcggagccaacgaggctcacaccacatgcgcaccagccctctcatccagagcaccgcgattcatctgccgccctgctccgcgcaggcctgggcttcagggagagcgtgcatgctgctgcgcatgctgtgctgagcgtgctccccctcttcatcatgtgcgggtccaacgacgtggcgacaggcatgcaaggctggtttggggtggtggaagattgggcacggtgatcgaggcatttcccgacatgccagcccccggagccctccagccccatgactgccatggcacgtctgcctgggacagaaaacttcccaaacatagaccctccctcccttttcctcccactctcccagagtgcgacaatccatatgacactcggtacaagccggagcggctccttatctacgacaagcacccgggaggcataggcctgtgtgccgcggagggattttgcctagaacaccacatcgagggctgctctgctgaaaggccagctggacatctggcccggcctacaccacacctcccaggcagcaggcctctttggtcagatcctgatccgggccctgcagctggtggaggcttgcgaatgcacctcggacattgggtgcccatgctgtgtacagcacgtgtcttgcagccagtacaacacaggtgcgtcgatgagcagctgtgcttggagggtgcggcggcatgggaccgtgcgcctatgctggcagggaaacaaattacagtgctggcatgcagaaccaacaaaaggatggcgcccatcatgccattcaaccaaagatcaaccttgcctgtaatagacgctccacaatcctcccccctttgcagtgctaagcaagcctggcggtgtactggtgctgcagaccctcatcaagtgggaggaggaaagggctgctcagacccgccaattggagcttgcaagggaagaaggagcttgaatagtgctgatggtgcttccttagtagttttatggtggaggggagtgaaccatggtcttggttgcagaggagatggctgtgtggtgcatgcggcctgtggacccagtgccgacggcatcaaggatctcggccggtatttcatgcgtgctcgccccgcgacatga

SEQ ID NO: 6917 - DNA, 603 bp, Chlorella protothecoides
atgcgggtgggtggggcgagtggttgggtcatgctggtgctgggtccaggaggggcagccgtctttgggatccgttcaaggaacagggccaagcgtggcggcctcgtctcctctgtcgtatcctctaagtccacccatcccccccaccttccatcctcaccggcagactaccccatcgagaggctggcgctgaggagcgacggacagatgctagcgagtgcctctcacgaccagacggtgaagctgtgggaccttgccgacgaggaggaaagcgaggaggaggggggcaagaaggaggaggagggcgctatgtccaagtgtctaccagcggaggaggggagggggggcgtcctggaaggggcagaggctagtgccagccccgaggccgacgcgcttgggtctggctcaagtgccgagcccggcagcgacgaggggccggcagagggcgcgagcgagggcggcgacagcagcgaggagtcctcctcttcagacgagggggatgcctgggagaggaagcggcggcgagggaagggggctcaccgtatccccagcaagcaagtggctaagaagcagtccagtggcgcattcttcgccgacctttag

SEQ ID NO: 6918 - DNA, 480 bp, Chlorella protothecoides
atgcaggccgtgcacacctggacgccccatggggactacgtctcgggcatgacctggcacgagccccagcagtccctgctctccgtcagcggcgatggcacgctggcgaggatggaccccagggccaagaaggtgagctacatgcagcatggcgagattgggaagggatgtggggcgaggggaggcctgagtgagggcctggctcgtgcgaggggcactttttcgtcgccaaggggtgactgctactggcgcaggtatccggctgctctgggaacttgcgttccccactcatgccatgccctcccccgtctgatgcaggtgaagaacaagagcgatgatgacgtggatgacgagctgctgtctgtggtagttgtgaagagcggacgcaaggtgtgcacctctttcggcgtatttttccaccgaccctttgccatctcttcctccttcatgtggaggaggattatgggcgagtggggctga

SEQ ID NO: 6919 - DNA, 774 bp, Chlorella protothecoides
atgcatccccaggcgcagacgcgggcccgccacggcgcggcgggggtgcaccaggagaaccggcgcggcagccccatcatggagctgagctgcctgctggcggaggcggtgcagcacggcctccgcaccctggccttctgcatgactcggtggggcctgctgaggttggggatgggaggggggaggggatgggagggggaaggggatagtcggcacattcccagtccataccacatgggaccccccctgtgccagcctcgggcctgctcatgcaccccgccctcctctgcattcaacatgaacagcaaggtgtgtgagctcgtgaccgcctacgtgcgtgagatcctccagcacactgcccccgggctggaggaaagcatcgccgtgtaccgagcggggtacagggtttgggaagggctgctgctggaggcctgcgtcggggtggtgtccatccttccagcctctcccccttcttccctcgctcccattcccccttggtcgccccccacctcccccctccccatcaccactcccagcccccaggagaggagggaggtggagcaggcgctgcatgacgggcgcctgatggcggtggccgccaccaacgccctggagctgggagtggacattggtagcctggacttgaccctgcacctgggcttcccgggttccgtggcatcgctctggcagcaggtgggcgggcgtgtggcagtggggcgggggggaggagactgcgtcgcagagcgaggggacggcggtgctggtccccgctga

SEQ ID NO: 6920 - DNA, 396 bp, Chlorella protothecoides
atgagcattctcatcggctgggagagcccgctggaccagtacttcatggcgcagcctgcccgcctcttcggccggcccatcgagcacgccaccatcgacccggcgcagcccatggtgctggaggcgcacgctgtgtgcgccgcggcggagctccccctggtcctgaccccagacctggacctggcttgcttctccacaggatctgccacgctcacatcctaccgctgcgccctggctcaacgccccgctgcagccctgcgtccggtgtgcgagaacctgaaggccagcgggctgctggggaggcaccctgggtcggcggcagaccactccatgctgcactacacgggccagttcagcaacccggccgccaagatcaggttcaggggatggaggtga

SEQ ID NO: 6921 - DNA, 243 bp, Chlorella protothecoides
atgcctgcacgccggcactcccacatccacagtctcagggccatcgacccggagcgctttgccattgtcaatgaggccgcgggcgggacggtcctggaggagatagaggagagcaaggccttcttcgaggtgtacgacggagccgtctacatgtaccagaggagggggcccacgctttggggcggcatgaggaacgataccatcccaagctctgctgctccaacccacgagaccatgatgtag

SEQ ID NO: 6922 - DNA, 879 bp, Chlorella protothecoides
  modified_base (124)..(133): a, c, t, g, unknown or other
  modified_base (776)..(785): a, c, t, g, unknown or other
atgacagtgagaacgggtgacggcgtgcattgggagccgccatcgcatcccggcaagcgaagtctaaccccctcagactgccgccgcacgacgacggctgcgctgcgcgcgctgtgctcgaccnnnnnnnnnngccagagggatcggacacggtggggtctggatgacagtgagaacgagcgacggcgtgcattgggagccgccatcgcatgccggcaagcgaagtccaacccccctcacactgctgccgcacgacaacggctgcgctgcgcgcgctgtgctcgacccctggcacacgtggcccattctccctcacaggcccctgagatcaccacggagagctcgcaggaggcgatgtcgctggcggagcggctgcgagccgcgggggcccgcatgtacggcgccttctggtgcagccactgctacgagcagaagctggagtttgggagggaggccatggcggccttcccctacgtcgagtgctaccccacgggctggcacccggtgcgcgacagccttggcggggtgtggggtgcggccgccacctgggggccggactcccactgctgcagcggcggaccccctcccgccggccatcgaacgacgtgggatggtgggattcgcacgcggcaccgcctgctcgacgacacccttccaacacctcctctcctcgcagggcatggagcccgacgcggcgtgcacggcagtgccggggggcctggagggcttccccacttgggtcatcgggggcaagaagtcggagggcgacctgacgnnnnnnnnnnaacagcattggcggggtgtggggttcggccgccaccttggggccggactcccactgccgcagcagcggaccccctcccgccggccatcgaatga

SEQ ID NO: 6923 - DNA, 3000 bp, Chlorella protothecoides
  modified_base (741)..(750): a, c, t, g, unknown or other
  modified_base (2618)..(2627): a, c, t, g, unknown or other
atggcgcctgcttccaggtcggctgtgtgctgtggtggaggggtgcatgtattgctttccttgttgcacccaaagttgcttgctgtcctctgggctcggcgcggggtgcaagggtgggtggctggcgcacaaggttgggtgggtggggccgagcaccggacgcccgcctcccaagcacggcttccctttctctggcaaccccaacccatcccatctttcaacatgctgcagggcttcctggccgagggcctgcagcacacctctgcgggcctgggcagcgtggtgatcgacagccagccactgacggtggccctgttggccgcgctgctatacggcgagcggctgacggcgctggggtacgccgggctgccgctcggcgtactgggcctggccttgctggagatcccgccctcactctgggcctcgagcggcggggactccctggacgccgccgccgcggccgacgccgcgctggggccggcgctcatgctgctggcggcacagagcatggcggtgggcaccatcatgatgcggtgggtggcctccaaggccgaccccgtggtggccaccggctggcacatgatcctgggtgggctgcccctggcggcactggcgctggcacgcgagggcggcgacctgccggctcgcctgatcgccgcgacacgtgagggagggggtcaggattttttgcggggggcaggagggtgtgtgcgtgtcgttgcgagagggtctggaggtgcnnnnnnnnnngcgccgcgacacgtgagggagggggtcaggactctttgcggggggcaggagggtgtgagcgtgtcgttgcgagagggtctggaggtgccgccatgtaccggcactcccctgatcgctgatcatggacagttctggcacctcgatgggcagcccgcgccagacagcacacaccagcgacgcgctgctgctggcctacgtcacgctgctcggctccgcggccagctacggcgtcttctacctgctggcctcgcgggggaatgtcacctccctgtcctccctcaccttcctgacccccatgtttgccgcggcgggggggttcatcttcctgggggagaccctgactctgcagcagctggtgggcgcggggttgaccctgggcgccgtggcactcatcagcctgaacggcaaggagagccaggagtgagaggtccaggaggcggagtcgcggcccgctcgcccgtaacgacatctcccccaaccatcgatgaacctcgcgggtcgcctgcccccaagtatgttgcacccactgcatacccaactgtggcgctgcagggctttaaaggttggcaggcagtgccagggcatgcagctggtgtcagaaaggagagggaatctccactgaatggagggtgtgcggggaaatcgctggccgcagtggaccggactctcagcaccctcgagcaaaatcagcacaaccagagaacacacgtctcacgaaacaccccacatgatacaacagccgtcaaaaggggcaggctccttcaaaaggggcaggctgcagctggtgcacggggtggctgctgggagcaatacaagtcggcctccatgcacgtctctttgactggagggttggggggtctatctctcccctcctggcacattattgttcaccagcgtgacaactcacgccgttgccacctggctccgggtctctgtcgcattggcggcctgcttcgcccgccagtccttgactgccgccttaatggcgtcctctgccaacatgctgcagtgcagcttgacgggtggcaagctgaggtgcttggcaatgtcgctgttcttgatggtcagcacctcgtccaccgccttgcctttcaccctgtggagagtgtgcaggggatgcagctcagcggtgaattcgttgcaggctcaccactctgtggccacgctgctgctggcaatggccgacccacagccaaacgtcttgaagcacgagtcaacgatgtttccctcctcgtcgacgcgaatctggagcttcatcacatccccacacgcgggggcgccgaccaggccggtgcccacgctcttgtcgctcttgtcgaagctgcccacgttgcggggctgctcgtagtgtgcagcctcccctgttcagaccgcggctctcgaaaacccagcggaagcatcacaccacccacgttcttatggtatgcccgggcgctcgtcgaaggtagcgaggaggcgagcaccgcagtgcggcttcctactgcacggagcgcgctggaagagaggcgggagagcatccctgtatctgatccacacgggtccggagggtggacgcaacttcagttcctggtttgcgcactgcgagtactaggcgagcccgagccggaagtcaaagcacggctcagtgctgagtacctggctgcctggcaggcaggagaactgggctgcaccgacctagtatcgcaccatggacacgttccagaccgacccgcgagggccgatgagaaggtagcttgctttcatgtggggctgcaccgctggagtgcatgggatctgcatgcatgcagggtgcctccctgggtccagaccctgacaacccctccctcacagaccatgtcatgttcaagatgcacgacggcagtgcaggnnnnnnnnnncaaggtagcttgctttgatgtggggctgcactgctggagtgcatgggatctgcatgcatgcatgatgcctccctgggtccagaccctgacaacacctccctcacagaccatgtccatgttcaagatgcacgacggcagtgcaggcgcagggagagcattgatccctgctgacaagccaagagcactgaggactcacctccctccaccaaccccccccccccctttctcagctccagctcgtagagccatggaagctgaagcgcgggaagggcggcagcctggcctcccgccaggccctcctccactccctcgtccacatcgagaactgggccgtggacctggcctgggacatcatcgcccgcttcggccctga

SEQ ID NO: 6924 - DNA, 843 bp, Chlorella protothecoides
atgcccgcaggctcgtcaggctcccaggcggaagccgctgggggcaccccgccccacatccccgcctgggtgacggaggccagggcctacgagacagtggagacctggttccacgcgctcatacgtgcccacttccgtgggccgctgaagccgcccttcaacgatgccgccagggcgcaggcggggtttgggccggagtggtacctgccccttgcaactgtgggaggcaggagctctgtgagtgaaaagtcctcgcatgagcgcaaagagttatgggaatggtggccgtgggccccctgcaggacgcagatctcttcctggagggcgacacaaatcaccgctggcgatctgtgcaccgtaccgtcccggggggtggcgatggccgacgcaggcagcttgtggtggcctcccttcgcccaggtgtcccatgaactgcgcacttgcagtgcagaagatcagctgcagatcctccagaagtacgagaagtacctgacagcaggggtgggccactttcgacagcccagtgccgcctccaaggctctcatacagggcaccgcccctctgaagctgccggatggtggaacctttccaccggtctccgaggtggcatcggcggtcctccagctcagcgccgacctggtgcgacggtggtggggccctgcatctgggtcatgctccccagatcgcctacatcatcctggcacgttcctcccgacactgggtccgcgatcgcggggagcgctggctcaccctctcacagcgcaccgccgtccacaccctgtactacagcgagcgcctgcagctgctgcagatcgtgcaggacctcctggaggcgggaggtga

SEQ ID NO: 6925 - DNA, 1146 bp, Chlorella protothecoides
  modified_base (746)..(833): a, c, t, g, unknown or other
atgactcctcggagcccacaagtgaaggctggggaccacactttagctgagaaatccaccccatgctccttccttaggtctacctccccccgccgccccctcttccttgcagaccagccgtcgttgtgcgaagggctgtggcagcaggcgcggtccagcgacgcgccgctgctctcctacctggacggcctgcgcgccctgttccccgctttcccctcgcccctgtaccgcctgctggccgcgctggcctcctcccccgtctccgccgccgccgccgtggcctactttgcgcgcctgcccggcctggccaccctgcaggcgctggacggggacgtcgtctccttggaccctggcgaagggacccgcgtcgtggccggcagggatctgcgcctggacgccgcgccgagcgtccacgttcccgaggggacccagggtgctgactcacagaggcacaaacctttggtgggtggggcaatcgtttgccgtgcctgccctccaagactcccaacgtcaccccaacacaaaccgcagggcgtgccgggtcaggtgctgggcacgccgcccgggttcctggagctccccgtgacgtgggccacggcggcaggaaggcacggcgcccaccccgacctgggcctggtgggctggaccctggcctgccccgaggccacgggcttcctgatcctgatcgagcggggcctggcggcgcaggacgcgctgcgtgacgcccccgccgcccccgccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagctggcggctgcgctggcgctggttgcgcgtgtcgtggcggccgacgccggcctggccctggacctactgcacatagcggcgccggcggccggcaaggcggcgcgaggcgccggctggccgtccggcggccaggcgccggggggtgcggacgtgctgaccctggccatcagggtgctggcgggggtgccgctcgcggggcgagcgcgattcggtgccttggccgaggatgctgcgacggcagaggacggctacgacgccatgctgggtgggtgcctgggtgcccggggggctggtgtacattgcgaatga

SEQ ID NO: 6926 - DNA, 753 bp, Chlorella protothecoides
atggaaaatactgatgtcccgaccggagctcgggttgagacagccgccgtcgcttcctcggggcctcagtgtccgtcagatggcccgatggtggtcgcggatttgaagagtgtgagcgcgggcttcctcaagccggcgctcaaagacctcatctcctgcgagctgaagggttggggcagcagcatgtcgccgcagtccatcccagccgcgctggggccgtcgccatcagggtccacccccagcgagagcgacccccccagcccccgggacctgcctggtatcccctcagcggacacgcacgcagactcgggtcccccaaatggctcggcagccgagcctggggtgcccgacaccctcgggaagccccctgcagcccctgcagcccctgccctgggcaccagcggcgaggcagagctgctggcactgctgcagcgcctggcggccctggactccgagggctggttccaggcccccgtcagcgacatccaggccccaggctactcctccatcatccggcaccccatgtgcatccaggccatgcgcgccaaggtggcggcgcacgcctatacctgttggggcgactttgtgcgcgactttgagctgctgtgcagcaacgccatgcgctacaaccagaagcgctcccgcatccacaagcaggtgggggtgagggttgggaggattgagtggtctggtcgtatggtgtggggctcgggtgtggatcagtgcggtttggcgtctgccagatccctataa

SEQ ID NO: 6927 - DNA, 513 bp, Chlorella protothecoides
atgctcgaccatctaccctctcatcccctcccctctcccttgcatctgccttccttcccctcagtggcttgggcagggaactgggaaggcaaggctccatcacatgtgctggccccgtcaccccgttccgactcggtcatttcaaggcgcgatggtcaggcgccaggggcagaggcaagcagcaccatgacaccagagggaatgcacggcgaggagcacctggcgtttgcgctcacggacggcagagtgggcatgctcagcgtgcgggggcggcgcatccaggatctaaggccctgtgccccccatcacctcgagctggaagaaggaggtgggattggaagggggggccgattggcgtggtggacagtgagaacgagggtggtagctgcagatgtggaatgtatacatgacgatcatgccatgaggttggaggcccaagccagggtgaagtttgctgtcatggattcaatccgacaggtggcatccaggatacccctcctcgtgcagatgtga

SEQ ID NO: 6928 - DNA, 573 bp, Chlorella protothecoides
attctggtgtttgatgtcgagtacgggcagccggcggcctccacccagctgccccccggcatgcgctccccgctcgtggccctgctttcctcctacggccatggagacgcggggccggacctcctccgccccggcggcatcgacgtgctgacctgtcgccacgcggacggcggcctgagcacctggcggcggcgcccgggcctcctcacctacgcctgcctggggacccaccccacgggcgccgcccagaaggcgggcccggcgctgctcagccacgcggcggggttgtggggcggcctcgaggaaggcgaggcggtctccgggccgcggctcgcactgcaggtggccgccgtggcccaggacggcagcctgtggcagtggcagcaggcgctggtgctgggaccggggtcaagttgctcggtgcccctgcgcttccttggtgcgattttgtcgtgcggggagaggcgggggttggccgctgtgctcgcagcccagcctggatcggggctatcttcttcgacctgccgtcaatgctgtctggggctgtgctcgcttgacagggaccaaggatag

SEQ ID NO: 6929 - DNA, 2157 bp, Chlorella protothecoides
ttcccccgccccgccggccccggcggcgccgagtccctggccccgcccccgccctacgcgtccaccaacccgccgcccggcgcgctgcgcttctccaccgccgccgtgcccgcctcgcagtccctgcgcgcgcgctggcacctgcccttcggcgcggtgctggcgccgctgagtgaggcgggcggccccgtgccggtggtggatatgggcggcgcgggcatcatccgctgctcgcgctgccgcacctacgtcaacccgcacatggcctggctggacggcggccgctccttctcctgcaacgtgtgcggcacggtgaaccagacccccgtggagtacttctccgcgctggacggcgcggggcggcgcctggacctggccgaccgccccgagctgcgcgccggcgcggtggagtacgtggcgccccaggagtacatggtgcgcgcgccgcagcccccggcctacgtcttcgtgctggacgtctccttcgccgcggtgtccagcggcctgctggccagcgtctgcgccaccatccgcgcctcgctggacgccttccacggcgactcgcgcacacaggtggccttcatcacctttgacgccacggtgcactactacgcgctgcgccccggcgcggccgcagcgcccatgctcgtcgtggccgacgtggaggagctgttcgtccccctgccggacgagctgctgggcaacctggtggagtgccgcggggcggtggaggcgctgctggactcgctccccgccgcctgggcgggggccacgggcgtggacagcgccaccggccccgcgctgcaggccgccttcctggtcatgagccacgtggggggcaagctgatgctgttccaggccgcggcgcccagcgtcggcatcggccgcgtcaaggcgcgcgacaacccttccctgtacggcggcgaccgcgagtactccctccgcgtccccgacgaccccttctacaagcgctttgccgccgaatgttcgcgctgccacgtctgcgtggatgtgtttgccgcgggggccacctacatggacttgccctccctgggcgccatgcccaagtatctgggcgggcagctctactactacccgggcttctcggcggcgcgggacggcgccaagctgcgcgccgagctggcgcgcaacctgtcgcgcgagaccgtcgcaggcccggcggcggtagtaagggatgggagggtgggtggggagcaggggccaacgaggcctcaccctcctcccagtcctcctcatgggcaaaccaggcctcaccctcctcccagtcctcctcgtgtgcgcctgggaccccctcgacaccccgacaccctcacaacgcctcgcaggctgggaggcggtgatgcgcatccggtgcagcaagggcctgcgcgtcagctccttcttcggccacttcttcatccgcaccaccgacctgctgtcgctgccggtggtggacgcggacaaggccttcagcgtggagatcgcgcacgaggagagcgtgctgacggggcagacggcgtacgtgcagtcggcgctgctgtacaccgcgtccaacggcgagcgccgcatccgcgtgcacaccgccgcgctgcccgtcgtgggcgacctggccgacctgtaccgcgcgctggacgccggcgcggcggccgccctgctggcgaaggcaggcgtggagcgcagcctggcctcgcgcctggaggacgtgcgcctgggcctgcaccacaaggcactgatggcgctgcgggagtggcgcctgctggtgtcgcgcggggccacgctgggcgcccagcccccgcccaacgccatgctgctgccgcggcgcggccgcgcgctccccgccctctgcatgggcctggccaagaccgccgcgctgcgcggcggcggccgcgacgtcaacaccgacgagcgcatcgcggtgggccacgccatcgtgtccgggcccgtggacgcgctcctgcgcctgctctaccccgccgtctacgcggtggcgggggcggaggcggcgtgggggcggccgggacccgatggctccatcgcccttcccccgaccgtgcccgcgggcgtggcctactgcgaccccgccggcgcctacctcatcgacaacggccgcctgtgcatcctctggctcggcgccgccctggggccggccttctatga

SEQ ID NO: 6930 - DNA, 999 bp, Chlorella protothecoides
  modified_base (11)..(20): a, c, t, g, unknown or other
  modified_base (667)..(676): a, c, t, g, unknown or other
atgtgcatcgnnnnnnnnnncgccgacgcccacgcgttctggaacgcgtcggggggctacggggacgtcttccccagctgggactccacccacgtgccggcggtgaacctgctactgcaactcgccagccagggtgcggctgtccccggccaggccgagtacgagcgctggtacacctcgacattccaggcggcgtggctggatcccaaaggcaagcctgctgctgtacccaaggggtgggtggggctgggtggtggtgcaatggctgctggccatcaccaaagcgtgttccgcggtgcaagtgcccgtctcccctcgtctcggcgttcgtccattggaagcaggagtgttcttctgcccctcctcaaccttcctcctcaacccctcggtacgtccccggcccccacagcgagcgtgaagctcaccaggaccccgctgggcctggtataccccacctggagcacctggggtatcctctcctactccaccaacgctgccttcatgatggcgctgcgtgcctcctactcagcaaacgacagggagtcagcgctggcctttgtccggagccagctgaactatgccgtgggtagcacgggccggagcttcgtggtggggctgggggtggacccgccgcggcagccccaccacgccgccgcctcgtgcccannnnnnnnnntgctggcctttgtccggaaccagctgaactatgccttgggtagcacaggccggagcttcgtggtggggctaggggtagacccgccgcgtcagccccaccacgccgccgcctcgtgcccagacctgccggcggagtgcggctgggcccacttctcggccgcgggggcgaacccccaggtcctgaccggggcgctggtggggggtccgccctcaggggatggatcgtatgtggacctcagatccgattacaagaccaatgaagtggcaatcacatacaatgccgggttcgcaggagccttggctggcgccattgccctggcctga

SEQ ID NO: 6931 - DNA, 414 bp, Chlorella protothecoides
atgggtggcggtggttgtagcgggtggtgggggatcgatgatgtgcgggtcacggctgagtgcgtgagggggggcccgcccgccgccgacgcggccgacgccgacgccggcttcctcagcaccccatcctctccatgcacccaaggtgtttggcagcgcggccgatgccggccaggacccgggccagctgagcctggagccggcgcgccccggctcggagctgtcggcgcgcatcaacgccgtgctgggcgcgctgcgcggccagcgcgagctggctgctacgtggtgcggcagggcacgcctatggaggcccacgtggcgccctacttcgtggaggacgcgctgccctcctcggccagccccggcttcttcgagttcatgcaggtgctgcagaaggacatcctgggaaagtag

SEQ ID NO: 6932 - DNA, 1776 bp, Chlorella protothecoides
atggccgggggcggcagccgggggcgctacttctgctatgccatccccgccggcgggtcgcggggcgtgtacgtcgacctgcgccagaccgtgctgctgcacatcgcggtggaggagatcggcatgcgcagcacgaaatgggcgctgtgctcctgggcacagcgcgctgtggtgggtgggcgagccggcgagccgggcgaggccaccatgacgcagaggcaagctgggttggttcgtgcgcgaggggtggaagggggcgcttcaggagactggagcatgtgggcctcgactctgctgggaccatcccgtggcgcaggtcccacggcaggactgccccgcgaggctggagcacgtgggcctcgactctgctgggaccatcccgcggcgcagatcccacggcaggactgccccgcgcgtcgacctcctgctctgtccacggtcgcagattcgagcgactcgcctgcacggctcacccctccagccctcctcctcacgctcccccgctcctcgcccacgcacaggctgccgcgcgacatcccgctgcgcatggtcagcatggagatgccgctgccggtgctgccggaggacaacgtcgggcagtacctggtcaagctcaaggaggcggcgctgaacctcaacgtgctgcacacgcgcctcgcccgcgacgcgcgtctcgcgctcaaccgccgcgacatggaacgtgcggtggcgcacatgcgcggcatggcgcggcgcatgcgccgcagcggagcgtccctcgtggctaagaaggccagcgcggcctcgcagcgcgcgcgccgcgcgcgcctggggcgcgggagttcggcgggaaggagtggcgaggaggaggacgagcaggtcgccggcggcgtcgactccaccggccccagcttcctctggcgcgagtcgggggtggaggtgcaggcgccggctcggcgcgctgggcgcccggcgcccgggcgcccggacgatggcggcgcgggctcggaggtgcaggcgccggagcgcggcccggattcgcggcggccgggaggccagaccctgcccgccatcagcgagggcgcggagaccctgtccccgcactctcccccgccctcgctcccggccagccccttcagccaggacgcgggcggcccggcgacccgatggaatcagccggcgccgaccgcagctgtagtgccgccggcgggggagcctggggcaggggcatcgccccctcccctgaccagagtctcgcaccccgcccccgccgccacgttgcccggggtcaaggcccggccgctgaagaggtccacctggcgcagtttgttcagggtgggcggcaaggacgcgctgcgtgcggcggactccgccgacgggggcgccacggcggcccagccctcgccccgcccctccgacaacacagaggttgggacgccgcgggaggggcccgcgggcacgccctccaagctgccgctgctgccgcgtggcgctcgcgccggcggctccggcgccgccgcctggagggccggggacgaggacgtgccgctgcgcgagcgcgtggcgcgctttgaccccggcgcccaggacgccggggacgagaccgggttccaggtggtcacccggcccgcggggacgagcggccacggcacgcacggcacggtcagcctgcagccgctgcctgcgagcggggcgggagaggcgggggagggggcttcggcgccgggcgactcggccccggccgcccagcagcagctgggtccgcccccggcggtgccctggtggcggaagctggtc

SEQ ID NO: 6933 - DNA, 783 bp, Chlorella protothecoides
atgtcgctggcgccccagaagtacctgatccagaaccagagcgggctgcgcgtgtactactgggccgacggcccacgcggcggcgtgcgctcgcccgttttctccctgcccaacggcggcagcgagaacctgcgcgttctcccggcgcccaagcgcctgcacttcgcgcacaacgtgcgcggcggcggcggcgccggcagcgagcgcgtcggcgccacgctgcacctccacttcgagggcaactggatgccgctgcgcgacgtggcggtcaacgtggtgggcaagtaccgctaccgcatggcctcccccgccgacggcaccaccgtgcccgtgctggtggacatcatcctggtcggccgcaccaaggtcatcaccctccactcctcgatctgggtggagaacagcatcgaccgcccgctgtcgctgcggctgcacacccccaccacgccgctggtcccgccgggcgcgggcgcgcgcgacgcgcgcgaggcgcgcgacgccgcctccgccgacctcgccgttggcccgctgcgccccggcgccggctgctacctgcccctgacctcggtgctgggcggcctgctcttcctcgcgccggaggggttctgcgaggccgcacgcgatgtggtgcgcctcagcgccgatctgggcgcggtgctggcgcagcagggctacatctcctgcgaccccgaccctgcaggggaggaggagttcccgctccacgttgccttgcagaccacgccggccagggtaagccgagtgtgcatgtgtgttgtgttttag

SEQ ID NO: 6934 - DNA, 1107 bp, Chlorella protothecoides
atgcagggcactgcaacccgccgcccctgtgcacgctcacaggtccaggagaactcggccgtggcggcagcggcggccacggcgaccgtggtggcctcctcctcggccaagctggcccccccgccccccaagcccgaccagaagccagtgcacgacgtggtggcgggggccatggcgcgcgccgcctcgcagtccaccatccacccgctggacacgatgaaggtgcggatgcagacgggcccgcgggcgggcgcgccgcgcggcgccggcccccgctccggcccgcgcctgccttcctcgcgccccgcccggggcggcggcctggcccgcaacctgaacgagttcaagggcctgtacaagggcgtggtgggcgcggccaccggcgcgggcctcatcatcggcacctactttgccttctactccaccaccaagcgcttcctgcgcgagcactccaccctctccgacggctccgtcgcctttgtgtcgggggccaccgccgcgctcggctcatccgtggtcaaggtcccgctcgcggtctgcatccgctcggtgcaggcgggggtgtacaccaacgccctcgctgcggcgcaggacatcgtcaaggcggcgggagtgcgcggcctcttcacggacatcgtcaaggcggccggtgtgcgcggcctcttcacgggcttcctgccgaccatcctggaggacgtgcccgacatggcagtcaagtttgcggtgtacgagacggtgcgcaacctgcacctgcgcctgcgcggccggcacgcctcggtgctggaggacctgtgcatcggcgggtttgcgggcgcggccgccgcggccgccaccacccccctggacgtggtcaagacggtgatgatgaccaccgccagcgcgcggccgacggtggtgtcggcgtcgcgcgccatcctgcgcgagggcggcggcgcgcgcgctttcttccgcggcatgggcccccgcgcgctgtccaacggcctcaactccgccatcttcttctgcttcttcgaggccatccgccaggtgctgaccaagcagcaggcggcccgcgtcgcgcaggccgccacgggggtcaaggccgcgccgccggcctggcgcgcgcgc

SEQ ID NO: 6935 - DNA, 342 bp, Chlorella protothecoides
atggcgcgggaacggggcagtctcaacgttatgagcgtgcccgtctttttgaacgaggcgcagcggggctcgtccggggcccacctccgccttgcgaaggcgctgtgggaactatgcgacgaggagcccgcgcgtgcgggcgcggacctggtgcacgcgtttaagctcatcatgacatgtggagaggtgggcggggtggccttctccgacgcacacctgtcgtgtgggtgtccgtgcggcatgatgctcgggaggactcgcacgatgccgccccttaccctcgcccaccgccccgctgccgggccacacgctcttttccaacgcattgcccacaaccaataa

SEQ ID NO: 6936 - DNA, 2913 bp, Chlorella protothecoides
  modified_base (292)..(301): a, c, t, g, unknown or other
  modified_base (1416)..(1425): a, c, t, g, unknown or other
  modified_base (1721)..(1730): a, c, t, g, unknown or other
atgcaggtagcctcacgtgaggaggcgagaagtgcaagacaccagtactttgcacacctctggcccaagcaatctgtgacaaagggtcactgtgcggtagttcccatgattcctcagctagccaacttttcccttgaagtgtggggccttcccttgagcatggaacatgtcccaaaatgtacaagactcgttcttgagctggaacggcctgccaatgctcagatttgtcaaacaagtgctggagcgagtcctgggagttcctcgcaaaggcggagaatgtcgtcgtccaaannnnnnnnnnttgtcaaacaagtgctggagcgagtcctggaagttcctctcaaagacggagaacgttgtcgtccaagatcagaagcccagcgatgcgtgcgggggctcagcaaccccttgctttgcctcagcagaggggcaggcacctgcagacgcgacaagcaagcccattggatgagcccgagtctttgccacaatgcctcctggcagcccttcttgccatgcacagggggccgaagtcggaagttatctgagcaattgatcctccatcagctctgcggatggacagccttggagggcaacaccatccctgttaagctcatgggaacccagctgcaggcaaggttcgtgtcgcttagctccgctctgtctggacctagcactcatttgagtggaggtacccatctggcaaagatcggcttcgacaccaagatccgtctgttgaatctcgaccccacgagcggcgatgccccaagcggcggcaactaccaggaagcaccaccagcatctacctggagagaggatctgcaaggcgacttttcatcggcagccatcgcaggaatcgagcgggcgttgtccgctggaaaaagtattcgctttgccaagcccatggatcttggtgggtactcggagcaactgcacactctgagacaaatggtcgtcttgcccctggcacgaccagatctgtaccgccgcctccatatcagtccaccgcgaggcgtgatactgcatggtccgccaggtaatgaggatgacacgccaacggtgttgacggctgaaagcctctcacggaatctgcagaagatctccaggggggcattattcgctgcacgccagcctaacttcgatccgggtcacccctttccccacagggactggcaagaccatgctggcgagaaccatcgctcaagattcaaatgccacggctttcgtggggcgcattatgcgctgcacgccagcctaatttcgatctgggtcacctctttccccacagggactggcaagaccatgctggcaagaaccatcgctcaagaatcaaatgccacagctttcgtggtgaatggcgcggagattttttcggagttcactggagacactgaaacaacgcttagaggaatttttatnnnnnnnnnngtggccaaactcttacaaccttcggtgatatttttcgatgagatcgacgtctttgcgggctctaggggtgacgtgaatcaaggtcgccaacggaacgttggagcttctgggagaatagtatcggtactctcacaagcaatggacagtctagaaggcaggtggacgagtattggtccctggtgtacagtgacgagggaacttgagcaatgtggccactcatgggataagtccactaattcatgtttccctttgcgctggacggcccaagcttccatcactcatgcagatccgagcannnnnnnnnntacaacactacacccttttctacatccttcaggcgagcgagttgtcgttctggccgggaccaataacctggagaatgtggatcactcgctgcgccgcccgggaaggtttgacagcgaggtcgagatgccggcgcccaggccagccgagcgtgaggatataatgctgagggcactctctaacatcagccattgtgtggacaaggatcagatccgagcggtggccagggcttcgcatggattcgttggcgctgacatacatgccctatgcggacaggctgctctatcgaccttgcgtagatatcatcaagagcatgcaggactctcccgcgaatattctagcctagtacttcctcgggtatctgcctctgatctggaggctgccagactcagagtgaagccgagcgctcttcgagaagtggccttggagatcccaagaacgcgatgggaagatattggtggacttgaagacgtgaaagtgaaattgaaggaggcggtggaactgccattcaagagtggcgagaaactgcacagctttggtgctgttgcccccaaaggtatcctgttgcatggccctcctggatgcagcaagaccatgctagctcaagccatcgccagcgaggccggcttgggattcatcgcagtcaaaggatcggagttgtacagcaaatatgtcggtgaaacagaaaaggcaatatcaactgttttcaggagagctcggagtacgcaacctgctgtagtattttttgatgaacttgatggtctcgctgggaggcggacatctgatggagctgagaactctgtgggagacagagtgatcagtcagcttcttcaggagctcgacggtatctctgcacgtcaagcgatcatagtaatcggtgcaaccaatcgcttggattgtttggatcctgcgctgatacgaccagggcgattcgatcggattcttcacgtcccgctgcccgatagggagggtagacttgcaatattgaaggtcaagacgcgctcaatgcccctctccgaagatgtcgacttgcggcagctgagcaatgcgatagatggtttttctggagccgaaatcgcctatttatgccaagaagccggcctcaaggctattgaagaagacccagatgcacagaatgtgtgcgcctggcatttccaggaagccttgcgttcattctctttgtag

SEQ ID NO: 6937 - DNA, 801 bp, Chlorella protothecoides
atgccgtccctcggatatctcgccgttgtcttctgtttgttggcaacttgcgcggcctatgagttcgatatggtgttccagaccaagtgtgtgatggaggaggtggtcgaaggcacggagattacggggagcttcacagccttcaatcgccatcagcctagcgagctggtgcatgtagacatcagggtgagacgccgtgagcgtggttgcatctcggcagagcggtggggtgggtcccctgcggtcttaggtcctcacctacatgctgtgcaactggtacatgagtcctgcgcagccagtcacagaagacatgcccatcctctccctccagatttccagaccgctcagaacacccgcatcagggtcgagtggaagtctggagcctcggctcatgactgggagcaggtcgccaagaaggacaacctaaacttcctgcaaaccgagctcctcagtctcgagcaatctgtgcacgacattcacatcgaactgcaacgcattcgcaggaaggaggaagagatgcgagacatcaacggtgggaagggcgggtggtgcttggatgggctttgtgctgtgtcactgatcgccgcaggccatgttgctcaggtactaatcctactaaactgcagaggcaacaaatgcacgtgtggcgtggctgggcgtgggcgccctcctggtgtgcctaggtttgtctgggtggcagatgtcatacctgcagcgcttcttcaagcgcaagaagctattgtaagctcacgtcatcggcagcaaatttgccactgcagcgttttacaaggtcgatgctga

SEQ ID NO: 6938 - DNA, 1554 bp, Chlorella protothecoides
  modified_base (1150)..(1159): a, c, t, g, unknown or other
atgccgaaaaagtcgaccaagtccaagtccaagcggaccacgctgaagcacaagtataaggttcttcgaaaggtcaaagagcaccaccgaaagaagaggaaggaagctaagaagctaggcctaaagaagagagagccaaaggaccctggcatccccaacgcctggccatacaagcaggagctcatccagcagctgacggcacagaaggagcgcgcagctgctcgtatgcgtaagaccaaggaagagcacttcaagcgggagcaacaggctactgatctcagaccagctgcttccctggccaatgtttctcaagcggcccaggagcgtgcagacgtgtttgatggtgcattgcatggccaggatggagtgactgcgacgcaggattacagtcggcgcgcatactacaaagactttgtcaagctccatgagaaccaacacagcttgccagtcatgaatggttcatacttgctcgctgggttctcaaaggtggtcgaagctgctgatgtgatcctggaggtcatcgatgctcgcgaccctgagggtggtcgctgtcgcgacgtcgagcgctttgtgcgcaagttggaccccaagaagaaagtcacaagacagcagcatgggtgctctgctcgcactacctctttaatgcccatgtctagtgtcagaccgacgcccacccaatcacacacccaaccagacctggttcccaaggaggcgcttgccgcttggctgcagtatctgcggcaggagctgcccaccattcccttcaagagctccacccagcagcaggccaagaatctggggcagaaacagctgcacaaggatggcacggccaatccaaaagtctccgagtccctcggtgcggtgggcccagaggatttgtgcttctggcagtctgagtgggtgagcggtggtgctgtgcatggcgggagcatggtgcggcccccaatgatccacctgcactccttgccatgccccgcaggagctgactccctgctgcagttgctgaagaattatgcgcggaatgcaggcctgaagacggccctcaccgtcggggtggtgggtctccctaatgtgggcaagtcctctgtcatcaattccctgaagcgaagccgggtggcgcaggtgggaaacacgccgggcgtgacacgcnnnnnnnnnnggtatgcttggccccgtggtctcaccccagctgggattccgagtccatgccatgctgaggccagcaagtcaaggccctgtgcgctacaccacacatgtgctgtcgctccgtctgaaagtcaacctctgtcacactctgccccgctaggtgggaaacacgccgggcgtgacacgctcagtgcagtccattcatctcgacaagcaaatcacgctgctagactcccctggcgtggtgtttgccgatccgggctccgatggtgtggcggcagctgcactgaggaactgcatcaaggtgcggcgggcagccccatttcacagacctcggagagcatatttgtgtccagccaggcctcaggagccgttttcatacccctcctgcctccccgtttaggttga

SEQ ID NO: 6939 - DNA, 1233 bp, Chlorella protothecoides
  modified_base (545)..(554): a, c, t, g, unknown or other
  modified_base (939)..(948): a, c, t, g, unknown or other
atggagctggtgcgacgctgtccggccaagcagctgatggtcttgtacaaggcgcctgcatttaagactgcagaagagtttctggtgcaccttgccacctcacggggaaagctgaagaagggtggcacggtcgacatggagaagttgcacaacgatcagtgtatgcctttcagactcaatcccgcatacagcgagctgccccacacccagagtgtatgcccacctgcatcccatgacgtcccattgcaccccttgcaggctgctgcgaggatattgctccaagactggaatgatgggcgcatcccctaccacactctgccgcccaagcgcgcaagtacgacagtcactggctcagcagctattgtgacggagtgggggcccatgtttgaggcggatagcgtgcaggaggaggcgctgatcggtgcacttcccgtcactgccgggggtggatttgtggtggataccttgggcgaggttggcttcgaccccgaggcaccagagcttcaggacgaggaggatgtggacatggaagggatcgtggttgnnnnnnnnnngctgccgggggtgcatttgtggtggacaccttgggcgaggttggcttcgaccctgaggcaccagagcttcaggaggaggaggaggtggacatggaaggtgggtgggatggggcgaggaaactgggctgaatttcagcaggaggtgacctgggtgtctcagtgtgcggcggttgtgagggatcgtggttgtgcaaacctgcgaccaacaacccccatgcagcagatgaggagggtgacagcgtcatctcttctgacagtgattcatcaggcgacgacatggatataccctcttcttcaaagtctgggtgcgcctgttgtggttgatgctgagggggcgacgtggtctgccattggcagccctgcaccgtgcaatgtgagcgttggnnnnnnnnnnattgtggttgatgctaagggggggacgtggtctgcaattgacagccctgcaccgtgcaatgtgagcgttggccatttggctggtatatcccaattcgaggtcttgtgcactcttctgcaaaaggatagagggctgctgactgatgctcagaatgcccagctgtacaacaacccgggacagtacaatccccacgctgcaagggctgctcgaaaacagaagaagcgtttgagtaggtctgctgaggacgatagcgactttgacttcgaggaggactacagcgaatga

SEQ ID NO: 6940 - DNA, 2175 bp, Chlorella protothecoides
atgtccttgccaatactggagcagcaggagcactttactatgtgtcacagagcacgggtcaactacgtcattctagagaagctgagggtcgatgagcagttgcagggttgtgatggtgcatgtataaacgatcgtgtctgctggggcccttcatcatgcccagtgcctcgaatggaaactcgaaggcactcgagaggccattgctgccgcaggaagatgttcctaggtaaggggcagtttccaaaaacgccagagaggctccgacaacatgatgcacacattgtgcaagcgcctccgcagcaccctttcaagctcgacattccctctaaccgcagtcttgggtgtcgggaggagggattgacgcagagtcagacactatctcctcagcagtcgtcgcttctcggatttacatgcgacagcgagggttgcggaaacggaggtgccatatgcaatgtggccgtgaccgccatcggtgcaggtaaatttgtatgcgcaggctggaccgaccttcggtatatggtcggcagagtgcctgctttgactgaacggcgcagatctgagtgcacgggagtgcctgtttggtgggaactctaccagcttgatgagattgatgctgagcaccttgtcgcagggatgcttgccctcccaaaggctatggagcgagttggggtcatcctcggcttcacactgtttggcactgtatgcctgctgacctacttctccagctccatcatcatcaggtatgcatcccgccgcgggaagcgcacctattcggagctcatagagggcgagttcggccttactggcgcacgggttctgcagacctccatcataattcacgtttctggtgagaaggagatgtatcttttcacactgatcacatgccggatcagctccttggcgtctgcatcaccgaccagagaagtactcgtcctcatttctacaggtgtcatgattgtgtacctcatcatcatcgccgacatgctggtcggtgcagcgcctgagtggcatggcgtcctgcccacccttctggatcgtcatgatggcgtctggtttctgtctcgcccttttgtggtgaggagatggatgcccggtggaggctcgctgcaggcattgccatcgtgcagaggcctcattgttctcatgtttccctcctgccgttccttcaagctttttcacaattaccccttgctcccattcctgctcgcagtgtgcggtcctgctcgtggttgccattgcgcccatgctgatcagccgcgagctcaccgtggtggcacgctactcgcgcaacagcatcatcatgatgctcttcctgtcctctaccatgatcgccctcgcgggggtggcgctctggcagggcaaggcggcagccatccacatcctgcccacgccactcgaccccaagtgtgcctccgggtgcggcacgctggtcaacatgtgcgtggccatcctgtcagtcctctccgtttcttgcctggcctttacctgccaggtagggaaagggtgtttaaacattggagtagtgggggcatccccgcctcgtcacaacactgtgtagcagggcaggatccgagtagacatgcggtgcatgcctgctcatttggttctatgtcggctgctgtgccagcaggcgtgcatgttgaagcactgtcccatgcgaggtgcttttgtgccatgagaagcatgcatatgttgctggctggcatgtcggatccactgccctcatcttctttccatatgcagttcaacctgctgcctgtggtccgactaaatgtgccatgcccggcgagcagcctgttgagcctgttcttcttcgcatgcgctctgctcgatgcaagcccaatccccctaccccgcttgcagcacctctccctcaaggatgggcgttgcagtaacatgctgagcatcaccaggaaggccatcgccctgtgtgctgccctctatggcaccgtggccattagcggatacattatgtttggcaagaacacgcagggggatgtgttgcgcaacctgaccatcagatacgtctccaccctggtgcaccctgtgctcgccagcgtcctgatcgacttcatcgtgctagccaccaccttcaacctgttggtaagcccggggagggtggggaagggtgtggatgggagcagtctggccaggggttgtacttctgatggctaa

SEQ ID NO: 6941 - DNA, 1074 bp, Chlorella protothecoides
atggggctagcggtggagcgatgctccagccccgcctgcgccacctcggcaggggctccgactcctgatcttagctgtgacgaagcgagcatccactgctacaatgatgaggcaatatcttgtgaaccctctgtccggcggctcaagagccagaaacggcgcgcagccgaggcgcgccttgccgagcgtgcgtgcgtgctcatgggcctggttgcgcccccttcccctgcggcccccctcccttgcccccccctccctgcaccccactcagcggcggatgatgaagtgtgcgtgctggcttgcagcgactgcccccccgtagcagcccctctgtggtgcggcatggatgtcaagctacccgccatcgactgggcggccgccttcgcctcccggcattccccgctgatcagcgatgcccccaagggcgcctcctacctcctccccggcgccctccctgtcatcctggtggagcaggcttccgcgcttccccaggccttggaggcactgcgggcctccatgcgcgacgaagtccttggcatcgatctggagtggcggccgtgcttcactgcctctgctgcagagggcagtcgtgtggcgctcatgcagctggcctccagtcacctgtgcgtgctggtacgcctgtgctgcatgggaaagaccttcccacactgcctgcgcagcttcctttccgaccccagcctcgtcatagtggggtatgcctgggacggggccgacgagaagcgcatgcgatgcagctatggcctgggacgcaacctcttccagcggtactttgacgtccaagctgtgtcggagagcctgggctaccatggactggggctgatctccctggctcgacgtgtgctccagtgcgacgcctccaagtccaagaggatcacgatgagcaactgggaagcgcgcaagctgggctgcagccagattcgatacgcagcgcttgatgcctacctcaccggtcacttgttccggtcactgcgcctgtggcatgggtctccatccgcctgcatcacctgcgccagcgccctgggcaaggtatggtatgggagctttccagcgtga

SEQ ID NO: 6942 - DNA, 846 bp, Chlorella protothecoides
  modified_base (59)..(68): a, c, t, g, unknown or other
  modified_base (525)..(534): a, c, t, g, unknown or other
atgtggagtgggaaagagcggcgaagttttagaaaggacaagagagcgacagggatctnnnnnnnnnnggtgtgtttggctaggagtgttgaagtggggtgtggagtgggagagagcggcaaagttttagaaggggcaagagagcgacaggtatcgggttgttgcgtggagagggacgaagcatgtcactgcgccccgagcccccttgcactggagccagtggtggcattggggagcgctggacacaccggctgctccagcacgtgcaaccactcacccaacatcaaatcgctgcgctcaccttcctttccctcttccctccccccccatattcagatcaacttctggctgggggcactggtggagatgcggagcgaggacctgtatcgaatgaagggtgttttggccatccagggctttgatcggcgatttgtttgccaggtgagggatgtggagcgggaagcactgtcttcccctgatgcagccacccccgttcacactattgggtggtccagggttgagaannnnnnnnnntcccctgatgcagccacccccgttcacactgttgggttgtccagggtcgagacgagcctctgccgtgcggcttccagcctgcctgcccaggcccttggcatcccagctcatcatatctcacccggatgtccactgccgctcctcccccagggcgtgcacatgctgtttgagggcatgccagatcgtccatggaaggagggcgagaagcgcaccagcaagatggtcttcatcggcaaggacctggatggcgcccttctgaaggaaggctttgaggcctgccgcgtgaagcctgacgacgcgcccgcatcttag

SEQ ID NO: 6943 - DNA, 1392 bp, Chlorella protothecoides
  modified_base (18)..(27): a, c, t, g, unknown or other
  modified_base (951)..(960): a, c, t, g, unknown or other
  modified_base (1153)..(1162): a, c, t, g, unknown or other
atgtggacagcgagctcnnnnnnnnnngggctgagcattggggcagtctcggctgtaatacacctcctcagggcgccttgctcaatcccgtgtgcacagttcggtgaggtggatgtggacagcgagctggtgagcatccgcgaagacctggagccgggccaggagcagatcatgatgctgaacaacggctgcctgtgctgcaccgtgcgggatgacctggtggacatgctgaacaggctggtgagcttgggaacgcctgtgtgcctggtgcaccatgggtcggcggtacaggggtcaggactgggtcctgctgcatgcccaggggatgtcagccagacaggacccaagccggcggggggctgtggccctgggatgtcagccagacagggccccaagccggcgagggctgtggccctgtctcatgacagtcagcccatggccagtgctgaccctagagtccgtatcactctcccttccatgcaaacacacgcacacacttgccagatcgagcgtcgggaccagtttgaccgcatcgtcatcgagaccacggggctggccaaccccgcccccatcatccagacctttttcatcgaggagtctgtcgctatcaacatgaagctggatggcctggttaccctcgtcgacgccaagcacgtcgagcagcaccttaatgagaagaagcagggtggggctgtgaatgaagcccttgagcaggttgcgtacgctgacaggatcgtgctcaacaagaccgatctggtgtcgcccgaggacatcgagcgcgtgactgagcggctgaagggcatcaacggcatggccactatcctgaaggcgacccgtgcccaagtgccgacggactacgtcctgggcgtcggcgggtttgacctcgagcgcatcgacgcagatgtgaggcaggggcccgcgtcgctcaagtggtgccttgcccctttcccnnnnnnnnnnctgatgggggaggaaaccagcaaggggcctagtgctgcacgttcccactccatcacaacctattatccagacagtagtcgctcaagtggtgccttccccctttccttaatatcccagctccttgtggagaaggaggacgaccaccatcatcatggcgatgatcatcacaatcacgacgagcatgaccaccatnnnnnnnnnnggagaaggaggacgaccaccatcatcatggtgatgatcaccacaatcacgacgagcatgatcaccaccacagccatgatgaggatcaccaccatgaccagggcgacgatcatcaccaaagccatgcccatgcccacagcgacgagtctggccacggcagtcctgaggatggccatgccgggcacaagcgcaaacaccaccaccacgaccaccaccatgacgattctgtga

SEQ ID NO: 6944 - DNA, 1266 bp, Chlorella protothecoides
  modified_base (252)..(261): a, c, t, g, unknown or other
  modified_base (936)..(945): a, c, t, g, unknown or other
atgatctgcggctcgtgtgttgctcgagaatattctactcctgtggaaccaggtagtccagagaagtctagggctgggggtgggctgcctggctcgcggctgagcggccaacaggtttctccctgccgcgagcttgaacaactgcggaacgacggcagtagaacgcgcaaacagtccagtaatcagcatgattttgggatgtggggcttattcggtatgccacggcgccaacgccttgactcagaagggccnnnnnnnnnntattttaggatgtggggcttgttcggtatgctacggcgccaacgccttgactcagaagggccaagctccggccaacccctagtcccgatgggattcctcccaatccctggaatgcgatctcgacaacgggaacgcctgggagagtgcctgcagcttcgtggcgaagcgggcgagggtgacaggatggcaaccacaccctcgcgtgccgaggagaaggcccgcaaggaggagggtgaagagcagactgctgctctcacgacctctagggcctcaaccccgctacgcgcccctcctcacaggctaggggagtccggacagacttctccccggaccccagaccccaaagcctccctccagcgcctgctccggtccgcaagactcacagacttggtagcccagagctctggtctggcagcagaggtggggtccctggactccgacatgcagatgctggtgtacgagaactataacaagttcatcatcgccactgacaccatgagggccatggctggctcgctggatggcatggacaccaagctcaccggcctccagtcgctgctggggggagagcatgctacaaatcgccagcctgtgtgtccatggctgcgaaatcgccaatgcgctccagtttggtcgcaatctacggtgcaggacatgctgtcggttcttggacgnnnnnnnnnnctaaccctgcggcggcattctaaagagggaaagcatgctacaaaccgccagcctgtgtgtccacggctgcaaaatcaccagtgcgctccagcttggtcgcaatctatggtgcaggacatgctgtcggttcttggacgcgcctcctccccagctctaggctattcctgtatagatctaccacgaagcatgcacgaccacctgcacaggggatgtgatggagcgcagcgcggacgtcagtgggcggctggacaagcggcagcagcagatcgaggagctgagcgacactcgcctgctactccgccgcctgcaggccgtgtatga

SEQ ID NO: 6945 - DNA, 837 bp, Chlorella protothecoides
  modified_base (80)..(89): a, c, t, g, unknown or other
atgcagcctcggtaccactgctgggcgggcataggagctgggagggcgttggttagcctcccagcgcaggcccgtgctgnnnnnnnnnntgggggtgggggaagtgctgggagacgcagcctcggtaccactgctgggcggacatgggatctgggagggcgctggttagcctcccagcgcaggcccggtgccctgcgccgcgttgcggtcgagatcgaggggctggcgcgtgagacgctggccctggtgaagtcgcgtatggcggccgaccccggcaccgcctctgactgcatccaggccatggcgtgcatgggccaaccccccgaggagctggaggccgcattcgttgcctgcaagcggggggtgctggagcgcacgctggacatcgctgcggccctgctttcctcccaggccgccgcggccgggctgcagggcccgtcgccggggacaggggaggaaggagggcccgggcctgatccacgccgggccacgcaggccgctgctccgggcctcgaggcggacccgcctacgtctggagcgcggtcacctgcgggggagggcggggcggcagtagaggcgtgggacccggccggcggcgccccctccctgcagcagttcctggtgcagctggactcccgcttcctcaccgagctggcggcgacctgcgctgaattcgggattctgttccggggccgggacacggcgccgctgttcaaggtgagcaggcagcggcatggcaactggagggatgggggtggggagggtgtgatggggtcttgccatgccgtgctgttccagtgccatggccgtccacctgcactctaccgcggtgcctga

SEQ ID NO: 6946 - DNA, 1152 bp, Chlorella protothecoides
  modified_base (1016)..(1025): a, c, t, g, unknown or other
atgatgaagatgcaacgggttgcgttgctcgtccttgccctggcggttgtcggcggtaactgcgccccagcgggtgagttcgggatcggtctgttgggatcattctcgtggccaactatacactacttgaaggtcgccgctgtctcaacctattccactcgccgccatgcaggtgagggtatcctcgcgggcttcgagcctatcgccgaggaggccagctctgcttttgagaccgttggagaccgtctatcgagtgtcttcggtcgcaagttgctgtccgacaacaagtgggagtccgccgtggcccccgctcttgaggacgccaaggagtgggccgacgaggccggcgaaacccttcaggagactttcggacgcaagctctccgaggacaagaaggacaagttctctctcaagaactggcaggactccatcgccccggccgtcgaggacgccagggagaaggccgacaagtttggcgactccatcaaggatgctgccgagcacgtccaggacaccgtgaaggaggccttttccggccgcaggctgtctgaggacaagaaggacaagttctccctgaagaagtggcaagactccgtcgggccagctgttgaggatgccagggagaaggcggaggaggctcttgagaagttccaggaggccactgaggaggttggcgacaggttcaaggaggccatcaccggccgcaggctgtctgaggacaagaaggacaagttctccctgaagaagtggcaggactccattgctcccgcaattgaggacgccaaggagaatgctgaggagacccttgagaagttccgcaacgctctggtgacgagggatgaagaactttgcctcatggcttgtgcactgctggtctgcaacgtcctgcgttggtgcccatcatgttggccacaggaggctcagaagaatccaaaaagccgcccttcaaaccacctctgccctcttcacctgcaggctaaacatccttcacccattagctgctggacatcccatannnnnnnnnnccacctctgccctcttcacctgcaggctaagcatcattcgcccattagctgctggacatcccatgcgcatttagttgccaccccagacgcggaggccccgatgcttatgctaacgggaggcctttga

SEQ ID NO: 6947 - DNA, 666 bp, Chlorella protothecoides
atgacggaggccggcggctggaggacggggaaggagcctcgcgggccgcgtgagctctgcgtcctgctgctcgatacactggccgccctgcgccagcgatccactgccagcacgccccgtccgatctgcgattgtggtcgtccagggcaccccgctcctggcctagatgcgtgcatcggttctccctgcgcccttacatgcccaacaaccccaccttttcttcccgccctcgccgcagaggtgagcgaggaggtggcggtggtgacggccacccagccgctccccgcgagcacgccctcccaccgcgcctcccccagcgggtccagcgcctctggcgcaatggacacggaatcgatgggggcggctgtgtcccgcatgtttgcctcttcgctggagcgtgggccgggggcccccgctgggatcacgccgcccgctgtctgcgcggcagtcgcggcgcgaggcctggcggcgatggcggaggcgctgcatgcgcacacgctcgtgcgccccgctttccagcagatccagctcgacgtgcacttcctgcgcgcacccctgcaaggctttgtggcgggaagctatgaggaacccgccgtgctgcaggtgggtgggcgccagtccttcgtgtgccctcaaatgcgccacgggagtgcaaagtgccgttga

SEQ ID NO: 6948 - DNA, 1026 bp, Chlorella protothecoides
atgtcgaccaagccgctgttgcccggcgtggagcgggacgtaccccttaccacccgcctatcatacgcgcttaaacaccaatgggcggtgtggctaggcgttccggtggccatggggctcattgtgggactgagtcttccatccaacccggagctgcctgcaccactgaacatcgtcagccccatcatcggctggacctactttgcagcttggagcgtttcgttctatccacaaggtacgttggaactggagtacagatcatgcgccaggagggaatttgaggggctggcgctgtgccaggccgtggccgtggtggatatggtgatccttgtgccctactgcttactatgcctcccatgctgccacccacccatcacagtctggctcaactacactcgcaagagcgtgtctggcttgtcactggacttccagatccttaacctcctgggcttcgtctgctatgctgtgtacaacgtatcgctgtattggaatgctgccatccgtgaggcataccgccttgtacacgggggcaactcgcctgccgtccacgccaacgacgtcttctttgcactgcatgcggcggtgctgacaatggtcaccctggcgcagagcctggcgtatccgagtagccggaccccacccagccggctgtgtgtagccgcggtggtggctaccagcggggccgtcctggcttatgccgccgccctgtactgggcccctggcctgcatccatcctgcctcaacggatgcactgaaggcacctggttcacctggctgaattttctgtacctagtctcccttgtcaagctggcggtgtccctggtgaagtacattcctcaggactggagcgccattactggcaaccccgtcaagtttgccctgggattcgtatctatggtttttgacgtcatattcgtcggccagcatgtggcgttcggaaagcggcgcggggtccaggatgcagagggcgaggaggggagtggattgcttccagtgagcgacgaggcgcagcccgcggacgtatga

SEQ ID NO: 6949 - DNA, 315 bp, Chlorella protothecoides
taggcgccgaagccgtacagggtgcggccctggcgcttgagggcgtagaccacgtcgaaggcggtcacggtcttgcggcgggcgtgctcggtgtaggtcacggcatcgcgcacgacgttctccaggaacaccttgagcacgccgcgggtctcctcgtagatcaggccgctgatgcgcttgacaccgccacggcgggccaggcgacggatggcgggcttggtgatgccctggatgttatcgcgcaacaccttcctgtggcgcttggcaccgccctttcccaggccctttccgcccttgccgcgtccagacatggtt

SEQ ID NO: 6950 - DNA, 1281 bp, Chlorella protothecoides
  modified_base (1231)..(1240): a, c, t, g, unknown or other
atgacgcagtccaacggcaacaccttcagcgcagagaaggcccagcagtttgccgaggtcttccccgatgcactcaagtctctaaaggaggcagatcccgaggttgctgccctgatcgaggacgagaagcgtcgccaatggtgtgtggtggggcagggcaacacgcttcgtgcatgcatgcccttggatcgctgtgccagcctttcggatgccggtcgagcggcatcatcgtgcactcgtgcatcatcgctgtacctgaacatgagaaatctaccccctctccccgctcaggagcgggatcgagttgatcgcctcggagaacttcaccagcgcccccgtgctggaggccctgggctccgccctgaccaacaagtacagcgagggcctgcccggcgctcgctactacggcggcaacgaggtaatcgacaaggtggaggtcctctgtcagcagcgcgcgctggcggccttcggcctggaccccgcggcctggggcgtgaacgtgcagccctactccggctcccccgccaactttgcggtgtacaccgccctgctccagccccacgaccgcatcatgggcctggacctgccctcggggggacacctgacccatggctactacaccgcgggcggaaagaagatctccgctacctccatcttcttcgagtcactgccttacaagctgaacgtccaggtgttaccgcatgtgctcctccggaaacccggtcactgggtgctcaccagcctgttccctctttccacctgccacagactgggtacatcgactacgacaagctggaggaaaaggccaccgactaccgtcctaagctcatcatctccggcgggtcggcctacccgcgggagtgggactacgcccggctgcgtgccatcgccggtgagccagggtgggctggtgtggcaagggaggaggggaggatgagaatgggttctgaagcttttgggggcaccagtttgtgggtgctcctgcaagttcctcaggcacgtctcccttcattgcccggctgccaagggagtttggtatcgggcagctccccctcacgtagctctgacgagcctggttgcgtgcccatgccatgcatgggccagcatacgccaggcaaactcaaccgacatcgccgggccctcaccgccttctaccactcaccacccaatgcagacaaggtgggcgcgttgctcatggtggacatggcccacatctcgggcctggtggcgnnnnnnnnnncggcgaggcggccagcccctttgagctcgccgacatcgtga

SEQ ID NO: 6951 - DNA, 1161 bp, Chlorella protothecoides
atgccacgcttgccacttgtcaacatgccccatttccccacccatctcccaggtacgagcctgcgatacaagcccggcttcatccacggcggccccggcatcgagcacgactgcggcaccagccgtggtgtggggtactacctggagcccctggccctgctggccctgtttggccgcaggcccctctccgccagcctgcggggggtgaccaacggtgggccggaccccggggtcgacgtcttccgcgccgtcacgctgcccctgctgcgccagctggcagggctggaggatgggctggagctcaggatcgaggcgcggggcgcgccgccactgggcggcggcgaggtcaggttgcgcctgccctgcgtcaaggccctgccccccgtcgcgctcacagacgagggcatggtgcgtcgggtgcgaggcgtggcccactccatgcgcgtctcaccccaagcggccaaccggctcgtggacggcgccaggggcgtgatgaacaaggccctgacgcagagtctgaggcacagctgggcaagtagaggggggctggtggtatgtcggcgccccgctcgtgtctcgcccccaaccgaggcacacagtatcctccctttcaccgcacagctgctggccgatgtgttcatcttcaccgaccacatgagcgggcgggcatcgggcctgtcccccggctacggcgtggcgctggtggcggagaccacctccggccgcatgctgtgcgccgaggcgtgcgccgagcttggaaaagcgagccagagcacggcagaggacgtgggcagggcggcggccgcggcgctgctggaagaggtgtcgcgtggcggcgtggccgactctatgcaccaagccctggtgctcacgctgtgcgcgctggggccggaggagatcaacgaggtccggctgggcccgctcacgccctatgcaggtgcgctgaggaataggaacggcaggggtcctggagccagacggcaggctcaccccaccctgggcctacccttccccccattcactcgcgcagtggggacgctgaggcacctgcgcgacttcttcaacgtccagttcagcatccggcccgaggaggagacccgaaccatcttcctctcgtgcgtgggcgcgggcgttaagaacctgagcaagaagattgcgtga

SEQ ID NO: 6952 - DNA, 258 bp, Chlorella protothecoides
atgctgagatttcagggagctgagcactttcgtcagagactggtattctccactctctctggtcgtcccatccgcatcgacggcatccgtccccatgccgagtccccaggactgcaggaacacgaggcctccctgctccgcctgatagagaaggtcaccaacgggtgcatcatagagatcaacgagacaggtcagcaggtgctggccttggagggaatggggcctgaggagtgcccttcaggctgtgctggtctctga

SEQ ID NO: 6953 - DNA, 1791 bp, Chlorella protothecoides
atggaccaacctccaccgagcaagccccaggcctctgcgccggagcacatcttgtgcgatacagcccatggggtgaagagcgggcatcagacccgctcccaacacccagcagccccagtgtcagctccggggctggcgttgggtggcgagagagggcccacagacatggatcagggcaggagggagcacgggcatgaggacaccagccttcctgttgccacacccatggccagtgctgcctacgacctgactacagacattgatctctcctgtgtcccgacaccagtccccatgccagacaagcccccaagttcttgcagcatcgaagcgttttcgcctgaacttgagctaggcaaggagttggctggagacggcctgggcaagatggagagcaacctgcagcctcccgccacacggcaggacgagaggggagcaggggcctactgggtgtcgccttccctgcacccactcctaccatgccagaaggaggctgtgctggccgccttccaggacaacaccctcgtggccatgccagagggatcggggcaggcaagcatcgccgccgttgtcatgctgaacttcctgcggtggctcccccaggtgtggcgggtgggctggggagcctgcacagggtgggtatcagatcttggtgactgtgggaatctgacagtcgcagcttgcaccgtcttcggaaaggctgcgcgacgtcctctcgcctcatgtcatcgcgataccacgatcccacgccatgccccctcaattccttgcgtccaccagggcaaggttgcgtttgtggcgcccgccaggtggcagctgaagagccaggtggaggcttgccagagggtcaccggcctggacgcggcgtgcatctccgacttctcctcggcctccaagcaggaggcgcgcaaggaggcctggtcccaggaccacaagcgcgccttcttctgcacccccgccacgctctggagcgacgtgaagcggggtgcgtgcggcgagagagcgggagtggagaggccgcaagccgtgctgcgcctgtccctccacagccagggtgcccgacgtgcttctccctccctctcccccccctccctccaccaaccaggcgtctgcgcgtacgaccagctggcctgcctggtggtggccgacgcgcatgccgcgtccgcccggtcggacgcggtggaggtggtgcgcaccctgacgcggcggcgtctgcgcacgcgcgtgctggccttctcctcctttcttccgtgcctgccgcccgcccaggtgcaggaggcgctcaccgggctggccatccgtcgcgtgtgttgccgcggcgagcggcaccccgacctcggcgccctgcgggttccgatggagcgcgtggaccggatcctcacccctggtccggaggcctcgagactgctcgacgccctgctgcgcacgctacggcccctcatccgccagctggcaaacgccaacgtggggcctggggatgaaggaggagggactgcaagctcgaggggcttgctgctggcgcccggcgagacggcggagggcttgacctcttcggccctggattccattgccctgccagggtccggcccgcagccgcgcgccacgctgcgccacgcttttctagcgctgcgcctgcgggaggcgttggaggcctggggcccacaggccgcccaggcggtgctgctggacgcgctggcggccgacacctcggcccaccggctggtggcctccagccgcgactttgcgcaggtatgtgggaggctgaaggagcaggagtggggagggagggggtag

SEQ ID NO: 6954 - DNA, 846 bp, Chlorella protothecoides
atgatcttcttccgtagggctggattccttggctgtgtctccggctgggtggcgggacctctgacgcatggagctctgcgcctctgcagccaatgcttcctcagcagcgcagccgccgacgggcatgcggcctggcgccgtcgcctgcatcacccagcgctgacagcgccgacctctttccctccacaacacccccagggccccaagccggagtcggcgctgaagcgcggcgaggcgcctggcagcgtcagctacgatttcgaggaccgcatcaactttgcggtgttcccctccctccagggcgggccccacaaccaccagatcggcgcgctggcggtggcgctgcgcgccgcggcctcccccgccttcaagctctacgcgcgcgcggtggtggccaactcccgcgcgctggcgggggagctggtgcggcgcgggtacacgctggccacgggtggcaccgacaaccacctggtgctgtgggacctgcgccccgagggcctcaccgggtccaaggtggaggccgccgccgaccgctgccacatcacgctgaacaagaacgcggtggtgggggacgccagcgcgctggcacctgggggcgtgcgcctgggctcccccgccatgaccagccgcgggctgggcgaggccgacttccgcgccatcgccgggttcctggacgaggtggtggcggagtgcaaggacgtccaggccgcccacggcaagcagctggccgccttctccaagggcctggacgccagcgagaagctggccgacatccgggccagggtgcaggcctgggcggccaccttccccatgcccggcttcgacgccgcgctgctggatgcctga

SEQ ID NO: 6955 - DNA, 714 bp, Chlorella protothecoides
atgccgccgcaccccctgcagttcaaggccgagctggaggtggctgcgaggagcggcgccgcctgcccgaaactggccgccctccagtccctgctggaagcccagctccaggtactttatgggtccagcccgtccctgtgctgtgcacgcattgacttcagccgtacacactcacgtgggcctccccccaaccagacgaccgccccgatgcaccccgccaaaacacactcgcaggaacacacgagctcgcgcatgctggtctgcatgagccaccggcccagttttgccgggctggccgccgacctgtcccaagcccctggggtccgggccggcacctggatgcccaaggccggcgccagcgggaagggtgcggggtcggggtccgcgcgctccgccgcgccctcgaccggcccggcgcaggcggtgcgggaggcgcgcgcggcgctggccgccttccggtctggcaccctgaacgtcctggtgctgccgccggactgctgccacgaggaggaaagggagtcgctggcggtggccgacctggtggtggccctggacggcgccgccacgccgcatgccctgctgcacctcctgggtctacggggccgggcccgccccgctcgcttcctccggctgctgaccgcagggggtgaggcggcgcgggcgcgggctgctgacaaggcgagaggtggattggtgtctctggggcgtgtttaa

SEQ ID NO: 6956 - DNA, 342 bp, Chlorella protothecoides
  modified_base (268)..(277): a, c, t, g, unknown or other
atgctgcggtgcgccttagccctcgtgccgaggcccagcgtggcattgcagggctggatcccggcggtgcgatgctttgcggtgggaggcaaccatatggccctcataagggagctccgagaggcgtccggtgcccccatctcggacgtgaaggctgccctgcagcaggccgactgggacatggacctggctgctcaggagctgaggaggaagggcgtcgcctctgctgggaagaaagcaacgcgcacggcagcagagggcctggtgnnnnnnnnnncgccccccaatatcgcaacgctgacccctggctcaagtagagtgcccacgcattcaatcccctga

SEQ ID NO: 6957 - DNA, 888 bp, Chlorella protothecoides
  modified_base (525)..(534): a, c, t, g, unknown or other
  modified_base (593)..(602): a, c, t, g, unknown or other
atgccggcaggcgctctggcgcgtcacccccatgtgctgctgttggtcaccccctcctcaaatttccgttcgatccgaatctacccgtcacaactcccgatcacccttgccagcctcgaggacgcggtggccaatgtggccggcacggtgcgcgagaatgtgcgcctgcgccgcgctttcttccttccccggcccactggcggcgtggtggcctcctacctgcatcagggcgcgggggaggggctgggcaggattgcggccctcgttgtcctggccccccgcgaccccggaaccgagttggccgggccggccgccgaggccgccgccgacctggcgcgcaagctgggcatgcaggtggtggccagcgcgccgcgctttcttgatcgcgagggcgtggaccccgtggccgtggaggaggagcggcaggtcctgcggagccaggccctgggctcaggcacgctgggagcggagcgcttttccagggggtggggttcaggggttgtgagcgctggaggcgcggtatgnnnnnnnnnnagtgcttggcaagatccgcgagtcgcattggcggcctgcagccatcctggctccctttnnnnnnnnnnaggagcggagcacttttccagggggtggggggttaggggttgtgagcgctggaggcgcggtatggagattgtgcgtccatgcaatgtcttgaaagggcctgggcctggcagttgcagacagggggtagtggcacagccagggctggcttggcgccgggcacggcgcccgtgtgcttggcaagtccacgagtcgcactggcggcctgcagccatcctggctccctttcagaactccaaacagcatcttctctccacccctgtgcaggcaagccggcgtccatcgtag

SEQ ID NO: 6958 - DNA, 771 bp, Chlorella protothecoides
atgcccgagtacgacgcggtgagcaagatctccatcgtgccgcgcggcaacgcgggcggcctgaccttcttcgcgcccagcgaggagcgcctggagaatgggctgtacagccggtcctacctggagaaccaaatgtcggtggccctggggggtcgtgtggcggaggagctgatcctgggcccggacaacgtgaccacgggcgccagcggcgacttccagcaggtcacgcgcgtcgcgcgcatgatggtggagcagatgggcttctcagactccctgggccaggtagcctggagccagtccggcggtgggtccttcctgggcgcgcagatggcgcagcccgccaactgctcgggtgaaacgcaggatatcatcgacaaggaggtcaaggtgcggggcagagtgtgggtggttggagacgtcgaagggggtgggccccgccactccctgtcagactggcgcagccgcagcggcatctgtatctcggagggatccctcgcctggcaggacgatgttattttgggtttgcagcaggcgcagcagcgacccccgcaactgcccaggcagcagccccagtacacgctgcttgatgaaatgaagagcctcccagacttggggaacacccacttcccactcccacgcatcacacatgtctcactcccatcccctcctacccctcccaatcgcacaacatcagagcttggtggaccgggcgtaccgcagggccaaggacctgatccagaacaacatctcagtgctgcaccgcacggctga

SEQ ID NO: 6959 - DNA, 1596 bp, Chlorella protothecoides
  modified_base (1524)..(1533): a, c, t, g, unknown or other
atgggtaggccaactgctctccttacctccagcctgcggtgtgcaggcgtccccgagcacacccaagccgcccccggcggcgtgctcctcacgcccggcgcttccagaccccttgctcaaccacacccacccctcctctcatcacccaggatcggatccctggtcggcggtgcccagggcctcatcagcgccagctacgacggcgccgtgcggtgcgtgcgcagcgacggcggcgtcgcctccgtgttcgtggcgagcgcgcgcccgctcaaagccctggcgctgggcggcctgggcctggccgccgccggcgacgacggctgtgtgggcgtgtgggagctggggcctgggggtgccgtgccggaggccccccggcagctggtcagcctgagggggcacaccgacgccgtggcggcgctggccttctccccggactccgccctgctggcctccggcggctgggaccggggcctgcacctgtggcgtagcgccgacgcggccgaggcggccgcgtcgggcgcgcccgcgcccgcggccgcaaagaagcggcgggtgggcaaggcggagggcgcggaggcggccgcacccgcgccggtgctggacgccagcgccgccgagctggcggggcacaccggcgccgtgtcctcgctgagctggacgcgggaaggtgcgtgttgtttcttctggaagggggcggaaagaggaggccgggccgggaaccgcagtcgacccgtggccagcgcgctcctggcggggagccttgcgcgcctcgtgcgccctcctggccaaagctcacccttcctcttccatccgaggccgccatccaaagcacacacagcgtccacgcacccggcccccctcctttccacccgcgccacccacaggccggctggcgagcggctcctgggaccacagcgtgcgcatctgggacgcagagacgggggcgggcgtggacacgctgaccacgggcaaggcggtgtacgcggtggcggcgggcgggccgggcggcgcgctggcggtggcgggcgcggaggcgccgctccggctgtgggacccgcgcgagcgtggggaggacgtggcgccgcagcgcctgcgcggccacgccggctgggtgtcggcgctgtgctggcacggcgggcgggagcacctgctggcctccgcttcgcacgacggcacggcgcggctgtgggacgtgcgggccagcatcccgctgcacacgctggcgggcaggaatcgttaaaggtgacaggaggcatggtttcccacggcatccggggtgccccatgctcacagcctaacagtactcggcaccacgcccgtgggggtgaggttccgtgggacccagcccttcgctcccgtcagggccgggcgcccgctggtcaggaccattgtccgcgcagcaaaagtacgatggaatccctcgcagggctgggtgcgggatggcgtgaaacggcgtggttggcggggagacgggtgtgcggtcctggagctccggggggtgtacgcgctctggcatggcctcgnnnnnnnnnngggctgggtgcgggatggcgtgaaacggcgggattggcggggagatgggtgtgcggtccctga

SEQ ID NO: 6960 - DNA, 2169 bp, Chlorella protothecoides
  modified_base (136)..(145): a, c, t, g, unknown or other
atggtcacacaacggccagtgtcggtgtacaatgcattggttgcgcacaacacatcaggggacccgctcgccctcccccacctgtgcgacaaaactgttggtatttgggtgagggacccgatgggcgtgacggcannnnnnnnnnccagaagaaggtatcctccgggagggccgcgatcctgcaggcattcatgtgtaggagccttcagtatttttggagtggcattggccacaggcaggaacaacatggttgcacaactgccagtgtcagtgtacaatgcattgtttgggaacaacatatcaggggacccgctcgccctccccgacctgtgcgacaaaactgttggtatttgggcgagggacccgatgggcgtgacggcgttgtggatgaaccccgtcagccgtccagaatcttcttcgggtgcaaggcgcagtcgcgcagcatactgcaagcggagaggattagcagtgggtggcctgttgaggaatgaactgcaaggcgctctggccgatgcgtgctgccagggtctcgacaacagtggagcgcccgacatctccattcaagttcctagacaagcaccaagacaattcccattcacccaagctgcttgcctggacgatgatcatgtagtacttggggttcagggggtcggagcagtctgtcacgctggcatgggccttggtatttaccatcaccatactcttgcacctgggggagagcaagcaatgatggatggaggtgtgctcatcgtgctgccaacaaagcgccagacccccatgcaatcaaatcccaagtcctacaaccatctccaatcactcacaggtggtagacactcgctgcacccagcgcttgccgtctgccctccagcggccaggagtagtagggctcgggcactcgctggaaggcaaagcgggtcaccccgcgcaacagcaactcctgcgccaggcgcagctgagtgggggaggcgccctctcccatgtgttcggctggggtggtgtcctcaggacgcatgcaggctgctaggggggatggctgcatggcagggggagcgggcagccccgtggccatctccagagcggccagacgcccgcacagggattcccatgtcctttcgagacgcgcaatacgttcctgggcgtccgaaggcattgcttgtaggcaatgaggcggggcctaagcggggatcagaatcgcagagtacgcacaatgcagcggtattgcgaatgattgtctttgcctgtgatcaagcgttgggcccaggtacaccgtacacaggggctctcaatttagcgcgcgcaatgccacgtcacggggcggtcggcactttacaccgcttccctctctcaatgcatcgggacataacctattacaggtcattaccatttcttttgtgtatactgcaccttccatacatcatggtggacgcttccgaggtggcggacgagggtgcacagctaacatgcaagttcgtcacgaagctcccgaaggagctgcgggtacctgaagctgccctggtgaggaggctgggtgagaagcgcatatattattgtgaagttaccatgcacgcgcctcttctcacctgcatctgtcctgcctgtcccctcagaccgtgccagccaacctcacccggtatggcctgtcgcaaatcatcaaccacttgctggacctgggtgagttgtacagggttccgcactgcgtctgatggacgaagaatcgatgctcgaggatgtcgggatgagtgggtaacactgctcgacagaggggcaatcagggtgctccaggaccacccttgggctataccatgggtcatgcggcttgcacatgaaacctgggttcatgagacacctcttgagcacggacccaccacagagatggccaagccctttgacttcctgatcaaccacgagctgctgagggggacgctgcaggagcacctgtctgcccgcggagcctcggccgaggtggtcactgagatcgagtacatccccctgcagctgccgcccagccccggcccccggaccccccacgacgactggtgcgcagggggtatgggtaggccaactgctctccttgcctccagcctgcggtgtgccggtgcccccgcgcacttccgagccgcccccggcggcgtgctcctcacgcccagtgcttccagaccccttgcttga

SEQ ID NO: 6961 - DNA, 345 bp, Chlorella protothecoides
atgaatgcctgcaggattgcggccctcccggaggataccttcttctggctaggagcaggagaagtggatctcaaagtgggcctcttcgtcaaagactttgtgcgtgcctatggcgcacatgtggtggactgcacctacgatgagtgctggcctggggaactcccggatgaggtccccttcacacatgaaagatgtgctggcctgggaaactcccggatgaaccccccttcaaacatgaaagatggtgcccgaccatacagagcacctctgaaaatggccacgaatgtaatgcgagtcatgggacttactggacgctggaggcgtcgcgcagtgccgatccagtga

SEQ ID NO: 6962 - DNA, 465 bp, Chlorella protothecoides
atgggcgaggtgctggccgtgggcgaggccgtgtgggtcaagatcgtggaggtgggcgaggacgagcgtggaccccgcgtctccgccagcatcaagctcgtctcccagcgggacggcaccgacctggaccccaacggcctcaagtacaagcctaggggcgccgggggcgggcccatgcaggtgtgcggtgctgagtgggaacttgggggggggggtaatggggggttgctcgtcgccacagggagcggggatggcgtgctgaccttgagggcagggcggggcgtggacgaccctctcttttcgaggagcagggatggcatgctgagcttgagggcagggcggggcgcggacgaccctctcttttcaagtgtcgccctgcccgggtgcggggtatctctccgttcccgcccgccccgcgagctgcccagcccctgtggcctgacctggcatggtgtgggcttataa

SEQ ID NO: 6963 - DNA, 345 bp, Chlorella protothecoides
atgttgtgggagggtctgcccggcccgaagcagcggtggggcgcctccctcgccaccgcgcccctgggggtagctctgccgtggtggccgccggcccacgaggtgggggggtccggcgaggcagggcccagcgcagacggcgcacctgcctgcgcggcgcgcgccaggatcacccttcacacccccaacccccccatggccgacccagatggagggcgcaccgtccaggccggcggcctgctggaggacgccttccattggatccgggcgcactacccctactggaatcgaaagggggggagggaccacatctgggtacgtggcggggcagtgccagcgtgctaa

SEQ ID NO: 6964 - DNA, 303 bp, Chlorella protothecoides
atgcacaaattgtgggtggcccttgcggtctgtgctctcgcctcgtgtgtccaggggatcagttccggagatgctccgtttttcctgcgatcacgcgccacgaagaatcatctcaccaaggaggccgctgctgataaggtgtctagtctccctggatggggaaacctgcaggatgatgagttcgacatctactccgggtacatcacggtggacgcagaggctggccgcagcctcttctatgtgtttgtggagtcccaggacgaccctgccgccgacccgctggtgctctggctgaatgggtag

SEQ ID NO: 6965 - DNA, 858 bp, Chlorella protothecoides
atggaaggggatgccgagctggtggctgccctgggagagagcctgtggcctcagcttgcagaggcctacatccaggcctgcctcaggcccctgctgccaacccctgattgtgctgaggcagaggacctggcctcgtttgggcgggccgcgggaaggggcagcaagctggaggccaaggcgcgcacgctgggcctgctgggcccagatacggcgtcagaggggcccatcgctgcgtacatccgcgaggccatggcgcagtatgccctcagcagccgggccaggtggagtggtggggagggattgcatggaggagtgatagggccaaaatccaccctcatcaggctggtggaggcctcggcggcgtgcctggcgtcctgggactcgcgcgacacgcgcctggtcagcctggcgcggcccgggtcggaggacggcgcgccgccgccggcagaccagcccagcctcctggtcagcgcggcaacggcgcggctgctggcgctggcgcgtgccgcgctggcctccgcctgtgaggccgggtcgcccgtcttggcccaggccgtggcggcgggggtggtggaggtggcggcgctgatcgccgagtttcggccgctcgaaggcgctgaccagctgctgctgccctggccggcggcgctgcggcacaacgactgccaggcggcctaccagctgctggcggggctgccgcacgacctcgcgccgcggctgcaggcactggtgcaccgagcggtgaactttgccaatccgggcgcgcgcgtgcggcgtgcagggtccgacgcactggcggccatgctggccgcgcagcgcgccgagctgtgcgcgctggcggccgacgccggcgtgggc

SEQ ID NO: 6966 - DNA, 327 bp, Chlorella protothecoides
atggggcgcttgcaaaagttctaccaggaggtgtgcctcctggagcagccattcgtcatggacgactccaagagggaagagccgccaggagggctctgcacgctccatccatcaactgttcttagtgcgtgttccaacctgggagcatcccccgccacccctctggcccaggtgcaagacgtggtgagggagctgggcgaagcgctgggagtgcccctgcaccttccggccttcctgcgggtgaaggtgggggagggcgtggacagggacgccaaggactttgctgctgaggtcgcagccacgctggctgaggctggcaaggcctga

SEQ ID NO: 6967 - DNA, 780 bp, Chlorella protothecoides
atgctcccctaccctccctcagaccgagcctacggtcggcaccagggccgcggcggtcccggcttgccccagcacgaggaactcccccccgtctccagcatccaccatgcccgggtggtgtcggtgcgcccctttggcgcctttgtggagctggacggcttccgacggcagggtctggtgcaccatacccaggtggcggaggacgtgcgcttcacacgcgaggacgacgatgcagcgcgcgtgcacgccatggagttcttcctcccgccgggcgagcgggtctgggtcaaggtccaggcgcacgcgcccggacccggccccggccagacccggctgtcctgcagcacgcgggcggtgtcccaggaggacggcacggacctggaccccgagggacgcctgctctccgtccccggcggcggcggcaccggcggtggcgggcaggggggcgcgccgcaaagcgacctgccccccgagctggacagcgtccaccgcggcacggtgcagtccatccgcccctttggcgtgtttgtgcagctggaggggttccgcaagtacgccctcgtccactcctcccaggcgaggcgggtagcccagggggttggagtggggctctctggtcatggagggtggcacggtgccgagccgggaggggagtgttcaggagccgaagcagatgctgtgttgggggcggggtccacaagtcagcaccccagggtggcgcgtgccgaggcaagaggcgcagggcaccactccccccatgcttctggagggcgaccctaa

SEQ ID NO: 6968 - DNA, 435 bp, Chlorella protothecoides
atgccttcggacgcccaggaacgtattgcgcgtctcgaaaggacatgggaatccctgtgcgggcgtctggccgctctggagatggccacggggctgcccgctccccctgccatgcagccatcccccctagcagcctgcatgcgtcctgaggacaccaccccagccgaacacatgggagagggcgcctcccccactcagctgcgcctggcgcaggagttgctgttgcgcggggtgacccgctttgccttccagcgagtgcccgagccctactactcctggccgctggagggcagacggcaagcgctgggtgcagcgagtgtctaccacctgaacttgaatggagatgtcgggcgctccactgttgtcgagaccctggcagcacgcatcggccagagcgccttgcagttcattcctcaacaggccacccactgctaa

SEQ ID NO: 6969 - DNA, 276 bp, Chlorella protothecoides
atggatgggccagcaaaccaaagctggcgggtggttggccgtggccccctcccagcacccaccactgctccctggacactccgctgcccctcgtggcccgcctctcctctgccgccaggcctggaggtggagcgaccctggattgcagacatggtgtacacccccgccacccacgagccggccgccaacgccacccgcctgcggcccctcatctgggtgtacgagatgccggaggattatgcctcacgcatgctccagtaccgggtggacgggtga

SEQ ID NO: 6970 - DNA, 267 bp, Chlorella protothecoides
atgtcggagctggggcccttcttccctaccacgcgcggcaacctacaggccaacgactattcctggaataccaaggccaacgtcctctttgtggaggcccccgccttcgtcggcttttcctactccaacaccaccgccgaccgtgacgtcggcgacaagaggacggcggaggacaaccacgagttcctgctgcgctggttcgaccgcttcccccactaccgctcccacaagttctggctgtcgggcgagagttatgctggtgcgtaa

SEQ ID NO: 6971 - DNA, 1059 bp, Chlorella protothecoides
atggcctcaaccacgccgcatgtgcccgcgcggcatgcaaggtgcatgcatctgacagtctctccccccactccacgcccacagggcccccaggcaccagggccagcagcacagcaggccgcggccgcggctgccctggtgagcctgctggcctctgccagccccgccctggcggcgacggactaccagaccccccccctgcccaccctgaccaacgtggagcgccccggcaccgcgccctccaccacctccctgtcacctggcgacgcacagtccgcgccgcccctgtacggcaccgaggtcaagaaggctgaccagggcctgccggagggcacgcagtggcgctactccgacttcatcaacgccgtagagtctggcaagatcgagcgtgtgcgcttctccaaggacggcacccagctgcagctcaccgccatcgatgggcgcagggcgctggtcaatgccgtgaatgacccggagctggtggaccgcctggccaagaatggggtggacatctcggtgtcggagggcgagcagcaggtccaaccaggcgaccacagcctgaacaccccgcccccctcaccctcaccctcaccacagggtggttttgtgtccctgctgggcaacctgctcttccccctgctggccttcgccggcctgttcttcctcttccgccgctccggcgacggcgcgggcggcggctttggtggcggcggcatgggcggccccatggactttggcaagtccaagtccaagtttgcggagatcccggagaccggggtcaagtttgatgatgtggcggggtgtgacaactccaagctggagctgcaggaggtggtcgacttcctgaagaacccggacaagtacaccaagctgggcgccaagatccccaagggtgccctgctggtcgggcccccaggtgtgtacatggtctggtgtttggggtgtttcgtgtgctgggatttgtgccgtggtggtgccgacgccgtggcagtcgatgggcagacgtgtgtctgcctgccgatcgaattcctggtcccacggatcagcacgtgtccatag

SEQ ID NO: 6972 - DNA, 522 bp, Chlorella protothecoides
atggctcgagcgagggtcccagccggtcgaccggggcggtcccgctccacgaaggccggtgcgcccaccacctccccgctggactggctggatgactacgaagctgtcagcgcctggatggcgcggcatgacctgcataccgcgctggaggctggggacgggctcgcctgggtccccgacttcctgcccggtgcagtggctgaggctgcgctggcctgcctggaggccattcccccctccgcctggaacgccacggcggctgccgaggacgcaggcgccaacaatattgcccacgagttctggtccaccaagtcggcgccggggacggccctggcccagctcctgcgcgccttccccctgctctccccgcgccacgacttcaccaccttttccgccgcccgctacgacgcccgccaccacatcgcgccgcacgacgaccgagcctacacccccgtgctctgcgacgatggtgggtggaggcatgggttggggttgagtgtcggtggcacaagggtgaggtag

SEQ ID NO: 6973 - DNA, 207 bp, Chlorella protothecoides
atgcgcgcccggagcggcgacgaggctaggggccgcgcccggccgcgccaggtggcggacaccgtgggtgcgggcgacgccttcacggccggcgtgctgtggggcatgctgggcgggcacagccttgccggcgccgcgctggcggggtgtgaggcgggcggcgtggcggtggaggccgcaggggcggagccgggcgtggctgcgctg

SEQ ID NO: 6974 - DNA, 276 bp, Chlorella protothecoides
atggccgcaaacgagggcgccctgcccagcgcttgggacagcaatcgccggagtagcaactcccgcttcttgcaagtgaccgatctgagggtcaagtacataggcactggcaacgatgaccgagacgctgctgccatccgatccaactatcccgtcagcaagtccctgcccttctactactgggaggcccaaatcgtagacaaggggcgagatgggttcattggagtgggcatgtcggctgcggatgtcaagttggaaaggctcccaggtgggtaa

SEQ ID NO: 6975 - DNA, 1410 bp, Chlorella protothecoides
  modified_base (403)..(412): a, c, t, g, unknown or other
  modified_base (881)..(938): a, c, t, g, unknown or other
  modified_base (1240)..(1249): a, c, t, g, unknown or other
atgcagctgcgcccctccatggcgcacctggacgcagagagggagggtgggaagaaagcggcgcccaaggaggaggagggccccgacgctggcgtcctgatgcccgtcatggtgcaagtgaagaagcgggagacagaggcccagctggaggcgcgtttgcgctcctttgcccacatcaccgcccaggaggccgccgaggagtgggtgggcctgcagtaccatgatgacatgtccgaggtgatttgggcatggccagtgggaggtgtgacgagtgcttcgtggagatgtggaacgaatgaggggccgccgttcatgagccctgggggtccccactccgccagccggcagcccacgtcaagcatcccctggcctccaccacccagcccccctcaactcaaccccnnnnnnnnnntcggcagcccatgtcaagcatccccctggccaccaccacccagcccccctcaactcaaccccccctcctccttccccggtcaacagacctcccagggcatcgcccagaagctggccgccgccgacgcgcagccggcactgcaccccatgcgcgccggggactacctggcggcgctggtcccggaccccgaccgcgatggcgccggggtcgtgcaggagatgcccatgggcgccgccgccaccgccgcagctgcgcggccaacgggcgccgcgccgcgcgccgggccgtccgccgccgccccgtcggcgcacccctccggcccggagttcccgcccgcgcaggttgcgggcatgggccgcgcgctggggcccctgttccaccacagcccggtgtgcaacctgggcgccatccgcggttacctccagcgcagcacggccgagcctgggctggcggcggccgtggcggcggnnnnnnnnnnnnnnnnnnnnnnnnnnnnnnnnnnnnnnnnnnnnnnnnnnnnnnnnnntgcacgtgggtgtgctggccaccggcctggtcctggagatccggcgggcatacgtcctgcgcagcctgggctcgcccgcgctggacccgctgcgcgacctcctgctgggcctgctggcggggagggaggcgctgaagcgcggcgacatcatggaggcggcgcgcgcggcgggcatcccggtcaccgacggcctctactccaaggtggtgcgcgacatctgcgtgtcgcgcgggtccacctggagcctgaaagtcacgtgagggcactcctgtgcctgctcgccgtagaccttcccaactccnnnnnnnnnntggctctggggaacacccacgaggaactgagagtgagcggggaccttcccctccgacagggcactcctatgcctgctcgccgtagaccttcccaactcctatcatcagtgcccccaaggatcgccggtttgcctgcccttctgacgcccttcacaagctga

SEQ ID NO: 6976 - DNA, 1425 bp, Chlorella protothecoides
tcctctacttgtgagctgggtacggtagtgaggtcagcccctcatctgcctcgccatggaatggatggcatcctgcgccgcactcgcagctcgggcatggccactcatctattccccttccctacacctgatgcaggcgaggtgccgttcaaggacgtgtacctgcactccatcgtgagggacgcccaggggcgcaagatgtccaagacgctgggcaatgtgattgaccccgtgaacgtgatcgagggcatcagcctgcaggacctgcacgcatcgctggagggcggcaacctggaggccgccgaggtggcgcgcgcgcgggagggccaggtccagaacttccccgacggcatcgaggagtgcggcaccgatgccctgaggtttgccctggtcgcatactcttcccagggccgtgacgtgaacctggacatcaaacgcgtggtggcatatcgccactggtgcaacaagctgtggaacgccatccgcttcgccatgctcaacctgggcgaggactacgcgccgccggagggccccatctcccacgccagcctgccctttgcctgccgctgggtgctgtcccgcctggacgccgccacggccgaggtggaccgcgcgctgaatgcctacgagttcgccgccgccaccaccgcggtctacgccttctggcagtacgacctctgcgacgtcttcatcgagctgtccaagcccgtgctggcaaagggcggcgctgaggcagcagagggcagcgctgagctggcagccacacgcaccacgctgtggacgtgcctggagacgggcctgcgcctgctgcaccccttcatgccctacgtgacggaggagctgtggcagcgcctgccgcgcggcggcgcgcccctccccaccccctccgtcatgctggccgagtacccgcgtgcctcgcccgacgctcgcgatgcgcgcgccgaggccgacatggcctacctgctggcggtggtcaaccgctgccgctccctgcgcgccgactacggcttgacgcgggagcgcccggcgctgcacgtggcctgcgccgacggggcccggcgcgcgctgcttgcggcctcagccaccgagctggccacgctcaccgactcagcctcggccgcactgctgtcggcgggggaggccccgcccgcgggctgcggcgtggcggtggtggacgacgccaccacgctctacctgtccctggcggggattctggacgcgggcaaggaggtggagaagctggccaagaaggaagcggaggcggccgccaggatcgaggcgttggagaagaagatggcgctgctgagctacaaggagcgcacgcccgcggaggtcaaggaggcggacagcgagcgcctggccaaagcgcaggcggagctggagtccctgcgtgccgccaaggctgacatgcaggccctggcctga

SEQ ID NO: 6977 - DNA, 267 bp, Chlorella protothecoides
atggccaaggtgggagtcgtggctggggtcggtggcaaggccctccttgtcgccgcccaatcccccaacattgatgaacggaagtacgcccaagtgctgcgcatgctcgggaacggtcgcctggaggcccactgcatggacggcgtgaagcgtctgtgtcacatccgcggcaagatgaggaagaaggtgtgggtgaatgccggagacgtggtgctggtcggcctccgcgactaccaggacgagaaggcggatgtcatcttgaagtga

SEQ ID NO: 6978 - DNA, 495 bp, Chlorella protothecoides
atgtccctcaaaagtactccctcctggcccctcccatctcatcttcccaccctcgcccgatacaactccccctctcttttccaccctccacccctccaccagacgcctggcaacgtggtggggcggctggtgttcaactactgcacccaccacggcctgtgggacaccgccagcctggtggcccgcgacgtcctggccggcgccgtggccgtgtcggaggcacagcgcgcggagcaggcgggcctgcgccgcctggccgcgcacgtgcgcgcgggcgacgtcgacgccgcgctggaggaaagcgaggcgctcgggcccggcgtgctggccgcgcgcccgggcatccgcttccgcctgctggcgcagaagctggcggagctggtgaggagtggttgtcaatgtgtgtgtgagctggatgttgggggtggcatcgttgcaaggggtaaagaagatgtgtcagccaggcagcgagttgggagggggcccgggctgtga

SEQ ID NO: 6979 - DNA, 282 bp, Chlorella protothecoides
atggcagatgaggctcggtcgctcaaggcctatggcgagctgcccgacagcagtgctggatcgattcgcaaatggttgtcgagtgccacctactcacctccaaccacccccaccgctgcagtccgcgtcaatgacaccgacacctttggcgatgaggagggaggcgagaacgacgactacatcgacttcgacgacatctctggtgtgtgcttgtgggtgggtgggggagagtgcttgactcgattgccaccgtgtcctgctttgcccgcgacaggcgattga

SEQ ID NO: 6980 - DNA, 255 bp, Chlorella protothecoides
atggatgtgcgactggacacaacgatccccgagtacaacgacaatgtggagcccacacgcctgctgaaaaagctcaccctgcagtcctccagcgtggagtgcggcacctccctggcggcagcctttgttgagggcgacaggctgatactgctccccatcgacgaggtggggtgggatggtgaagcaggggttggtcatgccctggcagaggccaatgcaggcactttgtgtcgacgcaggcccagtaccgtctag

SEQ ID NO: 6981 - DNA, 375 bp, Chlorella protothecoides
atggagtttgggcgcgctgtggtcgaccccgccgccagcaccgcggaggaccacgagcttctggaggacgtggttgcgctcttcgcctacacagacccggcatccagccccagcggccgcctgctgaccgatgagcaccgcgctgagctggcggctgctctggtgcgcgcgatgctggcgcagtccggcaagcgcgagttctctgcgctggaggtcctgcatgcgcacgcgcgggcgctgcacgcccagctggtggccgccggcgacccctgcaccgccatgatccccagtgtggagaggtttgtggcggcgcgaggggcgccgctggagcaggaggaggacggcgatggcgacacggccatgccccctgcttga

SEQ ID NO: 6982 - DNA, 951 bp, Chlorella protothecoides
atgtcggaggtgggagacgccgaagcaccaacagcacccttactggcgacggtgcctgacgcccactctggacccaagtccttcccccttgatctcggggacgatggggtggaggacatcaccctggagaggaccaccagccaccacagcgccgacgccgccggcaatggctggaaggccaccaccttcatcctcctcacagacatgtttgggtgtgtgtccaatcccgcagtctcctcctgccccaccctcgctctcgccatcccccaacaccaccacagcttgggcgccctggccattccctccgtcttcgcccacctgggctggctggcggccggcgtcgcgctgctggccctgggcttggccatgctcttctccggctccctcttcacgcgcctggccgccgcccaccccgacgtctcggtctaccaccgcctggcgggcgcggcctacgggcggcgcgggcgctggctggtgtttggcaccgtctacacgctcatcctcctctcccccgccgtcatccatctcacctccgccgaggcgctgggggtgctgatggggggccgcgccggcccgtccccgggcctcctcgtaaccctggccatgctgcccctggcccaggtgcgcagcatggaggacgtgggctgggtgtcggtggtcggcaccgggaccatgctggccgcggtggcggtcacgctgggcaagctgctcctggagccgctgccggagcgggcggcggcggccacccactggctgcccccagcctccaccacgccgcgactggcactggtagccctgctggacgtcgtgtttgcctacggtggccagcaggcaaggacttggcttggtgtggtctggtggaggccggatggcgggtcaccgcggagagctgtgtcgggggtgctggtggcgacagcgcattttgaactcggatggcgccggaatacctga

SEQ ID NO: 6983 - DNA, 915 bp, Chlorella protothecoides
atgcagcttctttgccggggatgtgtaccagggcgacgcccttggcctgacctccgaggacgaccccgtccccactccggacgaggccgctggtcccagcgcagcagcgtcctctgccgccgaggcgtcaggggaggacgaggccgctccgtcggggctgcgcctggctgcccccgaggccatgaccgccgccgaggagaggacggtgctggccgggctgcagggactcaagcgcggatcccagaggtgcggggccccgctgctcctgccggtgctcagaggcgaacccctcatacatgcctgaaggtttgccgtcgtactccacggcttgagccccacaacaaagtcccctcccttcattccctggtccccaggatcgtgctgcagcagctgctgcagggcaagatcctggacagcgaccccgaggcgcggcgcgagtgggccgagatcgagcgctccttcgcgccgcccaccggcctgcgcatgcgcgtggtggacatcaagcgcacctccaagggcacgcggtcggggggcctttaccgcttcggggccatggtggtggttggcaacggcgagggcgtgctgggctggggccagggcaaggccgccgagctgcagtctgccgtgaagaaggcgtacgcccgggcctgctcgaacctgttccccatcccgcggtacaatggccacaccatcccggagggcattgaggccaagtttggccaggtgaagctcgtagtgtaccccaagtctgccggcagcggcatcatcgcttcggagatgattggcggcatttgcaagatggcgggcatccacgacatcggggtcaaggtgcacggatcccgcaatcgccggaatgctggtgagcttgtgcattcatttgttgtggttgggtgggaggagggaacggtcgcttga

SEQ ID NO: 6984 - DNA, 396 bp, Chlorella protothecoides
atgaactgccgcccagttccagcggcgcgagctgttattaacatcaacgtgctgacgcacctggtactgacagtggtcgccaagcaccgtgcacccgcccgcagctggcggggctggggcgcctggaccctggtcagcggcgtcggcgttttggccagctgggccctggcctccggcatccccttcttctccctggtcatcgcactggtggcggctgtgggcgacgtggctgcgggctacctcatccccgccctcctcgcactccgcctgctgccgctgggccgcgccgagcgctggctctgccgcgcgctggtgcccctgtccgtcgccctgtctgccgcgggcatcttctccgcggtccgcgagattgtgcacgactccgcggcagcaccctga

SEQ ID NO: 6985 - DNA, 375 bp, Chlorella protothecoides
  modified_base (292)..(301): a, c, t, g, unknown or other
  modified_base (362)..(371): a, c, t, g, unknown or other
atgcacggcaccggcacgcccctgggcgaccccatcgagacgggggccctggccgccgtctttggcggcgccaccctcaccctgtgtgcggggaagagctccatgggccacaccgagccggcggccggtgtggtgggcctggcgcacgcccagcgggcgctgagtcagcgtgtcgtgcagcctgtgctgcacctgacaaaggtgaggtgctcgtgggtagggaaggggaaacgaggaagcgggagtgcttgggggttggagcatggcatgatcaccgggggtaagggcaacnnnnnnnnnngaggaagcgggagtgcttgggggttggagcgtggcatgatcacgggggggtcagggcgagnnnnnnnnnnttga

SEQ ID NO: 6986 - DNA, 1848 bp, Chlorella protothecoides
  modified_base (1604)..(1613): a, c, t, g, unknown or other
atggagtgcgcccccgccgggcgccagccgctggcgctcagcgcctccaagtcctgggtcggccacgccgagccggccgcgggcctggccggcgtggcgcaggccgcgctgacgctgacgcacgcggcgctgccgggcatcctgcacctgcaggacgtcaaccagtacgtgggcacctccatgcgccccacccccggcgtggcgccggcgcgctgggcgctgccgcgcgccacctttggccggccacaggaggcggcggacgcggcgtcgtgcctggcgggcgtgtcggcctttgccttccagggaaccaacgcgcatacgctgatcagggcgcctacgtcgccctcagtggatgcggagacgagcaagaacgtgagcgtccagcccgtctggcagcgcgggcgccactgggtggcccccagcccgcacgccggcctgcatcgcgccgcgatcaatgcacgggcgatggtgctggagtgcgctctgggcgccacgcctgccctcgccttcctctgggaccacagggtgagcgggcgcgcggtcgtgcccggcgcggccttcatggagctggcgggggtggggctcgtcacggctgttcctggagacatcagccgggcgctgcagggcctggaggtgcccaaccccctcatcctgcccgagggcggcgaccgcggcctcaccatccgcgtcagcctggcgctggcgtcgggggccgtggcagtggcctcctccccggccgccttcaagcacgcccacctgacagcccaggccggggcagtggagagcaggaatggaagtgcctccgcacggcccacactccactcaacggccatccaggcgctggcgggcgggaccactcccgcgcaacaacctgctacgcccggccccctggcgggcctggacaacacgggcgccgccgacctggccttcctcgcccaccccgccaccctggactgctgcctgcaatccgccgcagccgcgacgggccaggaagccggcctgaaggtgcctgccggcgccgacgcggtgctggtgagcggcacaaagctggcagacgccatgctgtgggccttcagcagggagctgtcggccgactccgcgacctcccggctcgactacggcctggcgggcgggagcggcacgggcatgagcctgagcggcatgaccctcaagtccctggcggggaccggggccaaggcgacggcgcaggccgccgacgcgccgacgagcatcgcagaactgctgtacaacgtggcgtggcccgctgccgtgcctgttgaggtgcaaggaccgactaccacctttgcgccgcgcttccagctgcctcgcggcgacgagcgcgccgcgacctccgcgctggaggtgctgcagggcggcctggcggcctccgcgagtggcgttggtttcgtcggcctgcgcggcgcctcggcccggtctgaaagcaagggcctggcgctcagtgggctgctgcgcgccgccgccatggagacgcgcggccgcgtggcgctcgcggcctcggcactggacgcgcagaacgcgaccgcagcgcgcgccgcctgcctggagctggctccgcgcgagcccgagcaggggtccgcctttgnnnnnnnnnncagcgcgcgccgcctgcctggagctggctctgcgcgagcccgagcagggatccgccttcagcaacggcgcttacggcacggcggagagtggcaaggcgcggcacgacgcgcggctgcgccgcaccgcgcccgccgcgccgtcctccgtgccctttggcctcttccctgcgccgcgcggcgcgctgcagaacctgcgccgccgcgcggtggacgttgctgcgccagccccgggtga

SEQ ID NO: 6987 - DNA, 2274 bp, Chlorella protothecoides
  modified_base (743)..(752): a, c, t, g, unknown or other
  modified_base (1309)..(1318): a, c, t, g, unknown or other
atgtgtgcctgtatatactcatatatttggccatgcgctgtaccccttgtcccttggagtggtgcacatcactcaccacattgcagacccctgtccccaactcttgaatcctcaccctctcttcctgcttccttgcccctcagaacgccccgacatcagcttcaacctggtggcggtggacttcctgtcggacgaggcggtgcagtactgcctatcccgcctggcctactacatcgggcagggcggcctgcgccccctgcccaacgtcgttcacgacctgaccaacgtgcgcaatgcgctgcgccagatgtcgctcgcgcgccacgtgggcaagatcgtggtgaggacggggacgctgcagcagcgccacgcagacgtcgcgcgcggcaccgttgccattaccggcggctttggcatgattggctccctgctggccggctggctggccaggcagtccatcggggggatcctgctcctgggacgctccgggcgtggcgcctccgcagagggcgccgtggcacttgccgtagccggcagctgcgtccccgtcaccatgcggcgctgcgacgcgggcagcgcggccgaggtggccgccgccgcagccagcctgggcaccgcatcccacctgcaggtgagatatttggttgggatgctgtggcttgggagatggggtttgctctttggctccctcaggaacctcccaacatctggtgtggtgcactccggcggggtgctggccgatnnnnnnnnnngaacctcccaacatctggtgtggtgcattccggcggggtgctggccgacgcgaccctggccaaccagagcgtggccggcatccgcacctccttcgcccccaaggccgatgcggtccagctgtggcagggcgcgctggggtcgtccccggccaccctgcacctcgccttctcctccgtggcggccctgctgggctcccccggtcaggccaactacgcggcggccaacgcgacactggacgctgcggcccagacctggcaggcgcagggcctggcgggctttgccagcgtgcagtggggcgcctgggccgagggcggcatggccgccgcgcacgtcggcaccgccaaggccgtggagcgcatgggcctggccatgatcgaccccgagctgggcctgggcgccgtggcgggcctgctgctggccggcgccgccgcgcgccccaccaccgcggccgtgcccttcatgacgaggcggtggcggtggatggcggtgacggcggcgacgccgccgagcagggaccggctggggagctctcccccggacccggcgctccgccgtnnnnnnnnnncggtggcggtggatggcggtgacggcggcggcgacgccgagcagggaccggctggggagctttctcccggacccggcgctccgccgccgtccttcacccgtcgccgtcgcaccctgtcctcccacccggggaccgtcagctctggccccaaaccagcaaagaagacaccggcgcagggctctgccgagcccagcgccgaggcgcgggcggccgtgcaggccgctgtgcaggactcggtggcgggcgtgctaggcaccagcgtgggccccgaggatgcgctcatggccgcgggtctggactcgctgggctctgtggaactcaggaatgcgctagaacggcgcgcgggcgtggagctgcccggcaccctggtgtttgactaccccaccgtggccgctttgaccggcttcatcgccggccgcgtagcggcggcgcagggcggggcggtcgaggacggagaggagcccgccgccgccgcgctttctgacagtgatgtcgatgatggggcattctggtcgccgcgcggtgcggcgtcgctcgcctcccgcctccctccccccgctcgtgtcatcggcgtgagtgagatcgtgctgcggtcgcctgccgacgcgctggcgacgctggtgccggtggacgcaccgagccgcgtcccgttgtcccgctgggaggtggacgctgcggccgggctggcgggcggcctgcccgtgcagtacggcgcctggctggacgacgtcgacttgtttgacgcgcaggcgctggcggtgagcgccaccgaggccgcgcagctggacccacagcagcgcgtcctgatggaggcctcggcccaggcattgctcggtcacgtggatctgttggcggacgagggcctgcgcgccgactggggcgtgtttgtgcctttctatcgtacgacgtggtggaatgatggacaaccctgcagtgctggagagcacagggcatga

SEQ ID NO: 6988 - DNA, 3552 bp, Chlorella protothecoides
  modified_base (1885)..(1894): a, c, t, g, unknown or other
  modified_base (2135)..(2205): a, c, t, g, unknown or other
atgctgggccgggcgctgcgcctcggccccggctccgtggggctggagtgccgcctcgccggcctgcacatggagtacctgtgggaccacgcggtgggcggccgccccctcttcccaggcgccggcttcttcgagctggcatcggcgacggcctgcctgctcagcggcgggggcgacgccccccctcccctgctggtgaacgccgccgtccccgcccccctgcctctgcaatccccgggcccgggcctggcggccgcggcgctgctctgccgcgtgaccacccagaccggcgcggtggaggtcgtgtccagcggcgcgcggcgccagacgcacctgcgctgcggcgtggccgctgccaacgacgccgacgcgccgcggcgccggcgcacggggcagggcctgacccgccgtcccaccaacctgcaggcgctggctcgcgggccggcgctggacgcggtggcggggtccatgccgctcgccctcgccccgggcatcgcagcgcactttgccggcatctctgcgtccgccgaacgggcgcgggacgtgtccctctcgcccgccgccctggacgccacgctgcacctggcggcggttcccggccgcggtgcctccggcccggtggcgctcaaggtccccgccgctgtggagatgctggcgctgccggcctgggcacgtgcgcccgagggcctcgccgcagtcgcagcctgccgcctcagctcccccgcgggggacatgaacgactacggcgtcctgccgggcaccgccacgatcaccggcctgaactcccgccccctgggcgccttgccgcccatgcccgccgccggcgccgccgtgtcggcgaccggcgatgtaccgaaccgctcccagctggtgtacggtacggcgtggcaggctgcacgtgctgagacagcaacgcacatctccgcagatgccgccctgtcgctggccatcgcgccgccggggcgcggccccgcgcgcgtggggctggacggcatcgccgccatcgccacgcggctggcggccgccggccgggcacccttctccctcggcctgcgcacgcccaccgtgctgcatggcgccctggcggcgcctgcgcccgcgctgggccccgcgctttcctctgccacgcaggcgcccgcgctgctgtggggcgtgctgcgctcggtgggcctggaggtggctggcgcgagtgtgtccgccgtggacgaagacgcgctggcgtatggctccagcgaacagacatcgctctctctgagtggggccggcgccgccgacggcgcaagtgaaagggcctacggcgcggcgcaccgctcgggcatctcgctgcaagcgacgctactgccgggccgccggcgcgcggcgccgctgcccaccccgtccgctgtccagtcccgcaccgtcatcaccggcggcacggggtctttgggcacgctgatcgccgggtggctgggcgcgacggacagcgccaccgcggcgctggagctggtgggccgcgtcggccgcgtcgccgacgcgcgctccgccgacctggcgcacctcctgcgcacctgcctggcgccggtcagcctggtcatggccgacgcctcggtcgccgccgacagccgcaccgtgttcgggccccgcgactaccccctggccgccgtggtgcactccggcggcgtgctggcggacgccacgctggccaaccagagcgtgcgcagcgtgcgggcgtccttcggtgccaagaccgccgtcgtggaggcctgggcgggccccgtcaggtgccagcccgtgaccgcagccgccctcttctcctccgtcgcctcgctgctggggtcggcggggcagaccaactacgccggcgccaacgcggcgctggacgcggccgccgcgctggcgcaggctnnnnnnnnnnggggtcggcggggcagaccaactacgccggggcgaacgcggcgctggacgcagccgccgcgctggcgcaggcccggggcctgccctccaccagcgtgcagtggggcgcatgggcaggcagcggcatggcggcccaggataagtccaccgccctgcgcgcgccgctccggtgctggccgccgtgcccttcctgtgggacaggttcatgccgcgcctggcaggcgttccgcccatgtttggcnnnnnnnnnnnnnnnnnnnnnnnnnnnnnnnnnnnnnnnnnnnnnnnnnnnnnnnnnnnnnnnnnnnnnnngcgcccgccgtgaagcccgccgctgtggctgctcctgtgggtcggcccgccgcgcgccggctgccgccgcgcccgccctctggcgggcgggccgaggcaccgacgacccccgccgccccgccggcagcggtcctccagggcatcttggagaaggtcctggcagccgcggcgggggtgctgggccgtgccgtcgacccggccgagcccctcatggccgctggcttggacagcctcagctctgtcgaattccggaacgtcctggaggggcagctcgccatggagctgcccaccaccctggtcttcgactacccctcagccgaggccatcgccgggtttgtggcggcctccctgcagcctgctgccggttccactgtggctgccacggccccagctggcgtcacgccttcagtcgacccgacagccttcctacccatgatcctggcagctgccagccagctgctggggaccgacatcggcgcagacgacccgctctctgccgccggcctggactccctgagctccgtggaattcagaaatgtgctggaaagggaggtcggcaccgagctgccttcgacgctggtgttcgactacccatcggccgccgccatctctgccttcctggcgactgccactgccccggcggcgtcagccgcggcgcccgggtcccaggtccggccccgctcggcgccagcgcctgtggaccccgacgccttcctttcactggtgtcagcagctgccagccagctgctgggcacccagatcggcgctgacgacccgctctccgcagccggtctggactccctgagctccgtggagttcaggaacgtgctggagcgggatgtgggcgtggagctcccctccacgctggtcttcgactacccctccgcccgcgccatctccggcttccttgccaccgtggtggtcgcccccggtggcgaccacggcgctgacgaaggcgaggccgagtacgactcctggggcgcggccgaccatccctccaccatccccgcccagctcacccaggcgctgcgcggcggtggtgccggcttcggcctgggggacgcggtggtcagcttgcgcgccaccaccgaccaccgccccttcacccagggccgggcaggggacggcgcgcgggacgccgtccgcgtcatcggcctggaccggtgggatgtcgaggcgcagacggcacgcggcgggcccctgcccaacagattcgcgagcctgctggacgtgagctgggtttcgttttttgggtggggggcccaagttggaggggcggggtgcaaaggggttgccacagggcaggctggcgggtgtattgccaaggcctggtatctggaaggctag

SEQ ID NO: 6989 - DNA, 423 bp, Chlorella protothecoides
atgcgccagtgcgcctggggggtggccgccggggtcaacctggcgctgcacccggagacgcactacagcgcacagaaggcgggcatgctgaccgccgacgggcgctgcaagtccctagacgccggcgccgacggctacgtccgcgccgaggcctgctgcgccatgctgctggcgctgaccggcgccgacgagctggcgcgcgctgatgaggacgggccggcgctggccctggtccagggctcggcggtgaaccaggacggccgctcctcaagcctgaccgcgcccaacggccccgcccagcaaagcgtggttgccagcgcgctggcggtggctggcctccacgcctccgacgtctccggcgtgtccatgcatggcacaggtgcgtcgtcgtgctcctggctggatggagggggagggtgttga

SEQ ID NO: 6990 - DNA, 1146 bp, Chlorella protothecoides
atgacgtgcgccacgcccaggctgcgcagcagcgcgcgcttggcggggccgcccgccgtggtcacgggcgtcgcgcccgcgcggcggatgacctgcagcgcggccaggcccacgccgcctgcggcggcgtgcaccagcacccgcgtgccgcgcccgatgccggccagcctgtccagcgccgcgtccacggtgatgaacacgcgtgcccatgccgccggtgatgccgagcgcgggcgcggccccggcggggcgcgtttccagtgccggcgcgcgcaccacgatcttgcccacgtgccgcgcctgcgacatctggcgcagcgcggcctgcaccgcgcccaggccgtggctcacggtcggcaggggtgccagcatgccagcggccacgcccgcggatacgcgggtcaagcccgcgtgcagcgcggcctccgacatgaagtccacggccaccaggctgtaggaggcgtcggggcgctcctgcacgacgcgccccgcgctccagatgtcgcgcttgctgatctccacgaagcgcccgccagtattcaaggtcgccagggacccggccaccatgccggaggaggtgaggctgttgagcaccacgttcaccccccccagctcggcggcctccgagacaaagtcggtgtcccgcgacccaagcacgtcccgcacgcccaggctgcgcaggagggcgcgcttggccggcccacccgcggtggccagcggcgtcgcgcccgccgcgcggatgacctgcatcgcagccaggcccacgccgccggcggcggcgtgcaccagcacgacgtctgcggggcagatgcccgccagctgcaccagcgcggtgtccacggtgacgaagacggtgggcatggaggccgcggcctcgaagcccaggccggccggcatctgcaccagggtgtgcggcgagacgcacaccgccgtgcccaggctgccggcggccaggccaaagaccctcgtgccgggggccaggaccgcggaaccgggcgaggtcacgacgccggcaaagtcgccgcccggcgcgccggggtcgccgggagaatggaagggggggcggtagtggaggaccaggggcctagctgtaaggttacgacatgcagcactttcagtcgggaacctggaaaaaggcactggtga

SEQ ID NO: 6991 - DNA, 2457 bp, Chlorella protothecoides
atgtcggaggatgcgctgcacgctgcactgagccgtgtggcgagccaggcggccgccggcacgctggcccccctgccccacatctcccacggcatgggcgcggtgacggccgcgctgcgccagatgtcgcaggctcggcacgtgggcaagatcgtggtgcggctgccccagggcgtcgaggcgccgcgggccgacgcgccggtgctggtcaccggcggcctgggcacgctgggccgcctggtggccggctggacgcagcgccgcggcgtgcgcgccgccgtcctggtcagccgatcggggcgcggcgacttggagccgggcctgatcgccgcgcggtgcgcggtcaccgtcttcaaggccgacaccgccgcgggcgaggacgccacggcgctgggcctgctgggcgcctacggcgcggtcttgcacgccgcgggcgtgctggcggacgccacgctgggcaaccaaagcgtgcgcggcctgcgcgccgtgtttgcgcccaagaccgccagcgtgcggggttcggagcgggcgcgggcgcccacaccgctgcacgtcctcttctcctcggtggcgtctttgctcggcgccccggggcagaccaactatgcggccgccaacgcggcgctggacgcggccgccaccgcccgcgcggccaccggcctgccgagcgtcagcgtgcagtggggcgcctgggccggcggcggcatggcctcacgcgagaccgaggcccgcgtccagcgcatgggcatgggcatggtggagcccggccccgggctggccgccctggaaggcctgctggccggcgccgcgccatccatcgccgtccgctctgccaaccccttcaactggccgcgcttcgtcgcgcgcctgggcggcgccgaggccgcgcgccacctgcccctgttctcggactgggcgggcgcggccgcggcggaagcatccactgccgcaactgcgacgaaaacttcgagcgccgccgcgcgcccggccgccgggctggcgcgcgaggcggtggccgaggcagtgttggacaccgtggcaggggtgctgggcgcgcccgtgggcgtcaccgcctcgctcatggaggcggggctggactcgctgggcgcggttgagctgcggaacggcctgtccaagcgcttcggcctggacctgcccgccaccctcaccttcgactacccctccgtctccgccatcgccgagtttgtggtggagtccatgggcggcggcgaggaggaggtggccggccaggaggccctccgcgccgcgcccgccacccctgtgcccagccagcacgggtcggtggtggggctgacgggcgtggcgctgcgcctgggcggcggcatcgacgacctggccgccttccgcgcggccctggtggccgaccgggagctcatcgccaccgatccggcgccgcgctgggacgcggacgccctgttctccgccggcggcggcgtgggccgtgtgtccacgcgcttcgcctccttcgtgcatgacacctttgccttcgaccccgaggcctttggcctcagcctgaccgaggcggcgctcatggacccccagcagcgcatcctgctggagaccaccgtggacgcatttgcgagcgcggggcatgcgactgccaccctggtcggctcccccaccggtgtctacgtcggctgcatctggctggagtacggcgacctggccaccgccgcgggcaacccggcgggggcctacatggtcaccggcaacggcctggccttcatgaccggccgcgtgtcctacgcgctgggcctggtgggcccctccgtgcccaccaacaccgcctgctcctcctccctcgtggccctgcatctggcggccgccggcctgaccgcgcgagactgcacgctggccacggccgccggggtcaactccatgctcctgccgggcgccgcctcggcggccatgacccaggtgcacgcgctgtcccccgacggccgctgcaaggcctttggcgcggaggccgacggctacggccgcggcgagggctacgtgtcggtggtcctggagctggctggtggggctggaggggaagacggcgacgctccgacgttcgcgtcgaccctgtctgcagtgctgggcggcagcgccgtcaaccaggacgggcggtccagcgggctcaccgcgccgcacggccccagccagcaggcgctggtgtcagccgccatggccgcggcgaggctggatgtgctggactacgtgtccacccacggcacgggcacaccgctgggcgaccccatcgagtccggcgggctgcgcaaggcggtcacccgccgcggcgcgaccccggcccagctggacggtcactccttgacactgggcgcggtgaaagtgctggcggggcacctggagggcgccgccggcctggcggggctgctcctggcccaggtggccatggatagcagcctggcccacggcctgcgctacaggtga

SEQ ID NO: 6992 - DNA, 2214 bp, Chlorella protothecoides
atgggggttcccagggcgaggggaagaaaatcaaggtacagaccgcgatgcgcgtgctcttcacgcccctccctcctccaacccactccacccctcctctcccctatcctccctccctcaggcacggcgctgggggaccccatcgaggtgggcgccctgtcggcggtgctgctgggcgccgcgcagcgcggcgacccgcccctcaccctgctggcctccaagtcctggatcgggcacggcgagccggcggcgggggtggtgggcatcgcgcacgcgcacgccgcgctgttggcgtccacccagctgcccatcctgcacctgcgcgccctgaacccctacctggagggtgccatgtccaagactgcggggcactgggccgttccgcgcggcgacgcgccctggggcgccgacgcctcggccgcgagcgggcggcggtccctcggcgtcagcgcctttgccttccagggcaccaacgcgcacgcgctgatcggcgcggcacccggccgcgagctgcgcggctgggcggggcccgcccgccagccctgggagcgcgagcgcgtctgggtgcaccccccggtgcacagtctgctggagacctttgcggggacggccaagcgcaacccgcgcgccgtcttctccaccctgctctccgcccccgcgtcctccttcctcctcgaccacgtggtcaacggcatggccctcttccccggcgctggcttcttcgaggcgggggccgcggcggttgcctgcctgctgggcccgggcctggcgtccctgctggcagacgccaccatcccctccccgctgcggctggccatccccagcgaggcgcggcgcgcggacacctacccctttgccgagctcaccgccgtggtcagcgcggaccgcggcacggtgagcctgcagagcggggccggccgccgcgccccggtgcacctggcggcgaccgtcgcgaccgcgcccgcgacgcgcagcgccaaggccggcgcggtcgtgtccggggccacctccggggtcaaggccaagcgccccgctcgcggcaccgcactcctgctgcgcctggtgccgctggtgggcatcgcaccctccacggcctctgtggcgcagcccacgcacggtacctcaggctaccgcatgtctcctgccgcgctggactgcacgctgcagctcggcgcggccgccagcctggaggccggagcggcgctgcgcatccccgccggcgtcgacgcgtttgaggtcgccgccgcggggccctccctcgcgcgcctgccggccttcgccgccgcctgcccgcaggaggactcgcccggtgcgctgtccaccggcgagcccacctggaccgactacctgctgcgcagcgatgcggccgcggcgccctccgcctccgtcagcggcctggaggcgcgccccaccggcggctccggcagctcggacgcgcgccgcgtgcgcgcactgaagaagaagcgggccgcggccgccgacggcgtctatgccaagcccgagcgctggatgtacgacctggcctgggccaaggtccagactgtaggaggcccagcggctggtgctggtgctcccattccatccctggccctggtcctgaagcaggccctggggcccgccgccctcgccaccacggccatcgcgctggcgcaggaggcggcgacctccggcgcggcctcgctggcgctcaccaccgccggcgcggcgctgggcgaggagacggcacgcggtttgaccccggccgcgcgcggcgcggtgacgaccgcgggtatctggggcctggcgaggacgctggccctggaggccccgtccctgcagacctcggcgctggacgtcgtcgggccgggggcgctggcgcgccctcgcgcggcgctctccagccaggccccgacgctggcgcccggcagcgcgtacggcacctcactctcagcgggagtgtggggggccctgcagctgcggcgcagccccctggcgcccgcgccgggacccttccacctcttcccccagccgcgcggggccctgcagaatctggggccgctgcctgtggaggagagcgtggcacctggccaggtgctggtggccgtgaaagccgtgggcatcaacttcaggtgggcggtttgttacgagtatcttttcggggggagggcggagaggttggttggatgcctacagcgcttggactgtggccacgcagaagtcgatgctgctgtgtga

SEQ ID NO: 6993 - DNA, 1479 bp, Chlorella protothecoides
atgcgcgtggcctttgccatggacacagcacaccccgcccacgctttcttctgggaccatcgcgtgaacgggcgcgcggtgttccccggcgcgggctacctggagatggcggcggccatgggccgcaccctcgctgcgccgtcggcggcgccggcgggcctggcgctgacggccgccgccatctcggcgccgctcatcctgggcgcgcccggcgcgaccctggtgctggagggcgccgtggacctggcatccggggacgccacgctgtccagcaccgacggcggcacggtgcacgtgcgcctgtccctgtcgcgcgtggcgagtgtcggcgcaaacggtgccatggacggcggtgcctccgccacagagggcctgctggccggcacgcccgagcccgtggacaccgtgtacacctacgagcgcctggcggccgccggcctgcagtacggccgcgccttccgcctgctgcgcggcgtcaagcgcggcgagcgcggcgtcgccgccgcgctggcgccggaggggcactgttccggggccccggagttcctgctcggacccgcggcgctggacaacgggctgcagctggggggcatgctggccaaccaggccgccgtgcagggcgccgtcttcctgcccgccgggctgggggcgctggtggtccccgcgcccggggtcaagcccgtcgcagcgcgggccgcgcgcaacccgcagcacgccgactcggcggcggccatgtcccgcgacgtgctgctggtcggcagccagggcgcgctcgtctgcaccctcgacggcctcgtgtcccgcgccatcggcgacgccggcggggctggcagcgccccgccgtcggtggaggtgcaggacatgctctacgacatctcctggctggcggcgcgcagcgtcgcagcctcttcggaagagacacctgcgaggaacggagccttgaccgtgcgtgccagcgacagaggcgcggggctcgccatctcagcggcgctggcagccgtgcaagctgcagcgacgggcggaggcgccgacgcactgcacctcgccaccgcgggcacgcaccccgccgcgcagagcagcggccctcggccgggtgtcgacaccctgcccggggccgccgtctggggcctggtgcgtgcggccgcgcaggagctccccgccatcggagtgagcggcgcggacgccgacggctttgccgccgggtgcgcggggtgtcgatccgccctgcagatcggcggcacgacgggcgcccaggcaccctttgacggctacggccaggcggtgcgggcctcggtccttcacgagcctcgcctgggcgccagcacgacggcgcacagcacgctgcccgccttccagctgctccccttgcctcgcggcagcttcgggtccctcaagcccgtggctgtctctggcctggatgcgctcaagccggggcaggtggccctggaggtcaaggccgtgggcctcaacttcaggtag

SEQ ID NO: 6994 - DNA, 2253 bp, Chlorella protothecoides
atgcacggcaccggcacggggctgggcgaccccatcgaggtgggcgccctggctgcactgctggaccgagccgacccaggctccacccgccaccccctggtgctgaccgcgggcaagtcgctgatcgggcacaccgagccggcggcgggcgtgatggggctggcgcacgccagcctgtctctgacgcagcaggccgcgctgccgctgctccacctgaccagtgtcaacgactacgtcgcgccttccatgccggtcggccgcttcgcggccaaccgcatccttggtcctggtgcgagcgcggccccaggccaggcctgcaccgccggcgtgagctcctttgccttccagggcaccaacgcccacacgctgctgggcagcctagatggcgcagcggccgcagaggacagcgtcgacacccttgcgctgccctggcagcggcagagggcctgggtcgcgccgcggcccagcgacctcttcggcctggtcggcgtgaaagccaagcgcgccgcattcgtggccgacctggcgcagccgcggctcgccgcgctgcgcacgctgtgcctccgcgccgtgcccctgctcgcgctgggcctggcctcgcaggccatcgccgacgcggcagcgctgctcggcgccggccgcgccggcctgcgccgcctcaccacgcagccggccgctctttccgctggagccagcctgcatgtgaccctggatgggggccaggcctcggtgcacctggtcacgaaggaggccggcgcggcgcacgtcgccagcgccggccttgtggcggcgagcgccgagcccaagtccgtgtcccgaggcagcgcagggaaccccaggacgaaaacgctgtggtggcccgcgctggacagccagtcgagcgccggcaaggccgtggccgtgctggacgccactgcagactcggccctgccatgcggtcttgcgctgcagggcctggcggtggatgctgcggctgcgctgcgcgaggcaggggacctccccacttctgccggcgctctttggtcaaccacgagtgtgggtgctggagatgctgcagcccacgccgcagcagcaccaggcgaactcaccatcgccctcggcaccggcctcctggcagcctgggagctggacgcgctgccgctggagcggctcgcggtttcggcttccagcgctgggcctgctcacgctacctcgagtgcagacacagcggatgaggagagcaagaagctggtgtataccacgtcctggcaggcagccgaggtgcggcgcgcggcgacagcttctcgcaacgcgcccaacttccgggcaccaacctcagccgctgcggcgctgcaggcgctgcagggcctggcggggtcagcttccatgccgggcatcgcgggcacgggagcggctgacgtggctgtcgccgcgccggcccgatcacgcgcctcgcggctgcccggcgtggccctgcagggcatgctaaaggccctggctgccgaggatgctgctgggcctgtgctgtccatgctgtggaccgagccgtccgcgagccatgcagctgccggctggagcctggcagcacaagcagccgcggactctgcctcactggtcggcgtgcacggcggtgctgtctcggcacgcgtcgcctgggcgccgcgcctcctgcgcgcaccggagggcgacgcgcctgacgatgcacgagtcatgagcctgagcggcacggtctacgtgaccggcggcagcggcgtgctgggtggtacggtcgccgcctggctgctccaccagccggcggtgacctcggtggtcctgctcagccgctccggcgccgtgccagtcgagctgctgcgtgccagcagggcagcggccagcgcgaactcgacgaccggcgccccacccgccacgctctccagctgcacctgcgacgcgtcggccgccgccgacgtcgcggcgctggctggcgcggcgggcgccgtgtcgctcatgcacgcgggtggcgtgctggccgacggcctgctggctgggctgaacgcaggctccctacggcgagtggccgcgcccaagggcgccgcccaggcagctctgcaagcctcgctcctgggcgccgcccgtgtccaggcctgcgtggccttctcctcggtggcctccctgctgggctcgcccggccaggccaactacgcggcggccaacgccgtgctggacgctgcggccgccgacctggccgaccaggtgcgaggggacgtgggtcatgggggacatgctgatgcgtaa

SEQ ID NO: 6995 - DNA, 3522 bp, Chlorella protothecoides
atggcggccggggacagggccacagagggccggctggcgaggagcggcctggccctgctgccggcggagcgcggcctggcggtgctgggcgcgctcctgcgcgcctcctccgtcgccgtcgccgccgcgccgccccctgtccacgccgcggtgcccgtccagtgggcgcgcttcccggcgcgcgacgcattcttcgcgggcctggccgccgcgccgacgcccgcacggggcccggcggccgtcgtggacctcaccggtgcgcaggccctggtccaggaggcggtggcgggcgtactgggcgctagcgtggaccccgccgacccgctcatggcggcgggcctggactcgctgggcgcggtggagctgcgttctgcgctcgaggccagcgcgggcatgcgcctgccggccaccctggtcttcgactaccccaccgtgtcggccctggccgagttcctgggccagaaaatggccagggacagggagggggaagtgactgccgcgccgatggctgtgtcggcagcttggactggccctgctgtggatgccccgctggcgcaatcaatccgcgctccgcccgcctcgcccgtcctggtgctgggtggcgtccagcgcagtccgcgcgacgtgctcgccatctccgccgcatgcccgctggacgtcgtgggggtggtaccctacgagaggtgggatgtggacggggagaacccggtggcggccaggttcctggcggccctgcgccaccccatgacctttgacgccgccgccttcggcgtgcccagcgccgaggcgcccctgctagacccgcagcagcgcctgctgctggaggtcgtgggcgaggcctctgtcgccgtcgcgggggccaccggcatccccgccagcctgcagggcacctatgttggtgagttggattcatacgagggggaggcgcggggaggtggaggaggtgcaagtggcatcgcgagctccgattacgggagcctggtgtcggccgcagtggagaagggcgccttccacgcgacagccaacgccctgtccgtggcctgcgggcgcctgtccttcacctttggcttccgcggcccggcgctgtccatcgacaccgcctgctcggcctccctggtggccgctcacctcgccgcgcgcggcctggctgccggcgagtcggcgctggcctacgcggccggcgcccacgttcaggccacgggcaccagcaccgcctacgtctggagcgcctccatgctgggcgtgtcggggcgctgcatggccctggacgccgccgcagacggctacgtccgcggcgaggccgtgctgacgctggtcctggcggccgccgcgaagctgggcgccaactacgccagcgtgtcgggcgccgaccggcccctggccatgctgggctcggcggtgaaccaggacggacgctcctccagcctgacggcgcccaacggcccggcgcagcaggaggtcatgcgcagcgccctggcctttgccggggtcgatcccgcagaggtcaacgccctgtccatgcacggcacgggcaccccgctgggcgaccccatcgagatgggcgcggccacggcagtgctcatcgacgccgcgcggcgatcccccgtcgcctttggcgcctccaagtcctggctgggccacgctgagccagccgcgggcctggtcggcgcgctgttcggcgcggcggcggcggggcgcgccctcgcgcccgccatcatgcacctgcgcgccatcaacccctacgtctccgcagcgctggacgagacgcggccgggctgcgtggcgctgccgcgccagaacctgccgctggcggggactgggggccgttcggtggcgggcgtgtcggcgttcgccttccagggcaccaacgcgcacgcgctgctggcccccgttgtttccggcgccgaagatggcgcgacgcgcgctgaccccaaggcgccgctgccctggcggggcggcaggcagagcgtgctgccacaggcgcacgcgctcctgcaggtggtgacgagcgccgtccgcggccgcgtcatcctggagacggatctgaccgcgccgcgccacgctttcctctgggaccaccaggtcctggaccgggccctcttccccggggcaggatactttgaggcggcgggcgccgccgtgcgcgccgtctcgcgcgcgccagccggtgccctggtgaccggagcggccatccccgcgccctgtgtcctgcccggcctcggtcagcgtggcggcgacggcgtggtcctgcgggtgaccgtggacggcgccgacggcgcgctggtcatcgccagcgtgtcgatcgccggcacgaccagccacgtgctggccagcgccgaggcggcagggacggcgagcaacgacggccagcgcctcgcgacaggccctgcgagggcctctgcgctgctccctgtcagagcgatgctctcgctcgcagagcacctgcccgcctctgccgcgcccgcggcgacggcgggcctgcgctccgacacgggccggtcgggcctctggcttgaccccgcccccctggactgtgcgctgcagctggggcaggtgttcggtgccgcccccgccgacctgtacgtgccggcgggcctgggcgcgctggccatcgacccaggggcagcgggcctgccgcgcagccacgaggccagctgggcggcgtgcctgcccctgcccgcccctgtcggcgaggcgcgaagcgactacgcgctgctgcctgggtccaagggcgccggcggccccctggccagcgtgtcggccctgctggccaagcgcatggccggcggcggcgccgcgcagaggaccgtggagcgtgtcgcctgcctcctgctctggcgcgatgcgcacgcctcggccgtggagggcgtcagcgccgcgctggccgcgctgcagcgcgccgtcgctgcgcccgacgcccgcaaccggactcgcgccgtcgccgcgcccgacgcccgcaaccggactattgtgtttgaggcccccgccggcgccgggtttggcgccgtcgcgcccagcgcagcgtccaccgccccgccatcgactggcgtgctgggcctctccggcctcatccgcacgctgggccaggaggtgccgggcgtgggctggaccgcgagactgactgaccctgcggatcgatccgcgcccgcagccgccggcctgcgcttggtagacgcatcggcgctgccggcgctgcacccgctgacgtcggcgctggggtctgcggtgcggggcggcagcgccatggcgccgctgctcctgcacgctgagcgcgtgagggaggagctgccgccgcaccacctcatgcccatgccgcgcggcagcctgggttcccttgcccccgtgccctttgacccggagcggaagctggcggggcaggacatcgtcgtggcagtcaaggcggtgggcctcaacttcaggcaaggggttgttgttgtgtttccggagggggacaggtcggaggggatggtgacatcggaggaacgagtggtttgggtgtcacagcttgcaacggattgttga

SEQ ID NO: 6996 - DNA, 438 bp, Chlorella protothecoides
atgcccaccgtcttcgtcaccacggacgcggcgctggatcaggcggcgcgcatcgcccccggcgagagggtgctggtgcacgccgctgccggcggcgtgggcctggcggcgctccaggtcatcgcgcgggcgggcgccttcccggtggccacggcgggtggcccggtcaagcgggcgctgctgcgcagcctgggcgtgcgggacgtgctgggttcgcgagatgctctctttgcccaggaggcgccggagctggaccccatgggcctgtcggtggtgctcaacaccctgacctcgcccggcatggtggcggcatccctggccgtgctgcgcctgggtgggcgcttcgtggagatcagcaagcgcgacatctggagcgcggggcgggtggcacaaggtgggcgtgggcttggtgttttgtgtgtaggggtgcggtggtag

SEQ ID NO: 6997 - DNA, 522 bp, Chlorella protothecoides
atggcggcgggcctggactccctgtccagcgttgagttccgcaacagcctggaggccaaggtgggcgccgacctgcccaccaccctggtcttcgactaccccaccatcgcaggcatttcggcattcctggccgagcgcgtgggcggggcgacggccggcgagtcagctgatgctggaggggccgtcctcggcgagcccaccgatgctgacgacatgtttggcaccggcgaggctactgtgtctagcctggcagggcccctggtcgctgtgccggcgggcagcaccgtggtcgcccagcgtcccagcatctgggtgggcgagtcggtcacccagccgccgcgctccgcctttgcggggctgcagcccgtggacgccgtggccctgctgcccctgtcccgctgggacattgacaccggggaaggtgggctgggcctttgtgagttcttgggaattggagactggggcacgtgcaagtcgagctcctgccaaggggagagggtcttatactgttgcttgtcctga

SEQ ID NO: 6998 - DNA, 744 bp, Chlorella protothecoides
atggtacgtctgatgaaacccaccagcagaggcgagggcgctgcggacgacgccctgctgcgccgggccgttgggcgcggtcaggctggaggagcggccgtcctggttcaccgccgagccgagcacggcgatggccgcgtcgccccgcggcgcctggccgccttgcaacagcaggccgcccagcccctccgagcgcacgtacccgtcggccgccgcgtccagggtcttgcagcgtccgtcggccgccagcatgcccgacttggcgaaggcagcaggggtctccggggccagcatgacattgaccccggcgttgatcgctgcagcacactgggccagggtcagcgcggccagtgcggcgtgcagggagacgagggaggaggagcaggcggtgtccaccgtcatcgccggaccacgcaggccaaaggtgtaggccaggcggccggaggccacagacagcgtgctgccggtggcggtgtaggccgtgacccccgccgtgtgacgcgccaccaggcgcgcatagtcggtggaggaaaggccgacgaaggcgccgacgcgcgcacggtccagggcaccgccggcgcgggccagcagttggcccgcgcactccaggagcaggcgctgctgggggtccatcagcaccgcctcgctgccggccaccgagaaggcggccgggtcaaactcgtcgatgcggtccagggtggccccgaagcgcacggggatgccgccaaacaggtctgtgggtga

SEQ ID NO: 6999 - DNA, 1401 bp, Chlorella protothecoides
atgaccctggccgtgctgtgtcccgggcggctcgccttgcctgcaagccagaccccgagcactgagttttgtagtctccaggatcttttcagtcgacaggagggtggccaatcggtggacttgggacagaggaatgagttgaccgcagggacatgcgggagatgggtgggcacggtgcctgtcccccaccctgggagtggctgggcctgccccttccccgagtgggtcagagggtccaagtacggtagcagcagccacgccacggatcgcgcggcgggtgaggtatggccagcccgtgccgccgcgcactttgacagcacgccgctcgccctcctagtccagcagggcgccgacgactccggcgccgacggtgcggccgccctcgcggaccgcgaagcgcaggccctgctccatggcgatggggtgcatcagctcaaaggtgcaggtgacgttgtccccgggcatgaccatctcagtgccctccggcagcgtcacagtgcccgtgatgtcggcggtgcgcaggtagaactggggcttgtagttggtgaagaagggcgtgtgccgcccgccctcctccttggtcagcgcgtagagctcgccggagaagcgggtgtggggcttgatggagccggggcgggccaggacctgcccgcgctgcacgtcgtcgcgcttggtgccgcgcaggagcaggcccacattgtcacccgcctgcccctcgttcagctgcttcttgaacatctccacccccgtcaccgtggtccgcaccgagtcgcggatgcccaccacctccacctcgtccccgaccttcaccacgccctgctcgatgcgccccgtcaccaccgtgccgcggccctgtggggaattggtggggtgtgtgtgttgggggggaggggggggggtgtaaatgagagcaggggggtgaagctggaaagcatggagggggtactcaagtgtgctgtgaatgggcgcgggtgggctccggcatgtaggcatccacctccgccatcagcttcaggatggcgtccctggggggggggggcagggaggggacagggtggggaacgtggtggggcggcccagcgcggggcaggggcgtgcgacgcttggcgcatgcgccaaggggtttggggccggtcagacacgcatcaacgtttcagtgggccggggcgtgttgccccggccctcaataggaaggcaacagattactgtaatgtatcatcaccccgggccctgtctcaacaggcaggtgcgtgcgctcaagggcagcacgccatgcacagcttgccaggccatccataccacagctcacctgccgatggggtggttctcgcccttaagggctgccagggcagacccacgcacgatcgggatctcgtcgccaggaaacctgggtggttatga

SEQ ID NO: 7000 - DNA, 717 bp, Chlorella protothecoides
atggccggggcagtcgacgtgggcgtagtgccgcttgtcggtctggtactccacgtgcgcggtggcgatggtgatgccgcgcgctttctcctcgggcgccttgtcgatctcgtcgaaggccacggctttggagttgccggcctcggccaagacctgggagaggaagggtgggtgctttctgccttgggaaatccccgcgctcggtaccacgccgggatcgaccagtctatgctgtgccaccgagggcacgtgcaccctgtctccgctcaccttggtgatggcagccgtgagggtggtcttgccgtgatcgacgtgaccgatggtgccaatgttgaggtgtggcttggaacgactgttaatatcgtactccgcgctgtatggtcggctgctcagcgtcaggtgcaggggtccggcgctgtgcgaggacagggcgagactggtgatggacccggtggtgcatgcgtatcagtctctattgaggcatacatcaaaggatgcaaagagccggattttcctgcgctgtcctacaaaactcacatccgtgcgacctccgcctgtgtcgccggcccagcctgcacgagggtggcgcatcgggccagggcccccgccgcggcacgccggaacatcctagcgcgtcaactgagtgtcagtgtgcaagcagaagagagctgcaggggcgtggaggccagggttgagcaccctcaagacgaagcgtga

SEQ ID NO: 7001 - DNA, 495 bp, Chlorella protothecoides
atgcatgtcagctcggctcgcttccgggagcatagactggtcgatcccggcgtggtaccgagcgcggggatttcccaaggcagaaagcacccacccttcctctcccaggtcttggccgaggccggcaactccaaagccgtggccttcgacgagatcgacaaggcgcccgaggagaaagcgcgcggcatcaccatcgccaccgcgcacgtggagtaccagaccgacaagcggcactacgcccacgtcgactgccccggccatgctgactacgtgaagaacatgatcaccggcgcggcgcagatggacggcgcgatcctcgtggtctccgccaccgacggccccatgccccagacgcgggagcacatcctgctggcccgccaggtgggcgtcccctccatcgtctgcttcctcaacaagattgacatggtggaggacgaagagctggtggagctggtggagatggagctgcgcgagctcctctctttctacaagtga

SEQ ID NO: 7002 - DNA, 1317 bp, Chlorella protothecoides
  modified_base (697)..(706): a, c, t, g, unknown or other
atgatcagtatgggcaccagcaaaataggtcgatgccccgacctgtgcaatcttggcgggaagcgtcataatagtagaacgtccctcacctctcgacttcgcctccaagttcgagctccctgccgggctctgtctcttttcgtgacagcgaagaaccacaggacgcaggagacttgcacaagatggtgcgtggcgtgggccgggacggcgaccggggcgccgcactggaggcgaagccagcaccacgcgagtgtcgcgacgctggctgagcctgggcaatgccgtgatgtgctcgcctgcgatatcgacctgctgaaccctcctaaggagctggagaagcgcaagcacaagcttcaccgcctggttgcctccccaaactcctacttcatggatgtcaagtgccaggggtgcttcaacatcaccaccgtgttcagccactcccagaccgtggtggtgtgcactaactgcaacaccgtcctgtgcgtccctaccggcggaaaggctcgtctgaccgagggtgaggaagagatcagggttgcctgtggatggggcagcgaccctggtcacagtgcagagtgtgcatgtttgtgcctgcacacataccttggtcctgcatgcatctctcgtgcggcgcttggcctacatcccacacccctgtctcctcctctccaggctgctctttccggcggaaggctgnnnnnnnnnncctcgtgcggcgcttggcctacatccctcacccctgttcctccactccaggctgctctttccggcggaaggctgacagctgatcgtctgtgcccctcccgcctacctggaggccatggctgggtgtgcactgacgtctgtaacgctgccgctcttctagcaccagttgggcttcaagctggaaaacggagtatcatgagggtcgtgggtcctggtgggggatgggagctgccttgtgaggcaagctgggtcggcacaggggccacagtggcatgcgcaccagcgccgccatgggtgccgtgccaggtcgctagccagcgcgggggtagaggatgtcgtagtgccccgggcggtacagtaggtggacgctgggatccacgggcgctgcacctgccaggccctctggcacaaaatcgtgcatgtcaacgtgggcttcgtccctggcaccgggcccgccgtgcccgccgggcgaggcgctgcggtccaggtacaccacgcgcagtggcacctggagggaagggggcattgcaaggggggggttgccgatcagcagcagggcaaccggccagggggctcccccaaccaatgagccagcggcagcccctgcagtga

SEQ ID NO: 7003 - DNA, 1911 bp, Chlorella protothecoides
  modified_base (1285)..(1294): a, c, t, g, unknown or other
  modified_base (1526)..(1535): a, c, t, g, unknown or other
  modified_base (1599)..(1608): a, c, t, g, unknown or other
atggcggcgctgactccgtcgcgcgctgggttgcggcacggcgcggcgctgcaagggcattccttctccaggggatatcggtgcagcggtcgttcggcagctacttcccccccgcccctcgtgctcctcacaaggctttgggctgcccaaccgccgccggcgagtgttcattgtggcctccatgcacggcgatgcccgggacgtgctcctggcccagcaggcgagccatgccggtgcaccagactacagctctgcgccactccatcgatgcagggcgccatgggctgcccggggtcctgcaagcacctcttcgacggccagctgtgctacagctgctactgctcctcggatcggtcggcgcgggaggtttcctacgccatcgacctcggcaacgcgatgtgggtccctggaagggggggtggagcgggtgctcgggcaggagagggggaggttcataagccgagcaagctggctgctgtcccgaaccagggccggccagcctcaggggtgcagcgatgggtcctgctgcgcatccagaatggctgcccaaccaatccgacccccccgcctctgaagcctcacgcatcttcctcgttccctcctattaccaaactcacagctcgccggcgggggaggacgtggtgcccacgttcaccacctcaaacgaccgcatgctgctcctcctttcctccgggctcagcggaatgttgcgctgtgatgatgccgagcggctgcaggggccaagtggatggagtctgcaccctgtcagggatcgacgttggccccttgcaagccccacctctaaaccttgtcgcaaccaacagggcttgccggagggctacaccaagccctgctggccgctggcggggccggggctggggggccaccgcctggcgcgaccccgggacgtggatgcagagacagcggccgccaagcgctgggatctgctgggtgggtgctgtgcgtcgggctgtggtggagagaggccgccgcgcatgttgtgggcttttatccagttggtcctctcccctcgcggcaggaaacgcggtgaccgtgccagtcgcgcgctggctgggggagcgcctggcccagccctacgccttcaagtaccagaccgcgggggtcagcaaccggcggatggatgcacttgtccgggagggaatggcagatgccgggccggaagctggcagacctgggtatgggaaagatttcggccattggagagtcattgtggtgctgaatatccccattttcaaacacgatctggagattgctgacagtgaannnnnnnnnncgtccgggagggaatggcagatgccgagccggaggctggcagacctgggtatgggacagatttcggccattggagagtcattgtggtattcagttcccccatctttaaacacgatctggagattgctgacagtgaaaccagccacgttggtcatagcacgccatatcatccctttctccctcctcaacacggcgcaggccctcccccaacctgtggagctttgtgtgcctgnnnnnnnnnncggccggcgagatcgaggtcgaggtcgagggcatggaggcccccctccccgacctgaccacggnnnnnnnnnngatgagctccaggaggcggtgctcttcccctacctgctgtcccgcccaaagcccgccgtggccggcgaggtcgaggccgagggcgtggaggcccccctccccgacctgaccacgggcgactggctggaccccgccaccaatgcggcccgcgaggccacggccgaggtcatcctggcccagaccgacgaggcgggccgggaccgggagctggagaaggacatgtttcaggcagcgctggtgcatcgggtgaggcagcgggtggcctgccctggatcttggtggctggctttactgcccgcatga

SEQ ID NO: 7004 - DNA, 1335 bp, Chlorella protothecoides
  modified_base (953)..(962): a, c, t, g, unknown or other
  modified_base (1269)..(1278): a, c, t, g, unknown or other
atgaaggccgccgcgctgtccggccacgccggcgcgcagcttgcagtgtgccgtgaggacgcgctgggcgcgcgcgtgcgcgtgtggtgggacggcgacgccaccttctactcgggcgtggtggcgcactacgacgccgtcagcaccgagcacaccgtctgctatgacgacggcgaggtgggcatgcacaagctgtggcagcatgacgagcgcatcaacgtggagtcgggggtggaggagtggccgcgggaagccgaggcggccaggcagaagctgcgcaccgcacacgacctgctccgcgacaagaagcgcgtgcatcattccagcctgccctgctgcaccatcttagagcttgtggtggaggatgagatttccggtcctcggtcctcggccctgcacagaggctccccgccgtcggcagcccagctgccggcgctgggcctcagcgactatgagcagaagcgggcagagctggtgcgccgcaaccggctcatgttcgagcagacgctggcaaacggaggggaagcggggttggaggggccgggcagcggcgaatctggcgtcgcggcgccaggggagacggccgtggaggggcccgcgagcctggcagggggagcatcagggccgagccaggactggtctggaggcggccagcggccagaggcagtggtatcggtgtccctccctgcaggcgcgcctgtccaatccgccccaaagcggaagcactctgccagcggcaagaagggcggcagcaagaagaagaaggcgcacggcggcgcggccacgtgccctgccaatggagccaaggcgggcaatgccctggacgctgagcaagggcccgcgacgccgacgcccacccagcccaggaggagccttgcatggcggattcgacgcacagcaggcccacggcttgccacatcgaggtcatcacatacagctcccatcgctccacnnnnnnnnnntgcacagcatgacggctcaggcccacagcctaacacatcggggtcatcacatacagctcccatcgctccaacccctgcagtcgtgcgtggggtgtgcagcggcggatgtcacgccgcccacgctctcccactccacgtgccgagggcgcgaggcggcgcgcaacgacgaggacccgctgcaggactggaggtgccccaagtgccgcgcagcgcagcgagagctgggacccgagcatgcgctgcgggggctcgccgaggcggtccttgtggcggcctgagtgacgcggtggattgcacaagtttgaannnnnnnnnntacgccgcctacgctctcccactccacgtgccgaggccgcgaggcggcgcgcaatga

SEQ ID NO: 7005 - DNA, 465 bp, Chlorella protothecoides
atgcagaggccgtgcctcctggcctgttacagataccgcccctcatctcgtactcaggagttgccggaggaagtgaggacggcactcaggaatgcgcgtgtgctggatgcagcgggcaacaacctgcagagcatcccggactgggtgctcgaagccagcagccttaagcgcctgctcctgcagagcaacgcactgcgtcacctaccgtctgggatgtcccagcttcggtccctccgcgtgctaaacttggccagcaatgccctcacgcacctgccggatctccaaggcctggtgctcctacaggtcctcactctctctcagaatcacctggaggaggtagaccccagcatcggatgcctcacagccctcacgcagctcgatgtgtccggtgagctggccgggcatgcagagatgaggagagtagaaaatggtgctgcattttccacttacttgttttgccaatga

SEQ ID NO: 7006 - DNA, 321 bp, Chlorella protothecoides
atggccctgacggaagtgcttgcttctgacaacaggctcgtggaggtccccattgagctgggccgactacaaaagctccagacgctgaacctggagcgaaactccttggccatcatcccgccagccgtgctggtgggctgcatctgcctgcagacgctcctgctccagggcaaccccctcacgtcggagcagctcgcggccactgaggggtatgcagactatgaacagaggcggcagaggaagtatgacaaagtcctcgccaccaatgtcctcacatcaggcttcacagaagccattgaccgtgacgtcgctgtaacgtga

SEQ ID NO: 7007 - DNA, 609 bp, Chlorella protothecoides
ccgtgcgccgtccctgcgccgtgccgacacgccggcggggacccggcccagcgtgcgcagcatgcctgccactacggcccttgtccgccctgcccgctgccctgcggcactcgcctgccctgcgggcacctgtgcgccagcgaggcgtgccatgacgccgctcccacggcagtggcagagtacgccgccccccggccgccaccggcgggcggggccgcggcggcgagtggttccgccgaccgaagcgtcgaccgaagcggacccgtgtcggccgccgcagaggcgacggagcgggctgtgcgggatggacaggcgatgacgccctgcccgccttgcatgcaccctgttgcggcgccctgcctcggaggccacgaggtgcggcagctgccctgcagcgcaagcggcccctacgcctgcggcgcgccctgcgataagccgctggcgtgcgggcggcatgcttgcgcgctcgcctgccacgcgggaccctgcacgccctgcacgcgccggtgtggggtggcgcggggggcgtgcgcgcacgcctgcccgctcgcctgccacccggacgcctgcccagtgtgtgtagagctggtgcagcaggtgcgcttgtga

SEQ ID NO: 7008 - DNA, 501 bp, Chlorella protothecoides
atgggccgtgcagcaagaccaaccctgaagcagcagcacgactgcgatgccggcgatgacacaggtgcccacacctcctccacccccccaccttggcagggcatgagtgacctcggcgtcggccccttctgccagcgctttgtggaccccatggacgaggagagcgaccatgtgcacattgtcgccctcaccaacgcgctgcaggcaggggctgccgctggctcattggttgggggagccccctggccggttgccctgctgctgatcggcaaccccccccttgcaatgcccccttccctccaggtgccactgcgcgtggtgtacctggaccgcagcgcctcgcccggcgggcacggcgggcccggtgccagggacgaagcccacgttgacatgcacgattttgtgccagagggcctggcaggtgcagcgcccgtggatcccagcgtccacctactgtaccgcccggggcactacgacatcctctacccccgcgctggctag

SEQ ID NO: 7009 - DNA, 504 bp, Chlorella protothecoides
atgatgctgggtgcccccatcgaggcttccgaggttgcagctggcacggcccccggcggcccgctcttcccggaccggccatcagacgccgatattatcgcctgggagaataccatccgcgaggccggacccgggaagcaggcgctggtgggccagcccgagcccctgtcctcgctggcggcagagtacgccgccggctcgcccgtcttcctgtccaagatccagaccctggagggggcctacggcctcatccgacggacgcgcggggacgggaactgcttctttcgctcctttgtgtttgccttcatcgagcggatgctgctgatgggggatgacgccgagaaggatagggttctggctcggctggcggaagtcaagaagcagctgaccgaggctggctatgaggagatgggtgggtcagggcatggggggtatggagcgccctgcaggctcctcaccttggcacaggctgtgacaatttgtactgggcaacaatggttgtaa

SEQ ID NO: 7010 - DNA, 2877 bp, Chlorella protothecoides
  modified_base (1846)..(1855): a, c, t, g, unknown or other
  modified_base (2666)..(2770): a, c, t, g, unknown or other
gtgctgacgcgtgcggggctggcacaggaggcagacgccgcggcgcgcgaggtggcggcggtggtgcgcgcctgcgatgcggcgcccggccccatggccgaggccgcgctgcgcgctgcgggcacgctggcgacgcagcgcccgcacttcatgccgcgcctggtgcccgcattattatcagtcgccgcgcggcaggcaacgatggtgggcgagacggcaacaacatcgggggacggcggcacggcagcgaccactgaaagtggcacgccagcggccagggatgacggcatgtcagtggccctgccgcccgccgccaggaaggcgctgaccgcggccctggcgcaggtgcgccgttgcacgcacccgctggcggcggcttgggccaggaaggtggatcgggccctggccgacctggcggggggtggggggacgcaggacggtgctggcgaggcgtgtgtggttgccggcgggagagacggggcggcggcatccaagccaagccaggcggtgccgggtcggtcggcagaggacccccgccccccaccggccaagcgtccctgcaccgaagaccgggccacgggggctgcagggcccgccttgcctatcgagagcccacaggaagacggtgcagagctggcaacgagggtcgacgagctggtcgcgcggggcgacagtgccggcctggcggcgctgtacgcgtctctggacgccgagtcagccgccgagctggtgctggcgaggctgcacccgcccgggggggcgccggcgtcgctggccgccgacggcgcccccctgccggcctggcaggaggacctgcttcggcgcatggctgctccaggagacgccagcgcggtggtacctccccctgtcacagatgcgagcaggcagccgggcaggtcggcagctccctcgccatcacccctggttgcgggggccactgctgcgacgcccacgccccctctccccgccggcacggcgggcctagcggccaggttcaccaccgatcccctacccttgagtgccggggaggcggccaggctccgggcgctcaccatgcggcggctggcggcggccgcggggggcttcgggcactggctcgcgccgcgactcgccgccacgcaggccgacctcgctgggcccttcctggaggagctgggcaccgactttcatgccaggggaggggtggaggcagtgctcgacttcctgcacgccgcgtttgccgccgagggccgacaggacttgggtggtgaggacgaggcggtcacagagcggcagcagggcgacggctatcgtgccgtcctttccaaggccctggacctgcacgcctggcaatggggagttcactttgttgggggtacccaaccctgctccctgcgtctctctgggcattccatctccagcaagcactctccacatgccaacctgtacagtgtcctcctgtctgctcctgcgctgccggcggagctcctgcgcgacaccctcgagggcctgatgcagaccgaccttgatcacgccacgctgggcctgctggcggcgcgcgacttgatcctggcgcggccgccggcgcgagaagtggccctggcggcggtgctggccgcggcccacagcgaggacgcgggggttagggaccgcgcggtgcgcctgctcaccaaccggctgtggggatgcctgggcggccggctgcaacccaagatcttgcgtgaggcggagcgtagcctgcgccagctcgtggtccgcgaggacggcgcggcggtgaagcaggaagccgatggcgcggcggcggcgcgtgtgaaagcggaggccaccgatggcgcggcgacggcgtcaggggacgtggggcccgatnnnnnnnnnnaaagcggaggccaccgatggcgcggcgacgacgtcagaggacgcgggggtcgaggcaagggcggacaccgaggctactgcggtgaagcgggagctcggcgagggcgcggcgccgtcagtcgagggcacggggtccgtcgtcgaccccgccgcggcctgcgccctgttctgcgccctctgcacccggcagccgggcctgctgccacgcctgttcgaggcctttggcagcgcatctgggttgtgaggacacctcacgcgacctgtgcctgcgcgtgtcgatgcgcaggagcgacaccacatgaccaagcttcccccccacatcccggcagcttctggccgagagggcatcctgaagtacgcgggcggcctggccacgacgctggggcccgcctcccgggacctgctgggcgccctggcggacctgccggaggtgcgcagggttatcagcgggccgagccagtccctgtgctcggccacgcctggttgggtcccatggccgtcggcatgcagcccgtcatgcctcgagctcctggccccggcaccctgatgcctgaggtcgcgactcccctcccacaccctcacccctgctccctccatcccctccatctcaacaagaactgcatggacctggcgctgggcatgctgcgcgcgctggcctcggccctgcccgccctgcccgagggcctggtccgcgccgcggccgacctggcgcaggcctcgtgcgacgcgcgcccgctggtcccgctgctgcggggtctggggcgtgaaggcctgctggcccgtctgcccctgctcctgggcctgcccggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgctgcgcggcgcggcgaccgaccgcctggtcccgccctccgagctgctggtcgcgctgcacgggctggaccccgtcgccgtgcccggcggagtgcgcgccgtga

SEQ ID NO: 7011 - DNA, 609 bp, Chlorella protothecoides
atgttccagcccagcccggcggcagcagacgcgcacctgcgcggtgtgctcagcgctgccgccgcagcgggagtgatgagcccggtccccgacctggacactctgatccatgcaggtgagggccttgggcgggtcgtgcagcaattccggcatcgtgctgcgcttcactggggccagtggcaaggccgcagaccagacctcaagtctcggcgctcatctgagggcgctacacgtcggcaacccattgatcgtagtcaggcaacccccaaaccatgcaacgctgcagggagtgtgagcgaggcggcgccctggtttgaggtctaccgcaccgagttcttccgcatgatggcctttggcgagcacgagacgatggaccaccccgtggcctgtgagctgggaagggtggcgtgcaggactcagggatggcgtgggaaggaatggcacaggtgtcccacacagcagcaccacaggctggcatgctgcaccggcattgcagtggcttgggatggtgttgtctgctctgcaggccctcctgtttgcgcgctgaagctcctctcgaagcccaagcatgcggcaaacccatgctgcactcccctcgccctgatttga

SEQ ID NO: 7012 - DNA, 771 bp, Chlorella protothecoides
atgccggagctaccgcaggagaaacgggcgcgcttcgagggactgggcctgtctccttacgacgctcatgtcctctgtgacgacctggcggtcgccggctactttgacgcgacgttggaggcgggggcaagccccaagccagcggctaactggatcatgggcgacatcatggcacactgcaaggtgggcacgggcatcaagggctggtgcatgggcgagatggtgctgcatcaacggcttctcagcagtctttcgcaaagtgtgaaacaagaagagcagttacagtgcacaggcacctatacttatccatatggatctgctccaggctgcaaaacagttgcactcctacccacccactcatgtcctccccgacgcctacacacccaggaggcccacctcggcatggacgatctcctcctgacacctacaaccctggccaagctcctgggcctgattgagaaggggactatcagcggcaagattgccaaggatctgctgccagatctcctgcaaggcaaagggagcggagatctcctggcctacgtcgaggccaagggtctcatacagatcagcgatgaaggcgccctgctcgacatcatcaacaatgtcctggagtcgaactcaaagcagctcgagcagtacaagcaagggaagacaaagctccagggtttctttgtggggcaggtaatgaaagagtccaggggccgagccaacccaggggaactccagcgtctgctcatgcagcgcctcgccgaggaggcaggccaatga

SEQ ID NO: 7013 - DNA, 1215 bp, Chlorella protothecoides
atggcatgcagggtgtcgtcatggctccggccccaccacctgcacccccctcgcctcgcggtgctcggcaggtttctgcccgagcgagtccagcacgaggcgcatgcgcatgccagggtgactagaaggtttcacacatgcaggacggccagctcagcggctcagctggccaccgagcagcaggccactcccaatagccagccagaggtacgacacgaacctgggggtggggtgtccagatggatgcgcgaggagtgcatgccgtcttggagcacgtgcttctctgcacccttattcaattttggacgtcccgtcatcccatgctggcagaccgactacgaggctgtggtgggcatagagtgccatgtgcagctgaacacgcggaccaaggccttctgcgcctgccccaatcagtatggtggggagcccaacagccacatctgccccgtctgccttggacacccgggcaccctccctgtgctcaacgcagccgtggtggacaaggcggtgctgacggggctggcgctgggctgcagcatcgcgcgccactccatcttcagccgcaagcagtacttctaccccgacctgcccaaggggtaccagatctcccagcacgacacccctctggcttataatggcagcctggagattgatgctggggacggcacccggcgccgcatcggcatcacgcgcgtgcacgtggaggaagacgctgggaagctggtctacgtcggtgcccaggcactgacgggggccgcctctgcgcaggcggactacaaccgggcgggcgtaccgctgctggaggtggtgtccgagcccgacatgcgcagcgggcaggaggcggcggcctacggcgccgagctgcgcaggctcctgcgctacatcggcgtcagcaacggcaacatggcggtgaggaacatcaaaggagggcgaaaggggaggggcgggggggggtgtccgaagatgaggcgggtgcgagagtggaagggagggatgctgtggcatggacgctgggatggtggagccttgaagtttcggccagcgcagtccgctgcccaccgaccaagcaccactcaaccccgtcccacaggagggatcgctacgctgcgatgtcaatgtgtcggtgcggccccggggcacgactgcactggggaccaaggtggaggtgaaaaacctcaactccttcaactccgtccagcgcgccatacagtttga

SEQ ID NO: 7014 - DNA, 318 bp, Chlorella protothecoides
atgggctgccaggatcaatggaaggctagtgttgtccatctggttggccatctcgtcagtccggcagggacccaaaaggcatcccctctcttccatcctccgaccgcccttcaggtcaccgcgctgtcctcaggcgctgagcacgaggtggtggtggagacacgggtctgggacgaggcggcggcgaggacgcgcacgatgaggaagaaagaggggcaggctgactaccgcttcttccccgagccagaccttcctcccttggaaatctctgaggagaccatcgcaaggatacaggtgaggcgttgtctatggggttag

SEQ ID NO: 7015 - DNA, 1107 bp, Chlorella protothecoides
  modified_base (236)..(245): a, c, t, g, unknown or other
  modified_base (680)..(719): a, c, t, g, unknown or other
ggcctgcggccggggctggcgccggaggtgctgcagcacgtaggccagcacaccgcggggctgacgcagcgggagctgcgcgccgtggctgccggcgcggccgtcgacgccctggccgaccgcctgcccgtgcaggccgtcctggatgggcgcacgacgacctcggcgaagggagttggtgtggcgagcacaactgcagaacagccccagcttgccggggccgaggcccgcggcgnnnnnnnnnncaagggagttaatgtggcaagcacaactgcagaagagtcccagcttgccggggccgaggcccgcggcgacaatcagtccctggacatcacgcgagaggcgctgcagcgcgccgtcgagcgggtccggaccatggctgcctcggatgtaggggcgcctaagatcccctcggtgaagtgggaggatgtggggggcctggaggacgtgaagagagccatcctggacacaggtggggcagctggggaatggttcaagggaggaagatgggaggaagatggtgagacaagaaaagtgcattgcatcacaatgcccttcaatgctgtgtttgagcattgcatgccgctctcatttggtgactcctggccttctgctcaaagacaagtcactgatgtctgcctcccatcgaaatgccagtggagctgccgctcaagcacccnnnnnnnnnnnnnnnnnnnnnnnnnnnnnnnnnnnnnnnnttccgggggtttgcggagacggtctggcgttctcttgtatgggcctccaggtagatatcagtttgccttgcaggcagtgtatgccgtatgtgatgcgttagatggtgtcatgaaggcacttcccgagctcgtgatcgagtgcacagcattcgaaaagccagatgggatcatgaaggcatttcccaagctcgtgatcgggtgcacagcattggaaaagccagttgcactcacccgccaccggcaccgcataccactccttcaggtacgggcaagactctgctggccaaggctgtggcaacagagtgctccatcaattttctctctgtcaagggcccagagctggtcaacatgtatgtcggagagagcgagcgtcaagtccgacaggtga

SEQ ID NO: 7016 - DNA, 990 bp, Chlorella protothecoides
  modified_base (486)..(495): a, c, t, g, unknown or other
atgtctgtgacacgcggcgccggcatcgttctgttcgcatccctcactctcatggggctgtctatgagccgggcggaaagcaatggcacgctgttcgtcgtgggccagggccaggtatccgccgagcccaacatggccacagtgtctctttcagtatccagcaccaaggatacggcctcagatgcgcgagagcgggcggcggaactcaccaaagcgacgctgacctccattagtggaatctcgggcataaatcgaacctccgacattaagaccaccgacattaatgtcaacccccagatggtgagcttccgaatgtcttctgatatacaaggaacaatcctccctgtcctcttcaaggtgtctcatgtctctgccatgtcgttcatgctgcacctccacttttccattgtccccaggtgtacaactcccagacaggagagagcaccatcaccggcgggccctcagccacaggggcgcacggagctnnnnnnnnnntctcagaacctccaggtagaggcactggtcaccgtgcgcgacttgagcagcgacctcctctccagcgtaatcgacagcgcggtgcgtgccggcggcaacgccctgcaaatcaccagcgtgacgctctcgctcagccccaccgcaaggaaggcagccctggatgcagcccgccgtgccgcagtgagcgatgcacgcgacaccgcccggctactcgcctcagccgccgaagtcaccttgggccgcccacagcggattgaggacagcaactcgacgccagccatgccaattgcgtatgcagcagctggcctttggttcatgcagagcatcatctttctcatgcaccacaggcacaatggcaaggaacgccaaagatacagagactccagtggagctaggaacgctgcagatgtgctggaatcctctgcgactgtttgtattgcaactttctcaagacttgtttctgacctgagctctgtggggcaagtaactggttga

SEQ ID NO: 7017 - DNA, 819 bp, Chlorella protothecoides
atggtgttggagggagaatctagccttttgcttttcttgtttctatcgggatggtcttgggccgctctgtcgaggttggcgcaatgggtgaggagcttcccgttccgaaattgctacgcaaatgaggatctccgccgggcccctccactcaaatcgccctctgttgcacgtggcatcttacaaccgagaattctcaggcaggcatcagcggcaccgctccttccagctcctcggggactccttccccagctccgtccacagtcgcctgctggcgggaccagagctccgcgtaccgcccacccgcagccagcagctgggcgtgcgagccctgctctaccacccgcccctgagccaaagtcgattgcatggcatattgtttgtggagaaacaacatgccagtcaacccatcgagcctcttggagcaacaccctctgtcgccacacccctcccccttccagcaaccaacaaggtaacgcgtctcacctgctccaggaccacgatcttgtcgcactgggcggccgtggagagccggtgggccacaaggagggtggtcctgccccgcgccagcgcaaagaggctgcccaggatctccttctccgtggtggagtccagggcggacgtggcctcgtcgcacaacaggacgggggggtccttgaggaaagcgcgggcgagggcgacgcgctgcttctctccgccgctcagcttcaggccccgctccccgacctcggtgtcgtagccgtccgggaaggagaggatgcggtcgtgtatggcggcctgagggggagcacagggtgtggatgcagcaagcttgtatcatga

SEQ ID NO: 7018 - DNA, 2184 bp, Chlorella protothecoides
  modified_base (222)..(231): a, c, t, g, unknown or other
  modified_base (602)..(611): a, c, t, g, unknown or other
  modified_base (1390)..(1399): a, c, t, g, unknown or other
atgccttctgatccgagctatgaaagtctcaaagcatctgatgcgaacatgttccatgccgtcccaatcacaggttgcgcagtcgaccatccgcaatgtggcggtccgcacctttgctcacctgcacaacctggacctggcgttccatctttccagacagacgggggctgtgtcgcgtgtgatcgaccgaggctcccgaggcatcaatttcgtgctcagccnnnnnnnnnntgctcaggaagcttctgtgatctcagctgcacgaagccacatgtgtcatggcccctccatgatggagcatcctgctcacccactgctcgcacatacccatctctccagctccatggtcttcaatctagtgccaacggcactggaggtggccctggtggcaggggtcctggcctacaagtgcggcccggcctttgctgcgctcacaggggtgacgatagccttgtacaccgccttcacctttgcgatcacacaggcacggggcaaggatgtggcgtgtggggtactggaatgaagcattcttgtcaagaagggctggtcagcatactgcacgcttcaccgtattctccccacgcacacctccatctctcgcnnnnnnnnnngatgatgcaagctgcttgctgctgggacaactctcaattgctagaccagtgcaatgaaaaagggctggtcagcatactgcatgcttcaacgtatcctccccatgcacacctccatctctcgtattgctgctccctgcagtggcgcacccagttcaggcggcagatgaacagggcagagtcccaggccagcagccgagctgtggactcattgatcaactacgagaccgtcaagtactttgatgccgaggagcatgagaagcggagagacttgaccgccgtgcatcatctgttgagttgccaagtacctctccagcatgctttgattcccaggctccagaccaccatccatctcacccaggcccttgctgctcacctgcgcagatacgacgagtgcatggcgtcctaccaactcgcagccgtggagacgcagcagtcactgtcctttctcaactttggtcagagcgccatcttttccacctccctagcggtggccatgctcctatcagcccagggcgtggctgcggggacgctcaccgtgggtgacatggtcatggtcaacggactcctcctccaggtgtggacttgtggatgcgaggttttgaagcatgtgggacttagaaggttcatgaggggaagcaatgacatgggcactgcctggtgctctgtaagagttgctcacgtccaagccgtttttggcttcaatcatactcccacagccttggctgggcggcctcctccaatgctcgcacagtgcttcgcaaccacagcaacttttcctnnnnnnnnnnccttggctgggcggcctcctccaatgctcgaaaagtgcttctcaaccacagcaacttttccatcgccaccctctgcgcagctgtccatgcctctcaacttcctgggcagtgtgtatcgcgagaccaagcagtccttcatcgatatgggggccatgtttgcactgctccaggagcagacagccatcaaggacagggcaggtgaggctgggggtgggcacagaaggtggcgtgtcgagtcatcagggcggatgagctgccctctgactatctccagtgccctaccgcctgcaggcgcgatcgacctgccagaggaacccagtggctacgatctcacctttgagaatgtctcctttggctaccgcccggatcagcccatcctgcaggcaagggatcgagcgatgctgtactgtgctgttggcattgccatgacattcctccagcaagttgcagcttcctgggaccagcgtcgcactggtgggcacttcgggttcaggcaagtccacgctgctccgcctgctctaccgcttctacgatgcgcagggcgggacggtgcgggtgggcggccacgacatcaaggacctgcgcctggcgagcctgaggaggcgcctgggcgccgttccccaggacctggtgctcttcaacgacaccgtgcggtacaacatcgcgtacggcaagctgggtgccagcgagagccaggtggagcaggcggcgcggaaggtgaggcgctgtggtcgtttggagcggggaagcacactgatctgccatgggtgtctctggagatatga

SEQ ID NO: 7019 - DNA, 759 bp, Chlorella protothecoides
  modified_base (175)..(184): a, c, t, g, unknown or other
  modified_base (270)..(279): a, c, t, g, unknown or other
atgctggacagaatggactaccagcagccgcgcgggcgatggcaacccttcccgaggatggcccatgctggccagaatggactaccagcagccgcgcgggcaatggcaacccttcccgaggatggtaaaccccaagctaggccccagggcacacaacctcatctcaccatagaannnnnnnnnngtgaaagtgtattatggcagccagcgaatttggggcaatgtgcccagggcccctgccacccagattatattctcactctcgcaggnnnnnnnnnngagaagggggagcgcatgagtgagatgcacatagtcaaggagattgcaaacgaattcggggcaatgtgcccagggcccctgccacacagagtatattctcactctcgcagataccttaatacagagacgagtccagagttcagacgaagggcaggcatagccgtggcattgctcgtcgggggcaagctcctcaacatacaagttccttttttcttcaagtacacaggtgaaccagggcttgaaggcgctgcaccacgtttcagaattgtcgacgcactgaacgctgatccttccggcctcacgccagcctcagtggcaggcctcatggtgttgggccccacctctctggtgctggggtatgggctggcacgcatcggcgcatccttttgcagcgaagcccggaatgctgtctttgcctcggtgagcattacagcgctagaaaggcagggagtggcactctggcagcagctgcaagactga

SEQ ID NO: 7020 - DNA, 1725 bp, Chlorella protothecoides
  modified_base (375)..(384): a, c, t, g, unknown or other
  modified_base (492)..(501): a, c, t, g, unknown or other
  modified_base (679)..(726): a, c, t, g, unknown or other
  modified_base (980)..(989): a, c, t, g, unknown or other
atgcaggtcacaatgcgttttcagagcggtgtggtgccacatcgcgctcccccgaggcctgccagtctgcgatgcggtacaggttttaaaacggcttcgacgccgtgcaggagggcacgggcccccagattgccagtccaggcggcactacacaagcgcagttccgaatcggagctggagagtgcgcatggaaaggctttgcagctggtcgccgatgtccccttccgggagccgtttgtgcgctcgttcctgctcgggataggcagcggcctgctgctggaaggagcccatgtcctcatgcagatgcttggaagtcaggacctaggtgccttttcgtactcccctgccctggtggcagaccatattctggcattnnnnnnnnnntgggtgggcaatggcagccggcgagaccaccatgtcgctagccaagattattgcataccacacgcactcgatacttccccgggcagcggtgagatgacgcttcagggnnnnnnnnnngtgagtcgatgggggtggaaggaaggtgtccagcatgaacagatggagtcaggttggccaagaatgtatttgttactcgtgctgctggccgcaagtggtgttgttgaccgggcttcccttgtcatcctgcagcaccagctggtttgggctgtatttcctggaggcagctgccgtcctnnnnnnnnnnnnnnnnnnnnnnnnnnnnnnnnnnnnnnnnnnnnnnnntgttctgctctgtctggtgtgagttgtgctgaaccctggccagcacctcacacacacacgcagtcaaattcatgtgtcatcccttctccctgtcttcaggccaaggacctcgcaaacctgtccaccctgccaaagcgcctcattccccgtctgcctttcttctcccgcgagtcccgcttcaccaagcccctccttgcgtcggcctccgaagccaccagcaccaaggccacagtgacagttgatgctgaagcggnnnnnnnnnngcccctccttgcgtcggcctccgaagccactggcaccaaggccacagcgacagtggatgctgaagcgatggtggagcctgccaccaagcttgccacgagcaccctggtggagcccatgcctcggggcgggacggtcgtccgaccccagggagaaaacagtgtggtcagagcacccccgcgcaaatctgtctctgaaaacattgcttatcatcgcaatgtgtggcttgctgtacctctcctcaccccgccccctgcaactcaccgcctcgcagccggccacctctgtccccctgccccgcgcgccctcctcagccgaggaaatggcggcgggcgtggccaaacgtgcgcgcgagctgcgggaccgaagcggctacttgaagaacatgtggtacgcggtggccctctccgccaacgtcggcagcaaagagccggtgaaggtgcagctgtgcgggcgcgagatggtgctcttccgcgacgccacatcgggggatgtgcaggcactggacaacgtgtgcccccaccgcggcgccccgctctcctcgggctggctgtcagagaaggagtcggggacgtgcgtggtgtgcccctaccatggctgggccctggatggggctggggcgctcaaggatgtgccagtgagtggcggagggtgttgagggggggcgccggggttttaaggggggcgtcggggtttgaggggagggggtggagagggggccaggaggcgctggggtag

SEQ ID NO: 7021 - DNA, 1176 bp, Chlorella protothecoides
atgagactcgccgtgccttatcagcgatttgcaggggcgggggttcccatgccaaatcttccctgcaagattctgcgcggttcgagcatggcgcccccgtgcccccggccccccctgctcgtggattcgctaaatctccatacagacggtagtcagtgtattaagcaagcgccgcgagagcacctcaattccacaatatcattattgcactggattgtatcgtccaagctccgaaaagccagtgacgcaggactcgtgtgtgccgatgcaggacgaggtgtccttgccaaacaccctgcgggtgggtggtgtgatgggcctggaaattggaacctggcagcctcagcccagcaacttttctgtaggcctgtccagccccctcgcccacgccatgcaggtcttggatgcgacggccaaccgtctgaaaagcatagaggctgcgctactgcggctggacgggctcacgaagctgtgcctgcggcagaacctgctgacctccgcagaggaagtggaggcgctggcctccgcgccctgtcttgtggagacttgttgctcaaagatcaacgtacacctctgcaggcttggaggagttggatctccgggacaaccaattcacacaggtcgtggtctcctcggggtgggctcctccggtttgaattggagtgtgccatgatgccgcaccacccccatatcgcagcctccctcaagagaatcctccctgatgtgccctgctctccctcttcctcacttgctgtgcaggtcccgaacttccgtggctttttctccttgacaaccttggacatgtcttacaaccagtttgtgagcctcgaggcattgtccagcctgcctgggcccaggctgacgcacctgtactgcgctgccaacaagatcgcttccatggagggcatcgcacacctcgaatgtgggtgcttggcacagggggtggctgtcctcatacttccccgaaagggcccatgcgaggcatgcacgccacccaggtgcatgcctccctcgttcaccagcgacatcacaggctcagcatgccaggatcctcccacttgcgacagggatgtgcctgctggacagcttgtggctgggccggaatcggatcactcagatcaatgggctgagcaggtgcggggccaggggccagcgggtggtgtgccgactggatga

SEQ ID NO: 7022 - DNA, 480 bp, Chlorella protothecoides
atggcgtcgagtacaaccaccacgtctgcccgcacgtcgccccacccatgcctaccgaagctccctcgtgggctacatggtgcccggcacaggtttacgcggcattcagcgcccttgttagaccattgcacgcgtaaacggaacctcacgcgggccatgagggccaccatgaccccgtctgtcgccgaggcctcggcgacccaagatccgatgcatgtgatcatagccggggctggcattggcgggctagtgctggccgtgggactgctcaaggcgggattcagggtcacggtcctcgagcgtgacctgaccgccattcgtggcgaggggaagtaccgcggacccatccagctgcagagcaatgcgctggcagcgctggaggccctggatgagcatgtgggccagaggatcctggacgagggctgcatcacgggggacaggatcaacggactctgtgacggcatcacaggggactggtga

SEQ ID NO: 7023 - DNA, 318 bp, Chlorella protothecoides
atgctcgggacgccaagcatgtctcgaagcccaatcctcccccttcagcccccttcaaccccccttttcaccgcaccgcaggtcctcggcaccgtgaagaactcggtggtggtgctgctcggcgtcgcgctcctgggtgagagggtcacgctgctgcagggcgtggggtatggcggctctgtggcgtccttctgctggtaccagcagatcaagatgcagcaggtgcatggcagggaccccccgccaccggaggtgaacaggaccaggtcatcacaggggccgctcgcttccgaaacaaaggccacattggagccgtga

SEQ ID NO: 7024 - DNA, 1302 bp, Chlorella protothecoides
  modified_base (375)..(384): a, c, t, g, unknown or other
  modified_base (522)..(591): a, c, t, g, unknown or other
atgacggtcgaaacatcgacagcgccctggccctctccccctcctgccttttctttcacgaaagcaagctcacatggagaaggagacggatctcacatattcggcggcaccagtccccaagcccgcatggtggtggccgttgcagcctccctgctatggatgaccatctcctcctggctcatcctcgtgaacaaagccctgctgtctggcggctttccctaccccatggccctctcgtccctggggatgctgtttagtggagtctgcagctacctagcatgcagggtgcgctgggtggctgtgcgcagggggggtccgatcgtcgttgtcttctcctctgcgtctggatccaatgcagcgcatgccaaccccacnnnnnnnnnncgcccgcggtggggggggtccgatcatggttgtcgtctcctctgcgtcaggatccaatacagcgcatgccaaccccagtccccttggagaggggtcccgtatggccttgttgcaaagatggtcagggcgcccaccgcnnnnnnnnnnnnnnnnnnnnnnnnnnnnnnnnnnnnnnnnnnnnnnnnnnnnnnnnnnnnnnnnnnnnnntcccctctctgcctcgccccaggtgttcaaggtggtggatgcccggcgcaccgtcactcggcgcttctacctcaccggcgtgatgccggtgggggcgctgatggccctgaacctgctgtgcggaaacctggcctacctctacctcaccgtggctttcatccagatcctcaaggccttcacccctgtcatcaccatgctcgccatgttcttggcgggactggaaacccccacccgccgcctggtggccgccgtggcggggatcgcggtgggcaccgccgtcgcggctgcgggggaggtgcggctggacgtcctgggcgtggccatcatgatgctgagcgaggtgttcgaggcggtgcgcctggtcctgacgcagcgcctgctccagggcatgcggttccaccccatcgaggggctcatgtacctggccccctcctgcttcctctggctgggcctggggtccctcctcctggaggccccgcgcatggcacgcgcagacgcgctggccgtcgtccaagcccagcccgccacctttgtgctggcggccgtgctgggctttggcgtgaacagcctggcctacatcgtcatccaggcctcctcctccctgacgctcaaggtgatgggttgtgggtgtgggtgttggtggaggggaggagatcgtgcagggggatcagtcgacggcctcgcagtatgaggagggagcctcggtgctga

SEQ ID NO: 7025 - DNA, 1665 bp, Chlorella protothecoides
  modified_base (248)..(257): a, c, t, g, unknown or other
  modified_base (1446)..(1455): a, c, t, g, unknown or other
atgacacgactgcgcaagctgtcctgtgaggagacccttgctgggatggtgagtcagcgctctcaaagcgtgtggagttactggtgtcgaggggaccaaggacaacgttccagagttttgccaggtatgatggttgagtctaactgccctatacggaggacttgcgggtgctctttgtcgcacagatgtccgcttggccatggtggaggttgcctcactcagactcatcaatccttttcttttcagannnnnnnnnnactggcgatgcacaacttgacaggtccaactgccctatatggaggacttgcgggtgctctttgtcgcacatatgtccgcttggccatggtggaggttgccctcactcacactcatcaatccttttcttttcagggttaccttgaccgtgggaagacagtgattgtgtactgtgatacaagagagtctcccgaagcctgtgctcatgagattgccagaattggaaggaacgcatcaaggacatggcagccccggcagggagtcgaggcaatctatagctgccaagctgcgggagctgggcaggagatcctcgcaggtgctcgccgctctggtagtgcaaggctttgcgtattaccatgcaggacggcaaggattggtgtgggcttgtcaggaggaagagtgacggaatgcgtccttgccttaggttctcaacctcatctccgcccaacgtcaggccttcctgcccaggaacggggcctggtggaagctgcagtcactcatggtctcatctccgtgctgataacaacggcggcctcgatacattccatcagctgggcagctgatgtgagcattttcagactggcgtcagttggaaagggcagcagccaggaacgctcatcctgcgccaaagctcaccgcctcttgcactctgttcggggtgcacagggcagggagtgcattctgacatcagcttcaagtgtggccgactctgacctcatgggccttcttgcggctgataacgctgaagtgtcgagttgcctggcctctgaaggcaacatgaggcaggcgctcctcgtcagcatagggaggcagttcacttgcaccgcgctggatgtcaagacttacgtcggctgcactctgatgagcgtgctgcatggacccgtgagtgcaatagtccatcctggatatggtgctctgatgtcatacattatgtggttgctgctcgttccctaccaacaggctgcagctgcagctgcccaggccgccctctgctggctggtgaaggacgccaagcttgcgagctggagtgagaaaacggctcggtataccctcactcggctgggaagcacggctctggaagcaaatctccacccatgtcaggccggcctcctgcaggtgggttggcagtcgctgagtgcctcttcgctttgcacttcagaacagtctactgcctggagtgcatgggtggcnnnnnnnnnnggccggcctcctgcaggtgggttggcagtcactgagtgcctcttcgctttgcacttgagcacagtctgctgcctggagtgcatgggtggtgacctgtgcatcaaacctgtgtttgaacggatgggtctcatgctaccagacacttttcaatgcagagagaactcggtgctgcacgcgaaagcctcatcctcacctcccagctgcacatag

SEQ ID NO: 7026 - DNA, 549 bp, Chlorella protothecoides
atggacgatcatgtcggcggggttgacgagccacattctccggcccagtgccctgatcttgaagtctccactctatccctctcgcagggaggttcaggagagggtgatatcttcctgataggagcaacaaatcgccccgacctcttggatgctgcgctgctgcgaccagggagactggacaaactcctctatgttggcattgctcctgagccgtcttccaagcaaaaggtgctggaggccctctccagaaaattcacgatggatgcagacgtggaccttgcagctgtcgctgaggcctgccccccgcagttcacgggcgctgacatgtatgcgctgtgctcggatgcgtggatgacagcgttcaagcagcacatctctaagcttggaggcttgccggctggtgggaatggcaatgcgtcggccatcatggtccgacaggcagacttcctgcaggcagccactacgcttcagcccagtttgggcgaggatgagattgccaagtatgaagtactcagagaccagtacgaaggcggagctgctcggcactga

SEQ ID NO: 7027 - DNA, 498 bp, Chlorella protothecoides
atgcaccggattgcagattgcttcttggtgcaattgcagagggagctgtccatccacagtctgccacgctcctttccacacgcacaggagatcttggccgagcgatgctgcgagctgggcggacctgatgccatctcaaacaatgccaacgtcgttgactttattgacgagcgggatgctgcgggtcacgtcactgccatcctttcggatggacggcgggtgaagggggacttgctggtcggggcagacggcatttggtcaaagctcctaacccacaaacctctgtaccccgcagtgggataccgggtgttcctgggcaacggcaagtactttgtgtccagcgatgtgggcggcggcaagatgcagtggtatgccttccacaaagagccagcggggggctcagacccgccaggtcagcgccaggaacgactcatgcgtatctttggctcctggtctgacaacggtgagacctgcaaggaggcggtgggttgggaatga

SEQ ID NO: 7028 - DNA, 780 bp, Chlorella protothecoides
atgctgacggagcagtaccccaacggcgacctggtgtacgaccacctggccttccgcacgctgggcgtgcctgggctgggcatcgattcgctggcgcccaccttcctggagctgggctggcgggcgcgcgacgagctgcgcttcccggccaagaagctgcgtgcgcgctggttcgcgccgccctgcccctccctgccccgcatcttcatctcagagctgctggtgggggaggtggacgccgccgcacgcgaggccatcgccgccgcgctgggcgccacgccgcgcactctgctggcgcggcactcgctgctggccgccgcgggaggcggcacgccctggcccgcaccctcccgcgcgcagtacgcggcggtggccgccaagagcgagtacggggcctgggtgctcgccaacggcgcggccctgaaccacaccacgctctccgtgcacgccatgcgggacgtggcggggctggacgacctcatcggccgcctgcagggcgccggctttgcgctgaacgcagagggcggcgcggccaaggtgtccccagacggcctgctgcgccaggcctccacgcgcgccgacgcgcgcctgttttctttctcctgcggggcctccgcgctggtgcccacctcctacatcgagttcgcggagcggctggtcctgcccgagttccaggggctggcggaggaccaggtccaggagcaccaccgccgcgaggggtttgaggtgggtaacgcagacaagatttttgagagcacctactcctccaaagcggcctga

SEQ ID NO: 7029 - DNA, 855 bp, Chlorella protothecoides
atggcgatcgaggatagcttccagatggtgcaggagctgcggtccagcggcagccgctccgtggcgcacatcctgaggcagtaccagctgcggcgcatgctgcgctcctccgtggtgcatggcatggcgggcatggcggccttcatggcctccacctacaaggcgtacctgggcgagggcctgggcccgctgagccgcatgacggcctggcgcattccgcacccgggccgtgtcatgggtcaggtggtgatgaaggcgtccatgccggcggtgctgggctgggtgctgggcgggaacgaggcctcgctggcctctgcggagcgtgtgccgcgctgcatgctccgcgacaggccctccggcttcgagccgggccagttcgacaccctgctgcgggacgacgccgccctactgcgcgccgccaaggcccactgggtcctggctcccatggccggcacgggagctggggcggggaaaggggtgagctgcgccggcaatggggcggggagcggcgcgggcagtggtgccgccggccagccctggacccggctgggcgccgatggccttgtcatggggtctggcagggatgcggggattagagaccccgctgcagcgctccgccatgcctgggtgcagagccatgagggcgactacctcgtgaccgaccttggcagcggccagggaaggcggctggtcccaaatgtccccgtccggctccagccgggggatctcatccggctgggtgcagcaaaggacagccccgccttccgagtgaagctgcagcatgtatccatggctgatgatgtggaccgcagcgcatatggccaggagacggacaggcccctggtgggcgtatga

SEQ ID NO: 7030 - DNA, 1011 bp, Chlorella protothecoides
gcgcagggcgtgctggccgcgctggcgccgcacctggcggccatcgcagcctcgcccgcggcggagctgccggggccgaaagccgcgccggggagggggccgggcggcgccgcgctcaccgccgtggacgacaggctgtacgcctttgaggcggccgggctgctcctgggccaggaggagatggaggcgggggagcaggccgcctggctggccgccgtgctgcagcccctcacgcggcagatgccggtttgggggggagttggtccttcatggactcctccttgtcagcggggttttgccgggaggggacccacccccacgttcgcttcacaacctgtacccgcgaaaatctggaatttccatcaagacgcacgagatgcggcgcgagtttgtcagctgcaggtcaacggttcgagcccgtttggggccaggcacaatgtttccggccccatagctcagttgatcgaggaggcgctgggggagggccagggcccgagcaacgggtcagctgccctggtgccaccggcgctcatggtgcagcaggcgctggagggcatcacccgcgtggccaagggattctccttgcgcctctgcaccgagctgcgccccgccctgggtgctgagttcacgagtgagcgccaacaggggggtgggaagggaagtagacggggttgcgcagggctgttatgtctatgcgccctgacaaggataccctggcagggccccttcactcggcttgggaacgccgtccctagccccaccgatcctattcatccaggcccatctcagccctcctcacaccccgccctcccactcgcacaggggctctgcgctgcgccatccaggtgccgcgccggctgcccggccaccgcgcgctgcgcgcgcgcctgctttcctttctccaccgcatggtggagacgctggggcccgcctccctgcccttcatgcccgaggtgctgcaggcgttggtgcgcgagggagctgacgcctgcgagctggccgacgccctga

SEQ ID NO: 7031 - DNA, 1107 bp, Chlorella protothecoides
  modified_base (105)..(114): a, c, t, g, unknown or other
  modified_base (618)..(627): a, c, t, g, unknown or other
atgacgcctttgctgccgcctggttcagcaccagcgcggcctccgacgtcggagacggccactgggggggagccggtgagctggggtgcggcaagggcctggtgnnnnnnnnnnaccagcgcggcctccgacgtcggagacggcgaccaggggggagccggtgagctaggggtgcggcaagggcctggtttggttcttacctggctgcatcaaggtcagatgaagcaggcctcgtcaggggtgggtctactggagtacacaaagcactgtcatcatcgaaacatggcgctcccgcgcatgcaggagcagcagcagcaagaaggcatctgtgctaccaccacttcccctcctcaacctttgcaccccattgccacacctgcagcccccaagagctcaccccctttcaagcgtgtgctgatgtttgtggacaacgctggcgccgacatcgtcctcggcatgattcccctggcacgggagttcctgcgtctgggcgcagaggtggggagcatccccggcggtgccaggggtgcaccgtgcattcgcgacacgagcaacgtgtgtcatgccccaggtcccactttctcacgcgcacgacgacctcgcttctccttcactttnnnnnnnnnngccaggggtgcaccgtgcattcgcgacacgtgcaacgtcatcatggtggccaatgcgctgcctgccatcaacgacatcactgccgcagagctgaggggcgtggtggcccgggctgccgagacctgccccatcattcgggcggccagggacgccgcggtgtccaccctggcggccgccggcggccacatcccacccgtcgccggcgccctcccggagtcctccatggcgcaggagctgccggtggccaggggccagtcggggcacgccaccgtggcgcggcccgtggtccgtaccaaccctagcccgcgccggctgctgcctcacgccacggattttgaggaccagccggagacccccaccactgcggcgcgcaagggcatgtttggggagtcatacccttccctgtggaaggatccgcggtgggtgatggccgtgtcgatgtgctcttccttaactgctcgctggggccgcgtttggtag

SEQ ID NO: 7032 - DNA, 1995 bp, Chlorella protothecoides
  modified_base (1817)..(1826): a, c, t, g, unknown or other
atggacttcatggaggccaaacgcctgcaccgctccaatggcggcaatgagcccatgagggtgaaggccacaggagggggggccttcaagtatgcagaggtagagtgttcattcagagggtgcattgaggatggagcaaacctggatcctggaacaccttctcagatacctccaagctattcttctcctacagagattcaaggagcgactgggtttgatcctggagcgagaagacgagatgagctgcctggtggagggctgcaactttctactgaaagcagaggacccgccattgatcagtctgcagcctatgagtatgccccatcggcgccaagaccgttccgagctctccactccactccgcagtgcggcacgaggcgttcatttttcgacacagaactcacacaacgtgccgcagacctgtatccctacctcctcgtcaacatcgggagtggcgtgagcatggtcaaagtggatggcgagggcaagtacacccgagtgtcagagggaaggatattccagcaccagcgaatgcctgcacatgctgcgtcccaggtgcgcatctccctccagctgcccacctttgcgggtcccccattgcttgtccccgacccctgcccagggacaaacgtcgggggaggtaccttctggggcctgtgccggttgctgactggggtcaacaatttcgacgacatcctcaccctttccagccagggcgacaactccaatgtgaggactgtgatcgatgctgctgagccagccattgcacagggtgctgggggcctgttgcctgccatccaaggtgtggacatgctggtgggcgacatctacggggggcgggactacactggcatcggcctgtcggccaacacgattgcatcgtcctttggcaaagtcatcaacaccagcatggtgagtgggggttcctgcattcttctgctgcgggctgcaggaccaccgctgctcgtgtactctgctgagcttgcaagagcaggaagcctcacgtccgagccatccgactataacccagcagacatagccatgtccctgtgtcgcatgatctcctacaacatagggcagctggcttatctgaacgccaagcggttcacctccactctttcctcactcgaataccactctatacgttcactgcatgtcaccagcaactgcccaagccgctttccctcactctctccctctcctccaccccgccccacccaggtacaacctgccgcgcatctattttggcggcttcttcatccggggccacccctacacgatggacacaatctcctttgccatccagttctggtccaagggcgagatgagcgccaagttcctgcgtcacgagggcttcctgggggccgtgggcgcctacctgaaggggctcatcctggctggccatggaatttgcactcttgggatgctcttgccatgccccattgccatgtgcacacacaggcacaccctacgtcgtctcttgtggctgtgtgtgggtcggtgattccacctttcaacctccagaatccgcactcatgtgcccgcccatgcaggcccaggcctgcttcgttgagagattcacggtgggtgcgcccgtcacgggcggcgaggttcgaggtccggccatcggcagcctatctgacaaggtcacatgggtggagaagttcattgcggccgcacagcccatcacggaaaccgccaaaacagagcatgagcagtgaggcggcgggggagggggagtgggggagcgagggatttctgccggcgagccgggcacaaaatggggaacactttgcggccgaggggtggagggggannnnnnnnnngggggggggagcgagggatttctgccggcgagtcgggcacaagatggggaactctttgcggccgaggggtggagggggctggaggttgtttgcgctgacatcatggctcacagtgcgcatgcatctccattgcaagcagccaggtgtgctccctcccaccatcaactga

SEQ ID NO: 7033 - DNA, 663 bp, Chlorella protothecoides
atgtacggcagcggcggcgcctacggcacgacaggcggcatgtatggcgcctcgccctacggcggggcgggcatgggctcctacggtggctcctacggctcaggcggcatgtatggcagctcctatggcgctggcagcatgtacggccgccccgccggcgccggcatgtacggcgcgggcggcggcatgtacggtgcgggcggcggcatgtatggcggcggtatgtatggccagggcggcggcatgtacggccagccgggcctgctgggcggcggccctgtggaccccaacaacccgcacgccccgccccagcccccctccggctggcaggccatgctggcggggctgggcggcctcatgcacttcttcggccgcctctccttcctcgtggacgagaacgcgcacgccgtccacttcttcgtctcggccctgctccagctgctggaccgcgcggggtcgctgtacggcgagctggcgcgcttcatcctccgcatcctgggcgtacggcgcgccaagaaggcgggccaggccctggtggctgcggcggggccgggccagccaccgctgccgctcggggcaccgactgcgcccaagcccctgcccgccgccgcctctgcagcaggcggcgctccctgggacagcgtgtggaagaagcaggactga

SEQ ID NO: 7034 - DNA, 243 bp, Chlorella protothecoides
atggataaggagcgggagaatgctgcagccctggaggccctgccagacctcctggatgaggtggacaagctggacggccctgagcgactcctggccctgattcagggatccctggcggccaacatctttgactggggagccaaggcctgcgtcgacctgtaccagaatgccacgatcctggagatgtaccgacaggtcagaggcttgggtccatcggaatcgaaagcatgcattgagctgtga

SEQ ID NO: 7035 - DNA, 558 bp, Chlorella protothecoides
atgctgcgccacctgccccgcctgacccagggcgtggagcaggcggtgcgcagcgacagcctctcccgcggcgcgctgggctggttgcagccctcctcccccaccctatccagcgcctggttgttccagggggccatggccccccgcatcggccagctggcgcggtcggggtcgcgtcccggcgcgccccttcggggccccggctggctgcccccggaccacgtcaatcgcctgctgcgctgcgcctttggtgtgctgcagtggctggggccctgggcgctgcgccccttcctccaggacacgctgctcttcctgccgctgtcggcgaccatggcgggcatggccctgcgcgaccccggcaccatcctgcgcgtcgtgcgccagctggggccctgggaggtggtgagctgggcgcggcactacctcgccctgggcctggccactctgctggatgccctgctctggcccctgcgtgggcagctgcagagcagctaccgctggaggcgcgtgctggacgcggtgcactgggggtcgggggccgactaccacgaccactga

SEQ ID NO: 7036 - DNA, 1497 bp, Chlorella protothecoides
atgtcccccatgacttgccgtcatgggctgtcccagcgaccacccagccacgccttcccactctgcggcaccagcccagtgcctcacctcgcctcgaatcccagaccatatataatgcggattaaatgccatcaccaccgcccgcctgcggcgttgaggggccaggacgagggagcggccggcagcgtccggtccccacccaccccaaggcctgcacgcagctcgcgccactcccccgccctgcagcgcgtgctgtccgagcccgggctggaggtacccggcggcggagacccatccaagtacctggccacccaggaggccttctggaaggcaatgcggcggcggggccccaagcccagggcgcccaccgtcgtcaggaccacgcagatgcagtaccgcgcccccgttgactacgacgtggcggtggcggggggcaccctcggcatcttcctggcaaccgccctgcaggtacatgtgttgaccatcgtccacagcccccctcgccccacctccctcctcgaccctcagctgcgtggcctgcgggtggcggtggtggagcgcggccgcgtccagggccggacgcaggagtggaacatcagccgcgcggaggtcgcgacgctggtgggcacaggggttttgacacgggaggagctggaggaggccatcgcgtcggagttcaacccgacgcgcgtggcgctgcacggcgcggcgcccatcgaggtgcgcgatgtgctcaacgtcggcgtctgccccgccacggccgtggaccgcgcgcggcgccgcttcgaggcggcgggcggcgtcgtgctggagggggccaccgtgcgtggcgcagtcgtgcaccccaacgcagtggtgctggagactgcggcgacgcggagtgggactgtggccgcgagcagtgggggcggggacccgggcagcgaccacggccggggcgccccgagcggcgcgcagacggcgtcagatgggcgcccagctgacgccgtcgagacatcggtccggcgcccacccgctcccgccgccggcgcccccggcagctccccaccccgccccgtggccgcgtcgctcctcatagacacgatggggcactggagccccatcgtggcgcagctgcgccgcggcgcgcgccccgaccgcgtggtcatggtggtgggcggctgcgtggatggcgtgcccgccgccgccaacgtttcgggggacctgctggccacgctgggcgacgccgcggacgacatgcagctgttctgggaggccttccccgcgcgcgacggcggccgtacgctctacgcctttgcctacctggacgcgcaccccgaccgccccagctttgaggccatgctggaccgctacctggacggcatccctgcctaccagggcgtggcgctggaggagctgcgcttcaagcgcctcctcctcgccgcattcccctgctaccccgacgccagccccctcaagccaggcttcgaccgtatcctccaggtggggggggagtga

SEQ ID NO: 7037 - DNA, 2097 bp, Chlorella protothecoides
  modified_base (188)..(197): a, c, t, g, unknown or other
  modified_base (330)..(339): a, c, t, g, unknown or other
  modified_base (1458)..(1467): a, c, t, g, unknown or other
atggctgccatgcaggtcatgcctggggtcaaggagctggccaagcacctggacgagcgagctgtgcccaggtgggccgggtggggtgggggacggccacgctcggcggctgggcgggaagaggtgaccgacccattgcgtgctggacggcggaattcggcagctgctcatggcggtgtgcagggcannnnnnnnnnaggcgtgaggaagagcgacgaactcattggggtgtatacggtgtcgttatcggcacgctcacgaggagggcatggcggccatgcaggtcatgcccggggtcgaggagctggccaagcacctggacgagcgagnnnnnnnnnnacgctcggcggctgggcgggaaagggtgaccgacccattgcgggctggacggcggaacccggcagctgctcatggcggtgtgcagggcacacttaccgtctcgcacgcacaaggcctttggtgatgaagcggcccctcttaccaccaacacacagggcactcgtgacgaggaatttgaaacgtgccgtggacctgttccatgccacgcactttgacctgccccccttcgagcccgtgctcacgcgggagttcctgccatacaagtgctgcgctcgtgctccagccattgcctcccggggccaccttcccatgcatgtgattgttccccagccacactcattctcccccctttccaacatcgtgcagcctcacccggcggcgctgctgcacattgcagagcactggggcatcacgccgcaggagctggtcatggtgggagacagcgccaaggatgacgtgcgcggtggagctctgttgacggtcatcctgtctgccaaagggggttgcatgtcatgggggaggggaccaggatcctacactgcagggcccggcacctggccccacaccatcgtgcaccaccctgcacgtccccacccgctcctcatgcaggtcggtaccaggatcctacactgcaaggcccggcacctggcctcgcaccatggtgcatcaccctgcacgtccccacctgctcctcatgcaggttgtgagtgggaatcgtgcgggcgcgtggaccatcctcctggacaccgaggggacgcacagggagcgcggccagggcctggaaggggacctgcggccccacttctatgcggcctccatgcaggaggtgcagcagatcctgaccaccgagctgcagctgcccagtccccgggtgacttgaagggtaatcggcaccaggaaggggtggaagcgggcagggcgccggcaggccattgcatgcccgcctttgttggggagaccccgcagctccaagctggttgggagtatagcaggacttgcagtgcctgccggcgcaggttctcagtgttgaaaagcaatccctcctgggcctgttccctttgcagcagctggataccgttcaattattacagacatccccttgtccgcaccatgccatgnnnnnnnnnntgcctgattgctttgcagcagctggatactgttgaattatttcagacatccccttgtccgcaccatgccatggatgacaagcacccccatagatattggctgaatccgtcagggcagggcactcggggcagagaatgcgaggggcaactaccagggagcacctgctgcgacaacaaaacttcccagccaccagggtcctcgcccccagccagccctgcctggacaccgcagatctgcatgcctgcgcgtgctccagcgcctcaccaaactcggtggcgagctcgtacctgcgattgcgatgtgggaggcagggccagagcgtgggctcgggagcgccaggcgaggcccaggagccatgccttggcacccagcgcagcgcaggtctgcggcgcccaggtcctggatgcgacgcctgcggcccctgccctccccctccacgcccttccaaactcactcggtgtaggcggctgtgagtttgccggcgttcaccagcttggcgatgctttccagcaagacagggacccgcttgcggtgctcctgcacccagcgccggatgttgaagccccgcacctggttgcgtttgaagagcggggaggagcttggagccaagctgcctgttcctccgcgtga

SEQ ID NO: 7038 - DNA, 1170 bp, Chlorella protothecoides
atggtgctccagctggcgagcctgctccgcctcaggacggtggccgtcgtctccgacgacgcgggcggcgactttgacaagaccgcggactggctgaagtccctgggcgcctcggtggtcctgcccgaccgcggcaacctgaaggtggggcgggtgcatgccggcggccgtgacgcgggtcgcagcgatcgccgctgcctgcagcactgtgtctggctgcacacggcccaggcggtgggctgcctgagaaggtgtgccgcgacccttggcagccttcgacatctggcagacgcacacttcacccgttggggacagtcattgcactgcgcaccatgctgcccggagctttccacctctggccgagctggacaagctcaagttcttcgccaagccaaagctggccctggatgcggtggggggactgagctccacccgcctctcagacatgctggcggaggggggccagctggtggtgtacggctgcatgtccggcaagtctcccacctggacctggcactcctgggtgttccagggcatccaggtgactggcaagggctgggtggagtatctggaaagggcgactggctgctgcacggcaattgctcgtggcttgtccgaggcagaggatgttgtgagaggatcggcacacagctcatcatagcgtttcacgcggaggaacaggcagcttggctccaagctcctctgaccgaggcgcgcccaagcacatcatcgcatgtcccctctcactggccacaaacccccgctcttcaaacgcaaccaggtgcggggcttcaacatccggcgctgggtgcaggagcaccgcaagcgggtccctgtcttgctggaaagcatcgccaagctggtgaacgccggcaaactcacagccgcctacaccgagtgagtttggaagggcgtggagggggagggcaggggccgcaggcgtcgcatccaggacctgggcgccgcagacctgcgctgcgctgggtgccaaggcatggctcctgggcctcgcctggcgctcccgagcccacgctctggccctgcctcccacatcgcaatcgcaggtacgagctcgccaccgagtttggtgaggcgctggagcacgcgctggaaagggggaagaacaccaaggtcctgctcaaggtgtcggacgtcggtgtgcagtactga

SEQ ID NO: 7039 - DNA, 843 bp, Chlorella protothecoides
atgcctcaaacacacttcccccctccccacggcaactatcgggacaaggtgcgtgccgccgagacctcggaggccagcaacatctcggagcagatcacggtgcgccagtccaaggaggccggcagccacggcgccggcttcgaggcctggatgcgcgggcgcggcagcggcggggtgcaggtcttcaccgccgacgacgtcatcgaccagtttggcgtggtgaagggttcgtacgacgcggtgcccctgcccaggatcaaggcccacgctgtgcgctgctccggcgccggcaggccgcgcgaggtgctgggcgtggaggccgaggagctgcctgccgagctggagtggggccaggtcctcgtcagcatacgctacgcggcggttaacccggccgacctctacactgtggccacgggcgggacctacggccaggagcacgtgtccgtcccctttgtacccgggcacgacgccgtcggggtcatcgtcaaggcaagagaggggaccggacctggcgtgaagggcctgcacgagaacgactgggtggtccccctgaagcccttcctgggcacctggcgctcgctgctggtggcggcggagaaggatctgctccgcctggcgcccgacgccatgcccatggagcagtgcgcggtgctgcgggagacgctgaccgcgtaccgcctgctggaggatgcgccgggtctcaaggtgggcgggggacgctggtggggatggaagatggctggggctgggtgtggaggtggaggggcctgccctttggctggaaccccattcgtgcgtcaggctggcactccattggtccatgaagcgtgcactttgccgtag

SEQ ID NO: 7040 - DNA, 288 bp, Chlorella protothecoides
atgcagattttcgtcaagaccctcacgggcaagactatcaccctcgaggtcgagtcgaatgacaccataggtagggtcgagagtcacctctgcggtagccgcgggtcgagagtcacctctgcggtagctgcgggttcgtgtttcttatgtaagcattttgccggccttgtgtgtgtcaaacttttggagtcggactgtcaatctccagtctttgcggcattggactggccaccatcctgttgcactcgccatcttgcagacaacgtgaaggccaagatccaggacaag

SEQ ID NO: 7041 - DNA, 1128 bp, Chlorella protothecoides
atgacgacgccgctggacgatgccaacgcaaagctgcgctactctgtggaggtcgtcaacctgcagatcaacctggaggcccagcaagcacagggccgattcctgctggcggcggagtcggggctgctggagggcctgaccctgccccacaacacgatgagcatcaccaagctgaccctggaccaggtgcaggcgtatgtctccgccacgtcggtcgaccccggcgcgacgcccgcctggctggacacgcacggcggccgcttcgcgccgggcgcggagccctcgctgcgccgggtgttcaaccccatccacatcggcctgcgccactcgcgcgtgaccccgggcgcgcacgccggcggcgggggcgcggcaagcgcgccgtcccgcgtcacgccgggcccccgtggcggcgagggcggcgcccaccgccgcaactccaccgcccccggctggggccccgccagcttcaccggcgcggggccgcgcggggaggagctgctgctcagcgttccccagatcgtggctaccatggagggcacggagttcgaggtcctggtggaggtggtggagatgctgctcagccaggggcctggcgtggacaccgtcggcgaggaggggtccctgctcgcggcagactgtgccggggacgaggtggaggacgcgcggcagagctacgccctcctgcgccgcgagctggccgaggcccgggcgctgacgctggagcaacgccgctggctggggctgcagctgttgcgactggatcggagcggcgcgctgtcgccgcccgactcggccggccccggcttgccacttcaggtcgccgccctggagctgcacgcctttgccggcggggcagcgcagggcgcggcgtcgtcggccgccggcgccggcgcccccgccgccttcgacctgggcctgggcccgctggccgaccccgacgccgagctggacggggcggtgcgcgcctacctgtactccccgcgcgctcacgcggtgcccgcgcagggcctgctgctgtgctgggccgaggagcaggaagaaagggcggccaccacgctcgaagctgcccgctccagcctccaggacctcaaggtgcagcgcatgtgggatgaggagggtgagggttag

SEQ ID NO: 7042 - DNA, 1335 bp, Chlorella protothecoides
atggcctgtgtgtcttgcccctcgactggggacccctcctgcccaccgcccactgcccaaccgcccacgcatcgcagggcgcccgtcaaggtgtacaccgacgcgctgctgcagggatcgggcctgcagatcttgcacggccccggcatggaacctgcgctggccatgatggcgctggcgggcaagcgcctggcgcccagcgacccggacaagtccctcccacgcccgccgcccatcccctggtgggacgacctgcgctacatgtggcgcgggcgcgcaggtctggaggtcgcgggcctgcgcctgaccctggcggccgaccgccgcgccggcccgggcccggactcggcacggctggtcttggccgcccaccgcgtcggcgctgagctggcggagggcgtggcggagctgaggctggcgggcctggccgtggacgccttcgaggcggtgggactggacggccccgccggcggcttgctgcgcctgcccatgctggccgtgccggcgctgacgctgcgcctggaggcggggtggcggctgcccggcggccggaccccccggcagcaccacctcttccccccgaccccgcccctggacggcgtccaggggccccgcctgccgggtgaagtgtacaagtccgaggccctggacctgggcatcactgccgacctgggcggcagcgctgcgcagagcgccgtggtctacctcggcgatcaccaggaggcgtccactatgcgagttggggtccgaggaggaactccagggtcgcagcatgcccgtgctggaccaaccccagaccgcagacaactgaaggccagtgggcgactgacgcacctgcatccccctctcccacccccctccccacactcagatccagttcctgaggacctggatcgcgctgttgagaatgccagaccctgccgtccgcgccgtggtccggcgcggcactttcttcgtgcgcaagcccaagggcctgccgcccaagaagaacctgcccaagctgctgcgggaggtgagagggtttggctggtcgatgtcctgtcgattgccttggttccatgtccaaacacaaacttaacaggcccgcctagctcgcaatttccaaaccaaaggcactgtcctccaccagcatgcgtcttcctcatcacccgtgcacagatgaagatccaggtgtcggcctccccgctggaaatcgtgcacttcacctgcgacaccaccgacccctcccacaacgtctgcatctcggcggtgggggtggagtttggcgcgagctggctcttcaaccagcccattccctccttcctcaagccaccgccccacgccgcgaagaggtga

SEQ ID NO: 7043 - DNA, 450 bp, Chlorella protothecoides
atgtgccatgcacccacgcccttccccacagagcgcgcgccggccctccacagcagccgcccggaagccgaggttcaagcacttccggaccaaccgcatgcattgccgggtcacctacgccggggggcgcacggggctgcactttgcaccaatacaattgcatcgaccacccttgccaggccggcctcctcgccgcgggccggagccaccacccgcgcctgcccactcccgccacccccacactcacacatccccgccctcacctgcaggacattcaccgacctgaaactggtgctggacaaccgcacctatgagaactttgagggtgggtggcgggacctgctggcgcgcatcaagtgggacacagtgaagagcgtggccaagtcggtcacggggctccagggccgcaaattcaaggtgtggctgggcttgcagcggggcaaatggtga

SEQ ID NO: 7044 - DNA, 663 bp, Chlorella protothecoides
  modified_base (339)..(348): a, c, t, g, unknown or other
atggaccgacaggccggggagcggagcatcctggtggccacggacgtggcatcccgcggcctggacatcccctccgtcgactttgtgctcaactacgacgtccccgtcaacggtaaggactacgtgcaccgtgtggggcgcaccgcccgtgcaggtcgctccgggcgcgccgtcaccctggtcacgcagcctgccccccggtcttcctgggaggccccttgcatcaggatcttctttccccctgtgcggcccctgcacatgcccttcgctcggccccttggttccctcatgcttggacactcatgcatgcacccatgcccggccgcccgcacccccccnnnnnnnnnntccggtattcctgagaggtcccttgcatcaggatcttctttcccccgtgcggcccctgcacatgcccttcggtacgacgtggagctgtaccagaagatcgaggcgctgatcgacatgaagctggaggcctaccccgcggagcaggaggcggtgctggtgctgctggagcgtgtgagcgaggcccagcgcatcgccaccatgcagatgaaggagaccgactcgcgcaagcgcggccgcaagtcggcggtggacgacgacgagcgcgacgctgagggcgtggcgcgtggcggcaagccccctccccgcaagcgctga

SEQ ID NO: 7045 - DNA, 528 bp, Chlorella protothecoides
atgctccaacaccaacaggtggtggcaggccagaccgcttccctggcactgaagaaggtcaagcgcagcggcgtgcggaggggcatgatcctggccgaccccggcctgcactgcagcgccggctgggagtttgaggccgagatcgccgtgctcacgcactccaccaccatccagacccggtaccagggcgggtccgggctgagggtccaaccttgccgcatcctcctctgcaagacagcaaactactggtcccctggtgcattcgagagcagaaacctgcctggcgctccatccaccctcccaccctgcacccttgcgccccctcccaaaggccgtcatccactgcgaggcggtgcgccagtcggcccaggtcgtgggcatggacagggaccggctgcggtctggggaccgagccaccgtgcgcttccgcttcctgcagcaccccgaatacttgaccccgggggcccgtttcgtgttccgggagggcaagaccaagggcgtgggccgggtggtgggcttcgcggatga

SEQ ID NO: 7046 - DNA, 726 bp, Chlorella protothecoides
atggctgccgagctcgccaacgagcgcggcgacgctcgccaggcggcagcggtgaaggccttcgaggccctagggatatgcacgcagctggctgagtctgcagcgggactggggtggaaggagccgtccgaaatccagacccaggctgtcccactcgtcctgaaaggccaggacgtcatcggactggcgcagaccgggtctgggaagacaggggcctttgccctgcccatcctccagcaattgctggacacgccgcagcccttctttgcgctggtcctgtcccccacccgcgagctggccatccagatctccgagcagtttgaggccctgggcgccggcatcggggtgcgggctgcggtgctggttggcggcatcgacatgatggcgcaggccatcgccctcgcccggcgcccgcatgtggtggtgggcacgcctgggcgggtggttgaccacctgacaaacaccaagggcttctccctgcgggcgctgaagcacctggtgctggacgaagccgaccgcctgctcaacatggactttgagcaggagatcgacaccatcctgaaggccatcccgcgggattcagagctcaaggaggtgaggcatggggttcgcaggcagagcctggcaacagagctgattggttcaagctcttctcggctcctttgctctcgacattattcatgtgcactggttcccggcacggggactcagcaaggagaaacctag

SEQ ID NO: 7047 - DNA, 471 bp, Chlorella protothecoides
atgaccagcaaggtggcaaagctgcagcgcgcctgcctgcgcaaccccgtcaaggtggaggtggcggccaagaacaccacggtcgccaccctacgccaggaatacatgtttgtgccggccaagtataaggactgctacctcgtcttcctcctcacaggaggaaatccctatgcagtccccatggccccccccagactgccccttcccccaagcgtagcctgccgaccccctgcccctccaattcccccccacccccgccaaccgacaccccaacacagagcttgccggtgcgagcaccatcatcttcacgcggacctgcgacaccacgcggcgcatcgcgctgatgctgcgcaacctgggcttcggcggcgtgcccatccacggccagatgagccagcccaagcgcctggcggccatgaacaagttcaaggtgtggggaggggtggtgggggtgctgagtttgaggggtga

SEQ ID NO: 7048 - DNA, 642 bp, Chlorella protothecoides
atgagcttgccccgcaagcgctgggttgcgtatgtagccgtcctgattcaggcagatggcaagggactgcttcgtccccagtacagttctggagcctctcgcaagttctgccttccagttcccccctttcccgcccagatcatcacgctggtggacctggccgggcacgccaagtacttcaagacgacggcgtcgggtctgacaggacacctgcccgactacgctgcggtggtcataggggccaacgccggggtcatcggcatgtgcaaggagcacctgggggtggcgctggccctccagatccccaccttctttgtcgtcacaaaagtgagtcatgtgatcccgtgggatcgctggtggcagctggtgtcaccgaggagccctgctgaactgcaccctgcaaacttgccaatgttcttccagggacatcaacacagatcagcaatggtcaggggtgaatgcctggctgcactcgcctcgacgtgcttgcgctgcaaagatcacccccccgcaaccctcctcgacaccaaggtggaccttgcgcctgcgcatgtggcaaagcacagcctggagacgctcaccaccatcctcaagcaccccagcatacgcaagaagcccttcatggtgagggacgaacggtga

SEQ ID NO: 7049 - DNA, 375 bp, Chlorella protothecoides
atggtggagctgaacggcactaccctgggggaggaaagccccagccaggcgagtatggacgccgcgctttcctcgctgcacgatgcgatgcaggccgtgggcgcagaggccagggtgctacgatcccgccccgccacgcgcgactcccgcgcctccaccgacgtctgggtgcgctgccggccgggggagggggaggtgctggaggtgcacgtggcggtgatcgggaacgtggacagcggcaagagcacactggtaggggtgctgacgcacgccgcgctggacgacggcaggggcagcgcccgcgcccgcgtcttcacgcacggccacgagcagagcaccggtgggcaaggggatttttgttggagatgcatttga

SEQ ID NO: 7050 - DNA, 2097 bp, Chlorella protothecoides
atgctgggcgacgtcgccctctgcatctcgccgcagcgaagacttgtaccagtccaggccctgcatggggtgtggtggtctaggcagtgcaccagattccctcggtacgcctgggcggggcggcgcctttccggcaccaaggtggctccctgccaccgggtcacagtgccacccaaggcgcgctcacctgcacctctccctgcgccccaggctcggcttcttcgagaaggggctgtggggtgggtggcctcctcttcacccgcttggggttggtgttctgtgtcgcgctgggtggagaagggtcgggatacctgggtcctgcctcgctctgagtctggtggtcctgcggacggggatcagggatggaggattggtacttcaatttcaagccaaacatccacagtcctcggctggccgacaccaggcaccctacctccgaacgatggaacagcttgcgaaggaattccattcacccccaagaaactgatgcggggttgtgcacgtgcagatgcctgcaacgatgccggaccgggtgtagagcaaaggcgtgagtatcacgtcaaacttgaattgggctggatcacttcggagtgcaagccagactggcaaaatcaggtggtggaaggagagtatgcgctcccctgctaccgacatcaggctgcctgccactccctgaatgtgtgcggggcagggaagttggactgggcgattcgggatggctggccgagctcagcattgccaagctctcaccccaggtatcgcagacgccgagtgtgcatgaaagtgaaggggttgagcagcacaatgcggagccatgagctgacaagccacactttgtccattgccccacaatgcggagccatgagctgtcaagccacactttgtccatcgcctgtccaggatgcctgggatgtgcatgctgcccatacggagtggccccctctccacctccgccgtcgagccgcgatagccgaggtggtcctggcaggcagcctcacgatcgccaccagccaaaatggagtggctgtggcattttctgagggtgggtgtgggaaggctgagccagaacatggcagcaaagagggctgcgtgctgaatctggcggccgatgagcacattcatggcatctctgccgtctccgggaggcccagcatcactgtcatcagctctttcctcagtgacggaggccagtccctcagatgccgtgtcgtcagcctggcaggggtctcgagggggacgccgcacgactggatgccgctgtggaccaacgagcccctgcacaaccctggcttcatcgagctgtctgatgggggtgtgcacgcccttgtctttgacccagccaaggggtgcgctggcgaggggggggcttacctctgcatcgatcaggaggccagaggaagcgtccactcatccacctctccgggcggcaagactccgtcaccccaccccggtgcatgcaggcagtatagcgtctgggacgtggggtctcgcagcgtgatcttcgggtttgccagtgccggagtggtggatgccgtcttcgcctcggaggatgcggtgctgtgcatcaggccgagcccggcgggcgggacgcagcggctgaccctgctggccctggtcgacggctcatcgatgcatgtgggtggggcagggaggggcggggcgcggggtaatggtgcggtactcgatgccaggccggccgctgcagcatatgcgtgggatcgccggagcactgtcatgactttcacccctgcttttcaatgctactgcctggtgtgcgaccgcaaagccttgccccgctcagtgacattctccatgcgccgggagcctggccccgcgctcctcggcgccaccgctgctctggacacctcctccctcccatgcgccccccctccaccacaggacaccgtcgtccctgggcccgcctgccccacccggcggcacgaggtgaacggcccttggctcttcatgcacggcgcggacggcgtgctgcgcacgcagtgcatcctgcgccagggtgccccccgccccctgcgcgccgcgcccgccccagacctcggcgaccccctggccccacccaccctcctgcacgcgccgcgc

SEQ ID NO: 7051 - DNA, 1167 bp, Chlorella protothecoides
  modified_base (226)..(235): a, c, t, g, unknown or other
  modified_base (395)..(404): a, c, t, g, unknown or other
  modified_base (824)..(833): a, c, t, g, unknown or other
atgggacgtcaaaccgttcagcatgtgcctagaatgtatgcttatcatctagcgatcgaagggccgagactctcaaggggcgttgcgcatctgcgtacacttcttatcattgaatataccagatcagggatcaaagtgcagctcagtcacttagtagaaggaggagcaagtaccctcagcgcactcgctgggacccactccgaagcacccaatcaaccctcggggnnnnnnnnnnatctatgtcatggctgttgccctcttgacctctgtgctgaccagcaagctggtgtccctgtccaggaaaacgaactgcaagctgggcatcagcaggatcaagcttctacgcacccggcagcttccctcaaaatcctgatgttgggcttgtcaggctcgannnnnnnnnngcgtaacaagaaacatattgctgtgcgtttgggagacctgttggggtgctcaggttggcgcttggctctcgggcaggcacccggcagcttccctcgaaatcctgatggcttccgtagggaggtggccgacttgcttcgcgccggaaagcagggcaatgcgcggattcgcgtggagtctgtcatccgggagacactcctgcttcaggcatttgacacgctggaggtctaccttgagctgttggcggtccgcgtggagctactggccaagaccaaggagatgccgccagacatgatggagggggtgtatcctcttgggtacagcctcgccttttccaacctgccccagattacaatcccgcttgtaggccatctgcagcctgatctacgctgcggagcgcatcagcagcgacctgcccgagnnnnnnnnnnatgtgaccataggggtgtattctcttgggtacagcctccccttttacaacctgcccagcttacaaacccgctcgtaggccatctgcagcctgatctacgccgcggagcgcatcagcagcgacctgcccgagatcgcggtcatccgctccatgctggcctccaagtacggcggcctgtacaaggactttgcgcaggccgcggcttccgacgcgcactaccgcgagtggcaggtgaacgagggcttggtgagctgcctgtcggtggaggcgccgggcgcggagcagaagatcgcggtgctggagtccatctgcgaggagcacggcatcccctttga

SEQ ID NO: 7052 - DNA, 852 bp, Chlorella protothecoides
atgtgcacccctcttcacccacgcaggttcgacgacggcatccgtttggaccaggagggctggttctcggtgacgccggaggtggtcgcccagcaccaggcgcgggtagttcccccggggtcaaccgcgttggacccctttgcgggggtgggcggcaacgttgttgccctggccgaggtggcggccgccgtgatcgccgtggagatcgacgcgggcagggtggagctgctgcgccacaacgtggctgtgtatggcctggaggaccgggtacgctgcctgcaaggcgacttcttccagctcgccgaggagctcaaggagacagtcacggtccaaagtgtcccagactgctcgcgacatgccaatgcacaggacggtgtgcgcccgcgccgtgccccttcccaaggcacggcgcgagtcaaccttcccttgcatgtcctccctggtccgtctacccttccctccccacccgacgaccctcctcccccctcgtcgcccatcccccaggcggacttcgtcttcctttccccgccttggggcggccccgagtacagcgctcaggccgtgtatgacgtggagcgcatgggcgggctgggcctgtccctgacagggttgctggacctggccttccaggtcgtgggcgctcggggcgtggtggccttcctgcctcgcaacgctgacctggcgcagtgcgcgcggtccgcggggggccggccgtgcgtcgcggagcgcgtagtgctcaacggctacctcaagggcaccaccatgtactacggtgccgccgcgttgcgctggctggagctcagaggggcggaggagggggaaggggcgggggatgacaggccaccgggctga

SEQ ID NO: 7053 - DNA, 663 bp, Chlorella protothecoides
atgttagctgatctgagatggttcaaatcggggaaggcaatattttcagtattctcggcctcagctcagacttgcagcagcgggcctcagtactgggaacacaccaacgcctgggtaccaccaccatcgcgggtaccgcagcgctgcatggcacgtaaaccgaacgggcctgcagcatccgcgatgcagaggacctgcagcgcggccaggagcttcctgcagttccgtgcctgcacaggtgctacctgggtgaatggcctgaccgccgtttcctcctcatctacgctcaaaggcgtgaggggtctcgcggaggtagctgccgaggacaccaaagaaacaccatggcacagtgggcatagcgtggcgaccttgcacgaggccccaaccacccgctacttttcaatagaccccagggctgttcccgaggcacaggcggacttctatgaggaggcctacctgaagaaggagggtctgacccagcccaactatggctgcactggggtgcaggtcaggctgggggtgcaggcctcgatttgggggggagggggtgtgttcctgcagctggatggtaaccttgacacacaaggtggaggcatgcggaggagtgttgctgtgcatgaggagttctgtgggccgccccaagctgcctccctgactgtctag

SEQ ID NO: 7054 - DNA, 702 bp, Chlorella protothecoides
  modified_base (559)..(568): a, c, t, g, unknown or other
atggccgccaatggcatcgaaaagattggagttctggtggtcggagcgggacccacgggcctgggtgcggcaacgcgtctgcaccagcttgggcatcccagctggcttctcgtcgatgaggtgtgcaccgcggggacctcgttcccctcccccaccggcctcacgacgcacgatcgttatgatgggatcgcggggggggtgatcgacctgcaccgctgtattgcctgcctgcccccgtgccataccgacgaagatgcctcgattcccacaccccaggccgaggaagccggtggcctggcctgcaccgatgtcacgcccgagggcttcctcttcgacatgggcggtcacgtcatcttctcccactaccagtactttgacgagctgctggacacgggtgagatgctcctctctttcccccaggctgcgcgtggcgtcgtgcctggctgcatgctcctgggtgtggggccgagggcatgcgcctcggcgggcgggctgccctgcctcgtctactcagggctctgtcagagcgcctgctcacccatgttgcgtgacctcctgnnnnnnnnnncaggctgcgcgcggcgccgtgcctggctgcatgctcctcggtgtggggccgagggcatgcgcctcggcaggcgggctgccctgcctcgtctacgcagggctctgtcagagtgcctgctcacccatgttgcgtga

SEQ ID NO: 7055 - DNA, 222 bp, Chlorella protothecoides
atggagcagccggcccccgccaacggactcacggtgaccgcgccaacgtgcggcggccggctgccggccgccctggccgtcccgctgcccaggaacagcagagtgagcgtcccgcgctacaatctgcaggaggtggccaccgccgccgccttttactacgacaccggcgtcatcacagggcgtgcgtccacgagcatgagcggcaccgagacccgcccatga

SEQ ID NO: 7056 - DNA, 1392 bp, Chlorella protothecoides
atgctcctgaacgatctccgacagagcgcgcgcaaagaaattcacgacgcgagggtgtggaagatcattgcagcggtctcatctgaactccgccatcggcccccgcttccagcggaaggttgcccacacaattcgtgcacaggggcgatggtttctgcacttgcagcagccctggcccctgtagcagagcattgggcccagtgtgagaatgcaaattgtcagaaatggcggaggctaccacctggaactgtggtcgacgagaatgcgccatggtactgttacatgaatccggatgctcaacgcaacagctgcagcgccgatgaagctgtcgaagttgaagtcagtccatgtgctccagctcgaggccctcatgctcgaagttccccttgcgctctagggcctcaacagcgacgactcagcacaggcggcgcatttgaggcaggaacttggagtagacgtccatgcgaagacgggcacaaagagaggagccaaggggtgggtctcctgccaggaaggggtcgaaacatctggccagtgcgacttttccctcggcactcccgtcttgtatggggtaatggcctgcaatatgtgagacaccaggcatgcctgcccctccaaacccagttccttccctacttccacagacgaggcagtgctgggaagccccgggccaggcagcctcgtgtcaagtgggaggaggcgcctggtctggggacaggaccggaggctgctgggccctccgggacggaccaagacatgtactatgcggactccagcgaggaggatgcgccacctcgcatgaactggcgccagctcagcaagcacctggtgcgcatgttggagagcgcaggtggggcagaggggtctggtccggggacgagcggggccccgcccctgccccaccccccacccgacgtgtggcgggagctggggcagcgctgccctgaggccgccgaggctgccaggcaggctctggacacggccagcgccgcgcggtacttcccagaccgcccctcgggcgtgtgggaggagagcaccgccctcgcgaacgctgcactggcgctggcagcgggccaggtgctggtgcagaacgcctcgagcctgccacctgaagagcgggagaggctggggttggggccggctgcgccgctggatgtgacggctgtggtggagcgactgaggctgggagcagggcccggcttgccagcggtgggagatgctgtgcagatgtgcaaggaccatggacgtccctcgcaaacccctgtccgcaccgagatcccgccaggaaacccatcctccgctgacaccgtttacagcctggcgcattggcacagtctcgctcagactccattgaactattctcacaaccaccaatctacccgagaagcctag

SEQ ID NO: 7057 - DNA, 720 bp, Chlorella protothecoides
  modified_base (389)..(414): a, c, t, g, unknown or other
  modified_base (562)..(571): a, c, t, g, unknown or other
  modified_base (660)..(669): a, c, t, g, unknown or other
atgcctcgctttgaaggctgctgctcccacgatcacgactgcgaagaggaggactgcagcacttcctactcactgtacaagaatatcgatacacccagggtgcggtgtctgaacgagctggaggagggatcatgccaggcagtcttcaagccctggcacgcccggctagactcatcaggacccaacctccgaagtcaggaggacgaccctgagctgctgctctacgtcccctttgacggagcggtgtccctcaaagccatctgcgtgattggcggaccagatgggagggggcctgcaaagctcagggtgaacaggaggatgggtgggctacatggagctaggtctgctgcgaatggggctgcgagcgccactcatgatcgcaacattgnnnnnnnnnnnnnnnnnnnnnnnnnngtgtatgtcaacagagaggatctggattttgggatggtggcagacctgcagcccatccaggagtgggatctcgttgacaacacagccggtgttgtggactatcccacacaggcctccaaattcaatggcgtgcatagtctgacgctgnnnnnnnnnncgcagatttttcgggatgacttggctgctatcattcacaatgagatgatagagatcactctatgcccgcctcccgccttggcccccagnnnnnnnnnntgcagatttttcgggatgacttggctgccatcattcacaatgagattgtag

SEQ ID NO: 7058 - DNA, 789 bp, Chlorella protothecoides
  modified_base (413)..(422): a, c, t, g, unknown or other
atgccccgaggcgagggcggcgccgccgaggcagcacctctctcctgccccatcacatcagcgtcatgcctcctccagcccttctcggcgattcctgggtgcggtcacatcttctcgaacaaggccatctcgcacatggctggggtgtgcgggctctgttcgcagcccttcgacccggacctggtggtggggctgttgggggatgaagttgagaaggaacggctgcgaaggctgctgcccctcagaccaggcaggcagcgcagtgggaagaggaagcgatcctcgcagaaacaggcatctggagacgggggtttggggtctgtgttccatgtttggtgggtggtggtcaggggacccactgcccgcgctctccgcaagatcgacgtttcactgagctttgacggccctgaatnnnnnnnnnnaaacaggcatctggagacggttgaagccagtttggggcgactgcccacgctctccgcaagatcgacgtttcaccgagctttgacggtcctgaacaacataaacagtctcattgagctcaagtacaccatgacacgatcgacatatcggtcgagcgcactgcgcggccatcacgggactgccgcacgacccataatcgctggcggtcccgcggtgcgaaggcgatggtcatgtgggcaaatcaggccggcctcatcatacttacctggaccggttgcacggtgctcaagaaggtcgtgcaacatccagcagctgcaggccttgcacttcgctttgcggctctgggttcatggctcttcggggtcatga

SEQ ID NO: 7059 - DNA, 231 bp, Chlorella protothecoides
atgggtctggatggtgggaccgtcatctctcgcagcgacgtgctcagaggggcatcctgggagctgtcgcaggccgatggcaccaggagcacacgaggtggagcagtgagcaaagccgggaccttcaaaaagcccaagctcgacaaggtggcggtcaggtgggcatgggcagggtgctgggacttggcagtgtcacaccctgcctactgcagtgcacagcttgtttcataa

SEQ ID NO: 7060 - DNA, 813 bp, Chlorella protothecoides
atgcagctgggtcctgtcgcgctgcagggcagcgccgtgcctggggggccactccagcgcccctcaccgccctcccgcgccccctccaccaacaggggagccaggccagccgggggagatcaaagctggacaggaggactccacgcgccgccaggtggacccggagactccacgcgccgccacgtggacccggagtggaccgaggccggcgaggagaccgccttctccgacggcttccccttcctggtggccaacgaggcttcgctgacagacctgaacgcccacctccctcccgacgagggcccgctcaagctcaaccgctttcgccccaacgtcgtggtggcgggcgcccccgcctgggcggaggacggctggctgcgcctgcgcctcggcgcctcggccacgctgcacctggtcaagccctgcgatcggtgtgcggtgacgaccaccgagcaggagaccggggtcgtggggtacgagcctctgcgcaccctgcgcgtcgtgcgctccggcaaggtgctgggctggagcgaggcggtcccgtgcttcaagggcgcggtgttcttcgcctggaacgccgtcagcgaggggcccggggggagcatcatgcggggggacggggtggaggtggtccaggcgcgggaggggccggccgtcccgcagaaggtggaccagcccgccccggcgcaggcgcaggcgcagccgcaggcgcagcgtgagctgggggcggggctgaccaccctgcagaaggtggccctgctcctggcagcgatactcgtgcgatacctcttccagtactatgcagcgaagtga

SEQ ID NO: 7061 - DNA, 492 bp, Chlorella protothecoides
atgtcgctcagcgtggctagcctgcatgtgtaccccgtgaagagctgtggtggcgtgactgtcgagcagggtgtgatcacccccataggattccgctatgaccgcaactgggtggtgatcaatgaaaagggtcggttcgtcacccagcgccagaaaccggagatggccctggtctccgtgagcctgcagcctcaggcactgctggaggacgcgagtgcagaggagggccagtatccggacgccacgctggtcctgcaggcccccggcatgcccaccctgcaggttcccctgaaccccggtcgccggcaaggcccctccaccaaggtcaccgtgtgggagtggacggggctgggggccgacgagggtgccgaggcggccgcctggtggagccagtacctgggccatgaagcccgcctggttcgatatgcaggtgagggatctgggtcgggccgggggccgcacgtctgcgccgcctcgctgggagatgggtga

SEQ ID NO: 7062 - DNA, 822 bp, Chlorella protothecoides
atggtgtactggctggtcgccctcccggcgcccagcaccggcatggagggtgcatgggccagcctgcaggaggacaccacctattcctccgacctcagcgtcaacttcaagttcgcggtgcccgagttcaaggtggggaccctggactccctgctgggcctcagcgacgacctggtgaaggtgaacggtgcggtggaggggtcggtcaacaaggtccgacgccagctcttcgagctgcagtccgccgcccccacggaccggagcgaggaggaggaagggggcgaggtgagggtggagggcacctccccgcccgactacctgcagcactttgagtggcaggaggctaagtacccctccaagcgccccctcaaggacaccgtggcagccatcacggaggtcactcagaagctggacgacgacctgaagctccgcaccactgagtacacccagcagcggacgctgctccaggcccagctgcgaaagcgcacgggttcgctggcggtgcgggacctgtcggacctggtgccgcccggcgagctggtggagaccgagaacctggtgacgctggtggtggtgatcgcgcggtccaacacccccgagttcatgaagagctacgaggggctgacggagtgggtggtcccgcgctccgcgcgcctcgtcaccgaggactcagagtacagtgtggtcagcgtggtcctcttccggcgagtggtggacgacttcaaggcagctgcccgcgccaagggttaccaggtgcagagtggagggagggagatggacattgtgagggggggggggctgatcagaggggacggagggtaa

SEQ ID NO: 7063 - DNA, 492 bp, Chlorella protothecoides
atgttccactgcaggaggagggctgtgcccactccccttcagcggaagattcctgccggtgttaacgaaccagcaaaccctaaggaagctgtgcaagggcccgctgccaaggagatcacatcggatgcagagtcccagaaggccaacgaggagggtctggaaaagctgcgtgccgcggtggaggtgaagcggtcggagttcgaggcctggtgcctgacctcctactccgaggccttcagcgcctggatccacatccttgccgtccgcctgtttgtggagagcatcctgcgatacggcctacccccacagttcctgcccgtcctcatgaggcccaaccccaaggcagtgtccaagctgcgcaaggtgggaggggagctggacttgtccagaggatgtgggagggatgctctgcggggagaaggtctgggtgctgagaccagattcttccaccaagaacgcacacggggtatgtgcgtctggagggcagcttga

SEQ ID NO: 7064 - DNA, 1440 bp, Chlorella protothecoides
  modified_base (536)..(545): a, c, t, g, unknown or other
  modified_base (1256)..(1265): a, c, t, g, unknown or other
atgccttgtggattgcagacgtgcccaggcgtttggtggacgtgtcctctgctgaaaggtgtggaagccgggatgggtcaggtcatagtcctgaaagcagagcgtcccagtctggcttttgcgggcgccctgcctccacccatctctgcttcagcacctccaagtgctgtgtgctgcatcatgggggatgagggtggaggcgaacaggatagggcactccgtgattcgttgccgatcgtcatccccagctctggccctgcccagttccactgcgcaccagcccagcactcactgctgagccatgcatgtattgagggccgccatctcagacctgcaggcccatgctatggagatcgtgcgatccttacagcaggccgcgtatgcctcgcccacctccttgcactgattgaaccccttgctcttcaatcggtagaagagggctgcatggataggaacgggtgttgggtggatcacacagaccggctggactttggagggaccacgctgccctccctttccagtctgcacaacgcaannnnnnnnnngtgttgggtggatcacacagaccggctggattttggagggaccatgctgccctccctttccagtctccaccacgcacacctgctcaccctcttccgtcttcttgggaacgtccagagttgccatagggtggatatatgcgctgggatgggtgtaagccggctgatcgttgctgagacgcgttcagggcaccctcacgggacccagcaattcctgtgcagttcagctcttcagaatcaatgttgcaccgtacccctctcgataccgaggaggtgcgtcacacctcacctcctcgtctggggtgtcggtgctgctgtgcgtgcggtgcagagtgtttccagactcggcagaagtgtttccagactcggcagagtaaaactaagcatgactgacatcccaacatgtagaaagtggtccattgcacattctcagtccccatacgaatatctcgctgcctgtgggctgaccacccccctgctggccgggttggccgtgggagcagcggcatatgccggcaagacggcactcactgcttggcagtcatttagcaagacaacgccgcgcatgaggcaattctacaagggaggcttccttcccgagatgacacgacgagaggctgcactcatcctaggtgggaggggtttgtgtgtacttgtgcagggcaggtactcagcgtcctctcggcctgcccctcagcccgcccccctcctggnnnnnnnnnnctacaagggaggcttccttcccgagatgacccgacgagaggctgccctcattctaggtgggtggggtttgtgtgtacctgcgcagggcaggtattcagcatcctctcggcctgcccctcaatccacccccctcctgacaaaaatgtgtccgatctgtcgctcacgtcacctctag

SEQ ID NO: 7065 - DNA, 1443 bp, Chlorella protothecoides
  modified_base (137)..(146): a, c, t, g, unknown or other
  modified_base (1112)..(1121): a, c, t, g, unknown or other
atgggttcaccattgcgtttattgatgcgtggaaacgaaatactgccgctcatatcgccgcagatgccgtgcgagacttgccacgcaaggcgtccagctcgcatcagatccggtgctacgaccctgccacactcgannnnnnnnnngcatgccatgagcgctgctgaggtgcgagacatcatagcaaagacacgattggccagcaaggtgaggagcggtgtctgtcaagggtgcactacagcaattggagccgtgctttggtactgcaacgcactaaatcatctgctcccctcccccaacgctttccaggattggaaaaagtccagctttgcacagcgccggatgctgctcaagatactgctcaagttcaccgtcgagaaccaggccgacatctgcagcgggggactgcacccgtcccgagtcacttgctcccccgcacgatctcagagtgtctgccctggactcgggcaagccactggtggatgcatcctttggggaggtcctgggtacctgcgaaaagatctggtggctcgtggcagagggcgagagatatctcaggcccgagcgtcgctcctctggctacatggtgaggaggttgaggaggggaggatgattgcgagaagaccagggattgcggggttctgcttgggggacccacggctggcaggcatgtggtgcctgctccccccacgcaatctcagcctgcacggtccaggtatcccaaccacccccgctccaaccacgatcctcgcccagatgttctacaagaaggcgcgcgtggaataccaccccgtgggcgtggtgggcaccatcgtgccctggaactaccccttccacaacatcctgaacccgctcaccgccgcggtctttgccggaaatggcgtcgtcatcaaggtgtgcgggagtgcgaggggtgtgggcagagccctggggtattcggggcgggacatctgggttcgagggggcactccgcctgccagtgccgcgcctgctttgtgtatgctgtggaaagagcggcagaggcctgccgtcttcatcggccagcctgtcacacatccacatcctggcacacacacaagctatgcctcaagtcggcattccaacctctcttnnnnnnnnnncgtcttcctcggccagcctgtcacacatccacatcctgtcacacacacaagccatgcctcaagtcggcattccaacctctcttcctcccccaaaggtctccgagcacgccacctggtcggccctggtataccagcgcgtgatcgacgccgcgctggcggccgcgggcgcgcccccggatctggtccgcatcgtgaccggcttcggcgaggccggcggcgcactggtcaccggcggcgtggacaagctcatcttcgtgggcagcactgccatcgggcacaaggtggagctgcgtgggggggcagaggttcctcgggccgttga

SEQ ID NO: 7066 - DNA, 1122 bp, Chlorella protothecoides
atggtggacaaggcggttgcggagagcgtaggaggcttggggcagctgacccccacctccacctgcgttctcatcgagggcatcctgtctgagacgcctccaggcaccaagcagaaggccagcaagatcgtgcacctgggcaccaccgacgcggccgagtacccgctggccaagaagaagcagtcctttgagttcctgcgcgagaaggcgcacctgcgcccgcgcaccaacaccatcggcgcggtggcgcgcatccgcaatgcgctggccactgccacgcacaccttcttccagtcgcacggcttcctgtacgtcaactgccccatcatcaccgcctccgactgcgagggcgcgggcgagatgttccaggtgaccacgctcctgtccggcgccgacggcgcggcggcctcccccgctgcgaccccggaagagctggaggcgttgagggcggaggtggcggcccagggcgaggccgtgaaggccgccaaggcggcggctgcggcagacaagcaaacctcgacatgcaccaagcaacccccgaccctgcaggcggacaagtcgctggcggccgagtccaaggcccaggtcagcgccttgctggcgctgaagcagcggctggcgggcgcggaggagcgcgcgcggctggtgggcggcgtgccgcacacgccctccggcggcatcgactactccaaggactttttcggccgcgccgccttcctcaccgtctcctcccagctgaacgcggagtactacgcctgcgcgctgacgagcgtgtacaccttcggccccaccttccgcgcggagaacagccacaccgcgcgccacctggccgagttctggatgatcgagccggagctggccttcgccgacctggccgacgacatgcgctgcgcggaggactacgtccgcttctgctgccgctggctgctggaccacgccgcggaggacatggccttcatcgacgccgtgatcgacaagggcgcctccgagcggctgcgcgccgtggccgccgcgccgtttgcccgcgtgtcctacaccgaggccgtgcgggtgctggaggaggtggtggcgagcaagaagaagaagttcgagttccctgtgtcctggggcgtggacctgcag

SEQ ID NO: 7067 - DNA, 705 bp, Chlorella protothecoides
atgcccctcccatcgatcccttctcgccctcgggtcgcgtggcctggggtcacgagcacgatcgccggctttgcacgccccccaccctccccgacgccaggtgttgatcggcgggcgcctgccggccacggggaagggccacttttacccgccgaccatcatcaccggtgtcgcacagggcatgcgcatctgggaggaggaggtctttggacccgtcatgtccggcgtgcagtcacggccacgcgaggcagcgctccgtgccgaagcgagcaggcgctccactcgtcccatgacgaaagcgcgtgcattcacggccacgcgaggcagcgctccgtggcgaagcgagcaggcgccccgctcgtccgacgacgaaagcgtgcccacccacctcgcacgcaccaccccaccgcctttcccgtcggggtcccagtggtgagcttcaggagcgatgcagaggccgtgaccctggccaatgactgccccttcggcctggggtcggcggtgttctccagagacgtggcgcgtgcgaggcgcctcggcgcccaactggaggtgggtgcgacgctcttgcggggggtgggagtagcatgggtgtggccggtggggtcgagcgcgcctgggcccgcaatggagccaggcccccagctgcaccagacaagggtgtggatatgcggcaggctgtgctttccatggcccctggtgtga

SEQ ID NO: 7068 - DNA, 1260 bp, Chlorella protothecoides
  modified_base (1020)..(1164): a, c, t, g, unknown or other
atgggctccctccaggccgtgctcgtgacagaggacacggaggtgcggctgggcgcgtgcctcaaggagctgggctcggcgctggccgagctggcggcttgtgcgggcgacgcaccgcccgacgtggcgcaggacactgcgcgcgtcccgcgccagatcgccggcgccaccttcgccccccgccccggcaccgacctgctcacctggcagctcctgcgcgggctgacgctggcgggggtcgggcgaggcgaccgcgccgcgctgggcgcccagctgcgcgccgcgctgcgtctggtgtccctcggccgcgagggccttggcgtctggctggagcgggaggtgctcgcgctgcgcgccgccagcgtggccgcgcgcgccgcgggtgacgtcgtgctcgccttcttctgccaccaggtgctcatgtgcctgctggccgcggggaccggggcctgggactggctggaggagcccgtcgcgggggaagggtgtgcccaagacggcgctccgttggccaaccccagcgaggccgccgaggcgctggcctctgcgcgcaccacgcccgcggccagcgcctgcctgggcgaggccacgccgccagggcagggcaccccaccgggtgccggcaagggttctggtggtgcagaaggccagggtgtcagcgaggaacccctctccagggcggacgagggcagggccagctcgaacgtgatggcgcaccccgtggcggacctgacagacccagcggacatcgtggacggggcctcccccggtcctgcccccggcaacgcgcccgggaagggcgaggcacccggtacgccaccccgcgccgcgcccggacgggcgggcgaaggcccgggctcgcccgtgcgcggcgccgcgcgcctgctcggccacgtggcggcctggttcgcgggcatgggcggcggcgtggcggggccggtgccgcggtccggcctgccccttgcgaatgctttgtccctagacctggcgctcggcggctccggggcgctggggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccccggcagcgccgcgctttcccgcagcgcggtggccgcgctggcctcggacctgcgcgccgacggctggccggacgcggagctggactttga

SEQ ID NO: 7069 - DNA, 1437 bp, Chlorella protothecoides
  modified_base (293)..(302): a, c, t, g, unknown or other
atggtcttcaagcaggggcaaccatcagaagttggagtggctccacactccacgatttgcaagtatgctgagatccacatgcaacatccttttttataccaaactatgccgtctgaagcccctcaagacctcacatttttcctgcattcttcagcatcagtttctgcacctcgtagaaactgtcccaggtctcgtcagattccgggaagagggaagcatctatcgaggctggccagtctcccattcagccaagaggtctgcaagcgcacaccctcacaaccagactcctcagnnnnnnnnnntcagctgaccagcaagcactacgcatgcagcgaggctggccagcctcccattcagctaagaggtctgcgagcgcacaccctcacaaccagactcctcagatccatatctcagacccttgccatcattaacctgacccatacccaggccgtgcgctcactctggcggcttgggctcatcccctcgagagccaggagatcaaaatcgctgacaacccccacgatggagttgttttggtccaccactggcagccccgtaatccgatggttgacgagcagctccagtgctgaggacatgacacaggaaaggggtgagactcttgcaagacagcctagccccctccacaaacctttgtctacggttgtgtcgggtgagcacgtgatgataccgtcactggtcatgaaagaggccacgttggcaatgggcttggcttcctgtgcaggacaggcggcacaggagcaaagtcagaggctcacccttttgaaactgaggagtcgctggtgcacagcgctcgtcgatcagagtcaggcagccgctcctccctccaagcttaccgggggcgcagcggacacacgaagacgcgcctgcccagcgggccttcttcccacagcccgatggcatgctggccatggcttcaaggggcgagtagtcgggcacgcggggatcgctcagtttggactctccgccagtcgacgatacgcggtgcagaaaaatgccacacgtcacgctgctgcagactggcgcgcgcgcaaaaaatcctccgtaccgtacaaaaatggcgctggttactcctgcatccccatttcagaacattcaacccgctccctgttgaagtgtcctagggcgaagcacttcccttgtgtaccgggtgttgacatggtgtccgaggaagacgtccgtgaagctatcgcggcacacctttctgacgccgagagcacatcctaccgccctggttccctcccgaccaacaggtgtggcaccggctttgaggtgcaagtggtagctcaagccttcgaggggaaacgcctgctagagcggcacaaactcgtgaacgcagcactcaaggacatcatgcccaacatccatgcacttagcatcacgcgggcctggacgccccagcaagcagcagctgcctga

SEQ ID NO: 7070 - DNA, 1269 bp, Chlorella protothecoides
  modified_base (290)..(299): a, c, t, g, unknown or other
  modified_base (533)..(542): a, c, t, g, unknown or other
atgcactccgtcactggcaggcaggaggcaactggcccgagcgcagccacccctggcagcaatggcaagagtccaggcagcgtcggggagcaccgtccccggcttccccccccacccaccgtgcatcacctcacggaggcaaatctggggcgtttcagcgtcagggctagtttaggaggccccaaagaggctgcggtggtgctccccctgcctaccagctggcagcagtgcattgaccaggtgggcgtgctgagtacctgcgccagacttgtgtttagagcttgcatgtnnnnnnnnnnctggcagcagtgcattgaccaggtgggcgtactgggtacctgcgccggtgttgtgtttagagcttgcataatttcagagcatgactgtggcatggatctcctttatagtttgcgggggcttgataggcgcacaaggattctggctgggttaggacagtggtgggccggcaggagaccagctgtcatggccgatgctgaattttcgcctgctcacacccacccccttcttattgnnnnnnnnnnggccggcaggagaccagctgtcatggccgaggctgaatgttcgcctgctcacacccacccctctcttcttaaaaatctcccctgtctaacaacaggcggtggatgcggtcatcagggcgtgggaggatggtgtggacaggcaggtggtacatctcctgctcccacaggcatgaggcagggcaaacatgggctgtggagattgagctttacattttccctggtgctgtattgctcacgagtcgggcatgaggcagggcgagcatgggctgcggagattgagctttacatttaccctggtgctgtaccgctcacgagtcggttgaacacggtcgaggggcgcggctggcccggcggcatcaggcagcagtgcaggtcggccctcccactcatagaagcgctcctccggaggctgaagaagcatccagacctggcgggcaggctgacgccgaggtggctggatgagccagactgtgtgggtgaggaggagtgttctttgaagctggtttgcttggtaggcttcaactttgacgatccgcgccgtagggcttgggactacgggggaaatgatcggtttccggtgccaccctccagggtcacatgctgctacgttgttactgcctgccagccagcacagcatccaagttaccacctcctcctttttcacagcgctgtggcgcagcccgcgtctggcggcggccatgtttgtgacggccgatacgctgcatga

SEQ ID NO: 7071 - DNA, 1500 bp, Chlorella protothecoides
  modified_base (953)..(962): a, c, t, g, unknown or other
  modified_base (1279)..(1288): a, c, t, g, unknown or other
  modified_base (1358)..(1373): a, c, t, g, unknown or other
atgctgacgcagcatgcctcgtgccgagtgctgcccactggtgcctggcaggggcgtggtcgcacctgcccccggcagagcattacccgtacggcatgcgtacgggatggaacactgtttcaatcccaaaatcgccggcagtggctgcagcgtggtagggcactggtccctctaccgggcaccttgcatgggggacccccaccccctcccctgagagggaccggccagtatgcgcatcaggcacgcgcctctgccctgcccggcatgggtgcgctgcacctcgtcaggagtcacatcgaacctggggtgctgggcgccgccgcgagcgtatcagtgaagctcatcatgatctgctctgtcgtcgcctggctgctgcgcaccgagaggatccccgccgacaccgccaccaccctgagcaaggttcctcctggagggttggggggaaacgagagtgggtgcccaagggtctggcagcttcagtcgcgctctcaggccgtttcgaacctttgcatggcggcccctgccacgagtccatgtgccgcgctgtcgagcctcgagtcctcgctgcccatggcccagcaccatcgaatcccccatgctcctggtcagcatcgccggcgtggcgacgctgcaggcggccctgggcgccgcctgcggcctcctgctggggcccctggtggacggcgcctacccacgtgcctgggcggtgggcggctggcatccgctccgcccctcccgccccgccctggagatcgccgccagcctggcggatgccgcggggttggatcgcgcacgcgccgacgccctggcggcccagcccgcacccgcgcctcaaggtgtgtgctttctgggacagcagggggagtgatgatgccgaagggcaccctgcacctctcgcacccctgctgcgcaccacaccactggctgctcgaggatcccggagctctgcaccnnnnnnnnnncctggggcagcagggggagatcccggagctctgcaccaccgatcgcgagtcggttgcccccaacccccaagagcacaaccacccaccccccttcccctcattctgccgatgtaggttcccgccagctcctggtcctcgcctgcgcgtttggcaattccttcaccctgcccgccatcctgctgagcacgctcttctccggggcgcgcgcggacgcctgcgtcggctacgccgcgctctgcctcctagtcctggacgggctggtgtggagcgtgggcctgggggcggtgcgcgccgcgaccccgggcgcgccccgccgnnnnnnnnnnaccccaggagcacaaccacccaccccccgaccccctcactctgccgatgtaggttcccgccagctcctgnnnnnnnnnnnnnnnncgccccgccgctccctgcccgaggcgctgcgcgcctcgctcaacccgcccatgctgggcatgctggccggggtcgcggcggggctgacccccctgggccgccgccacctggtgctgcccgccgccgg

SEQ ID NO: 7072 - DNA, 816 bp, Chlorella protothecoides
atgctggacgccctggtttgcagctgggcccgcagcccggcagccctgctgggcgcctacccctccctggccctgccccagccgaggcggcgtgtgcttgccacccacctggacatcgcgctcgggacgggagcgtgcagctggcgcagcgtcggcaggcaggcagtgccgggcccccgtctcgctgctcggctgcttgcgccgcaggatgccgtgcacacatgcacggactccccctcgtgctcgcacgctccatccctcccccacgacacacgcgcgcagtcgacgcgcgggcactacgcgctgctgctgggcccggccggcgtggtggccttggccgccgcccccggccgcccccccctgacgcagtgggaggtcctgctgctgctcaacatcgtgggcgtgctgggggacgaggaggccctgaccccggtgtgcctcccccacgccgaccccaccgccctcctgcacgcctacgtccggcgcctgggcggcgagggatccaccgcgggggcgtcgcccggggccggcctgggaccgctaaccctggccctgctcgtccccggcgcgccggaccgcgccagcctggcggccgccgccacgcgcctggcgcccataggccacctggccggcgcctcgccctccctcgccgtgcgcgacctgccctccagcctgggcgggggcccgccggggacgacgccgctcctgcactacgcctaccgcctgacgggcggggcgcagttcgtggcctcgccgccggtcggcgacggcaggctgcagcaggtgggcacgagggatccgggtgggggggtatga

SEQ ID NO: 7073 - DNA, 321 bp, Chlorella protothecoides
atgctgccccgcgccgtcatgagtccccccaggcaccgccggacttctcccccgtcgcctccctttccacccccccaggccatcgtgctggcgtacagccaggttcgggccgcggcgtacgaccgcgggtcggaggcggaggggccgctgtgcggtgtgcgcgtagagcggcgcccgggcctggccctggccgcggtgctgggaaaggagggcgagctcctggcggcgtacgacgcgctgtcgaagtgcgaggaggtggccgcgcactgcgcgcgcctggccgcctggctgcgggcccagcacgcctcttggttctcgtga

SEQ ID NO: 7074 - DNA, 876 bp, Chlorella protothecoides
  modified_base (50)..(59): a, c, t, g, unknown or other
  modified_base (371)..(380): a, c, t, g, unknown or other
atgcgaccctcccgccattcacccctcacaacagggcgcccagctgaccnnnnnnnnnngttcactgcttccccaccccccctcatgcgttcctccctccattcccccctcacaacagggcgcccagctgacgagcgtgcagtggggcgcctgggccggggccgggatggccgccggcgacgcgtccaccgccgcccgcgtggagcgcaccggcatgtcgctgctggcccccgccgacgggctgggggtggtgcagagcgtgctgatgcacgccacgccccccgccctggcggcggtggccttcgcctggccccgcttcatcgggcgctttggcgccgtggtgccggccctgtttgccgagttcgcggacnnnnnnnnnnggcggtggccttcgcctggccccgcttcattgggcgcttcggcgccgcggtgccggccctgtttgccgagttcgcggaagccgcggccagaccgggcaaggccggcgggcggcggggtcgcaagggcgcctcggccgcggccgacgccgcggacgcgcgcgcgggcgtggcctcggcggtggcggaggccgtggcctccatcgtcggcgccgaggtgggccccgccgacccgctcatgtccgcgggcctggactcgctgggcgcggtggagctgaagaacgggctggaggcccggttcggcctggccctccccggcaccctggtcttcgactaccccagcgtggaggccctgactgggtacatccgagaagccctgcccgagggcggggctggttcaggggaagacgaccaggaggacggctccgaggtggactgggccgcagcgggcgcggcggccagcccctccgcgggccccagcccccgccgcggcgccgcg

SEQ ID NO: 7075 - DNA, 1917 bp, Chlorella protothecoides
  modified_base (1419)..(1428): a, c, t, g, unknown or other
ggagcgcatggcggccgccgtggcggcggagacggccgccgccacctgccacgcgcaggccgtcagtgcgctggcgaggctggacctgcgccgcgcgggtggcgccgccagcctcctcctctctgcctcacgggacggggtcatcaaggcctggcggtgagagcgctgaggtcgcaggaggttgtgtcatggcggtgcctgcctgcaggtggattccttgtgtgtgcctgcaggtgccctgactgtgaaagaaacatgcgctgtgacgtcggagcgcgggtgaggaagccgtgggggggctcatttgcgacatttgggcgcgcggaggcactcgtcgatctgctcgggacccatcgaaacacggatacatggggagcagcccgctccagcactcccaatcggcatcgcactctcgcgaatgggtggagcgtgcctggggcctcagcgcacagggcggggacgaggcacgcccgccctttcgcggcgcatgcacccccatgcacagatcagcggctcagacgcaggccggcggcctgtcaggcggagcgacccgactctgggtgggtcgagccagccgcagggcccagcctgccctcccagggcgagatggttgtgaccgggaccccggagtccatcgggcggcaactacaggagattctgaggccaccccccgacacagactaccttgctgtgagtgcggtgttgggggtggggggggtgcacccacacctagccctcccccacatacagagcgcggcgttgatccgaagcctcccgccccccctttccacccacctgcacaccaatgctctctgcccccaggagttcctggccatccagaacaatggaccacggaagctgggattctttgggacgcggaacatgggtttcatgcaccagcagctgatcgaggtcctggcctacgccatgatcctcacggtgcgtgcattcctgctggcccctggtggtccccggcagggcgcagaggcagcatgctcccccgcccgggatgtgcgcagggcatcatgtcaagctcccggcacctgctccccgcagggcaatcacatctacacctccggggctactgggacgaatgcggcggtgattcgaggggcgctgagagctgagaacccggagctcctcaccgtgggcaatcacatctacacctccggggccacggggacgaacgcggcggttattcgaggggcgctgagagccgagaacccggagctcctcaccgtggtcctgccacagagcctcaccaagcagcccctggagagccaggagctcctccaacaggtcagaggccactggttgatggcctggccctcagagcatcttgtgtttgtctcgagtttcctagctcgaagagggtctgcgtttcaattgcatgcctcgcccgattttgcccccccatcnnnnnnnnnnccttgtgtttgtattgagcctcctagcccgacgagggtctgcgtttcgatggcatgcctcgcccgattttgcccccccatcaaccgctgcatgaccttccaacgcccacaggtgcctcagttgatagagatgccccagaacgatgacatgcaactgtcagaggccagcaggcatgtcggggcggggcagcaaggggcatgccagggtgagcttccgagtcaagtgcgatgccctccaggattgctcacctccccagagcctttcccaacccacaggctgtgcaatcgtgacatcataggccgcgtggcgcagatcatttgcttcgccttccatgactctggcctgctcctggagacgtgccaggaggccaaggctgagaagaagattgtgaccatggtggtagttatcgggcgagccgtgggctggggcagccttgaacagggagtcgtgcgcacagtggcagctggtgcttcaagcgccctgttctga

SEQ ID NO: 7076 - DNA, 417 bp, Chlorella protothecoides
atgggtggggcgggacactcggtggtccctggactgcaactcggtgtggcgggacagacgagcatgacatggctcgggggttttgtctttgggcgtcaggcatccaacgacaccacttgtgcagccctctcccaggccccactcaccaaccccttcccaaacacccaacacccccccaccctgcacgcagacttcaagaacgtgtcgatcgtggggcactacatcaaggagcgcaccaagaacgcgcagttcgtcatcatctccctgcgcaacaacatgtttgagctggcggaccgcctggtgggcatctacaagaccgacaacgccaccaagtcggtggccattgaccccggcgcgttcgtggtaggggccacgggccccgcaccggcggtggcacggccggtgctggcggcctga

SEQ ID NO: 7077 - DNA, 348 bp, Chlorella protothecoides
atggccggcttcaacgccgtgtccctgaagctgaaggagatgtaccagatgatcacgctgggcggcgacgctgagctggagctggtggactcgctggacccattctcggagggcatcctcttctcggtgcgcccgcccaagaagtcgtggaagaacattgccaacctgagcgggggggagaagacgctgagctccctgtccctggtctttgcgctgcaccactacaagcccaccccgctctacgtcatggacgagatcgacgccgccctgggtgagtggctgaggggctggggatcgggcgagtcgttggcgcggggagacgagcatggcatgggctcggggggttag

SEQ ID NO: 7078 - DNA, 708 bp, Chlorella protothecoides
atgggcaaatgtcaaccactgtcccacctttcgcacacccctaagcccgccccccccccttactttacacacacactttggcaggagttcaaggcgctggacgaggcggcgctggaggtgctcaagggccggaacgcggccgaggcggcgctggcggagcgagcggcggacctggcggacctgcgcgccggattcgaggccaagaacagggaggtgggcgtcatccggcgcgtggagcaggacatcctggcggagatggaggtgcagcgcgtcgcggccaaggacgaggccggcaagcggcggctgtgggccgggcgcgcagcggccgccgacgcggagatggcggagaagtggggcgaggcgcccgccgcgcccacccccgaggagctggcggcggccagcacggaggacctgcagtaccgcaccaccctactgcgcgaggagatggagcgcatgagcatcgacctcaccgccatcgaggcctggcgcgccaaggacgccgagtatggtgtgcgagccgccgagctggagagcgccaccgcccagcgagacgaggtgctggagggggaggttcgccgggaacgggtgggataccgcgccacggtggctggaaacggccgcctgcagcgccacggacgagggtcagcggtgaggaaactctctggaatggagtatttgccagcatccctgcacgacacgcggcgatga

SEQ ID NO: 7079 - DNA, 318 bp, Chlorella protothecoides
atgctggagttggggttgcgcgtggacacgccacacgacggtgcggtcaccgggaaagtgatatggggagtgctgacctgcctgggcaggcccgggccccgccagcggtcccgacccctcagcgtatgcctctcctgtgcatgcgcagtggtggacatcgtggggaccggcggcgacggcatcggctccgtgaacatctccactggggcatgcgtggtggcggctgccgcgggggcgcgggtggccaagcacggcaaccgctccgtctcgagcctgtgtgggagcgcagatgtcctggaggtgagtccaggggcctga

SEQ ID NO: 7080 - DNA, 219 bp, Chlorella protothecoides
atggcgaaggacaagagccgcagcacggagcttgtctcccgggagtacaccatcaacctgggcaagaagctgcacgacatctccttcaagaagagggcgccgcgcgcactcaaggagatcaagaagttcgcctccaagcagatgaacacctctgatgtgcggattgacatcaagctgaacaaggctgtgtggagccaggtgcgcgaaggaggatggtag

SEQ ID NO: 7081 - DNA, 219 bp, Chlorella protothecoides
atgactcccatggtcatgagacccccaggtgcgtcccccggcgctgacagccagcggctctgcgcctggatcctggatgctgcgctggctgcgctcccaccagggcaggagtgcgtgctcgggatctttgatctcaagggcttctccctgcagaacgcagatctaggctttgcacggttcctggtgaggtgtggcccgccttctttcttgggagtctga

SEQ ID NO: 7082 - DNA, 360 bp, Chlorella protothecoides
atgcgcctgcatccaagccagtcccgtgcggtcgataacctcctatttttctctgccttgcagccagcgctgcaggcgtgcgcggagctgggcatcggcctgacgatggtgaagcgcctgtcccggaagtatgggatcatgcgctggccctaccgtaagaacagggcggagcgcagagtggccggctgggacgaacagcatgacgtggccaactcttctgacctgggtgagtacgaaaaaggagctcatgggagggggcctcatgggtggtgggtgtacagcatgcctcgcctgtgcaccccagtgagtgggcctgcacggagagccatggaccccaagctgacgggtgctggtgggtga

SEQ ID NO: 7083 - DNA, 1089 bp, Chlorella protothecoides
ggagcacacgctcgcgccgccggtcccctgctccgccctgcccgcctgggccccccctgcgccgggcgccgccgtccccgggaaccggtactacctgcccaaggtcctggcggcgggggaggggccgggcgggcgccgcagcgccgctgccacggcataccgcaagcccccctgccggtgggaccgcgatccccccgacctccccgcccccacacccggctgccggtcgagctgggcgggcagcgcgctgcgagccgtgctggcgggcgcgggcccctgggagatcccgctgactgtgagcggcagcgacgaaggcccgcatgcctgcttccacaagccgctgccgcggcggggggccaacgcgcgccagcgccagcagcgcctgcagcgcgcggcggcgctgagcctgggcggcgccgacggggccaggcgcgcggaggccgtggccgtgtttgccctgggcacgcaccgcctggccgtgcacagccgtgccggcctctgcgtgctcggcggcgcctgggcccaggcggccgggtgctcggcggcggccgagcgcggggagcggggggatggggccgccgagcgtgagggaccgggggatggggccgcggagcgggaggccgacgataggattggcgctgagcgtactgtgggagagcctgcagcagtccctgcctcggcgctccccagccctgacccaggctccacctcagaccccgtcccagaccatacctcggccctcagcgcagccccctccacgtccgccaccccctcccccgagccctgccgcgtggtgctgggggtgcgggtcgagtacctgccctccccggcgcgcgaggcggcgacgctggacgagctggcctggctggcggccgggctggcgctggacccggaggcacgcggcgcgctggtcgccgccgtgcacgtccccacggcgcgcttcctgggcacgcaggcgctgacacgcgaggcgctggagcgggcgggcggcgacgcgctggcggcccggcgccacgccgcgctgcgcacgctggagggcctgctggcggcgagctccaagcagaggtgggctgtgttgctgtgtcaata

SEQ ID NO: 7084 - DNA, 501 bp, Chlorella protothecoides
atgccagggcatccgccgccgtggcacgacgccatctccgccagcacatgcgctacccagggccaagatgtggaggagggcacgcggtgtgcggcgcgcctacccctcagcggcgtggggctgccggacccacacaccgtgtacgacgtgcacgctgcgcatgctgcgggcgctgcggtgggggccggtgaccccatggacgaccccgctgtggcccccttgtggcagccggccgacccgggggtgccccagatcgcagacaccctgcccccgaagatcgtggccgggggccgccgcggcggacctggtcggggcgcaagggggcgcaagcgcaagctcagccagccgtatgcctggaaggtaggtggggccgagggaaatccatggcagggtgcattaagctggctgcctcgcgcctgccatcctccctgccccgcacagagggggccactccatggcgccatgtgggttgagtttcggcatgcatctttccctcgctga

SEQ ID NO: 7085 - DNA, 1002 bp, Chlorella protothecoides
atggccctcggcatggtgtctcacagtcacacagctggttttgtgcgcccacggagtgatggccggatgcagcgagcctccaagctggggccaggggcagtctgggctacggcgtctacacccccgaagccttctacgggagtgagttcctccaccctccaagcggggcggtctcccagtctggccactcagctgcgcttcgcaatgccgagcaagggcgaggaggcgggcccctcctccgtgcagcagttggcgacgggctttcgcccactctccagggttgcctaccagggggcacctggtgcatactcggagatggcagccctgaaggccctgccgaactgggagcccatgccatgtgaacagttcgaagtcgctttccaagcgctgtctcaggtgattgtactgcgaagctctggtcggcctgcgattcaggcttgggctgagcaatttgcagctgtgcctcaacccgagcattctccaatatcatcccagtggctggctgagagagccgtgcttccggtggaaaactcccttggcggttccattcacgacgtctatgacctccttctacgataccgccttcacattgtgggggaagtatccattgtggtgagctctggtggggcacctcttcagagtgcgtgctgtgcccagggtcaggctgcacactcatcagcacggccctgtcgcaaggatgatgtggttttcttgctggttcatgcagttcctcaaggcactgtttgcttggtacctatatattcaagaagaagccagacggtctatcggctgggttggtcccacctatggccaacctccaagacagtcaaccctgtcgagccgtgcctcatccagcatctgcccccgttctggtcaacaggtcaaccactgtctcctggcgctgcccggcgtctccaagaccgacatcaaacgtgtgatgagtcatccccaggccctggcgcaaaccgatggctacaccagaaagcttggagtggtacgtga

SEQ ID NO: 7086 - DNA, 885 bp, Chlorella protothecoides
  modified_base (479)..(488): a, c, t, g, unknown or other
atgtgcatgtggccttgctctgagacacactgcccctggacgcggtggggctggaatgctgggaccgcgacgtgcttgttgccgaccctgtgcgctggctccccgagcaaccaccctccttgtcgcccccctccccaggcgggcctcctgctggcagagacccccttccacctccagatcgaggcggacattgcgccgtacaagggcctgctcatgggcctcttcttcatgacggtgggcatggagatcagcatgggcctgctcgttgccaagctgcgcactgtgctcgccgccatggtcctgctgatcggcggcaaggtggccgtcatggccggcgtgggccaggtgtttggcctcagcctcgtccagagcctgcgcgccggcctgctcctctcccctggcggcgagtttgcctttgtcctctttggcgaagcagtgcgtggggtcggattggtggtgggaaaggaagggggggttcnnnnnnnnnntgccggcctgctcctctcccccggcggcgagttcgcctttgtcctctttggcgaagcggggccgactgcagggtgctctggtgatgctgggagccactcgcacatggcgatgttgactcgaggtattgctccagatctacagcgcaagggcctggcccgagggtatcccgtccctcaatcgaggtctcccctgagcaacatcgtcgaacagctctacaagcccttgccaccagcagtttgtgatcctgcgctttccccttcctccctctccacaggtgaccaagggcatcctgaacgccgcgatggtacaggagctgtacctcgtggtggcgctgtccatggcgctgacccccttcctggcggagtggggtgcgcgcctgggcaagatcctggataa

SEQ ID NO: 7087 - DNA, 1116 bp, Chlorella protothecoides
  modified_base (185)..(194): a, c, t, g, unknown or other
  modified_base (1096)..(1105): a, c, t, g, unknown or other
atgctcagcgagcagttgatcccttttgtcgcgctagatgtggacgccaatcgagtggcggtgagaaggctgggtggaggaggaaaggggttgatgtctggtttgagtcagggttggatggtgatcaaaagccaaggatcctcttggattgatttccataccctgacctccatccctggactgcnnnnnnnnnnattgatgtctggtttgagtcagggttcgatggtcatcaaaagccaaggatcctcttggattgatgtccataccctgacctccatccctggactgccatcatatgtgcggtcttcccaccaactctctcgaaacttgtctccacaggagggccgtgcgctggacctgcccgtctactttggggatgccgggtcgcctgccgtgctgcacgctctgcgcgctgagaaggctgcctgcgccgtcatcacactggacacccccggtgcgtgctttggctggcggtatggggaaggtccatgcaggaggtgtgatgtcctgcactggagtcacacgacggccgtcatacctgccatcttgcttctcttgctgccgtcccgttcccacatctccttgattccttttcctacccaaatcaacccctacccacatgccacagccgccaactaccggagcgtctgggccctgcacaagcacttcccgctcgtcaagacattcgtgcgcgcgcacgacgtggaaaacggtgcgttgcactggatacgtgcagcgggggtgggagctgtgtcccgggtacccccccctagggatcaggtcaaaggcaaggctcgagactggccacagtcgattgaacatggcgaggcatggagctgccctcatgccctcgccggcgcgggtggcttgcgttctcctgcaggcacgcataaggctgctgatcctggcatgcatcccgtggccctcctcccacctgtcctgtgcagagctggacatccccgagggcgatgtggccgaagccatccgggacctgaggcggacgcacctgtcggagctgcaggtggggggggcgtggagtgggatgcccgagcgtacacgcatggaattgctgggaggaaggtgtgcgggcgtacgnnnnnnnnnngcgtggagtga

SEQ ID NO: 7088 - DNA, 981 bp, Chlorella protothecoides
  modified_base (607)..(616): a, c, t, g, unknown or other
atgggcggggatcatacgctcgagcgtaccgctctgctcaagatcctccttcacgcgatcaagtaccccgcattcggtgtcaacggggttttgctgggcagcatagccaatggcaccgttacagccacggatgctgtgccctttgtacacaacttcacaacacttcttccggcctttgagacggcactgtgccaggtccgagccacgctgggcatcattgagctggccacttgtttctcgagagaagcagggctgaagtacgggatacctgtttttcacgagcgcggcaagcaggctgcctgcacaggtgcttttccttcgtcatccttcccaggggccatcctggcaaatcaactggcaactcgtcccacttgtacaggtggacaaccacacgaaaacacagagcggagtccaggtggtgggctactaccaggccaacgagcacaacaaggacacacagctttccggtgccggcaagctgctcgccacaaaagtcgcgacgctgtggccctccgccatcgccgttgtggtacgaggggttctgggccttttcattggtttgcctggctcggcgagacttccccagaatctgctgcactggaccccnnnnnnnnnngacttccccagaatctgctgcagtcaaatgatagctcttgcatgcatcaggagttgatctcacctcttcgcctctccgcccgctccctgctcttgcagctggaccctgagggcctgaggcagctgttgcaatccagtggaggcgagtcacccagcgacgcacggcccttgttcaccctccacatcaaggatggccggaattgggtggagtatggaggcaggctgaaggtacacacagctgggattccatcagccctggagcagctgagtgcggagggaaagcacagacagctcgcggattttgaggatcacatggaggatgtcagcctggactggctcaatgccgggctgatcaaggcgtcatga

SEQ ID NO: 7089 - DNA, 903 bp, Chlorella protothecoides
  modified_base (491)..(500): a, c, t, g, unknown or other
  modified_base (720)..(729): a, c, t, g, unknown or other
atgcccttcctgcgccgccgcatcctgtcgcgcgaggcggagggcgacccctccatgatggaggcaggggcaatcgcctctggtccttctctgggccccgacggtctgaagaaggatgcagaggaggggagccaggacgtggagcaccgcaacctgaccctgtcggagcagcacgcgcttcgctttgcggccaaggacaaggcctggaaagacaagaccttctgggagaaggtcgagtacaacccggtgaccaacatcctcctgcacaatgttcgccaggatatccacggtgtagcagagaccgacgagggcgtcaaggccgtgcacgacaacgctgagctgttcgacctcaagaccgaggccatgttccgctacctccagctgggtgagtactcgttgcagatcgatcatccatgttctgatcggacatgtcgggctctgacaggggctcactttgctgtcatcatgggtgatctcttgccttttgccannnnnnnnnnagtggcagagaccgatgagggcgtcaaggccgtgcacgacaatgccgagctgtttgacctcaagaccgaggctttgttccgctacctccaggtgggtgagtactcgctgcagatcgatcatgcattttctgatcgggcatgttgggctctgacaggggctcactttgctgtcatcatgggtgacaacaatgtggagatggcagctcttgccttttgccannnnnnnnnnacagatcctgggggtgaggagggttggaaggaagggtgtctctacactgctgtagtatggtggatgttgaggtgtgcaggcatgaagacggaaagtttggaccggcgatcctgtagcagcatcggcatgcgggacgggggagtatggtccacaatggcatgctgcactgcttga

SEQ ID NO: 7090 - DNA, 186 bp, Chlorella protothecoides
atgggcccctttgccgcggtgtacgacatctggaacacgggtgaggtgaaccccaaggtccccacccagacctggatcctcgtcattggaggcgcgggtatctccatcggtctggccctcttcggctggcgcatcatccaggtcctcggggtaaggagggttgaaaggagagaggggaggggatga

SEQ ID NO: 7091 - DNA, 1971 bp, Chlorella protothecoides
  modified_base (440)..(449): a, c, t, g, unknown or other
atgcccgtgagacctgcccttgtcgctgctaggcggcgcgtccacctcgacgccgctgtcacggccctcctggccgagtgcggccaggacctggaggagtgcgacgtggaggacagcccagagctggcgccgctcaaagaggccctcctgcgcgcccggcggcgcagggacgaggccctggggcagcgggaggccctggaggctgaggcgcaggaggtggcgcagctggcggtgaacgccgagactggcctggcggccgccaggaagctgctggaggccgccaaggccaacctggcctcggcggaggcagctgcgcctattgccaccggggcaccagaggcggagcccggctccaccaccggcgaagccggtcccgctgcggccgccgccgaggaccagggcaaggcccctggccccgccggcgaggacccgctgctggnnnnnnnnnncgcgcctgttgccgccggggcgccagaggcggagcccggctccaccaccggcgaagccgcccccgccgcggccgccgccgaggaccagggcgaggcatctggccccgccggcgaggacccgctgctggaggacctgcgcagcaaggtgagggagctggagcaccaggcggcggccgccgccgtggcctacgagtccgcggaccgcatcgcggcggcggccatggaggccgcggaggaggcagtgcgtgacgagatggagtgcattgccgtgttcaacgaggtggagagcgcgctggccaagaccatcgagggcctgcgccagctggacagcacctccgaccgccaggaggaggagtgggaccgggcctcgcactcctctcgtgcctctggcggctcgctctcggtgtcggaggccaccgaggcggcgctggccgccgtggccgtcagcaccagccccgacgcggaggcagacgatgcttgcatgcccggtgcttgcagcaaaaccgtccagactcaccctctcctgaccagcgaccccttttgcggacatattctctccacttccaaaaaccaaacccaccctccgcagctggccaaggtcgcggcagccgacgcaaagctggaagatggggtgacccccgtgaccagcctgcccaccggcgccagcgccggcagcgccgcggtcgccgcggcggccgcggcgaagaagaagcggcaggcggccaagaggccgctgtccgtctacgtcatggccgcggtgtttgtcgcggcggctgcggcggcggctcagcacttgggcatgtttgcagcgctggcggcgggcgtgcagctggccgcggagcgcgcgggcgccgcgctggcggtgggccggggcctggtggcgggcctgccctggccccacatccacatccacgactccgagaaggggctgctggagaccatctggctcctcctctcctccgtcatcaccgtccccctcatctgcaagctccccggcggttctgcagtcctgggcttccttgccggcggggctatcatcgggccctacgccctcggcatcatccagaacgtgtcttccgtgcgccacattgcggagctgggcgtagtcttcctcctcttcaacatcgggctggagctgtccttcgaccgcttggcgtccatgggcaaaatggtgttcggaatgggctccgcccaggtctgtctcaccctggcggccgtggcgggtgcctccctgctgctctccggtggcgcgctgggcggcgcgggcgccatcatcgtgggcggcgggctggccctgtccaccaccgcggtgggcatgcaggtgctggcggaccggggcgaaactggatcccgccacggccgcgctgccttctctgtcctcctcttccaggacctggcggtggtggtgctgctcatgcttatcccattgctcacaccctcgcccgagaatgccgcagcggggggaggtgagcggcgagggttttgtggggggaggggggggaggaggagctcctcggcttga

SEQ ID NO: 7092 - DNA, 276 bp, Chlorella protothecoides
atgctgttcaaggcgctgtcggtgtttgccctgcgcgacatcgacctgaccaagatcgagtcccggccgatgcgcgagaacccgctggtcctgtccatggactacgacgactcctccatgcgcaccttcaactacatgttctacatcgacttcgtggggtccctggcggagcccaaggtccagaatgccctcaggcacatggaggtgggtggcggggagtgcctgaagggcctggctcttgtcgcttttgttggtggggccctggcgcggcgatga

SEQ ID NO: 7093 - DNA, 1878 bp, Chlorella protothecoides
atgccacacccaaaccatgactctacccctccccccaagtggtacctggagtcccttgaggaactcccggaattgccgctggttctcccggaacagggtcaggatggggtcctcctccctctctgtgggggcggacggagaaggcgtgctgttggttgtgcgtccgaagtttctgatgtcaagtaccacttgcatccaagcaaagtttataaagggcatcactcacgctgggcggcagcctccgcgaagaatcgcaggtgcgctccctgggccagggcccgaacctccggcatctgcagaggtggaggcagtgaggttgacaccgcgctcgctgggagcagaaattgttgcacatcgcccgtacacgcagggttcaccctgctcaccgatcgccggaggcctgtgcgggtggccagagccagcagggccatgatagtggtgtggtggccccccgacaaacgttttccaggcccggaccggccagatatccaatcaaacagcagggttagggtcaaaacatgtcggccacccctgccggagtgggggtgcatcactggcgaattgagggcgcgcggaggcttccactgggaacaggcagtggccacgcttcatcgggcccaaacttggcctgacatggtggctactcaggcggaccaggtggtgatccacccgctcgtcctcctgtccgttgtggatcactacaaccgagtggccaaggacaccaagaagcgggtggtgggcgtgctgctgggcgagacatacaagggccggatagatgctaccaacagctttgcagtgccctttgaggaggatgagcgggatccctccatctggtttctggatcacaactacctggaaaacatgttccgcatgttcaagaagcgtctgagcatggtgtgcacgccatgcatccgcgctgcctcgcaccccagactgcgcccgcagctcagcgccccatgcccctcctgcgcagcgcgtgagcgcatcattggctggtaccacaccggccccaggctgcgcgagtctgacctggacatccacgccctctttgcgtcgtactgcgacaacccggtgctcgtcatcacggaagtgcagatcgaggtggtagggtgcaccaggcaagagcaggtacacaatcctcctgaatatgcctcctcacactcaaccccaccccctcatgctccccctttccagcccaaggccatgggcctgcccgtgcatgcctacgagagcgtggaggaggttcgggaggatggcacgcagaagagccgccgggtgtttgtcaacctgcccactgaggttggagccacggacgccgaagagattggctggcgccctgccacggacgcaattggagctggaacatctcatccaccccccctgctccaatgcacccctgccctggccatctgtgatcaagccccctccacaccctgcaacgctgcccagctccctttgccccgtcagtcctacccctcgcactcccgagtccctccctccctctcgtccccgcccaggcgtggagcacctgctgcgcgacgtgcgcgatgcgacggcctccacgctttcctcccgcgtcgacggcatggtgacgggcctgcgcacgctagcggcgcggctggcggaggtgcagcaatacctggcggcggtggtggaggggcgcctgcccctgcaccacgacatcctggccggcctgcaggatgtgctcacgctgctgcccagcctgggcggcggcagcctggcccgcggcctctccggccaggtcaacgacgcgctgctcagcgtctacgtcgcgtccctggtgcgagcggtgattgcgctgcacagcttgctggagaacaaggaggcgcgggtcgccgccgaggccgcctccatcaa

SEQ ID NO: 7094 - DNA, 285 bp, Chlorella protothecoides
atgctaacaaccccccctgcccctcccctctcccatccaaaggccttgattgactcccggtacaagaaggtgtacgacgggcgtgcgacgacggatcaggagatcgtgggcctgctcatcgccctcctgtttgcggggcagcacacctcctccatcacatccacctggacggggttgtacatgatggcgggcgaccagaagtactacaaggtgcgggcaggtggcagggtgctgggggagtggaatggagggtcggaccctcagcgtgttgcagggcaggcctga

SEQ ID NO: 7095 - DNA, 591 bp, Chlorella protothecoides
atggccgccaagcgcgtgctggtccccatcggcaatgggtccgaggacattgagtcggtcacgctcgtcgacgtcctgcgacgggcgggggccgaggtaacgctggcctcggtcgagtccgggctggaggtgacttttgcccggaaggtcaaggtgctggcggatgccctgatcggggacctgtctggtcagacattcgacctggtagcccttcctgtgagtggcggcagcgggggtatcgggcagcgcctgcgagactcggcggagctgctcgtcatcatgcgcaagcagaaggaggagggccgactgctggcagcagtctgtgccagtccctccgtagttctgcaccaccatgggctgattggggatgcgcccgccacagcccacccgggcttctcgggtgccctgtccaaccaggaggcagttcagcagcgagtggtgagatcgggtacggtcatcacgagcaggggtcccgggacgacgctggagtttgccctccggcttgttgccgagttgtacgacgaaaagaaggctctggatgtggcgggtcccatggttgttgctgcaggctgggagaaggccctagagtag

SEQ ID NO: 7096 - DNA, 1050 bp, Chlorella protothecoides
atggtggccacgagcgtggccaacctggccgcgctgccccttcccaccctgatcgggggcatcctggtcgtggctctggctgccgcggttttcgtgagggctaccgcaaacctgcgccgcgggaactccccccccgtggaggagggcgtgccctttgtcggtggcctgctcaagttcagcaaggatgtgccgtgcgccgggctgcatgcatgcagcgtgctggattgccccggctcccctgacgtgcatccccaccccagcagcgagctggttcccctcctcactcctgcttttcctgcctccttgacacatgcaaccccttcccccccctcccagggcccctggcacctgatgaagagcatgcactccaagtatggcgaggtgttcaccgtccccctggcgcacaagcgcatgaccttcctgctgggcccccacgcctcgccccacttcttcaacgccacggacgagcgcatgagccagacggaggtgtacagcttcaatgtccccacctttggcgagggcgtggtgttcgatgtggaccagcgcgtgcgctccgagcagttccgcttcgtggccgatgcgctgcgcagctccaagctgaagacctacgtccccgccttccggcaggaggcggaggacttcttcgccgcctggggcgacaccggcgtggtcaacctggccgaggtgttcggggagctcatcatcctcaccgcctcccgcaccctgatggggcgggaagtgcgcgagtccatgttcaagcgcgtggccgacctcttccacgacctggacgacggcatgcggcccctctccgtcctcttcccctacctgcccaccgcctaccaccgcaagcgcgacgcggcgcgcgccgcgctctccgacatcttcaagtccatcatcgccgcgcgcagggccagcggcgtctccgaggacgacgtcctccaggtgcagcaggctcatgggcctggggaggatgcccgtgcgcaaggggcaggcggtggtcactcgaggaggggcacggaagacatcccggaggcctaccgggggctttaa

SEQ ID NO: 7097 - DNA, 852 bp, Chlorella protothecoides
atgctgcagtcggagatggactgcctcaagtatgacaacgcctctctggaggagcagcttggctctgccagggcagaaattgcaagcctcaaaagcctgaaccaggacatggccgtggagattgaaaatcacaggatgctgcgtaggggtctggatggcgacgtcttgcagctgcgcaaggcagcggccaccctgcaagcccagctggagccgaaggccacccaacagagtcgacgtggaagggagaaagatgaggctctcctcccggcagcagcagcttcagagggccaagacacggcacccacgaaaggcgttggggaagtgggaggtgcttcagccacctctcattcttctgctggagccgatcaggaagctcagcgcgacctgcagcaggtggaggaggccaggatcgcagctgaaagaagagaggcggagtgcagggagcagctctcctccgtgcaagaggatctcatgcagtgccaagcgacgcttgcactgcgcacccagcatctcgagaaggccaagaaggatctatcggccgcggcacaggatcacaatgccatggcatccaagctggctgaggccactgcttgtatccaggcactggaagcaggtatgcactgcagggttggagcgagcagagaaacccgtttgctgaggtccttcgatgcacccttcccctgcccttgcagaggcatcgtccagcgccgcgcagctggagactctgcagtctctgctggatgcatcatcggttgcagcacaagccgcggcagccgatgccaccagcaagctctctgctctgcagaacgagctggagcgggccacagctgggctggccgcgtcacaggctga

SEQ ID NO: 7098 - DNA, 708 bp, Chlorella protothecoides
atggcggaccttctcaagcgtctgcacccaccccaggcccagtaccgggatcgccgcttcaacggcactcaggaggagtttgaggaggtgctgcgccaaagcaccacggtgtacgtcggcaacctgtcgttcttcaccaccgaggagcaaatatacgaggttttcagcaagacgggggacatcaagcgcatcatcatgggcctggaccgtcagaagatgaccccctgcggcttctgcttcgtcatctactacatccgcgccgacgcggaggactgcatcaagtacctgaacgggaccatgctggacgaccggcccatccgcatcgactttgactggggcttccgggacggccgtcagtttggccgggggcgcagcggggggcagagggtccctggggccgcacatggtagggggcccctgcacatatgtggcggtgcatgcaaagttgtcgcacgcctcggcgactgtcccacacctactccccatttcccactcccctcctcacctggcccctcttcccaggtgcgggacgagtaccgcatggactacgactccgggcggggcgggtacggcacggtgctgcgtggcgagctgagcgcccggcagcagatgctgagcatgctcagcggcggcatgcccggcacggagggcggggaccagttgcacccccgcctggccgccaggggggccgaggacgacgactactga

SEQ ID NO: 7099 - DNA, 1725 bp, Chlorella protothecoides
atgccagtcgagatccatgaacccatcatccctacaggtatcaaggccgctcctgcccccactacgagccccagtccgagtttttcgctccccacacccacacccaaggcaccgatcagtgctgtcaagagcacggtgtccaagaccattgctccaatcaaggaagctggcaagaaggccgcaaagacggtatcccaggcagcgccctcccctccttccaagccatcggctcctttcaagttttctggctccatcaacaagggcacccagggggatcttccggagggcatcgcccttcccacacccaagggagccagcagtggcggggggttcccctcgctgccttcgctgcctggcctgacgtctgggcaggagaaggggaagtcggaggcaagagctgaccagggggtggcatcaaagctcgcgtccaagattcagcccctgaagggcagccggctgcagtcgggggttgaggacgcggccggcaaggcggccgacgcggtgaaggatgctgtgccgtctctgcccaccctacagtccagggccaagcaggcggcgccttccctgccatcgctgcagtccaaggcaaagcaggcgttgccatccctgcccactctgcagtccaaggctaaggaagccgtgccttctctgcccactctgcagtccaaggccaaggacgcggtgccttccctctcaaccttacagtctaaggccaagcaggcggtgacgagcaacacgccatcgtcaggcgacggacccttcagcttcctgagcaagaagccgcagctgccagacgccgtgaagaaggcggcgagcgagaccaaggctgccctgcccacgctgaagtccaaggcgagcggcgccgtgaaccaggtcaaggatgcggccccctccggagcggggccctttgacttcctgaccgccaagccgcagctgcccaaggaggcgggcaaggcggcggacggcgtggcgtcggcggccaagtcgctggcgagcaaggccgccgacgctgggcagaagagcaccggccaggggtcgagcttcctggacgccctgaccaccaagccgcagctccccgcccaggcgcagaaggcggtggagggcgtgaaggcggcggcgcccaagctgccgagcgcgccccagcccggcggcgggggcgggctgggcatgctcttcacctccaagcccaagctgcagcagcgggtgcagagcggggtggcgaagacccaggccgcggccaagtcggccctgcccggcgccccctcctcggccaaggacgccgtccgggcggcgacgggtgcggccgcgggcctgggcgccgggctggcctcccaggctggcaaggtgggcgacgccatctccgcgccctcgctgcccagcctgcccgacgcaggggccgcgtccaaggcgctgtccgacgccggcagcgcggcgtccggcgcgctgagctccgccaggtcggcgctgacccctctgtcgcccggcagccccctgccccagagcgtgcagagcgcggcgggggccgtggccaagcaggccaaggccgccggctcaggtcagggggtgagcctgggtcagcgctccacgcaggcgggcgcggtggtggccgtggaggtggcggccgtcgcactggccaccgccatcgtcggcggggtgacgtcggggggcaaggccagcatgccccgccccaagaccaagtctgggacacgcattttcaggggttga

SEQ ID NO: 7100 - DNA, 576 bp, Chlorella protothecoides
atggtcctgccggagcacatcctggtgcaggaggccctgcacgcctgccagggcatcagcgggcgctacgtgtggtggcagcccggcaaggatgggggttccttcgcgctgggcccgggggcagaggtgccccccgcccagcgccaggccgtgtcccgcgtggctgaggttggagccctgctgcgtcgcatcgaggagctgcgtcgcgaccccccctccccgctgcacgaggccctgggctcggcagcctcccgggaggtctcctccctgctccgcctgctggccatcctggaggccagggccggcacccgctccgacgccctgaccctgcgacgcctggaggtgtggctcgccgagccccgcacccggctccgcgtgctggccggcgccctggaggccgcgggggcgcggcgcgggggcgcggcgctggacgcgctgcacgccctctcccgccacggcgaccccctggtccgcgccgtgctggtccccctgctggaggccgcggcggcgcccatgttccggggcatcgcatgctgggtgctggagggcgcgctggagccgggcgccgactttttc

SEQ ID NO: 7101 - DNA, 801 bp, Chlorella protothecoides
atgctcccgtatgcacgtgaagctcgcggaactgatcgagattcaagccccatcgtgcattcgctctcggaacaggaaccccttcccttcgtcattcggggctcctctacaggcaacgaacgcgccacattctttggggccaatgcagccagtgggagcagcaagaccattgccaatcttaatctggagggcctaggagacaagacactccatgacgtcttagcacaggtcatagaggactttgggcgctaccagtattgcatgctgaagaaaaggagactctgcttaagcgtcacaaggccgtgttcccctccatgtggcaacaatggaggtatgaacggggtgctgcacgttctcctacatccctcgcagtttgtcagtttgtcaggtcccatcaatccaccagaccaattaccccatccaaagctacctccgacaacacacagggctggtcatagcctcttgttccatgggttcggctccaaagcaggtttactggccgaatttgcagccaagtggaccctggacggcgcatgcttcaatgtaaacggcctgcagcctggcctgacctctcagcacatcctcgcatgggccacagcggctgcaaaagggtccaagcctgccctgtatcgtgcctacaagccggctgacctgatggaactactgacctcccccggaggaaagcgggtgtatgtcatcattaacaacatcgatgggccaggtggttattgccaggggtcttgcgtcgcgccagggcagctaccagggacgtggagtggcttggatgccgagcctttgtga

SEQ ID NO: 7102 - DNA, 924 bp, Chlorella protothecoides
atgccgccagcggttcccagtccttggcgtgtccccgctcgctggcgccgaggacctcgcttaaacggcagggtccgagaggatcgttccagcatgtgggtcgccatgaagtgtaggggagggaggggatgccacatgtcttccgtcgtgcacgcagcagggctacaggttgttccaactcagagagaatgcctttacttcgtaagtttcacaaattcggagcttgactacaacctcacctcgcctcaagtcctccccctccctcccttatgccagccacagctgattcgaagccatgggcgaagcatctcagggtcactggatagcagttacagcagcctttccagcgtggatgatgcctttgtgtcatctgagatcatggatatagaacagctgaagcagattgaggaggccgagccggacaagaaggccctgaatgtgttcctggctatcgccgcagctctcctgtttggactcggcatctggggcgttcaggtgggcggagctgtgcacgcacacatgcatcgtgtatgccgagctagtggatgtctgggatgggcgcaccatcgggcatgctcatggatacctccacatcccctggaccagggcccaaacaaggctgccgagtactttgctgggtatctgctggagcagtcgctctccattgacaacctctttgtctttgtcctagtgttcgagtacttcaagacgccccggaaggcacaggatgtggtgctgacgtatggaattgcctcggccgctgtcctgcgcctggtgctcataggggctggctccagcatcatcggccgcttcaaacctctgctcgtcgtgtttgccgccattctcatggtctccagcttcaagctgctcacgtgggtacacccttgctgtgcttggctgacactggatggcgtcatgtcatga

SEQ ID NO: 7103 - DNA, 1641 bp, Chlorella protothecoides
  modified_base (119)..(128): a, c, t, g, unknown or other
  modified_base (215)..(224): a, c, t, g, unknown or other
atgtcctgctctgcactcttattggctcgctcaatctacttggcgcaacaaagacctgtaaagcaaatctttttatggatggcgacggtggagttgctaggccctcccgcggaatttgnnnnnnnnnntaataagatacacatcgtgaggaatcggccgcatccagtttgccgtgagtcgatttgcagccccgacatgagtaccgtaacggttgnnnnnnnnnnaaatgcagcctttccgaccttgcagagcaggggtgatctcaactatacatccagtgtgcacccaataagatacacatcggacgagccactgttcctacacccaccatacaactcgtaccattcagatcccaggccagaaagcactgctgcagcacagccttccgaagcttctgggaaaagagaaaggagaaaggtattcaaaaatggaccgtggaagtgctatgggggtcatggcagagcagtagatgtgtatcagccatcaccccttcctgagacgcccacgctgacggtacctgagggtcgagctgacacccctcagtcttccctgcacgactccacagtgaacttcaagctaggcaaaatcactgggagggacgaacttactgagcatctgcacaatgtgctgtacaggcggaagggcgcgctccagtcgccacaagccagtccccccaaagccacagaggagacaactcgtgcacctcctgtgatgccaggaaacggaactggaagcgagaacgggtgcgctggggaagcataccctggaggttctccacaagctgatggacgtcttagatgttccacgagggaccggttccaagcacatgctgctggcatgagcgctcacgtgctcaccactgaccctctccttttgcagtctgacaagatagctgcacttcttaccttcttggaggcacctcgtcaaactcgagacagcgatcttgctgcccaggctgccaagaagagagccgccgcaagcaagaaacgagagcgggaggcccagggtgccccacgccgtctttggtgtctgcagaaggatgccaaagtcaagaaggccgagcccaccaagagcaagggcgatgaggaagccagtacattgcccattcaggtgcagggtcctgaggctgtggatcagcctgaaattctcaaggtgagaggctggtctcatgcttacagtcagtgggcaggccagcccagaatcagtgggcaggccagcccagaagtatcatcacactggagcttcatccacgttccttcctcctccttgtctcgtgacggaagttcccaaaggcaactcgtgtgcctaccgcagatgagcacagaacaactaagggcagatattgaagctattctgaaagaaaagtcagaggaggaactttctcaactgacctcgaagcagatccagcgcctccttggtgagtcagctgcacagatgatcctggcatgtgtggagcattggcctgttcaaccgtgcacattgcctgaacaaagttccacctcctaccatctgaccgtcaacgccacacaacgcacaggggagaagtatggattcgaagttcgaccacgcaaggcagaaatcacctccatcgcacaatcctatgccctgtcgcgcctggacggtgctgatggccaagagtga

SEQ ID NO: 7104 - DNA, 1221 bp, Chlorella protothecoides
atggcaacgccatccccacagaacgtgttgccggacaccccaaagtctgcggctgccatcacctccaagctgttcatcgatcagatgatgtgggcacccatctgcaccctcatcttctatgtgtacaagtgcttcctggaaggacgaccaaggtgccaggcagggaaatcgcagcttggtgtcaagatatgcgcttcatgcattcgcatatttatttgcgagtctttgatcgccccagcacgctcttcccccctttgcttcgtggcagggactgcatcaaggaggtcaagcagaaatggggcccgacaacatacggatggacgcctcgtaacattacgacagaatcctgtcgccctgctccaccctccctcccttccctcttccttccctcccagcttcttggaagctgtggatcccagcacacatcttcaactttgctgttgtccccacgcagcagcgaatactctacgccaatgtaatctcggtgaggcccgaggggtggctggaacctacatattatctcggtgcgccgctgaagaccacaggccggcgctgaaaacgccattgcaacccctgagagtcggcaaggaggggcggaacatcgaggagggtgttgtgagactcacggtcctatttgatggaggttggtgtgcacagagcgacaatctgatcctgtctggatttattcgaaggcaaaccgaggtgaggctgaatgatgaggggaccgaaccacgcactgcaccaatgcaagcaacctcctgccctccgtcattccacttcccgacatcgagcggggagacccggctcctactgcatggtaagacaccaatcgacaatgaggctggcagatcgtctgtaaggggtgcaccttttttaagcgagatttattaccatcaaacctctcgttatgtcgcagaccatgatcagaagctgtcagacttgcagctgcgggtcggcatggagtccacccgccttcatattctgctggaggagggccgcgatatcgccacggattgctccgctcggactcgtgagctggctaacatcgagggtcagctgcgccaggggcaatccaagctcggcatgcttcagaagcaggtcgaagtccactcacaggagctgatcatgatgcggaggcaaatgcagatggtagaagagaggaaggcaaccgcactcgtggagttggagcatgacaggtatgaaacaggtggcccggagtag

SEQ ID NO: 7105 - DNA, 615 bp, Chlorella protothecoides
atgtccaggcagggacatcaacgcgagtcggccctcccacactctaaacctccccgatcactccctgctcctgtcgccagtagcatccaagcaatctacaatggctcccaaggcagagaaggccccggcaaagaaaaccgccaagaaggtggcagagaagcgcagcgcaggcacgaggaagaaggtcgtgagcaaggtgagcgcacctccgtgacatcgcgtgacccctgcccgcgacggctgtggtcggggtgtttgaactggccgacagctgggagtgttacagccctctcagccagctctgcctctcctctgtcccctcaggccgagacctacaagatctacatctacaaggtgctgaagcaggtgcaccctgacactggtatctcctccaaggccatgtccatcatgaactccttcatcaatgtgaggactgtgggggatatctttgacaagatggctggggagactggcaaccttgcgcggtacaacaagaaacccacggtcaccagccgcgagatccagaccgccgtgcgcctgatcctgcccggtgagctggccaagcatgccgtgtctgagggcaccaaggctgtgaccaagttcacttctggttaa

SEQ ID NO: 7106 - DNA, 492 bp, Chlorella protothecoides
  modified_base (299)..(308): a, c, t, g, unknown or other
atgatgctcgggggaatggggggggtggctatggagggtcggtatgtccgcaaggtttccggtccagtggtggtggccagcagcatgagtgggtccgccatgtacgagctggtgcgtgtgggagctgacaagctcatcggggagatcatccgcttggagggcgacaccgccaccgtccaggtaggcctgggtgggcgaggagcagaggccttggacgacagtgccatcgactgtgcttggagcacagcttgggtggaggggagatgctgtagaccttgctctcacgcggagtggccttnnnnnnnnnnaggcctgggtgggcgaggagcagaggccttagacggcagtgccgttgactgtgcttggagcacagtttgggtggaggtgagatgctgtgggccttgctctcacgcggcgtggcctcgacgccttcccaccaccgtccaccttttcactgtcttcgccaggtgtatgaggacacctctggcctga

SEQ ID NO: 7107 - DNA, 1002 bp, Chlorella protothecoides
  modified_base (834)..(843): a, c, t, g, unknown or other
atgcgagggatatttttgcgacactgcgtcactgcagcgagtgccgttgcgaagcagatgagcagtagcaagcgtgcaaagatggttcgcatcggcacccacagcggctctttccactgcgatgaggctttgggctgcttcatcctgcgccagactgctgacttcaaggacgcggagatcgtgcggagtagggacaccgagaccctggccggactggacgtcgtgattgatgtcggcggcgtctacgatccaggttacagctgggcctggggagtgtgtctcacatgtggcccctgcggatctcaggtcacctatacctgtccctcctctcacacagccaccgcccggtacgatcatcaccagcgcgacttcaaggaggtgtttgggcatggtttcaccaccaagctctcatctgctggtctggtgtacaagcactacggcagggaggttgtggccggagtgatgggcctggatgcttcccaccctgatgtggagaccgtgtacctggccgtctacaagaagttcatggaggctgtggatgccatcgacaatggtgcatatggtggaagggattgcatcaaccagtgggatgcggagggcccgcccaagtacatttcgaggacagacctggggtccagggtcgcgggactcaaccccttttggaacgacgaggatcagtcgggtgagtggggacaacaaggcgtgctctttgggtttgggtgcaggctcctgcatccgcacgcagcttggtcaggggtgcggcgatttgtagattccggctatccttccgcacgaccactgcattctttgtctagatatggcagagctgacttnnnnnnnnnnatcaactaccactccaagattctggctactcttgcgcacgagccctgcattctttgtcgagatatggcagagctgaccagtttccctctgcacttgtcaacatgcagccgagaggctgatggagcagttcctgaaggctgtagagctgacgggctctga

SEQ ID NO: 7108 - DNA, 1095 bp, Chlorella protothecoides
  modified_base (70)..(79): a, c, t, g, unknown or other
  modified_base (230)..(239): a, c, t, g, unknown or other
  modified_base (355)..(364): a, c, t, g, unknown or other
atggggataggacatatggcagacgtgtcccattccggcaccccactgccactgcacacaagatctgttnnnnnnnnnncactgctcatctgctttgcaacggcactcgctgcagtggcacagtgtcgcaaaaatatccctcgcatgcgctggatgacgattgatgacaagacacatggcagaggtgtcccattccggaaccccactgccactgcacacaagatctgttnnnnnnnnnntctccgacgttatgttccttcaggcgcacggcaccagaggcttgttggcttcctgcaaagcattggaatccgtcccctttgtccacagcgcaaacaggctcgctcgtggatttcgnnnnnnnnnnactccgacgttatgttccttcaggcgcatagcaccagaagcttgttggcttcctgcaaagtgttgcaatccgccccctttgtccccagcgcaaacaggctcgctcgtggatttcgtgcaacattgatcatggcggtgcagcatcgtcgtgtgcgccacattctgttgccaggggaccagagagagctgcaggaacgcctatttctagatctccaaggaggcagtgctgattttgcacagcttgcggctgaccactctcaatgcccttccaagggtagggggggggacctgggatggatatcgccgggacagaccgtacctcagtttgaggaggcactgcaggctgcatcagtgggtggaggccccgcaaagtgcacgactagatttggccttcacatcctgcaagtcctcgatgtcagagacattgctgctgtgaagcaactgccagtggacgattttgcaagcctcatgcaggtcgaagaggcagaggatgtgcagtgcatcgatgtgagggaggagtgggaggcgagcatagcctccatccctggtttccagctctttcccctgagcaggtgggcggcccctagcctgagcatggggttcgttggcttttccgcttatgtgcatagtaatgagaagataatctcatcccagcgtgcaactgccctctgtccctctgtcccagctgcccagatcctcacctgcgtctcacccttgaagcatcaacactaa

SEQ ID NO: 7109 - DNA, 1026 bp, Chlorella protothecoides
atggacggcctcctgctcaacactgaagagttttatactgtggtgcagcagaatattgccgcagattacggcaaagagttcacctgggagctcaagagcaagctcctaggtctcaaggcaatcgaggctgcacgtttgtcgatcagtgagcttggccttaagggtcaattagagccggaagagtttttggagaagagggaggcggcactggacttgctattcccctcatctgagctgttaccgggtgcagagcggctcatccgccacctccaccagcatggtattcctgcatgccttgcgacctccagcaacatcaggggctatgccaagaagaccacaaatcatggtgccctcttttccctgttcacacacaaggtgactggggatgaggtggcccaaggtaagccccatcctgaaatcttccttgccgcagccgcccgcttcaccccaccagtgacgccaagcaagtcgtgtctcgtgttcgaggatgctcccgctggtattcaagcagcatcggcagctggcatgtcagtgggttgtttctgtgcaagatgccaccaacccaaggcacgctcagtcgctagcattctgaacatgccaccttgtggcctggatcccttcatgtccaaggtgcaaacctcggtttccctttcctcccaggtcgagcattatggtcccccaccccagcctgccaagggagctgtgcgtcggtgcggatcaatgcctgaccagcctcacccactttgtgccggaggagtggggccttcccccctacgacaatgtagacgcaagggaggggtagtggaaatgccacgagcacgcaagaggcttcttcatgacagtcaagccgctcaggtgggcaacttgatgaagagcagggtcaatgcagttgcccaggggacatctgttccttatctgcctcccgctgttgataaaaggcgagtcagaatggcatgccctttcaccctgcttcccttgactagtcagtgctctgcgtgtacagcttgcaggaaggggcccttctga

SEQ ID NO: 7110 - DNA, 483 bp, Chlorella protothecoides
atggggtcagaccacacctacgtcctgccgggggcgggcgagaagaagctgtccattgccgcacagaagcggctggaggcactgcgcagggaggtgcccagcgacctcgatgtcgccatcgaccccgcgcaccctgccctccggcatcgacaccccctccgagatcgacctccgcaaaggcaaggacacggggccccgccagctctacacggtgctggagcagacggcggcaaccggaggcgcgggggtcatcatggggtcggaccacacctacgtcctgccggggacgggcgagaagaagctgagctggagggcctgtccgacgcggcgctgcgtgagctgtacgaggggagggtggtggaggcccgggaggcggcgggcagggaagacttctcggacatggtagccgccaaggctgccgcccagaagaggaaggccgcggataaggcagcgagcaaagacaccaagaagttcaagttctga

SEQ ID NO: 7111 - DNA, 2973 bp, Chlorella protothecoides
atgaagcgtggaccaactgggccgcccaagaatggcccatccccacccccccggagcactggaccagcagctgcccctcccaaggcagcaactctgccacaggcacaggaggttcaacgtcagagtccagcagtgaatgctgctcctattccggcggtgcagcagcctcggccggtggccatcactcagccgccgcagcctgcgcctgcccccgagtcctatcgctttggggacattgatccggccgagttgcagccggtcatggcaaccaggaaggctcccgaggctgcattgggccaaggacctcctccagcccccgccgctgccaaggctgaggcgcccagggatgtccccatccccgtcggaattgctccagttgcggtgcgcacccctggggtcagcacagcaccgagcagtggaccgctcccttcctccgctgccgcgccggccaacagagaacggagcagcgccaacagcaccccgcagtcccgcggccgcgctggagaggctgcgccgttctcgcggccaggtcccatcccgccctccccatcctcctcggctggcggatcgtctgccaacgtggccatgcatggaccgaaccgcacccccccctaccacacgggccagatgcaggcgcagcaccgcgcgtttgtgcccgggtcgggccacaggggtccgtcgcccacggcaccccgcggtccgcaccagggcggctctcccaacctggggatgaacatgcactacccaggggcgatgcagggctacggcgcgtatgcctacgcgcccggcccggggtatgcgcagcacggctggcaggccaatctgcagcagtacgcctactaccccaactatggcggggtgccgccgcagtaccccaactaccttgatcagcaggcggggccagggcagcagggcggcgggcagcagggctcgctgccacatgtgcagcacggggtgtctactgggcgaggagggccgccaccgcaagggcactatgcgccacctaccggagcaccacacgcacagggtgggagctcgggcccggcgcctccgccgccgcagcagcagcaggggcaaggccagccagcgaagcatgtgcccatcaagcgcgagaggagggtgctggtcatcaaagacccatcgacaaacgaggccgttgatctgagcgatgtgaagcctgcagcccccaccccagcaggcaatggagccgcagccgtggcagcggagaagtcagcagcagcagcacccatcgcagaaaccgcggcgagcaggccctctgcacctgcagtgaaggttaccaagtctgcagccgacgaggtaccctcaaatgctcctgctgaggctgcggcaaaggcagcagcacccccagcagtttccaagccggccgatgacaagaccaccaagcaggctgccaaggtggacatgcctgtggcgaaggagacagcatccccagaggtcagtcctagagacgggcgtagtgcgatggaggagggtgatcctgctgtggcagcatgtgtgatcgagtaccatgcgccgcccaccatctctcgacaggcgacgactgtcccagaagagaaggccgccgaggcacctgcagcatcagtcaacaaggcggagcttgcagctttggttagcaaggcgcagcctacggccccggtcagcaacgaagagcccgcagcaccagccataaaggcagagcctgcggcgtctgcagataacgcagaagcagcgtctgtggaagaagtggcacctgctgttgaggccaaggatgcgaagccctcagtcacacccgtgccctctgcacacgctggctttgattcgacggtgtcgaaggaggaggagacatcagaggaagatacctcagacaccaccaatgagcaatccgccgacgaggacatggcgcccacgcgtccccacgtgcctgtgcccgagggcaggaagaggtacgaagccgaggccctattgtcactgagcgcattctgccaagaccctcccaagggtttcaatgctgcacagtttgcgctggagatcactcggcctgcacatcatgcgggtggctcccaccatgagcgcggcggcggcggcggcggcggcggcgggcccggtggcggttcctcctggaacaagggtcctcgaggagcaaacgctcccatgggaggtggctttggccatggcccagctgcaggtggacctcgcggtggtcctccccgtggacgcgccccaccaaacatggtgggcgtggacggggatgtctggcaacgaggccaagccctgcctcccatgcctcaggaccataggaatgaccgagggaactttggtggccggcctgggggcggtcgctctggtggcccaaacatggtcttgcacaagacagagagcgcgtacaaggttggcgcatacctgtccgaggatcccgaggaggagaaggcgcagaaggctttgaagtccatgctgaacaagatcactcccgacaactttgacaagatcaagggacagattgtcgctcagattgacgagcgcaaacgagctgctactctgcagagcttcatcgatcaaatcttcgacaaggcgctgacagagacgagcttctcagagttgtatgccagcctcgacaagctgcccagactcaccgatgagagcggagaggtggtggagttccgccgtgcattgctcaacaagtgccaggatgagttccaggagggcgtggttgccatgaaggctgtggcggagagagagctccgctcgaaggacggcgctgctcccgacgaggagaaggatgatgccgaggagggagagatcgagcacgagcagggcgagcgggcagagcgcgccgcagctaaagctgaagtcgaagcaaggaagcgcatgctgggcaacatcattttcgttgggcagttgttctgccgcggtgtgctgacagagaaggtcatgcactcttgcattcagcagctcctcgacgaggtgaggatataa

SEQ ID NO: 7112 - DNA, 579 bp, Chlorella protothecoides
atgtggacatgtccgcgagaggaggacaaacggagcacacacctcgacgcagccaacacctatgtccagagggtgcgacctgtcggatgcgcttgtgcgcacggggtggtccttgccattttgtgtgcacaggctgatcgactgacatcctcactggcgcagatcacagagacgcagctgcagaaagcggcgctcgtggcggccaatgctaagctggaggatgtcattgccgagcagcgaagggagagtgggggacccaatgcctgctccaagaaagttatccaggccctacagctggagaccaccgtgacgcagggcgcggccgccaagacccgcgcccgcctggccaggcgcaagaacgacctgctggacctggtggccgacatctgcgaggcgcacgaggcgcgggagaaggcgctggccctgatcgcgcacacccggggacaaatggatcgcgaggccgcggtgctggagcaggagtggcgcaagctcacccagatcctcgacctggagcggctggcgcgggtgggtgtggatgtcgatgaccgggggagggggttgatgccggggagtgggtga

SEQ ID NO: 7113 - DNA, 366 bp, Chlorella protothecoides
atgcggcaagcgtatctggaaaaggccgagacccagaagcttaagtccaaggcccgagagaggatgcagcccaaaatgggcaagctggacattgattaccaggtcctgcatgacgctttcttcaagtaccagaacaaaccccgcttgagcaagctgggagagctctactacgagggcaaggagtttgaggcagatattaagcatgccacgcctggtatgtgcagtatggggaaatctgcgtgcactcctcgtttagtgctgcctgggagccttcctcacagcagttcatcttggatctcggtcattctctgctgtcacgcaaatcacaccgccgtcttccctcaaaccaacaggcgtcctgtctga

SEQ ID NO: 7114 - DNA, 864 bp, Chlorella protothecoides
atggagcatcaaatcaatcggatggactggctcacctgccgccatctcgcacgacgctttcttgatgctcggtcctcgacccacgccctgctccagctttgcccccagcgctcgcgcttggccctgctcatgagctgcaggatgtactcttgcccctcctcccacgcccagccctggcacgcacacaacctcgtcaaggagcccctcttccccccccccctcaccccccctccccccttcgcacacacgcagccgctgtcggtggagctgggcccgggcatcatgggcaccatctttgacggcatccagcgcccgctcaagtccatcgccatcgactccgactcctgcttcattccgcgcggcgtggacgtgcccgccctggaccgcaccaaggcctggcagttcgacccgctggccttcaaggtgggtgaccgcatcaccggcggcgacatctacggcgaggtgcacgagaacacgctgatgcagcacaagatcctgctgccccccggcgcgcgcggcacggtgacctacatcgcccccgccggcgagtacaccatcaccgaccctgtgatcgaggtggagtttggcggcgcgaagaaggagtacagcatgctccagctctggcccgtgcgcgcgccgcgccccgtggcccagaagctgctggccaacacgccgctgctgacggggcagcgcgtcctggacggcctcttcccgggcgtgctgggcgggacctgcgccatcccgggcgcctttggctgcggcaagaccgtcatcagccaggtgagcagaccgaggagggatcgaagggggaagggggggccggggggattgacgcgcgcagacggagtgtgctcgcggcggtga

SEQ ID NO: 7115 - DNA, 942 bp, Chlorella protothecoides
atgcaggtggccaacacgagcaacatgccggtggcggcgcgcgaggcctccatctacacgggcatcacgctggccgagtacttccgcgacatgggctacaacttctccatgatggctgacagcacgagccggtgggcggaggcgctgcgcgagatctctggccgcctggcggagatgcccgccgactcgggctacccagcctacctctccgcgcgcctggcctccttctacgagcgcgcggggcgcgtcaagtgcctgggctcccccgcccgcgagggcagcgtgaccatcgtgggtgcggtgtccccccccggcggcgacttctccgaccccgtgaccaccgccacgctgagcatcgtgcaggtgttctggggtctggacaagaagctggcccagcgcaagcacttcccttccgtcaactggctgatctcctactccaagtacaccaaggggctggagcccttctacgataagttcgaccccgactttgtcagcgtgcgcaagtccgcgcgcgagatcctgcagaaggaggacgacctgaacgagattgtgcagctggttgggaaggacgcgctggcggagggcgacaagatcacgctggagacggcgcgcctgatcaaggacgacttcctgcagcaaaactccttcacgccgtatgacaagtactgccccttctacaaatcggtggacatgctgcgcaacatgattgccttccacaacgcggccaacgcggccgtggagcgctccgcctcctctgcctccgacggcagcaagctgaccttcaacgtgatcaagacgcgcctgtcggacgtcctgtacaagctcagctcccagaagttcgaggacccggccgagggcgaggaggcgctgcgggccaagtttgccgccctcagcgacgagatcaaggacaggttcaggacgctggaggaggagtaccgctga

SEQ ID NO: 7116 - DNA, 777 bp, Chlorella protothecoides
atgggggcgggtcagagtctcagaccgcacggtcgtgctgctccgcctgcgcgtgatgccaggcccactgtcaagcaagaccggccagcagccgctgcgcctgcacaagagacggctgccgccagacccccaactccaccacctgtggagccagctgctgacgtgaagtctgctacggccactattctgcaggagtgggagtcactcaaggatctgaaggaggctgagctgggtctagtagagctcctggagaaacgcaacgtgccggctgctgcagtggtggatgctttgctcaatgctgttctgtttctcaagggtgtgagctacgactcctccgtcgagttcttccagcttgacttcctgagggagaagctcacccaaaggcaattccaagaaggagcccacatcctgctatccaacctggtggaccgtctggaggacaagccagtcgctgtgacactgactggcgaactccttggcacgcttgtgaatgctggcctgctggacttcagctttgtcacgaaggatctgctgtcagccgaccttgaagctattcctgagggcgacgattctcagctcgtcgacagtggaaatgcaatcaaggtgatcggagctttcctgcgcactctgagcaagattgaaggagcggaagcggccaagactcgattgagcgacagcgggttgaagcttgcagactaccttcctgcttttgagcgggacaatgaggaggtgttgcagaaggccgtcgacaagttcgagttggccaacttgttgtga

SEQ ID NO: 7117 - DNA, 492 bp, Chlorella protothecoides
atggcaggcgggatgtacgcagagagcccatccccccctccgcaaccactgcatcaccaggacggtgatgaggcggtggccattgagtcctgcgagttctggagcgcgctgtgcgagtacggcgacgacgccactgtgctgcgccccttcctgccccgcctcctccctgtcctgctcagcaacatggtttttgaggagcacgacgacgaggtggcggaggccgaggcggcggagcagggcgcggccgcggccggggtcggacaggccgcggagcgcgcagccgacatcaagcccttcgtgggccggactggcggcggcggcggcgagggcgaccccggcgacgaggacagcgaggacgaggaggtggcgcgctggaacctgaggcgctgctccgcctcggcgctggacatgctgtccaccacctttggggacgagctgctgcccatcgtcctccccaccatccaccagcggctgcaggttgggcagggttga

SEQ ID NO: 7118 - DNA, 705 bp, Chlorella protothecoides
atgaactttacctgccataccaacatatcgcagatcgagggagtggagatagagtatgtctccgcccccctggattttgagctacctggcgctgctcccggcatcaaggcggaggcagggagtgagaacatgcccgtcgatgagcctgccactgccgggcttggcagcagctccctcaaacaggaggaggcggatgcagggacagctccctcaacagcagccgaggaggaccctgccgcagagctggctcgcataatgcagcggtttgggagggtcgaggacatgctgggcacttctggagcggaagcagatgaggccgaggagagaaacggcggtgcagccgacgggaggggggatggagaggcccaagaacaggatccgggcagcagcgatgaagtaaatcaaggtcctgtcgtgttaccggctccctgtcctgccaaactgtctacccccttgacccatagccccttgccaactgtcaacacagagggtggtgaggcccaactctcaaagaagaaactgcgagccgcctcacgtctcaaagtggcggagctgaagcaggcgtgcgctcgaccggatgtggtggagatctgggacgtgacggcagcagatccaaagctgctggtgcatctcaaggaataccgtgcctgtgccaaggcattggtcgcagaagagagcgtacctccagggaaagcgcggtattga

SEQ ID NO: 7119 - DNA, 570 bp, Chlorella protothecoides
atgctgcgccacgaggcgcgcccgctgcgccacacggcgggcacctgcgtggccgcggccgtgggcgtggccggcctcccccactggcccgagctggtgccgagcctggcgggggcgctggcccccgaggcccccctggcggccaccgagggggcgctggacaccctattcaagctgacggaggagcatccacgcgccctggaggagcgaggccccggcgatgccggcgccgcgcccaacgataccctgcttccggccgctctgcgcctcttcgcccaccccagcccgggggtcagggcgggcgcagtggcggcgctcaacctggccgccacgggcatgcccgccttcctctgcgaggccatggacgactacctgcagggcctgtttggcctggcgcacgacggcgagcccaccgtgcggcgcgacgtctgcgcagggctggtgcaggccctgacgctggcgccggagcgcctgcagtcctccctgccccagctcatagagtacatgctggggtccacgcaggtagggatgttggaggaaagtgcgaggttgggggaaagtgggggctga

SEQ ID NO: 7120 - DNA, 471 bp, Chlorella protothecoides
gtgagcgtacacgtgaaggtaatgatttatatatggaaatgaaagagtctggtgtaattaatgagtctaacatagctgattcaaaagtagcactagtatatggccaaatgaatgaaccgccgggtgcgcgtatgcgagtaggtttaacagctcttacaatggctgagtattttagagatgtaagtggacaagatgttttattgtttattgataatattttccgttttgtacaagcgggttctgaggtgtctgctttattaggtcgtatgccatctgctgttggatatcagcctacattagcgtcagaaatgggtactttacaagagcggatcacatcaacaaaagatggaagtattacttcaattcaagctgtatatgttccggcagatgatttaacggatccagctccagcaactacatttgctcatttagacgctactactgtactttcacgagggttagcttctaaag

SEQ ID NO: 7121 - DNA, 618 bp, Chlorella protothecoides
gggcgcgcgcgcgagcgcgcggccgtcgcccccgacggcaccggcgcggtcaccgtcggcgtgcgcgcgctgagcgagtccgggacggtgggcggctgggcgcgggagcaggtggagctgttctgcatcagcaagctgatcaactgcgtgctggaggcggacgaggagcacgtggccatggacttccacctggcggtgtccggcggcggcatcgccgccaccttccagctcctgcacctgttcctggaggcgccggcctgggagggcgccgccgcggagcgtgccaagcagatgtacgccagccacgcgcgcgcgctgcccaagagcctggagcgcgccaccgcggaccgcatcatgacggccatgatgggcgtagaccgccagttccgggaccccacccaggaggagatcgcggcgctgagcctggagggcatgcgcgccgcggtcagcgcccagctccgcgccggcaacctggaggtgtgcgtcgtcggcgacttcgaccccgccgagctggaggacgcggcgctcaagtacctgggcacggtggcgcccggggacgtgcgggacgcgaccccggcgccggaccgcgcctttgcgctgctggcgccgcccatgcgc

SEQ ID NO: 7122 - DNA, 582 bp, Chlorella protothecoides
  modified_base (241)..(250): a, c, t, g, unknown or other
  modified_base (358)..(367): a, c, t, g, unknown or other
atgagcgaggcggcggatgaggacagcgggcccagtgaggacgaggaggggccgggggatggcggcacgggggggacctcacgcgccgcccccgccgcctcggccgccccggacggcagcggcccaggctccgccggcgccgaggacgcgcgctccgacgcggagaccccaccggcaagcaagcgcgcgcggacgggcgagggcaggcccgccagcccgggctctggaaagccgcccagcnnnnnnnnnnggtcggccgccgcccgtccgagccggtcccggctggggcgggtggggcccgacccgacggggccgagccccgctggcgcagagggcgcggggcgactcgcggcggatnnnnnnnnnngagccggtcgcggctggggcgggtggggcccgacccggcggggccgagccccgctggcgcggagggcgcggggcgacccgcggcggagcaggcctgggtgcagtgcgacgcgtgccacacctggcgtgccgtgcctgacgccgcggtggccgccgagctggcggcggcgggggacgacgccacctggcactgccgcgacgcgtcctgggacgtga

SEQ ID NO: 7123 - DNA, 906 bp, Chlorella protothecoides
  modified_base (422)..(431): a, c, t, g, unknown or other
atgggcgacaggcagggcacaggtctgagagagcccttgctgccagctgtagatcacaggcatgccacgggtatcctgcaagtccttgctcgcattaggcgatatatcatagagctcttggcttacatactatatcgaatacaatcgctcctcttgctgggatcagacagcacgccgcaactgtcccccactcagtcttcgaggtggctggcgctgaagagaagggctagcatacaatatgatgccgccgacgctacccatttggtgcgagggtcgggatacagtcctccagctggcatcccggggcgcatgagtgtagtgctcagagcgtggccggcacatgtacacttattttatacaccctccaggcattgctcgggaggttgtggaccgcaggcttccaaacggaggaagccatgccnnnnnnnnnncagcatacagtatgatgccgccgacgctacccatgtggtgcgagggtcgggatgtggtcctccagctggcatcccggggcgcataagtgtagtggcttccaaacggaggaagccatgccgcggagggtcaaagctgagtgctggaaggatatgggctggcagagcgatgatccggggcgtgatttccggtgagatgagattccgctcatcgcctgtcctcgacaggggagggggcctcctgagcctcgagtgcctggtctatgctgccgaggagcacccagccacttttcagagcctgatgcagaagcgggacggcaagcgcagtgactgggaatacccctttgctgccgccggggtcaatctcacgttcatgctcgcgggtgaggcctggtgctgggcagcattgcttgttgcgggagacattttggaaattctgttccaggcttgcatgcaataccagcggatgggaatgtag

SEQ ID NO: 7124 - DNA, 732 bp, Chlorella protothecoides
  modified_base (60)..(69): a, c, t, g, unknown or other
  modified_base (137)..(163): a, c, t, g, unknown or other
  modified_base (554)..(563): a, c, t, g, unknown or other
atgggcgtgcaccagaggaagctcgactgtcatggcgacgggagagcgacgtttggcacnnnnnnnnnngttctgtggcggcgtgggattagaccgtcctccacggcacgttggatcatgtctcagcctttcttttnnnnnnnnnnnnnnnnnnnnnnnnnnngtagattgatcttaaggaaagctatcagaaggcattgtgacccccatcatcaatcgagtgtcatgcctctcaatggtcagagtcaatcggtggggtctgctttcccgatcgttcgggagtcgacgatggccgaggccgaccaacaggaggccattgagatctgcagtgccattgtagacaaacacggggctgaagtggagcggtgtactcacgctattcgggatggactcgccaagcattttggggccgggaactggcaggtggttatgggccaggcattctgctacagcatcagccatgaggtgagtggatggaaagtgggaccgacatgcaagagtatgcatgtcgaagtggtgaacatctcaagcgcagtactacttgccatcggacnnnnnnnnnngaccgacatgcaagagtatgcatgtcgaagcggtgaacgtctcaagcgcagttctacttgccaccggaaagatttgaggactgtcctcaacccacgttcaccccaggtcaaccagatgatatgcttctatccagctgaaaagctggcgatcttggcctggaaggcttga

SEQ ID NO: 7125 - DNA, 276 bp, Chlorella protothecoides
cacgccgacgccgcctcgccgcagcggccaggcgccgcgctgcgcctcgcgcagctggaaggggaggtgtcgctgctgcgccgccgtgccaatgagctgcagaaggctaacgaccgcctgcagcaggtattccgccgccagatcacccagttccgagaggcggtgtacctcctcttcggatatcgtgtggagatgatgaccgacccctcggccaggtggggctgggatgtgttgtctgggggtgatgagaggggggaagcattgtttttcgggctg

SEQ ID NO: 7126 - DNA, 1101 bp, Chlorella protothecoides
atgcgcggcttcgaggccttctcagaccagagcatcactgtggtgtgcgtggagggggtggaggacccggaaaatccctgcacccctggcgaggagctgggcgccgccacgggcctcgtcttcttcatctgcatcatggccaacatgatggcgttcctgctggcacggctgcgagtgggggcaggtgggggagtgctgagcctggcccgatctgcaaggacggtgggctggcgcagcagccagagaatgccagggttcttggggactgtttgcagggcaggtggcgccacggccgggcatgcgccggcgaccccgccccacacgacaaatccccgccccatctccctccgctcctccgtgcaggcctggttcttcgtgtttgagacggtgcagaaggagcgggaacggctcgagggcggcgacccctaccagcaggaggaagagagccccgccgccgcgccggggctgcccgtctcgcgtgcggggggcgggctcaccaacgggcacgcggcgggcgtggggcacgccgcggtgcccacccaggtgctgctggaggaagggcggaacgcgtcgcacctgtacggcgcgacggaggggcgcgatgccgacgagccccggacggtgcaggaccggatcgagacgcgggacaagctgcgcctcatccgcaccttcttctacggcgtgtccacctacgtcgtggccaacctcttcgtcatcttcctccccatcttcgtgcccaccgtcgttgaccgagtcatcctggcgctcatgaacggcctgcttctcatcttcgtgagcgtgctgctgtggaccttccgcatgcgggcgggcaacgcctacctggtgctgggcgaggcggtgggcatggagaccaccaccgaactgggcgtgctgagcgtgcctcccaagcgggtggggccctcgcagcccgtgggcggcggcgtgtacgacaccgccttcaccctggacgaggaggaggaggaggaggaggcgcggctggcgcgggggccctcctccagcgcgccgcgccaggccggcctgaaccgcagcgcggcgcggaagggggtggtggtcacggacctcccctccacgccgcactga

SEQ ID NO: 7127 - DNA, 891 bp, Chlorella protothecoides
  modified_base (799)..(808): a, c, t, g, unknown or other
acggccacggtgctcgaggtcatgcgctcggctcgccagcgcgtggagtcgggcgaggtccccgccttccgcttcgtggagatcaacggcctacgcctcgcctcgccccagcacgcctactgcgccctgcacgaggtgggacgaccggggaggggcctcgcgtgtgatgtggagggggcggagggctggtgcgctgtgttgagcgacaccaggacggtgggcagattcctggctgactgggtgtccagcccctgtgaagtcattggcccgcacactttcaccccttctccacacctgcaggcgctgacgggggagcgcctggggcccagctcggccgcggcggcgctggagcgcatgttttgcggcggcgcggcggccacgtgccggtccaagtcagcgccccccaagcgccccgtcatagttctggtcgacgagctggacctgctcgtgaacagggctcaggcatgtgttgaccgctggcatgctcccctgtgtgttttgactttgttcgtcgactcggcggctcagggtgtggacgctcaagtaccaggacacacatcccccgggccagcctttccagctcatcggaaccccccctctcccaccaccatcccagacggtgctgtacaatttgttcgactggccctcccgccccggctcccgcctgtccatcatcggcatcgccaacaccatggacctgcccgagcgcctgcaccccaggatcgggaggtgtgtgctgggatggacagggggtcatggagcagggtttcctgggccgcgcctgcgagattcggagaannnnnnnnnntgggaggtgtgtgctgggaaggacagggggtcatggagcaaggtctcctgggccgcgcctgcgagattcggagaagggggtga

SEQ ID NO: 7128 - DNA, 1152 bp, Chlorella protothecoides
  modified_base (307)..(316): a, c, t, g, unknown or other
  modified_base (544)..(553): a, c, t, g, unknown or other
atggcctcggaccccactcgacggctggagtgcgggctggcgcaccctttcccggtggcaattcccacatcacatcccccgctcacccctcacccgcctcctccacacagccggctggcggggcggcgcatcaccttccagccctacaaccgcgagcagctggagatcatcctccgcgccaggctggaaggcatcgacgcctttgaccccaacgccctggtctttgtttctcgcaaggtggccaactgctcgggcgacatccgcctggcactggagatctgcaggaggtgtggggggggaggcgggnnnnnnnnnnccacagggacgcctggacggcgcatgctgtggcgaggtcgaggacactcgccactccgagtcatgtgtgcgctgcccatgcgtacctgcgcactggtccacctctggccccctgggactcactcatgcctgcatgggtccactgccccctcgcccagagcggcggagatcacggagctggactccctggagggcaaggagaacagccaggccgacgccaacgccgagnnnnnnnnnngcctctggccccctgggaactcactcatgcctgcatgggtccactggcccctcgcccagagcggcggagataacggagctggactccctggagggcaacgagaacagccaggccgacgccaacgccgagtcctctgtggcccccggcgcggcaagccccaccacgacgaagccggcgcgggtgagcatggcgcacgtagaccgcggcatccgcgccgcgctgagcggcagcgcggcgcagcgcgcccagcagggcacccccctggagcgcctcctcctggcggcggtgcacctggagacgcggttcgggggccgggcggaggtgggcgtgggcgcggtgctggcgcgcctgcgctccatgctctccgccgcggggcaggagccggtggcgaccggcgcggcgctggaggcgggccaggcgctggcggcggcgcgcctcctgctctgcgacgcgccggcgcgccgcctgaaggccagggtggtgctcaacatgcccgccccggagctgctctacgtgctgactgcggacgaggagatgccctggctggcggcactgctgggggccggcggcgcgtgagctctctgtctcagaaggggtga

SEQ ID NO: 7129 - DNA, 762 bp, Chlorella protothecoides
atgcagcatggcgagctcgcggatgggccacgccgtccatcgagatgcatcccgcagctccctggcatctgggcagatggtgccacatcactgcttcatgccgcttcctcccctcagcgaacccaccagccccgtcctccccctcccagacccgtcccaggccagtatatttccacgatgaggggccgggcatcccgggaggcagcgtcctcgccctccacccgccggattctgaccaaaccctacgaggcggtggaggggaagccgcatgacaatgtgaattcagacctcatcgtggcagtggatgacgagctccgatcacagcacactcggtatgtcgtgcaagacctcctgggccagggcacctttggccaggtctttcggtgccttgagatgcccgacgtcgggagcggcaggggtggcgaggtggtggcggtcaaggtgatcaaggcgcagccggcctacttccagcaggcccgcgtggaggtgggcatcctgcagtacctcaacaccaaggcggacccagagaacaagcaccacatcgtgcgcatgaagggactgcgggggttgcggtggcgccatgtcgggctggtgggcggtcccacggtcccagggcgcgcccagcgccatgccctcattctgccggcctccttgcgccatcgcgagcttccccgcccacatggcctccctcctcccctcacccccaggactttttcgtgcatcacaaccacctctgcctggtgttcgaactgctcagcctga

SEQ ID NO: 7130 - DNA, 699 bp, Chlorella protothecoides
  modified_base (332)..(341): a, c, t, g, unknown or other
  modified_base (592)..(601): a, c, t, g, unknown or other
gacgtgcgcctgcagcgcgcgctgcccgcgctggtgtcggccgccgccgagcacggcgccggggtcaaaggcgcggccctgcgcggcatcgtggcgctgctggccgaggtgcggcgcgtcccggcgggggacgccagcgtcgtgctggagtacgtcctgccctcgctgtcgttgctgccccgtgaccccgcgccggcagtccaggtagatggtggagaggggggaaaggggggcggctgtgattctcttggcaatcgggtgagctgctttgggcagtctggggttggtggaggggctcacggcggtgctcctgccgagacagagttgtggtnnnnnnnnnncggcagtccaggggctcacggcggtgctcccgccgaaacagagttgtggcgggtcatcgaggaagggtgccaggaccatgcctgctccccgcgtgcggcatgggccgtcagggctgtctcgcacccctcaccctcgccacacttctccagccctcgccctcctttctcccaccctccaaacccaccacaccaaggtggagcatgccggcgtgctggccgacctgggcctcgcggcgctgggcctgctggannnnnnnnnncgcacccctccccctcgccacacttctccaaccctcgctctcctttctccctccctccaaacccaccaaaccaaggtggagcatgccggcgtgctggc

SEQ ID NO: 7131 - DNA, 360 bp, Chlorella protothecoides
  modified_base (84)..(167): a, c, t, g, unknown or other
atggccgcccacccgcgccccttcatgcgcctggtggccggccacctgcgcggcgactgggcgggcctggtggcggcccgtccnnnnnnnnnnnnnnnnnnnnnnnnnnnnnnnnnnnnnnnnnnnnnnnnnnnnnnnnnnnnnnnnnnnnnnnnnnnnnnnnnnnnctggcgtgagaccctggccctgctcctctcctccgcgccgccggcggagttcgaggccctggcaagcgcgctggcggcgcgcctggctgaggcgggcgacgcgcacgccgcaggcctctgcgtcgtctgcgccggtgacgtggacgctgcggtgggcgggtggagcgctgggctgggccgcatgccgcccgcc

SEQ ID NO: 7132 - DNA, 570 bp, Chlorella protothecoides
gaggggggggggcgcgcgggaggggagggtccacgacgcgtggctccggagcaggaagcagggcaggagggcaggcgaagaccgtggaggggcagagccgtggggcgccccgcggtccctgctgcagcgcagggcttgccgggcagggtcggacggacccctgtttcacctgatccctccttccccctcctcccccgcgaacaccacgcctcgcagtcgctgaagatcgcgcagggcgtgtccgggacggtgagggacaaggggtcggttcggcgcaacgtgcccttcctcatgcaggccgtgcggcaggggttccaggactttggggcgcggtccgtggctgacgcgcacgccgcgctcgccgcgggggagctgcgcctgcgcgaccggaccggggcggcgctggtcgagggcggcatccacgacatgcactcctacaccaagcaggcgtggcctgcagctgcagagcgcgcgttgaagacccggaaaggcgcgccgaaggaccctcagtcggtgagcggaagggcctcactgatgcctccacacacactcggcaatgtgagggcgtaa

SEQ ID NO: 7133 - DNA, 1671 bp, Chlorella protothecoides
  modified_base (545)..(554): a, c, t, g, unknown or other
  modified_base (1259)..(1268): a, c, t, g, unknown or other
atgtcagggcatggcggtggtgtccggacagccccggtcaggatcgggccaccaacaggttgtgggcagagggttcgcaatgcaccaaattcgagtgcactgagcaattttggagcttctacagtgaatgagatggtgcgtgcaggagcactgtccccaagttcacaatctgtgtggccaagttcacgatctgtgtggccaagttcattcagtatattgcgccttggcgacgctggctctcagagtcccaaactctggagtgttggaagccctaagtcggtgaggccccccccaatgaggtcggccaaggactatatggggccgtcggaggcgagtttcgacagccccttcctcccgatgcccctcaagaggcatcgcaccctccagcgcttggctgctgccaggtgcgtcgagccccttgtggtcgcaccccgccatgagagctcaccaaaccctagcgggcaggtacacagccacaagatcatcatcacccccagttctcatctcgtttgtacgcagggccattcaaagcctctccctcgagnnnnnnnnnnctcaccaaaccctagcgggcagtgtggtgaaggactggacctgatcttgggcgtcgggcacgggatcgcaccgggggatgggtccctgaggatagaatgcacagagagcaaaaccccccttcatcctgcacctctcaatcccccacagatgccaaactacttatttttcctaactttcctgctgtcatatttgagcatggtgcggggacagggaagcatggtgctggcatccaaacgctcaggaatggacctgatcttgggcgtcgggcacggcattgcaccgggggatgggtccttgaggatagagtgcacaaagagcaatacccctcttcatcctgcacctcccaatcctccacagatgccaaactacttatttttcctaactttcctgctgtcatatctgagcatggtgcggggacagggaagcgtggtgctggcatccaaatgctcaggtcatagtcaagatcagatgttgccccaggctagctctgcagcatccattccccctcaccccactctcccgtgcgccgcgcagtacaccaccttcgcatttctgtacatgctggagcccgacggctgcatcactaaggtccaccagttctcccacgccatgtggtttagtgtgcacacctcggccaccattggatacggccacatgtgggatgttaaagcagcccggcaggaattccagtcgagtctgcagannnnnnnnnnttggaaggcgctttctcaggggaaggcgctttctcagagggtgacagatgttagagcagcccggcaggaattccggtcgagtctgcaggacactggagctgcactgacatggtgtcaaagcgaccagtcgatggctcgaaggctcacatctgtcatcacctacccatgccgggtctgtctgtcccagtgctcctttgatgccagctttcatccactcaaaccctcccttgccgacatgttccagggcgccaaatccagactgcgtcagcaccaacctcctgatcctggcggaggtgttgaccacctgcctgctgcaggctgccctgctgggcgttgtatacgcgagattcaggcacgcctcctggatcgtgcctggcagtggggcatgtttgggccaagatga

SEQ ID NO: 7134 - DNA, 300 bp, Chlorella protothecoides
atggtcatagctggcgaggctgagacgggcattcccgacgataagcgcttcgccgtggagctagagtttgtgcagtgcctggccaacccccactatctgaactgtgagatactcgtttggggcgaggagttgaggagtgagggcggggggaatgggaggtggtttaacaaggagtatgcagtactcgagcgcggccagagcaatacctttagcgctcggcccgtgaccgatggtagggtctcccaattccactcgcaccccttgctccccctgcagggctggcacagcagcgcttcctag

SEQ ID NO: 7135 - DNA, 705 bp, Chlorella protothecoides
  modified_base (120)..(129): a, c, t, g, unknown or other
  modified_base (337)..(346): a, c, t, g, unknown or other
atgaggcatgctgttgtcaggtgcaggcagcttgaatcctcacatcgcccccatcttcaacccacccattctcaccccgaacaggttcattttcaggattgggatgccgcccgaggtgannnnnnnnnnttcctcacatcgctcccatcttcaacccacccattctcacccccgaccaggtttgttttcaggattgggatgccgcccgaggtgaggatcgagctggtgcggagcctggcggcggtggagcacagactggccttcgggaccagcgagaagctgcagctgggggcggtggtgggggcgtttgccgccgccaaggccggcatcgttgccnnnnnnnnnntcggtggagcacaggctggccttcgggaccagcgagaagttgcagctgggggcggtggtgggggcatttgccgccgccaaggccggcatcgtcgcctgcgccagctgatgcgtggcacactttcacccagctgctggtggtctgcgaggagatgcggagtatttgcacagagttctacctgctccccatgcgcagctggcatgtgtaagcgggtgcttgcggtgcctggcagcttcagggtgcacacggccctcagcactccgggagttgctgagccctggcgagggcgcgacctcgacagcggaactgagggagctcaaggtgcagcgggagtcgcagtcgcctcccccgcactttga

SEQ ID NO: 7136 - DNA, 903 bp, Chlorella protothecoides
  modified_base (389)..(398): a, c, t, g, unknown or other
  modified_base (651)..(660): a, c, t, g, unknown or other
  modified_base (853)..(862): a, c, t, g, unknown or other
atgccggaggtcatcgcgcagtactacttccgccagatggccgcgggcatggccttcctgcacgccaaccatgtggtgcatggtgacatgaagcccgacaacgtgctgctttcgggcgactccaccgtcaagatcgccgactttgggcaggcccactttttcaggaaacgcgacacctttaatcgcaccctgggcacgccggcctttcttggtaggcttggctggtatgtggcgatgggttttggcgaggtgaagacattcgaggcatggaagcttgcatccgctggccgctcctgcgcccttcacccacgtcttcccccttctctcgttgcttcgccccgcagccccagaggtgtgtgccggggagacataccgaggccggcaggccnnnnnnnnnntccattttcccccttctctctttgcttcgccccgcagccccagaggtgtgcgccggggagacataccgaggccggcaggccgacatgtgggcgttggggatcagcctgtacctcttcatctacggggaggtacccttccacgtcagtgcggagggttatggggctgggtgggtggatggtcgacgtacgggggtgcctggactggggtctcagcggcagcacggtaacgtatggacgctgtggccccgctcgnnnnnnnnnngttggggctgggtgggtggatggtcgacgtaagggatgcctggactggggtcttagcggcagcatggtaacgtatggacgctgtggccccgctcgattacggggcacggtggcaacttgcccctgccggggttgtgacacgttaaacccacagtctgcatggcccagccagcatgatcaggccgggtgccctnnnnnnnnnngtacggggcacggtggcgacttgcccctgccggggttgtga

SEQ ID NO: 7137 - DNA, 390 bp, Chlorella protothecoides
atgatcaggccgggtgccctgcccacaacccatcgcaacactccccactccctgcagagtgagaccgtgctggacctgtacgaccagatcgcggggggcagcgtgccctacccggagcacgtgccggtgtccattgagctgcaggacctgttcaggaggatcctgaaccctgaccccgcggcccggctgacggcggaggaggtgcggggtagaaacggggaattgaggcgggaatctgggtcggactccagggtgcttcccgctgcccttgagcaaattacaggccacgggatccctcaaggcgaagcgatgaggtccctggtggcctgcgcgagcatgcctactacctgcggccgctctcaagctgcttgtatgtccatcacagcctaa

SEQ ID NO: 7138 - DNA, 1713 bp, Chlorella protothecoides
  modified_base (664)..(673): a, c, t, g, unknown or other
  modified_base (1326)..(1335): a, c, t, g, unknown or other
atgggtatgggcatggaggtcccaggcgatccagtgagccgacacccccataggccagcggccgggtccggggtggtgggcatgatcggcaccgggggcccgccctttgtggccctgcgcgccgacatggacgccctgcccatcattgaggccagcggggtggactttgcctcggagcacccaggcgccatgcacgcctgcggccacgacgcccacatgacgatgctgctgggcgccgcccggttgctcaaggccgtcgagcatcgactgccagggaccgtgagactggtcttccagcccgccgaggagggcggcgcaggcggggagcgcatggtgcaggagggtgagggcggtcttggggcagggattttgtatgctgggaatcagtgcggcacaagcgctacggcctgggtgccagcctgccgaccatcatctcattgcgctctattgaatcccagcgccgctgaccaacaccccctccttcccgcattcctttgcggcacaatcgctacggcatgggtgccagcctgccgaccatcatctcattgccctctattgaatcccagcgccgctgcccaacaccccctcctccccgcattccttgttgtctgcgcttcattcttcaatgagcccccctttccagcatgcacacatatacaccccnnnnnnnnnntccccccccctttccccccccaacaacaaaaaggtgtgttccaagacgtcggcgcggccttcggcttccacgtctggccctccctgccctccggcggcgtgtactcccgccccggcttcttcatggcgggcgcgatccgctttgagctggtcgtgcgcggccgcggcggccacgccgccatccccgagctcctggccgaccccgtcgtggccagcgcggcgatcatcaccgcgctgcagacgctggtgtcgcgcgagacctcgccctttgactccgcggtgctctccatccccaagctggtggcagggcggggcagggcacaggcccacaacgtggtgccggactccgtcttcctaggcggcgtggtgcgcgccacctccgacgccgccatgcagcgcctgcgggcacgcgtggcggaggtggtggccgccgttgccgcagcgcacggctgcgtcgccgagctggactgggccgaggacgccacgccttactacccgcccaccatcaacgacccggccctccacgcctttgccgacggcgtggcgacggggtgggttgggttggggggtgtaacttctatctttgagggaaaagtgaagctctgccagccaggacggccccgccacaagaccacagcccccaaatcaacaccnnnnnnnnnntacttctatcttttgggggaaagtaaagctctgccagccaggacggcccgcccacaagaccacagcccccaaatcaacaccctgttacaccccccaaaaacaacatacaggctgctgggcgccggcgctgtgggagagtacgagggcaccatggccgcggaggacttttccttcatcgcgcgcgccgtgcccgccaccttcatgttcctgggcatccgcaacgagaccctgggctccgtgcatggcctgcacaccgaccagttcatgatggacgagagcgtgctgcccgtgggagcggcgctgcacgccagcctggcgcggaagtggctggaaagggaggcagcggccaccgccccaccagtgcaggacgagctctga

SEQ ID NO: 7139 - DNA, 1473 bp, Chlorella protothecoides
  modified_base (429)..(438): a, c, t, g, unknown or other
  modified_base (1085)..(1094): a, c, t, g, unknown or other
  modified_base (1426)..(1435): a, c, t, g, unknown or other
atgcagtactcctttagtctgaccacctttagtcctagtgggaagctggttcaaatcgagtatgcgcttgcagcggtgaacgggggcgccacgagtctggggatcaaggccagcaacggggtggtcatcgccacggagaagaaattgccctctacactggtggacgaggaaacggtgaagaagatatccctgctcactcccaatctcggggtggcctatgcgggcatggggcccgactcccgagtcctggtcaggaaggccaggaaggcagggcagacctactacaggcagtatcacgagcagatgcctgtggcgcagctggtacgagaggtagcggccgtcatgcaggagttcacacgtgagtgctggggggttggccttggggcgtggtttgcggcccgcctgagcttggcgtgtgagcacagctcnnnnnnnnnntgcaggagttcacacgtgagtgctggggggatggccttggggcgtgagtctggaggcgtgcgtccctttggcgtttccttgctcctggctggggtggacgagaacggcccgcagctgtaccaagtggacccctccggctcctactttgcttggaaggcgtcagccatcggcaagaacgccatcaacgcccgcacattcttggagaagaggtacagcgaggacatcgagctggaggatgccatccacaccgccctgctcacgctcaaggacggctttgagggtgggttcaagctcaggccttggcccaggctcgaagcaggccgagggctggcaagctccattgggtggaggtgcagtgcctggtacaatctgcgaccgcagtataaattcatgggtgcaggccggccatacaccaccctctcagcccccaaaccgatgcccaccctggcccgccttccctccgcaggcgagctgacgggagagaccgtggaggtggggatcgtgggtgaggatcgggtcttccgcgtcctcaccgctgccgaggccgagggctggcaagctcgattgggtggaggtgcagtgcctagtacaatctgcgaccgcagtacaaattcatggcctgtccccccatcccctacatcagcatnnnnnnnnnntgatgttgaatccatggctgccagcaggttcttacctctggctggctgcagcccgtccccctatcccctacatcagcacctctgcctggacccttgtgcttgttgtgcacttgagaacagggctcctggtcagtgtacatacaacaatctcagcatgaggcacgacatcagagcgccagggcagccatgctctggaagctggcctggacgggatatgcttgcgcgtggaactgagaggccgtcccatcaccgtttccacacactgccaaggagctcaagaaaacccttgggagagtcagagctcgtcctgcactggcggggcggtggccgannnnnnnnnntttccacacactgccaaggagctcaagaaatcccttag

SEQ ID NO: 7140 - DNA, 1533 bp, Chlorella protothecoides
  modified_base (158)..(167): a, c, t, g, unknown or other
atgcgtcctggcgaacgccttgccctcttccctcttacagaggatacaggtgcatttgcgatgggccctcgctctgactgctgtggcattcacgatgttcatgctccccgcaattccttcacgaatttccactccctccagagcgatgcgaaggcccnnnnnnnnnnttgctgtggcattcacgatgtccatgctccccgaaattccttcacgaatgtccactccctccagagcgatgcgaaggccctggccgccagccccaactattggtttcccttggagtgcttggattcgccagcaaccgcggccgaggaggcagcggctcacctgtaccatacatgtatagctgcaaaggatgtgaaaggcgtcgtaggcgccgaatactgggttcaggcaggttcactggcccctgggaagacagcagctgtgcttaagactttgggtataccatacagccctgagggatgcagactccatcaccctctgcaccccaacatccctgacaacagatatttgagaagggacgaggtctcagctttcacatggacaagagagttccaagagaaaacacctcatgtggacgacagcccaggccaagagcaccctccttcaatctcattgatgactgttaagcacagcgccctcagccagcttccttctggcggtctgcacccacaggacgagcatttgatggccaacgaggggcggctggtgacccccctcatctcgtcagtgctctacctcactggcacagcacagaacccccagcgccaaggtgtgtggttgaggggtgcacccctccctcctgtggcccaatgcaggcgtgtgcatgctcccgctgggaggatggagacgcaggtccgaatgccctgtccccctgcaccacatgcctctgcagggccaactgtcatcctggaccagaggtttgatgccgagctgggagcggtgaccccgcccagtcccgcctggagcacgctctccttccccctggcaggcaactactgcatctttgatggcgcgctgggtcacggcgtgctggacgccggggacgaagcggagatgcgggccactctcttaatcaactggtggcagcaccggccggaggcggtggggcgagcgccgctcatgcctgcgcaggccgaagcggccgagggcggtgacgccgggcttggcagcgatgccagatggaagctggccgatctctgtcttggggagcgcgctcttcccatccccagcattgccgtggacgccgccaggctggcaggggaggacgacatgctcctggacaggcacctaaactgccagctccacattagtcaacccacccccccctccccccactcacagccggacaatcttcttgcggagaatggggtcgcattgcatgggccgggtgccgtgcatgcggtgacctttcaccaccagggcctcagcctttgtcccattgatggtggggaaggactgagcatcgctgccgcgctggtcttggctcaggatggggagagcagctctgagagtggggacgaggaatag

SEQ ID NO: 7141 - DNA, 807 bp, Chlorella protothecoides
atggtcaagctcactgccaccatgcttctcaagttcatgggcgcagaccgggacccggtgctcctgggctccgcaaccgacctctcgtccttcggtttttttcagcgcagcaccgtgcgggagatgctgatcttcgtgtcccgcaccgtggccaggaaaaccgcgattggagcgcgacagagcgtgcagcatgaggagtaccttgcccacgtctacaaccgggacggcctggtggccgtggtcttcactgatgccacctacccggcgcgggcagggttctgcgtggccaatcaggtcatagacgacttcactgcccaggatggggattcctggcgaaggaacacgagcgatgtggagacggggaacgcattgctggaggccgccctccaaaaataccaggatcgagagtgtgctctgcaagatatccctgagcattttgaatggttgggtgggctgagagtaggcatggagctgggtgagtcgcttgtgaaggggcggttggcgtctcatttttggagagattcctgcaacgcgcggctgcataaggcgctgcgacaatgcctccctccactttgcgattctcaggatcccacagcagcagataagcttgccaagatccaaaaagacctcgacgagaccaagatcatcttgcacaagaccattgagagtgtactagacaggggcgaaaagctcgatcaggtggggagagatgcaagcatgcggttttcacttattgtgaagatagacaagccaacaaatgagcagacaagcgaggaattcagtgtccgtgcaccgctctcaatatga

SEQ ID NO: 7142 - DNA, 2442 bp, Chlorella protothecoides
  modified_base (2050)..(2059): a, c, t, g, unknown or other
atgaggcctcaaggttgcaacatgttggtagactcccatggcctcgggcgctcagccatgccaggggatcgcttcgtagggcgttggcaggcacctcgcagcggcacatgcacaagcccctgcattacctggagtgtcaccccctgcagattgactggcacagggtggttgcagccacacagggagacggccatcctctgcaataatgctggaatcgagttggcgcacgccaaggtgcctgcggagagtgcaacgagcttgggggcatgcgtcatgacaatggtcccagctcacctcaagatccaggatttcggcccccccacctggccaggcccgatggcgcgatgttccctcttctccaccccggcacccttcttcgccgagccccccatctcggggaagggcagcgccgccggtgggcccctgctcaagctgcgcctgaccagctgcagcaatggggacatcctctccatcaccgtctcccacctggtggcaggcgcgtgtgtgatggggggaggggggggcatcacatctcttcctctgctttggtccatgcaggggcaggaagggagggatgccagtcagaagcactggacacccctctcaccaccacagacagaccagcgcactccccctctccaccccccctcccatccagacggccggcacgagctccacctcctccgccgcctgtctgagttgtaccgcgggacactgggcacgcccctggctggcaccacccaggcctgcagctacgacgccctgcgtcccgccctcccgccgcccccccccggctggaaacccacgggcctagacccgcggctcacgccggcgcagtgggcgtccctgccctgcgccttctggcgctttgttgccgcggagcagggcgtgcacacgatccacctgccccgcgaggcggtggagcgcatcagggaggtggcgggcggcgggccgatccccggcccgcccgtctccagcctcgacgcggtgcaggccttcctggcggtgctggtgaactcgctggggggtaagccgctggtggcccgggccccggccctgctcaccgtgaatgtggagctcttgcacgcccgtctggggctggcgcctagggtggcccaccagctggaacgagccatgggaaatacgatccagatcctgcaagtgccggggctgacgcccggcgcacccacaccgcaacataccatcgcctctctgccctgtccgcctcgccgcagaggacgccaggagcggcctggctatgccgacgggggccagcgaagcctcgactctggaggcggccgtccagatcaatgcccgcctcatccgccgtcggctcatcgcggcacccctggaagctccagcacccccttgcctggggatcaggccaccaccccacccaaccccgcagaccgggacgctgcaggcgctgcacgagcaggaggagatggcatccctgcccagacccctgctggcagccaacttcatcgccaagggagactccctgaagacctgcgccccctccgccgtcaccgcatacccattccacgaggtgggttgcggctgccattgcaagctcctggacgttgccctcggcgggaaaacgggcctcgactggggcatcgcttcctggaaggagcaggcttgttgcaggctgcatcggtcagtgcccatgcgttccctcgtctctgcctgagctgccaagctgcattggttggtctctgcccatctaatctctcacatgcatcccctgcccaccctctcagatcgacttcggggcagggaagctcaaatacatgcatggattcaccaacccttggttcgagcgcttcgcctacatcaagccagccctgggatttggaacagggctgctcatccaactggccatcccagcagcccatgcgtccaaaatcgcattgcatcccctctgcgtccagcaactacaacataccattcccttttctgaagccacctcagaacctagctcagtgtgcccctgtgcctcgccagcatgtcaatcagcttgccactgtgtataccacatgcaacctgnnnnnnnnnnagtgtgcccctgtgcctcgccagcatgtcactcagcttgccactgtgtacaccgcatgcaacctagtgggagataattctcttgctccttcgattccgcagtgggtgcagagtgctggtctacagagtcaaatggcatggtcggtgaggtgcgccaagcaggaatgcttgaggggtttcaaggcaataaattgcaagtcggcaggcatgtgcggctgctttgcactgcacagccacagagcggatgaggagcgatcacatgagtcggcagcaggagtttgccttccgagcttgcttgtagaagagctgactcgccattccaagatcattactcttctccaccagctgctcgatgggggcggggagttgaatgagagaagctga

SEQ ID NO: 7143 - DNA, 3096 bp, Chlorella protothecoides
  modified_base (598)..(607): a, c, t, g, unknown or other
  modified_base (1664)..(1673): a, c, t, g, unknown or other
  modified_base (2545)..(2554): a, c, t, g, unknown or other
  modified_base (2952)..(2961): a, c, t, g, unknown or other
atgagactcgctgttttccaccagtcttcgagtactgtctgctgcataccccacagcccgcttgttggtgccaaacccagaatccaggctggtaaccccttcggaccagcgattgccggctgccgccttacgagactgaggtgtaacgaggaatcctggacagcttctcccacattaatggtgttggaggccgatgtgggcatcgtcgcatacgcgaatgatgctcagggcttcgccgccaccctcaagcacaggtactctgattttcgcgtgaatgagattcgccaggatggaggcgtcgtgcgactggtcgacaccaccgtccccaaggcggcagaggctcgtgaggtgcccctgtgttccgctcaggagctcatccagaagttggagtctgcgacgggcaaacccgcttcaccagacctccttgacttcttagaacgcgtcaagaatggctcggacagcgaggtggtcgctgatctcagcagaaacccagtacaaagcgtgaggccccccccccaagcgcaggttccttcctcggagcgcattcacctggggccctttcaggataaggcgcagcgaactgctgtgcacggaatcnnnnnnnnnnacagcgaggtggtcgctgatctcagcagaagcccagtacaaagcgcgaggccccccccccaagcgcaggttcctccctcggagcgcattcacctgggcccctttcaggataaggcgcaacgaactgcggtgcacggaattttcaaggcctggccgaccctggcgaccgagacaggagccgagggcagcattgagctcggtctggggggtggcaaggggatcaagaggaggcgcagtgagtgggctggcggtgacgctcggtatgtgaagtttaccatgtacaaggagaacatggagtctcagtgtgaaggtacccacactgacagaagtggaggaggttccgacgctgtcaacagcaccagagtgtggcaaaggcttgacttgaggcacccctacagccctacaggtctcacgcccacagccctccacacccaattcacgtccaacacttccccccaggccgcgctttctctgctaggcagtaagctgcatgtttccgccaaggtgtttgggattgcggggaccaaggacaagaggggctgcacctgccaagaagtcaccgccttcagggtcgaccctgggcgcctggccacagctgccaaacagctgcggggcatcagtgtgggtgacttttctttcactgacgaggagctacacctgggtcaactggggggcaacagatttgagctcattctcagggggctcccacctgatgcagaggaagacgtcaaggcggcgtgcacagccctcgctgcctctggcttcataaactactttggcctgcagcgatttggcagcggccccatcccgacacatgccattggcagggctctgttggcagggcagtgggacagggctgtcgccagcatccttggtcgggccggtccggatgtcctgcccaccagcctccaagaggtcaagagcgcgctgaggggcacccccggattcgcagttgctgagacagctgtgctccagttaaaaaggatcgtccttgatgccagcttcctggtcaatgatgctttgtggttgctggaagctactgccatgtcatcttccannnnnnnnnncaagagcgcgctgaggggcacccccggatttgcagttgctgagacagctgtgctccaggtaccctatttcagtgtgctgatgggcttggcacatgggtgtggtcttacagggataggacgcagcgtcaccaggcaattgtgtgcacatactcctgcgcactctgactgcttcatcacacccggtcacttccctccccaaatcccacaggctctgctgaagcatggcgccaccaactacctcacagcagtccaagccatcccgcggaacctgcgcaccatgtacattcatgcctaccagtcttacctctggaactcagtggcgagcttccggctgcgccagtccaggagtgcactgctggtcggagacctggtggcacagagcaagaccggtgcgggtgggcctgatggcagccaagagtttgtgggcagcacagaccaggtgcccctccattctgagaatggagtggagttcacagagcccggagcaaacgcacaggaggcggccgcccctgccaacatggtgaggcattgggttgggcatggtagaaattctactctggcctgcacgttttccccacttccttgtgtgcagacatgcgctgggagggcggtgcacataatttcagcagaggacctggacacgaggtcatactccatgtccgacctgctcctcccgctgccaggcagcagcgtccgtctacctgagaatgccaccggcgaggtcagtggctgcagtaagacagagcagcagggtcagcggtgctgggtgcatgattgtatgaccgtccttaccatgtgccggctctggccaccacctcaacgctgcacacattcaaggcgtgctccaaagactccttcgcccctgcgccatnnnnnnnnnncaccacctcaacgctgcacacattcaaggcttgctccaaagactcctgcgccactgtgtctaggagtatgcccgcctgctggccgaggacggcctgagcctggagacctcagcgcatgggactgcggggttcaccctcgcgggacagacgggggcgtaccgcctcgtgctgagttccccgggcgacgtcgagtgggagctgctgcgccactctgcacaggacacggacctggcggaggggcagggagtagagcctgggggcgccctcctggccctgcgactggcattcagcctggctccctcctcctacgccaccatggtggtgagggagctgacaaagcagtccggcgctgcgctgcatgcggccctgcccagagccgggccgcctgtctgaaccannnnnnnnnnctacgccaccatggtggtgagggagctgacgaagcagtccggcgcggcgctgcatgcggccctgcccagagctgggccgcctgtctgaaccctgctgcatgttgtgcggctctccaaaaggtctggaatgaatag

SEQ ID NO: 7144 - DNA, 2514 bp, Chlorella protothecoides
  modified_base (131)..(140): a, c, t, g, unknown or other
  modified_base (1550)..(1559): a, c, t, g, unknown or other
  modified_base (1653)..(1662): a, c, t, g, unknown or other
atgctcccgctgtccatgctctcctccacctgctccatcctcatctccacaggcctgaaacaaagctcaccctcttgtcaaattactctctcccctccgctttccaggcgaggatggggatctgtacgacnnnnnnnnnntgaaatcctccctcccctcccatttccaggcgaggatggggatctgtacgacagcagcttcccccttcccctccctgacctggtgcaggccctgaagagggcggtgtggtgggtgctaggtggcggcgaggccgcacgcgcccaggcccagggcggtcccggcccggggctgcaggcgcaggtcgtggagacggcaggtaggctgctgggccagctgtgcgaccgcaacgggcgccgcgcctttgtcgcggcagaagccttccacgtccccgccagcttccccgtcgacgtgctgggcgacctgatggccgcggaccccgaggccgagggcggggatgccgcacggcgcccgcagctgggggacgggcggggccgcgccgccgcgctgtgggtgtgggcgccctgtctcatccccttccaccagcgcgtccaggccttccagcaggcggtggcgcaggcgagccgtgcagagagggggtggggggagggggttaaaccccttgccaggatgggaggggtcagacgctggtgggcttgcttctcgcttgggcctctggctgaagcaccccctctccttgcgtgtgcccagaattccagaggaacccctctccttgcgtgtgccgagaattccagaggcggaggagagctggcagctgcgcaccgggtcttacagccgggactttgtgcccgtgcggcgggggcaggtgctgaccgacgccttccaggccctggggggcgctggcggcacgctcaagggccgcgtccgcatccagttcatctcggacctcgggttccccgaggccggcgtcgacggcgggggtgcggggtggtgcttcacgcccctggcctggtgacggttggctggcaaccgctacaatgcgttggcggcgtccttgctgcgagtcatctcattccacgcatgcgtgtatccattcgatcgtttgcctcacccaccccatcccccggcccttctcccccttcaccctcaggcctgttcaaggagttcctggaggaggtcagcaaggagggtttcgaccctgggcgcggcctctttgcggtgaccagcgaccagcggctgtaccccgcccccggcgcggcggcccttgtccccgacgccccccgcctgctggccttcctgggtcaactgctgggcaaggcgctcctggagggcacgctggtggacctccccctggccaccttcttcctgcagaagatggcggggagggggtgcgagctgcgcgacctggcctccctggacccggagctggcggccaacctgggcaagctgcgtgcctatgacgccgccacgctggcgggactggagctgactttcaccgtcaccgacgtgctggcgggggaggcacgagaggtgggtgtgctttgggggtggggaggaagggagcaggggtnnnnnnnnnnggggcatgccccacgtgcgtgcttcccatcgctgccttcccatcacccagatgttcatgtccacagcctgtcaggtccagcctcagctgcttgnnnnnnnnnngtagagggtgcccaaggccacgcaggaccggcggagcagccgtctagggaagcaggaggggttgtgattcgcggtatgcacgcgcatttaggcatggcccacatgcctgcttcccattgctgccttcccatcacccaaatgttcatgtccccagcctgtcaggtccagcctcagctgcttgcatgcacaatccgtaccggatccctccacgacccctgcctctgctgcttccgcttgttcaccccctccttcccttcatacactgttggcccaattgtcaccacccttacccaaaccgcacctaacccacaggtggagctggtgcagggcggtgcgagccgcagtgtgacgcgggacaacgtgattgagtacgtgcaccgcatggccgacttcaagctcaatcggcagctggccggccccgtcggcgccttcctggggggcctgcactccatcatccccccgcactggctagcgcccttcagcgccgctgagctgcaggccctcatctccggcggcgagcaggggctggacctggccgaccttgccgcccacgcgcggtatggcggcgggtacgccgccgaccacccgagcatcttgctcctgtggcgggcgctggcggcgctcaccgccgccgaccaggccctgttcctgcgcttcgtcacctcctgccctcggcccccgttactagggttcaagtacctccagcccccactcagcatccaggcgaggcggtggggagggaggggggaggggggagtgatctcgggccccgggctggggaatcaagtgcacgcgccagatcgcttgaggtctgatcttgctgaacccgcctgcacctctttcatagtgtag

SEQ ID NO: 7145 - DNA, 3876 bp, Chlorella protothecoides
  modified_base (879)..(903): a, c, t, g, unknown or other
  modified_base (1109)..(1118): a, c, t, g, unknown or other
  modified_base (1500)..(1509): a, c, t, g, unknown or other
atgacggcagcacttcaaccgcagagtggaatactcttcattgccttcggctcacgtggagatactcagcctctgctcgtcttggcacattcaatatctaccgaccctacctttagatcttgcagggtcggttttataacacatgcagctcacacggactggatcaggaatcttgatttgagttcagatttgcagtatttctgggccaatagtgatcccttcgtgctcccacacaaggttggcagcaagcagtggatctacagaaaaccttgcctcagagtgtactcgcgcctggccattccctctcattcctgcatctccccaacccagagagcagagcaggatgcttctcagcgacaatgctgtctcagcgcttgtcagaccctctttgccaaggtgccagcagctgcgagaatcggattgagtgtctgcaaacagccaggcctcattgtctacaatctattctccctggagggcttccatctggcagaagcatttggcctcatatccgtcgcagcctctccctgtgcgcctccttcctcagctccccctggcttttgggatgccatggcggctgaggatccagaatttgtctccagtctgcaggcttcccggttgcctttcatgcggcggggggggtgtggagatctcgtcagccgggcacacatccatgaatggatgtggcccctctttgccgattactggggcatttggaggacggcagccttgaatctgcctgcgtcgccctgtcaatttgatcggactgctgcccccatgctgctcctgggtgagcatgccgatacaactcccaggtatgtcactgctgtgcaggtattagtagcctcttgtgccccgagtcttccaggtcactcaccacgnnnnnnnnnnnnnnnnnnnnnnnnnccaggatcaaagccattgctcgttgatctgggctgcagctccagaatgctggatcttgatcagcagcaggcctttctggagctggtgggagcgctggcacgccaatccaccatcggcatacaccttttaggatcccagctgcgtctgccagagctcgacacgagagttttggaagggggatcactgacgcaagatgggagggaggnnnnnnnnnngccaccatgtgtgggccttgggacattcacggtttccagctgcatcgagggcccgaagtgtggaggaagtgcagccatcagaaagtccacctccatcgcgatcctgtcttgcacagtcatctcttgccaagctgctgtgccatcctacatgtgggaggggcagggacgactcttgccgctgccaaggtgtggaaatgggtcgtggtgctgtcaaagggggtgtcatgctgcagggagtcaacgaattcggctacctggaatgctgaaagctcaaactgatgttcaaagagctttccaaatgccgggaacggtacaggtgcaccctctcctactcaaccaagaccgccactcttctggatgcaggccgggaccccgcagctcnnnnnnnnnnggtgtggaaatgggtcgtggtgctgtcaaaagggggtgtcatgctgcagggaataaacgaatccggctacctggaatgccgaatgctcaaactgatgttcaaagagctttccaaatgccgggaacggagcaagtgcaccctcctactcaaccaactccgccactcttctggatgcaggctgggaccccgcagcttgtggctcccctgcactttgatcaggaggactgggcgtgctgtgtggcccggactggcatcggcatacgcattgcttcgctgctagacatggtacaccggggcaccgaccagggtcggcttgatgacgaggccgaatcgctggcccatgcgatccagcgcctggtccgtgaccccggcgtggcacagcgatgcagggagatggagcagaccctgcgcggggaggacggcgtgcgagcagccctactacagaatgcttggcgtgtcgagccgcagcacatccagttccaactagcacctgcagcagctatgggctctgagctcgagaccccccaccatcctatccggcacagcttacatcggtgcgctcaaggcattggactcattcattcaacgatacggttgcgtgcagccggtacccttcccatcttaggagtcgtcggcgcggtggggctcgtgggcgcgcaggcgcgactgccagcccggccaggagcaggtgtcgccctcgccgccggcgccgggccccagcgcctgggcgtaggcggcgatgcgcgccatgcggtcctcccgctgcgccgcgctggcgtacatgtagggcgggtcgatctcccgcagcgtggtgtgtcccgcgctgttgcagaccgacggcgggcgccccggccgggccggccccgcgccgcccccgccgccgccgccggactcgggcccctccgccagcagcgcgatctgacgcggggtcagcgccggcagggccagcaggtcgacgtgggtcttgtacccgttggtcaccacgtcgatggtggagggtgcgacgaactccaggttgggcgcgtcgtcgtcgaagctggtgccccaggagtggatctgcacgccggtgaccacggcgtagtcggcgcgcgcggggtccacggtctgggagatcaggtactccaggtcgtcggtgatggtgcgctccgccacctgggtcatggccaccaggtccagcgcctgcacgccctcctcacccaccccctcgtagcgcaggcgccgcgccaggcgctgcttcaggatggtcatctccgggtccaacggttcgtgcacgcctggcaccttgcaggccgcggccaggccggtgcgccggatgtcggccagcgcgccgtccagcgcgccgcaggcgcaggactgccccgggcggccggggcgggagatggtgccctgccgcccgcgcgagtcgatggagatgtgggggaaggagaagaagacgtaccgctccttgccggagcccttggagaccggggcatgggacaagcccgcgcgcaccccgctcacgccgcaggtcagcaccccgcccaggccgttggtgttgaaggaggatccaaacacctggtcgatcttctgcttcagggtcaaggtcacctcgtcgcggcacaggttcaccatggctgacacccagccccacccccccaagagcccaccgatgctgttgtcgccgctgaagccaaaggcgtacagcgcaatctccatgcgctgcatgaagtcgtccacgcccagggcgctggggaagtggtgggtgatgatgcgcgtgcgttggcgcaggtaggccagctccgtctggatgcccctgggcttctggatgggggcctgttcctcgtcaggggcgggggcctgggtgccgggggaggggctcaggcctggaagggcacgggtgcgaccctgggctttcgggggcagggcctggcgagggtcccgggccccggcgtggtggctgtggccctggccccgggctgtcacggacagcgccacggggctgaaggccggggtggaggggttgcagggacgcagcggcatgttggaaccagtgaagggggaggctcgttctgccctcatcgcgcgctgccttgtttctggcacccgagtccgattctggcgctctcctcaggtgggggcaacagcacacgtgggtgcgacgagatcgaggatgtgtcaactgaggtcgaaacctgcaccggcggtgatggcgtatcgcagcttgtccagcatgacttccaggctggtgtagggcggcagcttgagcaggttcatgcaggtggaggcggtggggagccggcccagcgcctcccccgtcgccgcgccagccatctgtgtaggttcgagaggaggggatgcatgaggtgggcggggcatgatgggaaatag

SEQ ID NO: 7146 - DNA, 2925 bp, Chlorella protothecoides
  modified_base (857)..(866): a, c, t, g, unknown or other
atggattgcctgatcacgtggacctgcgtggctttgggtcggcgagccaccttgcctcgtgtgggtagcctatggctgcaaactcaccatccctgcctctgcgcttggcaagtcacatcgccagcttgtattcaaacggcaccagaccatttctctaccctctccatcctgcgacagtgcacagtaataaatttattggaccgagcagctgggacctttggagggtcctctgatgactttgatgccctggatgcatcagtagatccacctcgcctggtgaggagctgcactgggtctgtagcagggtccacccggctctcggttggcaagatatgtcgtttcctacttatcagttctgagcagggtggtgatcttgtatgggggggcgtcagaattctggatcagcagacggtaattgttcgacaaaaacctgaggtccttggcgtggtgcgtcggagtgtgcacggcagggcttcctggtgtctgaagaagagcaatctagtccttaatgccaggcagggtgtgagctgcgcaagccagagatccgaagccattcctttcctcgatgctgaaccgtccaaagctccctcgtcttccatcgcagacaaagacacccagcaagccgcgacccatggcctccagtccctcctccccgccgctgctgctcacctcagggagcagtcccttacccagccctcgctttggggccagtccctctttcttctctggcagtcccttgagcaggagcggcggcaaggccccctcttgggcagaggacatcgtgatactggcaagcattatacctggcgggtgcactcatatgttgggactggccgtgtctgctcttcatcgtcttnnnnnnnnnngtgccacaccgtggtcttgagcgtctctttttgcattgtctgcctgaatctagtattcactgacatttgcgtgcactcatgtgttgggactggccgtgtctgctcttcatcatctcgatacaccgttctgctccccccctctgcactgcagggttcagctcgacgcagaggcctgaccgggctgggcaacctgggcaacacctgtttcatgaactccagcgtccagtgcctggcgcacacaggtgcgggaagaggaggcccccgcttgggcatgacgggcttctccaaaccgattcgccaccctgtggtcttgtgctccctcattccaagcctactcagcaacctgcgcctgcatgtcccccccttgaacccacctccacccttccccttgtccactggcagtgcccgtgctcgaagtcttcctgtcaggcgtgtacaagaaggactgcaacgccgacaaccccctgggcctgggcggcaagctggcacttgccttcgggggcctggtgggcaagctttggctccccggcgcctcccacgtcaaccccaagcacttcaagtggcagctgtccaagtttgcgccccagttccaggggtatgcgcagcaggactcgcaggagctcctcgcgttcctgctggacggcctgcacgaggatctgaaccgcatccgcgtcaagccctacgtcgaggagggcgacgccgacggccgccccgacgccgagctggcggcagaggcctggcgcgcctaccgtgcgcgcaacgactcggtcatcgtggaccacttccagggcatgtacaaatccacgctggtgtgcccgcagtgcggccaccagtccgtgaagttcgaccccttcatgtacctctcgctgcccctgccggggcccaggacgcaggacttcagggtcacaggtgggctggggcagctgccgcctgggtgcaggggctgaaaatgtgtacggagcctagtttgttttgtgggggggggcggttaacgatccacctgtactggtatggagtgggaagattcagactcgaggccggggagcagcaggatgattggcgggctgtgctgccgtttccacgtgccggacaatctcacagctggccagggtttgtgctggggggtgggaccatggcttccatcagggctgcatgcataggccttggagggatggagagtgctgtcctgccccgctcattttccatcctcagctgcacactgacctccgtctctccctcatcccacagtcctgagcatggacggtggggcagagcccaggcagtactcggtcactttacccaagacaggcactgtcgggcagtgtcgggtgagatggtgtgtgacgtggacggtcgaggggagtttacaagggagctcatgttgcacctggatgatgttcctggtggaccctggcagaacactatcaggggggagcagcgacggtcgggtttgcaggctgccctggcggcaatgtgccagcagcattccacagaaaaggcagggctaccttcatcgccagcctcgcaaccgcatctcctgcttgcgcgctggacgcctgcggcggggggcggccagctggagcttctgacagaagctgggaggaagctggctggcctcgtgcccgcccgaccagccgtctccctgtcctcgggctcccgcgccccccagctgttggggtacctgtatgctgatgtggactcaggaccagcagcagggaagcgcgctgtcctggtgcaccacaggtctgttgtgtggcctggtgtggtgctccagaaggatgccagtgggctgtctggccctgctgtcgagtcggcggacccgggatgctgcaagagtgatccccctcgttccacatgcaggataaactactccacagtcctgccgcccgctgtgctcttcctgtccactgaggatcttgagggcctgaagctggcacggatagaaagcagtacgataggacctgagggctcggacaatgtgctgagcgccgccctccttcggtcactcaggcatggcatagacgagttagtggatgcggtggagggtgagggacactga

SEQ ID NO: 7147 - DNA, 627 bp, Chlorella protothecoides
  modified_base (104)..(113): a, c, t, g, unknown or other
  modified_base (229)..(238): a, c, t, g, unknown or other
atgggggcctgcgtctcgccaggtggcgaagccaccctctgggagcgtgatctcccagccgtctttgagcaacatgagcgcacaccagctcctcccaccttccnnnnnnnnnnaggctggggcgaggcaggcttcttccgccttgcgcgcgcgtcccttaagaatcccaacggcccctgctccatctatgaggcgccctcctaccccgtcaagaaggacgaggtcaatnnnnnnnnnnaggctggggcgaggcaggcttcttccgcctggcgcgcgcgtccctcaagaatcccaacggcccctgctccatctacgaggcgccctcctaccctgtcaagaaggacgaggtcaaccctgaagtctccagcttctgcggctactttgggctgtcggagtgcccccctcacaacgcctgcacgtgccagttcaacctcttcgacctcgtctgcctctcctggggctgcaaggctggggagccaaaggaactttgaaggtgtagccgggcgtcgcaaactgccctgtgatgaccttggaaggcgcagggccggtgatgtgagggcgacttgtccaagtgtgcttgccgcccatgcccttccccgtcttgcacactccgcaagtccagcgtaa

SEQ ID NO: 7148 - DNA, 447 bp, Chlorella protothecoides
  modified_base (32)..(86): a, c, t, g, unknown or other
  modified_base (421)..(430): a, c, t, g, unknown or other
atggctactggtctttcgacctcccctgccannnnnnnnnnnnnnnnnnnnnnnnnnnnnnnnnnnnnnnnnnnnnnnnnnnnnnngcccgtgtcggtggccatctgcgccaactctgcgctccagttttactcctcgggcgtggcaggggacgagacgtgctgcacccagctcaaccatggcgtgctggcagttgggtacgaggatggacccgacggcagcgccgagagcggccactggatcgtgaagaactcctggggagaaggtgggcggaggggtgatgcggaggagggtgggtgtctgacggtgaaggggagggtaggggcctgcgtctcgccaggtggcgaagccaccttttgggagcgtgatctcccagccgtctttgaccgacatgagcgcacaccaactcctcctaccttcnnnnnnnnnnggtgggcggaggggtga

SEQ ID NO: 7149 - DNA, 849 bp, Chlorella protothecoides
atggggtattataatgcctgcacgacgtcactgtatgtgtaccttgcgtgcaaggagatctaccttcccttgagataccctgctcctccgtgccttacaaacagtgaactggtggatgaggccacattcctacggaacttctggtcggcattcaacaatttctcagatggcagcacgccagaatcccctggcatgcctgcctacttccgtttcctcaccctgcttgtggtctacacccccatcatctgtcttgcaggcctgaagatattccttgagcaaaatgtggatgttgtgattttggaatttgtggcgttagcccccttggattcgatcacatggacctcctcggacacaccctgcccccatactctgagcagttgcaatcctgcgtggttgccccaagcatccaaccacccagattccatgccctgccgctccctgcaggaaattgcgcgagagaaggctggcatcttcaaggcagggaggcctgccatcacggttcctcagccggcagatgcagccgctgcactggaggaaagggcggcggtcgcgggcgccagtctcagagtcgctccctccctggacacctatgctgatggcacgggaagccccctccacatcggcctgcccggggcacaccaacgagtgaatgccagtctggccattgcactggcacgtgcatgggaggagcagcgggctgctgcgagcccctccacgcccgtgtcggcgaggatcgagcagcttgcgaggtgccagctgccatcagagtacctgcgcggcctggccactgtgcactggccgggccgtggacaggcgagtcatccttcgagccagccagaatggctgtaa

SEQ ID NO: 7150 - DNA, 942 bp, Chlorella protothecoides
atgacgctgagggtcttgacagcggagggtgcaaggcatcaagagaagagtcatgcatgcccctctcatagcaactgcgaccttctgggccaagcaagacctcgctgtcctgactggtctgagtggactccacatcgaataggtggaaagcatttcaaactcgttagcgccctcgcgaggccagtcccggggctcaaccacgactcgcagcccttgctagcctgggtggtgagtggcctgggcaagggtgtgacggcctcctccattggagtgctcctcaaagcctgcggtctgcgcgtcacctccctgaagattgaggctgtgtcgtcgagtactgtcctgcatacccggtgtgactcacccaggcgctccgggtcacgcccccgtactctaccccgcagacccgtacctgaatgtggatgccggcacgatgtcccccctggagcacggcgaagtgttcgtcctcgacgacggtggcgaggtgtgcctgagcgtgcacctctgcgctgggagggcattttccaaggctggcctgctcccttcctcgcagcactgtgcagaaggcaacactgttccccattttccaaccaggccgacctggatctgggcaactacgagcgattcctggacatttcactgagcaggaacaacaacttgaccaccgggaaggtctaccaggtatggtgcaggtgtctctccgcttaccaagggtgtgggcagcactctgacagagaacgtcggtttgcatccgtgcgccagggaatgtctgccacgccatgcgcccagccatcgcccgctgctgcgtctatgcacccactagcatccacccggtttaccctttccccgtcaggcggtaatcgagagggagaggcgcggcgactacctggggaagacggtgcaggtcgtgccgcacatcaccaacgagatccaggactggattga

SEQ ID NO: 7151 - DNA, 252 bp, Chlorella protothecoides
atgtgggacctgtacgcacgtgagttcataggcaccaaagtagacatctgggcgctgggatgcctgttctacctcctctgctttgggagactaccatttgaaggggaggccaaactccagatcttgaatgggaggtacgaaatcccccctgggaccccagcttctatccgtgagctcctggaaggcatgttgaccatcaatgtggctcgacgctgggacataggccaggtgcgagcagactttggtggatag

SEQ ID NO: 7152 - DNA, 1212 bp, Chlorella protothecoides
  modified_base (829)..(838): a, c, t, g, unknown or other
  modified_base (1022)..(1031): a, c, t, g, unknown or other
atgaacctcttgaaagccttgggtaaacgtagagatggcggtggtgacttgtgtggacgctcgttggcggtggacggtctgcagatcaaggttgagagtctcataggagaaggaggattcgcaagcatttaccgcgtaacagaaatgaagtctcgaacgatattggccctgaagcacttccgtctcgggtatgagtctggagtaggccgtgggggtggggccgctggggtggggcgctgggacccagagaggattcttgcaatggggtgtgtccatttccccaccataccctcccgagcacccccgtattttacccacagaggggatccaggcgccgttgcagctgtctacaacgagattgggatcatggacgagctgcgtgaatgcccggcagcactttccctcattgccgccgagtttggcccagggaatcaggaagcattcgtgctgctggagttttgccagcataacctggcaacccatctccaatccttgtcgcggccaatggacctggagggcatccttgccgtcttccagccagtgtgtgtcgccgtcgaagcgctgcattcccttcagctgccgacagtgcacagacgctgtggtgagatgagtggtccctgcagaaaacgttgggcagcctgggatggccggttacatgtccttgacctcaatgaatgcctctccacagagacatcaaggcagagaatgtactactgcacagcaacggacagtgggtgttgtgcgattttgggagcgccaccacttgtcagatggtatttgggggtcttctgggtctttgcaaatatgcaatggtgtgggagggtcaccnnnnnnnnnncagcaacggacagtgggtgttgtgcgatttcgggagcgccaccacttgtcagatggcgtgtcgcacgggggccgacattgccctcttggaggacgaaatccagaggaataccaccccagcctatcgtgccccggaggtatactgtaggggacagattggaccatggaggagggtccgcttgttnnnnnnnnnntatcgtgccccggaggtatactgtaggggataggtcggtccatggaggagggtccgcttgtagtgctgtctggccatccatcctcctttttacaaggaggcatccttggcccctcttgcctgatgcggtacccatcactgtgtctgacctgtctccaccaaagcgaccctcaccaacctag

SEQ ID NO: 7153 - DNA, 3609 bp, Chlorella protothecoides
  modified_base (17)..(26): a, c, t, g, unknown or other
  modified_base (1284)..(1293): a, c, t, g, unknown or other
  modified_base (1917)..(1942): a, c, t, g, unknown or other
atgtgtgtgcaagaccnnnnnnnnnntaagaggttcattgatcacgagatcgcagctgaacgtcgttccggcagccacgcagcaggcactgcacgaagcgggcaagccctacgaatgacaacaccagcagagggccgggagagtgtgtgccaatatatctcggcatacagcgataggccgatacgcgtatactggtacatctgcgtccaacgcgctgcctgcgcctgtcttgtcattgtacaaaggaacagtcctcctgtcatgactgaccaccatcccgacgggctcgagagcgccattcggatatttaaagggctggacttgtccagcgttcccaacaaatgtatcgtgcaaatacaagttgccgagaagtgcgttcgaattttccggaacgcagcctccacaggaccgcagaacttggccctgctgcgagaaactggagtgctgggtgcattggcgaatgtgcttgccatgcggctcgacaccactgaaagctatccgcttgctaccctgcagctcctgagcatgcagacgtttgcaaatgctgcagcatcctctcctgcagccgtgcacctgtgctggactctcctattggaggcaggattgcttagcgcgctgagcaacttcacaggtatgagctccttgcgccatgcactgggaccggtgctcgatgccctctgttattttctgttcttatgctgccagaggtggaaggagccccatctccccaagccggatgtggcttggatcatcaagaagatcctcacattgctaccccagctggaccatgcatgggacaacctacccctcctcattgggtatgcggtgtacgagagtggcctggcggaggagttgctacagacctcgactgctgaactcccctgtacgtgcatgatattggacattctctgccaagaagccgcatcagtgccaaacagtgaagtgggaacctcggttgccacaaaccatcttcgagcgatgcaacatctgggaaagctagcccgtggtattgcagaaaagcgcgaaaccctgacgagcgacaactcgctcatgcttgtcagaggagtcttggcgcttggcagggcgatcatggcaagagatgaccagggccggggcctgtcagtccacaaggcccctcttgctgaggctttgctgcaggcaggctttgtggagctccttctatgtttcttggacatggtgccggcccctcgcaaagaccaggcgccagccggagaactagcagcgcaacatactctggacatcaagactgatgtcttggcaggnnnnnnnnnnacagggtatcttgtggcaaggagcggtgcccgtgtgtctgttgagttccccctgtcgccatcttttcccagcagtttcctcatagaaggggagttctgtggtccttgcctgaactggaaaccccgtcagcgtcaggagcagcctactttggtttttcacgtagcattcccaaaccaatcctccgcatgtgttctatcctcctttgcagctttggctaattcactgtatcgacggaaggctgtccaagaagctgtgcttgactctgggaagctaattctgatactgacacagtgtcaatctgatcacgatgcacccatggcccgggagtgggcacttctggctgtgcgaaacatatgcgaaggcaatcttcgagcccaggtgagggtacagatgaagaggtcgcaccgggactggaaccaatgccatgtcgcaggtctttaccctgcgtatgccccttgccagcacccatgtgacctctctgcagaacgacgtggggagcttgagaaaggtccaggcatcagaagggtctacccaagtcctgggaggcgttcagattgtcagcgaccaggcacttgggaagaaagtcttgaaggcagtctcttgaaattgcttccggcacttctnnnnnnnnnnnnnnnnnnnnnnnnnnaaaccctgcaaggcttcagtgtgacgtggcacgagagagcgcgagatcgtcggtccgaagaagcaggggcatttgcatggacgatgcaggacgtcctcgacgatccggacaaagtcttccagctattgcaccccctgggccggggatcatatggagcggtatacaaggccagggtaataagcacgggcgaagttgtggcagtgaaggtcatcccgctggccgcagacgacgagatcgagagcatccagagggagattgccatgctccgggactgcaagcacccaaacatcgtcaagtactatgtgagtggttgcacggcatgcagatctcagcctgatgctaggtcaacgaatacaggtcctcaccgtctaaacactctccggaacggcgcagggaagcgtcaagacgccggactcactctggattgtcatggagtactgcgccggggggtctgtcagcgatataatgcacgtgaactcgtccagtctctccgaggcgttgatcaagtacattaccggagaaacgctgaccggtctggcgtacaccgagacatcaagtgtggcaacatcctcctgactgaaaacggggaggtgaagctggccgatttcggcgtcgcggcccagctcactaataccatgagcaagcgcaatactttcattgggaccccacactggatggctcccgaagtcatccagataagccagtatgatggcaaggtggagcgaccccctccctccccttcccaggtcgatgtctgggcgctgggcatcacggtgatagagatggccgagcaggctccaccccggtggaagataaatcctaaccgcgttattttcatgatagtcaaggatcctgcgccgcgtttgtcggattctgagcgctggagtctgacgttccaagatttcattgctcagtgtctccaaaaggaaagcctcactcgcccccgttcccgatcactccaggacgttctcttgcggccgaccgccaaatttctgcagcagcacaggttcatctctgtggacagagccagtgtcttgcagctactcataccaatgatacagaggacacgtgcatacatgagcgagcttgcagctgcggctgctgctgtgtccggggataccattggcgctggagggaccattgcgatgcatgcctcacctgccaggaggcaggccgaggcagacacattggcggctgcatataccacgacagtgcttgcagacaagaatatccatagcagtcccggggagaatttcggcgcaggcacctttctgcgacatgacttgttccagggaacctcggcggcaatgcagtcttcccctgctcctgtgcagagaggtgaccttgctcacacaagtggtgactactcggctgcactgagtgccatgtcggacttcgacaaccttgacctcctgccatcagtacaccctccttgggtgaatgcgcatggaaaggtgagtgctgagccttcacacatctcagcgcctggtgctcgctgcaggaataaagatacctgcaacattaccccaccctgcgcagtcggatgtacaaaggttgaaggagcgactgcataccatatacactggaggatcggtcgtacccctccccttcctgcgagcaagcgatgcgttcccttcagcactcctgatgaagtcttgggagtctga

SEQ ID NO: 7154 - DNA, 777 bp, Chlorella protothecoides
atgcaggcccaggcggtcaagatcgtgctggtgggcaagtacgtcgagctgatggacgcgtacctgtcggtcaccaaggcgctgcagcatgcctgcctggcagctagcgtgaagctggacctggagattctggagtctggtgacctcgagcccgtcacggccgactcgccccacgatgaggcagcacaccaagctgcctgggccacgctcaggtcggccaagggcatcctggtgcctggtggctttggcgggcgcgggacggagggcaagatcgcggccgcccagtatgctcgcacgcatggcgtgccctactttggcatctgcctgggcatgcaggtcgcggtcatcgagttcgcgcgcagcgtgctcggcctggcgggggccaacagtacagagtgggaccctgcctcccccgcccccgtcgtcgtgttcatgccggagatctccaccacgcacaaaggcggcaccatgcgcctgggcatgcggcgcacgctgctggagaccaccgactgcgttgccgccaagctgtaccaggcggagcagtgggtggacgagcggtaccggcaccggtacgagatcaacccggagtatgtgccgcagctggaggaggcggggatgaggttcgtgggccgggacgagaccgggtcacgcatgggcattctggagcttcgagaccacccctactacgtcgccgcccaggtgagagcgggacgggggcacctgcacgacgcacgcttgggtcgaggccgggcccaccatgtggcgcctggagtctga

SEQ ID NO: 7155 - DNA, 1419 bp, Chlorella protothecoides
atgccgctgcgtccctgcaacccctccaccccggccttcagccccgtggcgctgtccgtgacagcccggggccagggccacagccaccacgccggggcccgggaccctcgccaggccctgcccccgaaagcccagggtcgcacccgtgcccttccaggcctgagcccctcccccggcacccaggcccccgcccctgacgaggaacaggcccccatccagaagcccaggggcatccagacggagctggcctacctgcgccaacgcacgcgcatcatcacccaccacttccccagcgccctgggcgtggacgacttcatgcagcgcatggagattgcgctgtacgcctttggcttcagcggcgacaacagcatcgccatggtgaacctgtgccgcgacgaggtgaccttgaccctgaagcagaagatcgaccaggtgtttggatcctccttcaacaccaacggcctgggcggggtgctgacctgcggcgtgagcggggtgcgcgcgggcttgtcccatgccccggtctccaagggctccggcaaggagcggtacgtcttcttctccttcccccacatctccatcgactcgcgcgggcggcagggcaccatctcccgccccggccgcccggggcagtcctgcgcctgcggcgcgctggacggcgcgctggccgacatccggcgcaccggcctggccgcggcctgcaaggtgccaggcgtgcacgaaccgttggacccggagatgaccatcctgaagcagcgcctggcgcggcgcctgcgctacgagggggtgggtgaggagggcgtgcaggcgctggacctggtggccatgacccaggtggcggagcgcaccatcaccgacgacctggagtacctgatctcccagaccgtggaccccgcgcgcgccgactacgccgtggtcaccggcgtgcagatccactcctggggcaccagcttcgacgacgacgcgcccaacctggagttcgtcgcaccctccaccatcgacgtggtgaccaacgggtacaagacccacgtcgacctgctggccctgccggcgctgaccccgcgtcagatcgcgctgctggcggaggggcccgagtccggcggcggcggcgggggcggcgcggggccggcccggccggggcgcccgccgtcggtctgcaacagcgcgggacacaccacgctgcgggagatcgacccgccctacatgtacgccagcgcggcgcagcgggaggaccgcatggcgcgcatcgccgcctacgcccaggcgctggggcccggcgccggcggcgagggcgacacctgctcctggccgggctggcagtcgcgcctgcgcgcccacgagccccaccgcgccgacgactcctccatccacatcgaccaggggtaccggctgcacgcaaccgtatcgttgaatgaatga

SEQ ID NO: 7156 - DNA, 261 bp, Chlorella protothecoides
atgatggaggagacgtacctgatggagctgatcaaggaacagctttgtttcgtctcccaggacccccagaccgacttggtggcctcgcgtggcaaggcctcccggcacaggagggtctatgtcctgcccgacggcgtgtctgacaagctgggtcacatgctggacgaggctgggggcgagaccatgcccatccaaaaggacacggtgaggggagtgctcggtggtgctggcattctgcctgctgggcaaatgcctgtgtga

SEQ ID NO: 7157 - DNA, 423 bp, Chlorella protothecoides
atggagggagagccgatcgtcgaccagggcggagggacaaccctgcccgagccggggaagcaggccgaggccatcaaaaccacggaggccaagtgtcgggaggcctcgggcgagcctccccggcccctctccccatgcctccacacaatcgttcgcaggtggttcacagcctggtgtcagcacacaggcttcacgtacaatgaggcgaggcagcgtgtctccatcatccgcccgagcagcccgggcccaaacccgggccccattgacaacagcgacctgctggcagagtgccagcatcctgctcagtccaccctggacgaggaggaggctgcaggggtcaccacactccgctccggactggtggagaagaagcacttttgggcgttgtgcgagccgacctgggagctcctgaaaggctggtga

SEQ ID NO: 7158 - DNA, 213 bp, Chlorella protothecoides
atggccttccacccgggaggcgacaagatgctgctggcggtggcgggcaaggacggcaccgccatgtttgacaagtaccacccctgggtcaacatcaatttcctcatgtcggcgtgtgtggtgggtctgctggcgccccccactcctggccctgcgggggtcgagtgggaggacgacgcgccggcgcaggagcataagcccgatgatttatag

SEQ ID NO: 7159 - DNA, 222 bp, Chlorella protothecoides
atggacaatgggggctgcacgatcaaggtcggtctagccggcgacctgtcctccctcaggatgatcccgaattgcacagccaaggtcaagggggagcgccaggggtacatagccgacaccgtcctcgcctgcaaagatgtcctctcactggtggtcagaaggccgatcgaccgcggctacgttgtctcctgggatctgcagcgcgacatctggaccaggtga

SEQ ID NO: 7160 - DNA, 1215 bp, Chlorella protothecoides
atggggtctctgtctctctctgtgacgccctgtagagttgctttgctctggacacgtgaatatcatgggccattgtctccttggacatgggcaccacggctcccaagactgaaagtttcgcggcatcccccgccgcgcaggcctcggcgcatggtgtccctgggcaaggtctctgccccgaagccggtgaatctcccctcccagcgcaaggagaacaacggcaacgacccgtccatagacctcgtccgcaagtctgccaacggcgggtggggcgccgcctctggcgcgcccgagtcccccaccgcctcctcctgcagcgagcagcaggcagcgaatctgacgtccgagccccgatccgcaaacggcgagggcatcccttctgcggtggcgccctcccgcgtcattccagcaggacccaccccggcctggggtgggctgggcatgcccgaggagcgaaagatctgctggcctgcgcagcctccgttcgcgttcgccggtcgcttctcgtgggatgggtggccggtgactgcgcctgccagcctgtggagccagcactcaagccttcaacacactccccaccccatcgcgcagagggccatggagcaggccagccgcgagcagttccccaccctgggtctagatgtgcggggcccccacggccccaactcctccatgggctgggagggtgacgagcgcggctatgtcgccccgcccggcgacgaggacggcggccaccgcggctaccggcgcggctacggccccggccccggccccgacggccccggctaccgggaggccccccacgggcgggactggtaccgcggcggcgagggctacgctcacagtatgcggccgccccacctcaacgaagacgccctgccgcgctgctccggcggcgtccgcgagcggcggctggagagtcaggacttccggcgcacggaggagtacgtggagcagtatgtgcccccgcccccgccgccccctcgggtcccgcagccgacgcacccgcgcggcggcgaggcgttccccccctccttccaccaacagccgacggcaggggcggcgacggcagggcggggccccggccccaacgccccctcccacggcgtggtcgtcccgccgccgccgccccccgctgccccccgccccgaccgcacgaccagcggcgagagcgggctgtcgcacgacacctccgacggcactgcagccagcagc

SEQ ID NO: 7161 - DNA, 519 bp, Chlorella protothecoides
  modified_base (355)..(364): a, c, t, g, unknown or other
atggcgagtcgcaatcgcaaggaggggtccgccgaggagccggtgctcagtctgcaattggactcgagcacagcggggctggaaccgagggaggtggatagcgacagcatcggcggctttcaaacaccctgcacactcaagggtctctctgcgggcgcgagcgggggagcgctgggcttcgtgttcggctttggtacgcagcagagtgtcgggcgggggagcctgcctggactcggtgacttgcctcgtctgcctgccggcccgctgcacacacctctttcacctcctccaatgctaggggggtattggtttagccaacgcttaaaaggcaacctacgtggctcgttggcggagnnnnnnnnnntgctgcacacacccctttcacctcctccaatgctagggggctattggtttagccaacgcttgaaaggcaacctacgtggctcgttggcggagggatggggatcggccaaggtacgagtcctgttgtggtgggctcctgttgtggtgggctcctga

SEQ ID NO: 7162 - DNA, 1392 bp, Chlorella protothecoides
  modified_base (918)..(927): a, c, t, g, unknown or other
atgagagcgtgccggcagccctgctcctccggtgcaccatcctctgatgcccaggctgagcccacaccctccgacaccctgcaggctgcacctgccttcccagacacctttccccacatgtttggggagcggaaggacattcggtgggtgccggtctggacagggaggtggggtatgggcgggggccgatatgcaggctggggcttaacccgttggcacggcaagcgcctgggaagcagcaagggctcctgggcccagtttcccatggccctgtcccggtgcagcagtgtgcggcccacacagcgctgtgctggcgctctggctttcagcatgtgcacagcagtccgacgtcggaccactcatgtcgacatgcaccagccccgcctgctgaccctgcagtcgtccctcaaaccccaccttcctcctcggccccaggtgcctcgtcccctgcgccatcgaccaggacccctacttccgcatgacgagggatgtggccccccgcctgggtcaccacaagacggccctcatcgagtcctgcttcttccccgccctgcaggcaaggcgggcttggtgtggggggaatcctgggactgcaggggtcatgagggccagccgatcgctcccgtccacctggtacacgctcatcctcgcccccatgcccgtgcccagggggagagcggcaagatgagcgcctccgacaccgcctcggccatcttcgtgaccgacaccgccaaggagattgacaccaaggtgaagaagtacgctttcagcggcggcggcgccacgcgggaggagcacgagaagaatggtgaggcttgcggtgtcgcagctgtggtgtgggttgccaaggttgttcaggtctcatggcaccctccagggcgcatggcccctacccgtgctcctctgcagcacagtgtnnnnnnnnnngtggtgtgggttgccaaggttgttcaggtcccatggcaccctccagggagcatggccccttcccatgctcctctgcagcacagtggggggggctgggcctccacatgcgctcttctcacatgcacgttgggcctcgatcccctcctcctactgtcacccctacccccctgtccattccttcttgccaggggccaacctggacgtggacatctcctaccagtggctccgtttcttcatgcaggacgacacgcggctcgaggagatcgggcgcgactacggcgcggggcggctgctgaccggtcaggtcaaggccgagttggtgggcgtgctggcggcgatggtgcagcgacaccaggccgcgcgggcggcggtgagcgacgcggtggtcgacgccttcatgacccctcgcgccatgcccgacctgttccccccccggggctgacggtgcttggggtcccgcactag

SEQ ID NO: 7163 - DNA, 1002 bp, Chlorella protothecoides
  modified_base (139)..(148): a, c, t, g, unknown or other
  modified_base (781)..(790): a, c, t, g, unknown or other
  modified_base (883)..(892): a, c, t, g, unknown or other
atgcctccttgtacagctgaatcagaggctgcgtggtttgtcactggatcgagattggagacgaacgtcacaacatggagttcggctgcaggcatggcactctgtcgatgggacaagaaacccgtgttgagcgattttnnnnnnnnnngcttttatccccgaccatacacgttattgagcaattggagggaaaaaatcgggtccaaatgtgtgtttgcgtgctccttgtgccaggttgagcgatctccatgcgggaggtacgtgcacatcagcgtgaaggacccatggagacctctccccaccctctgtctcagcgcgctcaatcggccactagccgaacatgattcgactagcccaatgtccgaacacccacccgcggagcccgagacctcgcaggcatcagagcaggtggtcacgccctgggatgtgaccgccgacagcgagggcaagatcaactacaacaagctggtggagcagtttgggtgtcagaagatcgaccctgagcttgtggctagggtggaaagggtgacgggggtgaaggcccaccccttcctgaggagaggcatcttctttgcgcacaggtctgagggtggcgaaggcggggttggaaggaaggcgctggttttgtctctgttgccaggcagaatggatctgacggagatccttgatgcctatgagcgcggggaacccttctacctgtacaccggccgggggccatccagcgaggctctccaccttggtcatctcatccccttcatgttcacaaaatggctgcaagacnnnnnnnnnnttcaccttggtgtggcagaaagggtggtctggactcctttggctctgagttacaccattgagttgcaacaccgaggtgcaacacccacctcgnnnnnnnnnngccttcaaggtggggtccgggtcttctcattagacgttcttcattgtagttcagatggagagagcaagtgcccctttgtgatgttattcgcatcagctgtcactccataa

SEQ ID NO: 7164 - DNA, 426 bp, Chlorella protothecoides
atggggggcctgtacgctgccgtgggttgcttcatgcagcgcctgcgacaaagagaggacgcctggaacggtgccgcctccggctgcgccaccggccttgccctgggctgggccaacgggccgctcggcgccctccagtcctgcgccatgctgggggccttttcctacttcatggacggcatggccaaggtcccgcccgccgccgcggcgcagcgcacggccggcgggcggggtcatgacggcgactgggcgcggacgcccgaggagcagcggctggccagcttccttgcagctcccttcctgcaccccggcagggcccgcagcacgctgcaggccgtgctcagccccgccctgcctctagctgtcatccttgcgccctgccaccccgcctttggcggctgcaggcgcgggggccccgccgtgtga

SEQ ID NO: 7165 - DNA, 1287 bp, Chlorella protothecoides
  modified_base (413)..(422): a, c, t, g, unknown or other
  modified_base (524)..(533): a, c, t, g, unknown or other
  modified_base (1238)..(1247): a, c, t, g, unknown or other
atgcaggccaagtgctcccccaacccactccgttctccaaccgatccctcgcagatgctgccgacctcgtcccggagggaccgggtggccagcaagtttgtggagaacgagtttgagaaggtggaccggctggtggaggtgtacctaagatacgagcagcgtgtggcggctggggaagaaaggtgggcttgggggaatggggaagggcagggtgttgaagctgctcgctccattcccagacgtcttggaggcgatggacgaggacgaactccttctggcacgcatggaggccgggttgttcactttgcagcaggtggagggtggaaagggaggacgtggaatgggtctacgaccggtcctgtgtggcagaggggatggaggacgcccgggtactcgccccactgttctggcannnnnnnnnngatggacgaggacgaactccttctggcacgaatggaggccgggctgttcactttgcagcaggtggagggtggaagggaggacgtggaatggggctatgaatnnnnnnnnnntgtctccatactgccatgctttccacctaccccttcaggctgcgctggtgctgggctctctctggctgctccaggaggaggcgctgaggaagcgggtgctcatgctgctgcaccagaagtcgcactcgctggcggccgtgcgcagggtgctgctgggccgtcgcagcgccctgggaggggatggctccggaatcctgggagaggggtggatgagcctgtcgcggagcgtgccactggccagcgctgcgccatgctgagggcgctgggacatgtggatgcaccagatggcgctgtggctggaggtgcagaggcggccaccccggggcagaacggggtcgatgcacccgccgccgacggcgccagccgcgacgacgtcggtagtgcatcagaggcgggaagggaccgcgaccctccttccgctgtacagtgtggggctggggctatgcctgagcgcgaccctcatcgcggcagtgccaggaccgatggccctggcgcgggtgaggcagatgatccggcagagccaggatcgcgcacgatcaaagaggaggggaggagtacggacgccgtatctccgtcccggcatgggcggcactcccgcgatgagcgtgggcgctcgccgcacgagaaatcgatagcccgccgcgtcgactcgtctgtgcagggtcggcgccaccgcagccgcagccgagacgacgactcccccgnnnnnnnnnnatcgcggcagtgccaggaccgatggccctgccgcgggtga

SEQ ID NO: 7166 - DNA, 1293 bp, Chlorella protothecoides
  modified_base (949)..(958): a, c, t, g, unknown or other
cgcgcgggcgacgacgcggtgcgcgccgccgccgccgagctgctgggcatcctggtgcaggcggggggcgagccgcgcgaggcgctggtcgccggtggcggcgtggacgcactgctgcaggccgcagcgccgtacagagcgcgcgcggcagaggagggcgaggagcaggagtacctggagaacctggtgaccgcactctgcgccctgctcgccctctccgccggccagcgcgcgtttgtcgagggggaaggtggtggtgggaagcggagagggctggccgcttggcgatggcatttcaagggtgaatgtgcggagccagggtggtgtctggagatcgtgtggggatccggagagggacagccgcttggcgatggcatttcaggggtgaatgtgcggagccagggcggtgtctggagattgtgtggggatcgtgaagaacagtgtatcctgggaggccccatggtatcttgctcactgttccacttccgagcgggccgccccgcccctggccacgcatgcgaccctggggtcgtgtcgagatggcgaggcattgctgctcccggtggaattcgaggcagccccaccacccctccttgcaccatcctgatgcccaccactttctccctctcgtcctgcaggcatcgaactgatgctgctcatcctgaggggcaacagcgctgccagagtggccaccctgcgctgcatcgactttgccaccaccaactcccagcccgcctgcgagaggctggtggacgccggcggcctcaagtccctcttcggcatcttcatgggcaagatcaaggcatgccggtggacggtggccgtggtggacggggactggcgttgactggggtcagcagtgttctatgcaggttgcctggtggaggcctggaggagtgggaagttgtaggccagatccccaatgtgaaccagaggagggctcctggtnnnnnnnnnncggcatcttcatgggcaagatcaaggcatgtcggtgtacggtggccgtggtggacggggagtggcgttgactggggtcagcagtgttctgtgcaggttgcctggtggaagcctggaggagtgggaagttgtaggccagaacctcgatgtgaaccagaggatggctcctggcatgctgacccgccacacacctccctccgcacgcagacaaagaaggcggatgaggtggatcggcaggaggaggaggagcggtcggtgtccatcatcacaaacctgttccaggtggggcggggggtgtggcttggggtgcaggccgcaaaggcaagcattttctga

SEQ ID NO: 7167 - DNA, 1962 bp, Chlorella protothecoides
cgacgaggaggcggacagcctggagggcgccgggtctgagggcagcgacctgggggcgggcgcgcgcctgcacgggcatgcgacatacatgcccaacctcggcgcgggcgtgccgggcatctccgccacacccgccagcggcgcggtgcaggacatgaacccccaccacaaggtgggggtggcagaggatgccttggtgtgttactgtgctcctgaagagtatctacccacccttttaagttccgtatcgttggctcacgacatcaccccaccacaccacaccaccccccccacacacaccacgcagacgcgccagctccagttcctactcgtcgacatcctgcgcgagtttgcggcggcctacggtccgctggtggtcatcctggaggacgtgcactactttgacaccgcctcctgggtcctcttctggctggcctctaaggagctgccgcgctcggtgctcttcctggccacgctgcgccccgggtttgctcagcccgccgccagtctgcgcgggcaggaccgcaaggcggtgctcctgcgcaaggtgcgcgaggcctacaaccgcctgctgcgggagcccaccacgctgcacctgcagctggcgccgctgagcgcggccgagacgcgcgagttcgtggcgcaggccctggcgggcatccgcgtgcccgaccatgtcaccgccatgctgtgggagaagtccagcgggcacccagccttcctggagcagtttgtggtgttcctgcagtactacagccgcgtggcggcggccgcgctggccacgggcgcgcccgcggagtcggggcccagcaccttccagctggtgtcgcacggcatggagttcatccgcaacaccgtgggcatccactccatcatacaggacagggtggaccgcctggcgccggagtacgcgctgctgctgaaggtggcgtcggtgggggggctcaccatctacgtcgacctccttcaggcacgtttgctggcggcgcacccgcagtcgccgagcctggagtcggtgcttgcgggcttggactacctccagtcccagcgcttcgttcagcaggacgaggtcgacgagaacctgtggcgcttctgccaggtgctggcgcgggacgtggtgttcgacatgatccccatcacccagcggcgcgactggcacgggcggctggcggcggccatggagcgcctggcccccgacctgcccctgcccccctccaccatcgcctaccactggctggaatcgtgcgcggggcttgaggtggcgcagtggccacgcgcgctcaaggccatggagtactgggagcgcgcgggcgtggcggccgtggacgcgggcacgcccgccgaggcgctcaaccttttgcaaaaggcgcaggacgtggcagaggtgctggaccgctactttgcaacacacacgcgcagcgtgtggatgatcgccggcggcgaccgcggcggcggcctgccggtggtgccccgcccgcgccgcatccactgggagcgctgcatggcggccatgggctggggcgcgggcatcacgcgcgaggggaccacgcagtgcatggtgcactgcctgcgcggcctggcgctggcgcgcgtggcgctgccctgggaggaggcctacctgtcgcaggtacgctggcgccggcgcctggccatggactggcggccccgctcccgcctcctccgcgcctgcttgggctactccccggagccggtgcacgtcgccttcgagcgccgcgtggccatgctggaccacggcgggaacggggttggtggagcggggggcagcgtgctcgtggggtgggcatggcagggcacagggggatgggtgaggagggcaggaatggctgccatgccctgccccgtcccgagagcggccgggtttatttcgagggtgcatgtcgatgccggtctacgggaatgggcttcctcccacccctgcatccctgaaagaggcgctgagta

SEQ ID NO: 7168 - DNA, 804 bp, Chlorella protothecoides
atggcgacggcgtccgtgaggccgaccgtggtgcagggcaacggcgccgccttctctcactctctgcgcccgcccaggcaccaagcacacgcatggcggcaccagcatggtgctcgcgatggcgagcgggccccgcgaacatgcatggtcgcgcaccggcacaccctgcccccgctgtcggccttccaccccttgctggccaccgcagccgacacgggcgactttgccgctcccgagcacaaggagtttgacgtgctgggctggggccaggccatggtggacttttccgcccacgccagcagcgagtacctggaggagctgggggtgcagagcggcgagcgcaggctgatcgaccttggccggcgcacctccctcctcacgcagctcagtgagggcgggtatgcggtgcacgccgcgggctccctttccaacaccctgctggccctggcccggctctccgacgcctctgcacgcctgcatggccgcccgcccctgcgcgtgggcatggccccgctgctcggctccgactcactgggcgccttttatgctgcctcgctgcgcggcgcggggctgggcctggtgggcgacccctcgccgggctccagcacgggcacagtgatcgtgctgacgggggaggacgcgcagcgcaccatgctgtcctacctcggccacgtcccggcgctggaggtgagcgacgagttcgcgcgcgccatccgccgcagccgactgctggtcatcgagggttacctgtgggagatgcccggcgccgcggcagccatcgaccaggtggggagtcgccgttga

SEQ ID NO: 7169 - DNA, 558 bp, Chlorella protothecoides
caagccacttgcattgcagtggcatactctgaaggccgcctcaggtcatacttgtttcccatcttcccacaagcaggcatcgccttcgacagactgttccagctatgtcgtgagcagttcctggtgtcgaatgagacactgctgtcctccttcctcaccgagttccgtgaccatgatctcttgaaggccaggtatggggacgggcagaatcgtgttggaagcacagggattcagcaatggagtgcttggggaattgttgacatgtgtcagacctcctccctttgcaaccccgatgtccaggagaacgacggaagggttcgatctgctgcacctcccttttgcaccagatcacctgcagcagctgctggaagaccttgtgtctcttacttgaactcatgtgtattcaacagctgtgcttcgtccactgaccctatgggcttggttaccgtaatgccgaaagtcacgggaatggagcacgaagaatccgatgaagtacgtagtaccgggctgtcaggctgtcaggaaattcctcagaggggtgcagcgcctgctagttga

SEQ ID NO: 7170 - DNA, 948 bp, Chlorella protothecoides
  modified_base (555)..(564): a, c, t, g, unknown or other
ggggacccttccgcccccctgaacctgtcgctccaggatctcttcaggtatggctgggagtgtgtggggcctgaaggtccaacttggttgggtgtgggtgtgactgagggggtcgccctccacgctgtgggcgatccactgtgctggggatgcgacggcaccccagcggctgcagcagaggccacgcaggatgagcccgcctcggatgtgccaggtgtgaggaggcagctgcatgtcgatctcggggtgcttctgggtgtgcaggccgggcagtcccctctgcaggccgagcagtcccctttgcaggtgggccctggcttgcaattccttccagcttcctgttggccagcctcctcccccctcaatgcactcctcccaccagcgacgccatcgccactggaagacatcttgggggttcagcccggggaccttggctgggccccgggcccggggtcgctggcgcccctgaccaacgacgcccccgtttccaagacgcatggcgccccgctctgggtctcgagcaaccctgtccccgacctggcccggcgctgggcnnnnnnnnnncgttccaagacgcatggcgccccgctctgggcctcccgcagccctgtccccgacctggcccggcgctgggcggcactggcccccggcctcgcccgcacctggcccttcgagctggatgtcttccagaaggaggccattgtgcacatggaggcggggcgcagcgtgtttgtggccgcccacacctccgcgggcaagacggtggtggccgagtacgcgctggcgctggccagccgccacgccacacgcgcggtgtacacaagccccatcaagaccatcagcaaccaaaagttccgtgactttggcgcggagtttgacgtgaggagggatgtcagggctgggtcctggggggcaaagggagatgttggcggtgatttccttggctag

SEQ ID NO: 7171 - DNA, 369 bp, Chlorella protothecoides
atgctgcccacccctccgctcccccccccaaatgcctcgccctctacccctgccgccacgcaggtggaggacatgctgcggcgctcctttgccgagttccatgtccagaggcggcagcccgagctgacggcggtgctggaggaggggcaggaggccctgaggaagctgcgcgcccgctcctggccacgctccccgctgggcacgacgcgcgaggcggtggaggcataccacgacgtgtgcgccgaggtggcgcgactggactccctggtgcagggggaggtggcgcagagccgcgccgccgcggcagcgctggcccacggccgcctggcgctggtcacccacccgggctcgggcctggtcggcctgggg

SEQ ID NO: 7172 - DNA, 333 bp, Chlorella protothecoides
atgggggtgaacgcccccgccaggacggtcgtcttccagtcgcttcgtaagcacgatggtcacagcttccggccactgctctccggcgagtacacccagatggcgggcagggccggccggcgggggctggatgcggtgggcaccgtcatcgtggccgcctgggacgagctgccgcaggagggcgacatccgccgcctgctgacgggtgggtttggggcatggtggagcgagctcagccacgcgactggagagccagttccgcctgacctactccatgattttgaacctcctgcgcgtggaggacctcaaggtgggtcagaggatggctgttga

SEQ ID NO: 7173 - DNA, 1227 bp, Chlorella protothecoides
  modified_base (974)..(983): a, c, t, g, unknown or other
atggatagaggggagccggtaccggtgaggccacggcgacgcgttcaaatggagtgcgcaggtcgctccagctctcacgaccgactgatgtctctgcggcatgcagttagaagcctgctggcgctgcatgtggcggccaccaccggtccttgcacgcagcagctgttggacaccggcacgtcctccaacctggctgccaacattgaccccgatagcccagccacagcctgcagcatggcggtctgcacctcgaccgagctgggtggatgtgcctctgcagccaaggagaacctcatcctggtcatgtctgacgagttcaacaaggacggcaggggcctcgcggtgtatcagaacgaccccctgtggactgcagagaatgtgggagagctggggttgcggggccagggaaggaaggggctgggccatgggatctggatcttgtgttttggtgcgcaaggggacactcgaggcaccccgttgcccaaacccctacctccttctccaactgtccagctctattaccaaccgacatctgacatggaggtgtacactgctcagcaggtcgccactggggcttcccgaggtgcaaggctcgataaacgactggactgtgctcgatcacaggcccttggaaaaccccattcgcaacacgatatccacatcctgccacagctctctcactcaatcactcacacggcttgcaggcgggtcgctggagatcaccatcaacaagggggtgggtcagggcatctcccaggcgccggacggcagttccacatctgtggccatgccctttgtctcaggcatggtcagctcctggaacaagttctgcttcacaggtttggaggggccctggttcctagcctggggactggccagcgaggacagcctttccatgtcctccagggctgctgtgccttgatgggagagggtccggagcttacaatgagcaggtgcctggctccctaccctcnnnnnnnnnntgagcatgcctttatgaatgaagctgccgcgagcctgaatataatcagcgggtacctggaggtgtcggcagtcatgcccggcgacgacttctattccggcttctggccagctacctggatgatgggcaacctcggccgggcaggtgtgcgtgctgtgctgtttggatcgaatgcaagggtgcacgctgttgtgtttgtgactgcgcgggcctggggccccgtccggccagccctgcctctggtc

SEQ ID NO: 7174 - DNA, 1218 bp, Chlorella protothecoides
atgaagcgggtgaggcagcatgctggtcccctcggggttgtccccgggctgcctttgaacaacccacaccgccaatcattgggagcccaacatcccgtgccgcaaccctctgcgcagtaccctgacgccgacgtgctggcctccagcgacgtggtcagcagtaccagcaggaccgaggacctggagggcccagcctccagccgaggggtcgccaacatcggcatcatgctcttcaggcccaaggccctcgcctttgccaaggtgtgccacgtgggatggcgggcaggggcgctggggtggtgcaatcgctgcatgggagggggtggggccatggagggctcagcacaccccgtgggcatacacgaggagggcggccgggggaaaggcccgaaggcttctgcctctgagcgcgccattcagtgccacgcaagtccaggggctcctggtggcaggcgccccgggtccgtggcctggacagccaaacctctgcctcaccccatgctgaccccaggagtggacggaggccatggagaaggacgaaaagtattgggaccagaatgccttcaacgacatcctgctgagcgatgcccaggacgtgccggggcggaccgacaacctgctcaagtacgcagtgctggaggccctgtgggggggcgttggggtcaaatggtggtggttggggagggtgaggtggcctggcgtcaggctcggcgctgccattgggaggtgcccacgcgcactttgcagccctcggcttctgggcattgggcgtccaagaggatcagtccctcccagcaccccgctcgccccgccgccgccgcgaatccagcccgatcgcccgccccacccgcctcgcctgcgcagggcctacaagggctcactcctggtgggcattctgcccgtctccatcttttgctcgggccagacctacaaggagggcctgttcaggaagctggggctggagccctacgtcatacacgccacctttcagttctcgggcaccgccgggaagcggcaccgcctgagggagtggggcgcctggaaggtgggccgcaaggggggaagggagggatggcggggagacacggtggggggcgtcacgcgtgcagggttggcgcgccgtcgaggggcggtgcactgctggcccctgtgcatgttgcagccccgctccttgactttgcccactgctggtcttacccccagaacgtcctgccttga

SEQ ID NO: 7175 - DNA, 687 bp, Chlorella protothecoides
atgatgctccgtgctccaccgcatatcccacccacccctccactccactcaaccaccagggagctcatcgagcccctggcgcaggacaagtacataatggtcacttgggccaactggcattaccgcgactttgtggggaactgggtctaccacctgaagaagacggggtgcagcgcatttgtggtgggggccatggacgacaagctcctggcctggctgcaggagaacggcatccccaccttcctcatgaactcgggcctgcccacctccgattttggctggggaagcaagtccttcttcaagatggtgagctgctgcttgctggggtggtgtggcattgcaagggatctgcgtgcagcaggtaggcatgccgtaggatgtcaggcatttcgctccgggatggggccagagggatgtgcttgcggccgccgagcgaggaattgcgaggctctgtgtggaagttgggatgtgctggctgaattgggtgagaaattccatcacttgtgtgcaaaagcatacctatggcaatactggcgtgcaccctcgaccaccccatgcaactgcatccgcttgaagccctgtcaccaggcgtgtcacactgccgccatcaggccccgcacctctcctcccttcccagggccgcgagaaggtgggcctggtgaatgccttcctggcaatgggctttga

SEQ ID NO: 7176 - DNA, 621 bp, Chlorella protothecoides
atgtccatcctgaccccggggtcggtggccaacctgaaggctagcgacgccttttccgaggccgtgacgctcaaggtgggtggaaccgcgtctttggacacaggatggcacgatggcttggaaaaggatatggaaacccacccccctgcattggcccatttggcgcaggtccaacagctgcaggagggagtgaacggcaagtacaagtgccagttctccgatggcaaggagaacatctccggcatactcacctcccagtctgcccagcgagggccacgcctgtacagcccatcgcactgctttcctcctcctgcctggcaggtcggaaagcgacatggcgcacagctgaaggaggatgatgtggtgtgcatcacggaagccaacatcagctccatcgaggacagcaaggtgctgattgttgctggcatggacctggtgggtgaccgggagccatcctcaccggcccctgctgcacccaaggccgaggccatcaagcccgaggtgacgcgtgtgtggcagcggccgggccatgcgagttcttggaggctgatgagggccagacattggaggctgagttggattgcgcggtatcatccgctgtcttctctggctgctgggtag

SEQ ID NO: 7177 - DNA, 1269 bp, Chlorella protothecoides
atgacaacccggtgcaccaccccacaggctgccacccccgccccgctcagccgcccagccgcaagcccctacggcgccccagcctccgccacgcccatcaaccacccaacccctccctccgccggctggtgggtgcaccagcgggaacatgtcggtcctgctcatgcggcacttgtggggccagcagaccatagggtgcaggggcctccatgctgggcttccaatccctcctcctctccagccaaacctccactctctccggcacagggcgctgcgcaatgggggtgccaccccccggaccatccagcccatcggcgccctgaacccctacaacaacaactgggccatcaaggccaaggtggtgtccaagggccagaagcgcaggcaagtggaccgccggtggcgggccgggcggaggcatggctgcgtactgtgttccatggtacacattgcaggcaactggtgcccatgcacgtctatcttgccattgaccagcttgcgaccccggacccagtcccagtccgaccccgagacgggactcgcacgatccctcgctcactccatcccataccgtccgccctgtacctcaaccctgactcttccccctttcctcatcacctcgcagcttcaccaagaacggcgcagccaccagcgtcttctctgcggagctggtggacgaccgcggaacgagcatcgaggccactttctggcgcgaggcggcagaccgctgctacgccgcgctggaggaggggcgggtgtacacgctggcgcgcggcgccgtcaagcccgccaacaagaagttctcctccgtgcgcaacgactacacgctgcactttgacgccggagcggaggtggagccgtgcggtgagtcagcatccgatgggcggggttgaagctcgatccatgcctgcccatgcgctggctcccctgggcgggaagcgagctgcgctgtatacttctccgcccccaggcccttgccgagccttgccccaccatgagcgccctccaacaccccccactcacccacacctccccatcccctgctccattgcagaggacgacattgatgtcagccagatgcaggccaagctggaccccgtgcccatcgagcagctggcggcatttgccgacaagaagatgaccgtcgacctccttgccgtggtttcgtcggtggggccgttgggcagcgtcaagcgcaaggtggacgccgctgagctggcacgccgcgacgtcacccttgtcgaccaggggtgcgcgcggattggctga

SEQ ID NO: 7178 - DNA, 567 bp, Chlorella protothecoides
atgctcagctgtatgtctgtggcgcgtgcgcgctggtttccttgtccatggcgtagctgtcttcccgttcaattctgcacttcccgcgcgcaaactccaggtcgcattgcagaggcagaggctcagcaccctccacccgttgcctgggcttcggatggattgcctgacggcagtcccggcccatcacagcgctacgccagcaccagcgcagatgaggctggggatgtcggggccgttgcatcggcctggaagcatgtaaaggcagtctccagtcgcgatgagggaaggtctagcgacctgtgggacctcttgtcgcacagccttcgagagacccagtactcgccagctcccccagaggtgatggctggcagggagggcatgaaggcacgcaggcagggcatccgaacccagttacatggcataaccttgtggctgagtatgtgttcatggtgttcccctaagcataccaggagccttctgccactgtcccctagccaggggtatgctggaaggagggcagtcccccctctaaccaagggcccgctgccgtgctccctccccctctga

SEQ ID NO: 7179 - DNA, 444 bp, Chlorella protothecoides
atgtgcctggctgcaacaataggctcagcctgctgcatgtgtgctcccatcgctcgccgcagggagctcttgcaggctgctcacgaggagggcagcctggtctcctttgccatcgacgaggcgcactgcgtcagccagtggggccatggtgggtggatgatgtgtgtgtgtttaactcggtacaagggtctggctactcaccctaacaatgtcatgcacggttccagtatatggctctgctcgaagctcgcagttcacaccaccacagacttccggccagcctacctcgagctcgtcaaccttcgcacgctgtgtcccggagttcccgttatcgctgtcaccgcgacggcaacctcacccgtgcaagccgggattaaaggtgggggaggtggagatgcttctcacctctctcttaggggagcatggggtggtcggtgtggatga

SEQ ID NO: 7180 - DNA, 408 bp, Chlorella protothecoides
atggccacggccggtcatgagattggtgacccttccgactgcctgcgagcccattggggacatgccgagtttcgctctctgcagcgcgaggccgtcgaagccacgttacagggaagggacgtcctggtcatccttcccactggcggcggcaagtcggtgacattccaacttccgccactggtggctcggggggtcacagtggtgatcacgcccctcctggccctggcccgggatcaggtgcaggccgctctggacaggggcatcgaggctgccatgtgggcgggggacacgtcggacaccgcccgggctagcatcagatcctctgtgctggccgggaggggtgatgaagggggtctgcgcctcctgtacaccacaccagagagcctccgcacgccccctatgaggtga

SEQ ID NO: 7181 - DNA, 1020 bp, Chlorella protothecoides
  modified_base (993)..(1002): a, c, t, g, unknown or other
atggcgagtgggttcgtgtatgccgacacctccaagggcctgtataagctattccataaatctcactttgcccttgcgggcctcgtccccgctaccttggccttgccgtccgatggcttcccagccaagctcgcggacgtgggtctcgcggcagtcctccctctccacagccacgttgcgatgaacagcggtgagtggaacagcacgcagcgcgcccgctcaagatccgagataaattatgttgcttcaatggagttggtaccagggtctgggtttaattgcggaagtcttgctgtgctcatcccagggtctgggttcaactgcggaagtcttgctgtgctcatcccaggtccacatgcactctgtgggtgtgggagagtttgcctcccggctgtgccttggacgcgtggtcgaaacccctctcccggacctctcccacaaacagtggtgaccgactacgttccgaaggctctgcagctcccagccagggcaggcgtgattggactctcggccgtcacattcattgggttgatgaagctctctctcacaggcgacggcattggcgggaccgtgaagaaaatctgggctggcaatcaccaacagaatcgacctgtacacaaagccaaatgtgtcctcaagatgatgatgcaataccgtggaaggggtgtgctggagccaagactgagatgcatagcacctattaagctctggacgatggctctcgttgctgtacacaacatgcaagacccggtgaactatgaacaccatgctccagcatcatctcagcaagggtccctagccttcgaaaaattgatacctcctgactatcaatgtccaatgttgccagcatacagcgtagaggggaagcagaatatactcttgttcattcaagcctcacatgcagctccattcacagcgtttgagagggctgtcagtccgaagtcccaaagtgtgaattcggtggggaatgcttacaatgatgagaaggcaccnnnnnnnnnngaagatgatacctcctga

SEQ ID NO: 7182 - DNA, 1398 bp, Chlorella protothecoides
  modified_base (31)..(40): a, c, t, g, unknown or other
atgcaggcccgacctcgccaggcctccaccnnnnnnnnnntcggagtactgctcccaaagaacgccatgcaggcccgacctcgccaggcctccacctctggcgacagcagcccatctagccagagtggtcccgatcttgcggccgctacgccacaacgcgctgctggcaagaccctgagttcccgggcagcgtcttatgcgcgccttcccgccagtgcctcatgctcggagatgccctcggcagccctcccggctgccacccccaagtggtacagcaaccgggtgtggtgtgcagcggccctcttcgcggtcctcgtcctgtgcagcctcaatgttgccaaactgatgggcacggcgcattctggagtcgaggtggtgaccgccgccggccaaggtcgaggtggtgaccgccgccggtcaagggtccactctgcaggtgagaagcgggtgccggtgattcgcatctggcttactctgccagagctgggcgggtggagtgagcatgccatgtgctgcatgggatggcaggcctgcccatgccccatgctttttcccaggtgtgcactgacaagccgcctcgtccacgatcgccaggtggggaccctggccggccctgccgatgctgccaccagcgatggagtggagtcgggcaagttctcaaacggccccgctcctacgacggcaagttcactggcggattcgatcgtggcgacgctgagccagttcacaaactccacctccaagtccatccgggagtggatggtggtggtgcctgcaaacagcaccaatgcgacggaagccaaggctgcggacactcagggtgaggattgccgtcaggatggtcgagtgggatgcagctgggccggggtgggatgggagggagccccagtcgcaaatggtcgagcagctggagtggggtcgtcgagcggggagtcaagtgacttggcgagggtgctcagggattgcaggtcccagctctggtgtcctgctcccctttgggaagcccctctcggggaggggcggtcatgtcagtggtgtgatgaagggagggttcatctccaaatcccttcctattctcatctgtcggagactgcagatcccttaggaatcccttcaacacaatcctcagattcactcaatccccttcttgccgcaccgctcgcaggggagcccgagaaaaagtttgttcccgcagagctcccgccggccgaggtttggagcaggagcggcgacgcctgcgccgacgccctcaagatccccaaggtggcgatactcttcctgaccaagggcgacctcttccaccacgccgtctggcgcctctggttccagtcggcggcgggcgtcctgccccgcgcgccggcgcacgccgcggcctgcgcccccggcgccgcgcccggc

SEQ ID NO: 7183 - DNA, 618 bp, Chlorella protothecoides
atggtgggcgccttcttcgccaccaacgcagggtccagcacgttttatggcgtggaggggtggcgcttcgctttcttccttgtcgccgccatttccctgggcacggggttcctggtgctgcacctggcccgggacccgcgccacgcctccggccccgggtttggcgaggaccccgtgccgctgccgcgccagctggcagttctgcagcgcacggggagcgggggcatcggcgagccgcggccgccgcgccctccccacgacgtggtgaggtacggcccggagagcctgcaggcgcgcaaggcggcgatgccggaggagggcccggacctgccgggctacgcacccctcaggatccccgagggctgggccgcggtggctgtgaatgggtgggctggggtggcggggcgggtcaggcagggcgcccccgacggcctcctgtcgggcctccacctgcctgttggggcagggacgcatgcagggcaggcgctccgtgccgcccaggccccagccgcccgccataatccccgtgtgcagctccagtggattcaggagcgtgatgagcgaggtgcggctggtactgggcatccgctccttccaagtcatgatcctgcaaggtga

SEQ ID NO: 7184 - DNA, 657 bp, Chlorella protothecoides
atggacgagggcatcctgcctgcagtctactttttcatcgggcgcagcctggacgccaccctgccccagctgggggccctcaccctctgcagggccatcgtacaggtgcgtgcttggggcctgtcgcaccatgtttggccttctttgaccctgtcccggggaggggccgcgccatggagtagccccaggggatcccatatctccccagccccgaccccttcccacaatccttcacccctccaccaggcgctgtcctcccccatcagcggcatcctgggcgacagatgcgatcggaccagggtggtcacagccgggtgcctgatctggggggtgagcggccgtgggtactgccgggacggcgggtactgcacacagcgtgtggtgcatggaccggcgcctgacctgccccgtgccgcgtcgcgcagcaccgcaatcgccagaccccaccccggccctgcgcacacgctcggtgcaggtgatgacggtggcggtgggggtgtccacctccctgcgccaggccatggtggcgtgcgccttcaacggcatgggactggccctcgtgatccccagcgtgcagagcgtggtggcggactgccacccggccgagcagcgcggccgcgcgttcggcctcatgtcactcacgtccagcctgggtga

SEQ ID NO: 7185 - DNA, 1254 bp, Chlorella protothecoides
atggtggggggccacgtgggcgtggtggcggttgactctggcgccgcctcaggagccagtgtgtcgggctacacgctgccctcctacaccgcctcgcgcgtgaatgcggccaaggggtctctcaccctctccgataccagcgccgtcgcgttgtccggtgcgtgttcgtttgagggttgggggcaggaagggggggaaggaggggatggcaagccgcaatttggccgagctgggcgggtgaccaggactggcctggggatgagaaggagggatcattgttttggtgacctgggcgaatctcatctgtgcatgcctgcagccccatttgccgggggtccacccctgcgtggcttgtggtcctcagatgctgacttcaaaacgtcctgctccaccatcccccaccgcatccccccttttccctcccaccgcccagacggcacgcttcgcgcgacgtggtccttccccctcaaccagaccctggctgaggcggaggccgccgagaccgggttcatctacgccatcgggcccctggccggggcaggcgtgctgggctcccacatcagtggcaacggccacccctacggcggcctggccatccagctggcctcggcgggcgcggccagccccgcagtcgcgccctcccccgggagcgccgcctcgcccagcccctccgtctcgcccagccccgccgcctcgcccagccccgccgcccagcccagccctgccgcctcgccctcgcccccgccggcagccacgctttcctgcacgctggtcgggttgtccagcggcgcgggcgaggagtttgggtcctgcgcctcccttccctccttcggcagcgggttcaacctgttctggaccgcgcgcgaggcctcggggtcaaacgcggccacggtgacctggggcatgaacaccagcgccagcgacggctgggtggcggtcggcttccccgcctcgccgggggagatggtgggcgccaacgccgccatcctgtcctcctgccccacctgcgcctcgggggtcaagctggagggctactacctggccggcaccagccaggctgacgtccagcccccctcccgcatccagctctccgacatctccgcctcgcgcctggatggcggcggcatggcgggcgcgttcactgtgaccctggcgaccagcggcacggcccgccgccgcggcctgctggccctgggcacccagcccatcatagtggcgtcggggcccgtgggcgccgacggctccatccagtga

SEQ ID NO: 7186 - DNA, 642 bp, Chlorella protothecoides
atgagggtaccggcaacccagcagtttgacgccccatcggggacctggagtgccactgctgagacgcccagccccgtctcctggatcgtcctggtcgaggacggggtgcaggtcgtgcgacaggctgtgactggcagcactcctgggcggggttctggggtgctgctcatcgtgagcggtgacaaggtgctgtccagggctgacagggccgggcagcgggctcccttcggccacacgtctgactccagctcaaggtcgagccgccgccgcctgctggccaccggcgactgcaccctggacatctcgggcaccgcccactccttcacggcctgccagagcgtggccaccggcttcaccgtctacacggcgctggaggccggcgtcggcggcgtcgccgtcctgcgcatcggcctggaggcggccgcctccggcggctgggctgggttcggggtgtctgccaacggcgacatggtgggggggcaggtgggcgtggcggccaccgaccccggcgtcccctcgggcgccaccgtgtcggggttcgtgctgccctccacctccgcccgccgcgtgaacgccgccaacgggacgctggccctgaccggggccagcgccgcggcgcggcccggtgcgggaggagtctga

SEQ ID NO: 7187 - DNA, 519 bp, Chlorella protothecoides
  modified_base (319)..(391): a, c, t, g, unknown or other
cgcgaggccgagcgcctgcaggccgcgcgcgacgacctggcctcccgcctctccgccgccgtggacttccggtacacgcctccggacccgcgcttcgacgcggcgcgcgtgcggggcgtggtggccggtctcgtgcgcgtgtccgacccgggcgacgccaccgcgctggaggtggcggccggcgggaagctgtaccaggtggtggtggacggcgaggccacggccaaggcgctgctggcgcgcgggcagctgcgccagcgcgtgaccatcattccgctggaccgggtggcggggcgcgcgctgccggaagccgtggtgnnnnnnnnnnnnnnnnnnnnnnnnnnnnnnnnnnnnnnnnnnnnnnnnnnnnnnnnnnnnnnnnnnnnnnnnngcgccgcggccgcgcccgcgctggagctggtgggctacgacgccgacctgtcggccgccatgcgctacgtcttcggcaacgcctttgtctgcaaggtttgcagggtgggggggggagatggagagtga

SEQ ID NO: 7188 - DNA, 240 bp, Chlorella protothecoides
atgtctaatgtgggtttaagaagatctgactatggaggcaagacgattgtggaccactcacaggtgtgctccaggcaggatggtctcttgacagtgttcgccccccacatcctaccccaggaggagggagacgtcgatcaagaggcaggaatgctcagtgaagacgtccgttccaagggatatgcccttctatgtgtctcacaaccgcatggcaatgtcaaagttcgcatcatccccgag

SEQ ID NO: 7189 - DNA, 411 bp, Chlorella protothecoides
ggccgggcgcggtccgcccccgacgccggcgcctggatggcgccagggtcgagcgcgcgggcgctgccgcgcgacgtcgcctgggtggcgctggccggcctcttctacgccctcgctctctacgtccgccactcggtgtacatcgcgggcgagcactactccgcgccctccatcgtgctgcaggtgctggaaggggcagggaggggcgaagcggtgtcaggttgcatgccgatgcatatctgcctgcagggcccagttcgtgccatgcagtgcgcgactcgatgcccacccccgcacacctgcctgccggagactctgcgtctcccactaccacccccattgatccccgcgctcacccctcatcccccgctcgcagacccggcagcgcgacggctccatcaaggtgtttga

SEQ ID NO: 7190 - DNA, 1248 bp, Chlorella protothecoides
  modified_base (108)..(117): a, c, t, g, unknown or other
  modified_base (928)..(937): a, c, t, g, unknown or other
atgcccggcctgcactgctctgcattgcatttggttcagcatcgtcaagctgaccctcccctcctcacgcacatgctcgcagtggggcgtgccatggccctcccagannnnnnnnnnctgcgtttggttcagcatcgtcaagctgacctccccctcctcacacacatgcgcgcagtggggcgtgccatggccctcccagagaaggcctcctccgaggtcttcaggtccctcgatgtggagtatgtgtttgtcgtcttcggcgccttcatcggggcctccgtggagatctcaccaaagggttctcatttaggtccagcagctgaccttttcccctcgacgccccccctcccgccgtacccctccgacgacatcaataagttcctgtggatggtgcgcatcggcggcggcgtcttcccggacatcaaggagcgggactacctgaacaggggccagtaccgcgttgacagcaccgcccccaaggccatgctggactccaccatgtacaggtgggtgcggagagagacatggggtggaagagggggcgaagctaccagggtccagaccgcgtgcccctgggcgggctgtgtccctccagccgctggcatgcgctgctatgcccttgacacgtggttgcaaggcaacggacggcatggagatgcatgcagcgtcgctgtcgtactatcgctttgcggagacggggcccctgtttgggatgccctacggctacgaccgcgtgcggcagcagaccattggcctgcccgacttcaagtgagctgcgtgaagaggggcggggcgctgtggggagcaggggggtgctcaatcctacatactgtagggggcactggcagtgcaatgcaatgtgcggcggacgctcaaatgatcctcatgtggccagttgaggctctcatggcggcggtgcgacccaccnnnnnnnnnntgacttcaagtgagctgcgtgaagagggcggggcgctgtggggaggaggggggtgctcaatcctacatactatagggggcactggcattgcattgcaatgtgcggcggacggtcaaatgatcctcatgtggatagcagaggctctcatggcggcggctgaagcattacgaggaggtattcacctccgagcactggatggtccgcgtctaccgcgtgctgccggagcccaaccgcgaggtccgcctgccaaacccaaacagggtcaaggcgcagcgtggtgccaaggtcaaacccaggcggccctctggtga

SEQ ID NO: 7191 - DNA, 1785 bp, Chlorella protothecoides
atgcaaggaggtcaaggaatgcatgctgaatctcacggaaagcgtcagcaaggtccccagcgccaaggaccccataggctgttgctgctggggcacgaccggcgccagattctccgacacgacacccatgtcccacgtcagcgcgctttggcgcttggtcacgatttatcaaagatggttcctgccgcatgcccaccaccgcatcgcaaccctacagaggcacctggcctcgaccgggaggtgtgtgggtgtgatgggcctggtgtgcacaagaagtacggcgggggctgcggcgtgcaccctcgcgggtcgtgtccaccccgtgtgggtccgcggtcatgtgcgcccgcggcgggagcccagatcccgcacgacaagcatgggtgtgatggatccaggatctcagatctcagaccccgccctcctccgctaacccgcaggcccgccgtggcgggtggccccggcagcctgaccgtggtggacaaccgcacgggcaggcggtacgagatccccatcagcgaccacggcaccatcctggccacggacctgaagaagatcacggccggcggcgacggcgtgggcctgcgtcccttcgacaacggctacctcaacgtcaccgcctgcaagtctgcggtgtcctacatcgacggcgacaggggcgtgctgcgctaccgcggctaccccatcgagcagctggcggagcggtccaccttcctggagaccgcgcacctcgtggtgtacggcaagctccccaccgcgcccgaggccgcgcggtgggaggaggcggtgatgcgccactccgcgctgcctgtggccgtggaggctgcgctggcggccctgccccacgatgcccaccccatgggcgtgctgctcacaggcctggccgcgctgtccacctgccacccggagcagaaccccgcgctggcggggcaggccatctacgcctcgcgcgacgtgcaggacaagcagatcgtgcgcctgatcggcaagatccccaccctcggcgcctgggcctaccacgtcgccagcgggcggcgccccgccccgcccaaccagcgcctgggctacgcggagaacttcctctacatgctggacggcggcgcgcggcccaactaccggcccaacccgcgcctggcccgcgcgctggacgtcatgttcctgctccacgccgagcacgagctgaactgcagcacctccgccgcgcgccacctggccagctcgggcgtggatgtgtacaccgtggccgccggcgcggtgggcgcgctgtacggtccgctgcacggcggcgccaatgaggccgtgctgcgcatgctgcgtcgcatcgggcacgtggacgccgtgcccgggttcctggagggggtgaagaaccgcaaggagaagatgtttggcttcgggcaccgcgtctacaagaactatgacccacgggccaagctcatccaggccgtggcggaggaggtgtttgacatcgcgggccggaacccgctcatcgacgtcgcgctggcgctggagaaggctgcccgcgctgacgactactttgtgtcacgcaagctctaccccaacgtcgacttcttctcgggctgggtgagggaggagggaggtttgccctgtgcccctggtgacaccgtccaagcaggggagggggcagtggcttcgttgggacaccacagcatgtgcggcagggctcgagacctgcatgtcaggtcccatcgggcgttgcacagagccagatcgacccttttggaacccaatcctccacgccaaggcctgcctctggtcgctccctga

SEQ ID NO: 7192 - DNA, 1377 bp, Chlorella protothecoides
  modified_base (111)..(120): a, c, t, g, unknown or other
  modified_base (338)..(347): a, c, t, g, unknown or other
atgcatctagagtccgtgaccacccgtgttgcacagtcgccactgtggacgccctcgtcccgacagcagtctgtgcgtttccaggccggatccaggatgcagagacctcannnnnnnnnntggccattgacgacactcgtgctgcaaagcacgcgcgacacgcgagcacaatggccgtctaaggaacccatctgtggagcagacgtacccaccatgccgaaactacatgctgcaaacaagctacaaccatatacacggcatggggagtggcggctggctagcaagttcgcgcagatatcagccacctatcattcccctgtgagatctacactgtcgtnnnnnnnnnntgccctcgtcccgacagcagtctgtgcgcaagtttacgaagttatcaccaacccatcattcccctgtgagatctacactgtcgtcgcttgggaagtagaatcccccatcttgccagcacctcccactccatcccaaatccagttgatggaggccaagcaccccgagtcctgggtcaagtttgagctgggccacatctcagagcaggatctctacgacaacttctggaggcctggggctgccggtgtgccctttgatggggctgcgctccgtgagcacatggtgagtggcgcccgttgcttgcatgcctgcatgctgttgtgttcctggatgcagatgtgctggttcatcaccttgtactgctgtgacatggctgggctgttctttggggtgagcatgccacatcatccacagagagtgagcattctcagagctgcttcaacaccgcatgcaccagcctgcagggcagaggcatcaagcagccgtctgcagcctcatccactctgcaactcttcctatcgcaggcctcccggtacagcctgctcccagggatggccgagctgctgcagcgtctggccgccgccggctacgagctgcacgcctgcagcaattacccgacctggtggcgggaggttgaagcacgcctccgcctcggcgacctgctgccctggaccttcctcagctgcgaggggcccatgcgcggcctgcgcaagcccgaccccgccgccttccaggcagccgccctgcatctgggggtcctgccggcggacctccttctggtggatgaccgggaggtcaatgcccaggcggcacgggttcacggcatgcgggccgtgcgctttgtggacacgggccgcttggaagaagagctccaggccgcgggtctggaattctgagggaacgcctgaaacatcgcgtgttgctgacgcctgctgccggttccagggcatgggcttggtcgtgacgaccccttgcaaccttgccattaccagtctatgttggcccgccgctccttcttcttgtctgacttga

SEQ ID NO: 7193 - DNA, 1119 bp, Chlorella protothecoides
  modified_base (937)..(946): a, c, t, g, unknown or other
atgaacttgatcttgggccggctcgccgctggcgcgtgggatcgctcgtgcgacggggtgggttgcctagcacggacgcaggtctgcgaatggagaggcacgggagggatgaggcgcgtgctgcgcggtcctaatccccaccaaattgctccagcgcaactgcagagcgataagcctgcagtccctttggaggtcccagggcctgcacctgccgtgtcccagccccgccctggtgctggccaggtgcccgatttggagctgccgcccgcgccagccgctgcgatgcatggccggtacaaaggagccggaggtgccccccgtcaaacgcataggcagagactacaactccccacctccctgtccctgctcggtgcccatgcagatgacgtccagattaagtttgcgaggagctcaggcgccggcggccagaatgtgaacaaggtgaacaccaaggtggacatgcgcctggccctgggtcgggccgactggctccaccccgatgtgggtgccgcgctgcggcggctggagcacggccgcatcaacaaggagggggagtttgtcatcacatcccagctcacccgctcccaagcgtgtgttggtgttgatggggggtgtgaagcggtccaccgatgcccgtatgaggctcgccgatcaccccaagggagaagaccatcatcacacgccaccagcttcctcactcacgcattgacccgcagggataacatcgaggatgcgctgcagaagctgcagcaggccctggatggggcctgggagagcatccagcccatcgaggaggacccggccaagaagaagaagctggagaagcagtgcgtcttgatgggggctcaaggagtgggcgtgccttgcatctgcctgtggcccactgcacgcctgcctgcgattccctttttcagccgaatgagcacttattattttnnnnnnnnnntggagaagcagtgcgtcttgatgggggctcgaggagtgggcgtgccttgcatttgctcgtgccccactgcacgcctgcctgcaattccctttttcagccgaatgagcactcactgtttcgaatctccttcccctctccctccaggaagcagcgtggcaatgagagccggctga

SEQ ID NO: 7194 - DNA, 585 bp, Chlorella protothecoides
atgagcaagcagggccacggccaccggcgggacgatgtcatggtggcggggtcgggaggccccgtcaacctgcgtcgcctgtccgcgcgagtgtctgccaacctgggggtgcagagccccagggaccttttcgagggcatagatcttatacctgcgtcgaggctgacgaaggtgaagagactggccaagggatcctactgtgtcgtggacctcgccaggctcaggaagccgggcgtcggggaggaggaggacccgggcatcaaggtggccgtcaagcgcctgcgtcagtccgcctataccgagagggacatcacatgctttgcccgggaggcggagctgcttctccagctcgaacactttcggggcatcaccaagctcatcggcatagggtgcgagcgcagccgatccgacatgatgtggcccagcatgttcctcgtcatggacctgctggaggcgcagatggaggacccacgcattgtcctgtacaactacgaggatgccatcaagtgggcgaggcagatcggctccggcatatccgaactccatgcacagaagccgagggtgggtttgagtggcaggctgtga

SEQ ID NO: 7195 - DNA, 327 bp, Chlorella protothecoides
atggcaggcacgccgcaggtgatgggcccgctggaggccatcctggacgtggcggcgcacccctcggacaacatcgcctccatgtccttcaacttctggcaccgcctgtcgcgcgtgctgacctcgggcctgcagccgcagcccatcggcagtgggggggcgcaggagggcgcgctggccccggaggagtcgcggcggcgcctcgccgtcttcgcgcccgtcttcgagcgcctggtgggcctggtgcgcggccgggtcaggttcccggacctcttcgactcctggcaccgcgacgagcaggccgacttcaagcgcgccaggtgctga

SEQ ID NO: 7196 - DNA, 429 bp, Chlorella protothecoides
atgggacgcctgaagcggcgctcgcacatctcgcgatcagcatacccgggctatgagccttacattgttggttttgtcaagctctgtggtaacacccactccgcgctccacctcctttcgctgagcagaacaatcatccctggcgccaagctgagctacgaccccgaggacgtgttcagcgccgtctccgacaccagcagttactgctacctgccgcctgaggtgctgcgaaaggagtcttacgacgagaaggtggacgtgtttgggtttggcatcatcctgtatgagctcttcatgaagcggtccttggtggcctactttgacggccagaacaaaaacgtgtccaccgccgcgtccgagtatgcgcgtcaggtgcgtggcagagccaaaggagtttggggggttgggacagggcgctggctgccgtga

SEQ ID NO: 7197 - DNA, 1449 bp, Chlorella protothecoides
atgcagccccaggtggccaccgacttcagggacgcggtgctcgggggcgactggtccagcgccctggccctgctcccctccctgaccgccagcgagggtgacgcctcccaggcccgcttcctgctcactcgccagaagtacggcgagtgcgtggcgcggggtgacctggccgccgcgctggccacgctgcgctgcgagctggcgccgctgggcgtcaaccgccgcgtgctgcacgggctggcgggggcgctggtgggtgcgcgcggcggcggcggtgcgccgcgcgcagcgccgccccgcgacgcgctgctggcggagctgcagcacctgctgccgccctccctgctcatccccgagggccggctggaggagctggtggagcaggcgctggtggcccaggcggaggcctgccagtacgtgaacgcaccgcacccgcagcagacgctgttcgccgacttccaggcgggccccgagcagctgccaacgcgctgcagccaggcgctggacatgcacggcgatgaggtgtgggcgctgcagttcagccacgacggccgcttcctggcctcggcctccaaggacggctgcgcgctgctgtggcgcgtggcgccgagcggctgggtcacctacgcctgccacctcacgcgctcctcctcccccgtcaacaccgtggccttcagcccggacgacgcctgggtgctgaccagcggcgccgacggacgcgtgcgcctctacacgctgccctcgggccggctggcgcacgagtgcagcttcgccgccagcgcgggcggcgagtttgcggtcaccgccgccgcctggttcccggactccacacacctgctggccgcgctgctggacaaggcgctttacgtggtggatgtgcgcggcgtgacgcagcgcaggctgaagcagacgcagcacgtctacgactgcgcggtcagccccgacggcgggaccctggtctccgtcggccaggacaagcgcctgcgtttccaccgcctcgccgacggccgcgaggccagcgtgggcgaggcgggggccgtgacctgcctcaccccctcctccgacggcgccttcctgctggcaaacctggcctccgccgccatccacctctggcccctgggggacatggccctgcccgcctcgcccgccgacggcgaggcgcagggcgaggcgccccccgggggccaggcggccggcggccagggcagccccgacgcgccacgccccggcgacccgttggaccacctggcacaggcgccgctgcaggagtaccgggtgggccaggcgcagcacgggcgcttcgtcatccgctccgcgataggcggctaccgcaacaactttgtggccagcggcggggaggagggcgccgtgcacatctggcaccgtgagtccggcaatctgctcgaggtgggttgctggggtttccgaggggaagaaagcctggggtag

SEQ ID NO: 7198 - DNA, 1038 bp, Chlorella protothecoides
atggcggatcaactcctccaggccgtgcacgccctgtaccagaaccccgaccccagcgtgaaggagcaggccaacgcctggctggacgcctggcagcagtccccggaggcctgggcggtgtcggatgcggtgctggcccggcccgacgcggggctggaggcccggtacctctgcgcccagaccctgcgcaccaagattacgcgggactacgaggagctgcccccctccgcggtgcccagtctgcgcgacagcctgctgcgcatgctgttggccacgcgcgacggccacgccgccacgcgcacgcagctgtgcctggccctggcctccctggcggcccacctccccgccgaccagtgggcgccggcgggcggcggggtgctggcctgggcggaggccgcgctgctgtccggtcccgtccccgcctggccgctggcggtggagctggcgggcatgctggcggcggagggcgccagcttccagccctccctgcgccctgcccgccgccgcgccttcctggaggagctgctggccgcgctgccgcgcgcgctgggcctgctgggcgccgcgctgggccgccccggcgtcgacgccggcgtgacgctggacgcctttgctgcctggctgcgcctgggcgcaaccaacggcggcgtacccgccccggcgctggcctccgccggcgcgctggcggtggaggccactgtggagctggtgtactgcggcgcggcgcgcggcgcgccccgccccgagctcgccgatctggctgggcgcatcgtgagccgggtcatggccctgcgcccgcgcttccacgtctgctgcgccgccgcccgcgccgaggcgggcgggggggtgccgggcgccgacgatgacagcgaggaggccaaggccctggcccgcctcttcgccgaggtgggggaggcctacactgagctcatagccacgggtgagcggataggggagtgggggggttacccacttttgatttggggtgtgtctcgtatctgggcatcgagtgggtggggcccggaacgcagcggctga

SEQ ID NO: 7199 - DNA, 1671 bp, Chlorella protothecoides
atgggaggtatccactgcataaaaagtttatttggtgctgtgtttgagaagctgtcaaacgtgcgtataattgcgagcggcacatctggggcagagcaaaatgtggctgtgatcatctgggaactgatgagaaaggggccggactcaggcagcagagggatgctgctgaacaagggaacggcttggcgtcatcctgggccccaaaagactacagcggacacccccattgcacgtcaaccatggtttttggcttggaaccaactgaatccgcctctactggcaaccgagccgaatgaaagcctcttgcggtacgtacgagctcccgtgtggccactacacggccaggcgctgtcgacaaatggcgtggtcttcactgggcagccctccgaacacgatcaccgtcgagtcgcaaacacatacctagcctgtatgtgcgccgggtcgccggtgttcggctgggcatgcttgcttgtcccggaactggggcagaagtcagggcgcctccctcgagatcttggacgcggggtttatgaggtgggggggcgatgtgcgtcagctcaccacgctcaaatgtgtgtccgcaccacagcatttcccaggacttctgtgaaattgagacatttaggaaggctgaattctcatctgagtgctctcgcccgtaccagccgcacttttgcgcttccatcgacgggtgtgacctctgggtaccgagtccccagagcatggtcggtgcgtcccgtggaacgcggcgcgagcccccgcgctgcctccctcgacctggccctgccgtatccggctcgcacttcagcttccaccaccccgaaagtggactgggcgggaactgttctcgccccaagtgaggacaacgcgccgtcccgagtcgtgcaggtaggcatgggtggtagggatggggcagggggcgaaatttttggtggagaggtgggccatgtccgaactacgccgcaccctccagcaagccccgttctccgcctccttacgccccagattcattctcgcgccgagtttgatgacttgctcgccgccgacccggagcggttggtcgtgctcatgtgcaaggccttgtcatgtcgcccatgcaaggtaggccttcaagcggaaatacgaccgtgcgtcgcgcaagtatggcgacgtcctgttctgcgaggtctttggggacgagtcgaaggagctcagggtgagacttggcgtctaggtgtgggggcttgtgagcaggcagtcatgccgactggtaggatggcgatgccagtgcacccaagctgcactgcagtggaaacgaggctgggaagactgcggcgctgcgtggcatccctgcgcgctttgcgtccgccgccgccacattcgccctgctccccgcaagtggcactcccggtcctgcaggcacccgtccccatgcgcagcgccttgcctctgccaaattttcaccccctcaccctctcccacccattcacagggcatgatgatggatgcccaggtgcgcgtcaccccgaccttcatcatgtacagggccggcaacgtcgtgcactcccacgtggggatcaaggaggacaagctgcttcaagccctgcaggtgggccgacctcctgcaccagcctcgttggagggtgcagcgcactccccagggcgcccttctgccgatgcctcgacctggct

SEQ ID NO: 7200 - DNA, 978 bp, Chlorella protothecoides
atgaaatcttgtccgcatctctccgtctgtataccggtgcctcaatgtctcaagtggtcgtcactgtcccctggtgccggtgtccagcgtccctccggagattccggtttaggcgggaagtcaggtagcaaggacgggactttgaacgcctattcactagcgtgggcggcagtggatcaggaacggaaagcacggctaggcacggcagaatccagtcgtagcttaatatcgtgtttatggagcatcgatcgcacgcgtgatcactgttccatccggaacgcattgggttgtcgccaagtcgcaagggatggcctcctcacgacgctttactctggctctcagcctctttctcgcactctattcggcgcagacgaccgtgtctccatcctccccgcactgcagacggcgagccccccatctcctcccagcgtcgacacctgctccattgatcatgcctggagtgcgaaggcagacgacaattccatcatactcagtttgcgggtcagaacgagtgtggtggcagactatatcagcttcacattcagtttcgagggaggaccgaattatcatgtacagatacatcccaccgccacaaacgtgaacgtcgagcaccgtgcagtcgacgttagcaccacatcaaaaggaaccgtcgttgcggtcgccacgttcaaggatggtactgaagccacgtcgaaggccattgctctggcacccttccctccaccaccgaagaagaacccccctccctctcccagaatgagccccagttccccacctgagaagaggccccctccccaaactaaaaagtcaccgcctcctccagcgagaaaggcaccccctccaccacccaagaagaagtcgcctccaccacccaagaagaagtcgcctccaccacccaagaagaagtcgcctcctccatccaagaagaagtcgcctcctccatccaagaagaagtcgcctcctccacccaagaagtaa

SEQ ID NO: 7201 - DNA, 723 bp, Chlorella protothecoides
atgcacacggcgtttaccgcgcgagtagtggccatccccctgccccgccccttccgctgtgccggccctgggccccgctcccgggctcgtggcggactgcttcgcggctcggacaagcgaatagaggtacctgagtctgtgaggccccaatgggacgcctgcgccgaggctctagaggtcctaggactggagcgtaaggatgccgacaaggcgattggctccgctttcggctggggcaagaagaagaaatactggcagggagccaagcaggacgaagtcccggatgtgcagcgattggcagaggcactagagttcctttcgtcggtcggtattgccgctccagaagatcaggggaaagtggtcaaggacttcccccaggtgctggggctgagtcctgatctgatgcagcacaacgtcaacaagctgaagcaggcgtaccgaatgaagggctctgtgctggcgtcctctgtgaagaggaaacccaaagtgctaggggccatcaccgattgcgagggcgactatggctgggatgaggatgggtgcatcaatcttgtccatgttctctctgccgctgcaccaccctctgaagcccatgtacaatccttgcacaacaacccaattctcctgtacatacagagaatggtatcagagcttacagaggtacagctgctcttggtcagactgaagctgccgactgatggttccgttctatgcaggacctga

SEQ ID NO: 7202 - DNA, 654 bp, Chlorella protothecoides
atggagtatgaggaggtcaggagcatgtttggaagaggccacgtctgcttccgggcgtgggactctgggacaggcaacccggaggccctcccgacgtggctactggcagggtcgggcctgaagaccaagaccaaatggaagaacagcgtggagagagccgcagatcgagcggcgaggctggcggctctgatcgagaagcatgggccccttgcggccgcagcactcggcgtgcaactcacgtcgccgcgggcgcgcgtgccagcacccccccgccccaaggcgccgccgcgagtgaagccggaacggcctggtcagcggcgccggtccttcttccccaccatcaggtccatccagaagtgtggggtctgcgctgcgtgcctgaatcccggctggaagaaagcgtgcctgaccaggagggcagagatggaggctctggcacagagcatactggaggctgatggcgcggaagagatccaggctgggccgggggctgaggtggacgagggggatgcggatctggccggcgaggaggaaggggaggatcttggattggcatctgaagacaaaggggaggctttggaaccattggctgaggaggaagggaaggcgcgagaccctgtggcgatgcatcctgaagacatgatacctgcgtga

SEQ ID NO: 7203 - DNA, 846 bp, Chlorella protothecoides
atggtcgcctacggcgctgacgagatcctcttgtggcacaagagggttgccactttccagcaggccatgagggctgtgctgggggatcgacgccgtactttcctctggtccggctccgttctggactccgtcataggcgccttcctgacccagaacgtggccgaccacctctccagcagcgccttcatgatcatggctgcgcgctttccacccgccgctgacctggcacgacacgaccactccgattcggtggactgggaggcggtgcgctgcgctgacaaggcccaggtgggatggaacggcatggtgtcgtggcggcggaccgtggctgatgccatcaagggtcgtgggatgcaaaatttcctggctgctaggatccacgactgcctgaaccacatccggagagtcaactgggcgcgctccaagggccaggactgggcgagcgtcggccatatttcggcgaagaaggaggctcagggccctggccttgagcctctgtcagttgcagcagatcaggagggtgccaacgcagggacagatccagggaaggccctggcggttgggcttccactggacctcgaggcggacgctgacgagctcgaggtggagggcatccctcgccctgagccgatcatgacgctgacgagcacacccatgcctgatccctgggacgaaccctgccctggcatggaggcccaggagctgctatccctggagtgggtgcgggacctgccaccaaaggaggcgcatgacttcctttcctcccttcatggtgggttgagtcgaggtccacagaggctcccacaaccttcaaaacaccacgttgccccttcctggcctctgtag

SEQ ID NO: 7204 - DNA, 981 bp, Chlorella protothecoides
atgttccccaccatcgaggcagcatgcgtggcggcggcggtcctgcgccgcgagacggcggtggacgcggtggagctcttcgaccgcccctccatccgcgagttcgagtgcaacgaggcggtggccaagctgacgcccgacatcctgggcgccgatggtggcgccgccgcgctgctggtggagtgccgggggcagacgcacgacgcgctgcacgcccgcatccgcgagatccagtgtgcgctgaagcgcgcggagctgccctttggcgccaaggccgacgcgcccatgcaggtcaccgactacgagttctgggaggacccggccaagtacaatgtctactgggatgtgcgcaaggggctcatccccatcgtgggcggcgcaagagagccgggcaccaccatgctgctggaggacgtggcctgccctgtggacaacctggcggccatgacgcgcgacctgatagacatgttccagcgctggggctacgacgatgcctacacctttgggcacgcgctggagggcaacctgcacctcgtcttttcgcagggcttccgcacgcccgaggaggtccagcgcttctcggacctgatggacgagatgtgcgacatcgtggccaacaagcacagcggcagcctgaagggggagcatggcaccgggcgcaacatggcgccctacgtggagatggagtggggcaccaaggccacggagctcatgtgggagctgaaggccctgtttgatcccgacaacatcctgaacccaggcgtcatcctgaacaaggacccccacatccacctgaagaacctgaagccctccccgccggtgaaccccctggtcaaccactgcatcgagtgcggcttctgcgagtccaactgccccagccgcgacctgacgctgacgccccgccagcgcattgctgtctggaaggagatcttcaggctggagaacctggagctgctgaccgacgagcagacgcaccggtga

SEQ ID NO: 7205 - DNA, 291 bp, Chlorella protothecoides
atgcggcaggtgctgggcctggctgacgtggcgcacggcgtgctcggtccctctttcctccagagcgtcacaggcctgctgaaccggtggtcggggcggctcgtgcccgaatggaacccctacatgcccaagcgcgcggccaacgtggacatgtcccccgcccagcctgagcagctggtcaccgaccgtggcatcccccgcaaggtggtctacctgcccgcctgcgtgacgcggatcatgggtccggcgcgcggcgacgaccagcagggtgagtggatacctggctcctga

SEQ ID NO: 7206 - DNA, 585 bp, Chlorella protothecoides
atggagctggcttccctgcgcagtgcgctggatgaggcgccggcccacccctcctctcggcccaccgcacccttcatccggggtgacggcgccttcatcgcggagctgcgggccaagcactcccactccagccagcccgagagccgacagctgctagccatcgcctccgccctgctggaggtggtgcgggaggagggcctggaccccacccccaccgccctctttgccgcggccatggcctcgctggagcgccccgacgtcgcccgctccccgcccctgctggcgggcatggccaccctcctcaactccctgctcccgcgcgtgcccaaccccgtgctgcgcgccaagttcgcgcccgccagcgcgctcctgcgcggcctgctggccggcgcagggaccgacgcgcagctggccaggcccgcgctgggcgcgctgtgccaggtgctggccgccgccgacccggctgactggccggccgcgctgccctcctttggcttggtgctggccgcctgcgccgacgcgcggcccaaggtgcgccgccgcgcgcacgcggggctggaggaggtgctggcggcgatgggcgcg

SEQ ID NO: 7207 - DNA, 1308 bp, Chlorella protothecoides
atgcgggacgaaatcagccccactccgcagaccgaggaggatcggcgaccggcgccgatgtctttgcaagacaacgtcctccccagcccaccttccaatgccgttcatggcgtgtgcagcaccctcctccagcccgcccatgcgctgttggaggctgtcgccagccaagccgctctgcccaaggatgaggatgaggagcctggaggggaccttggtcctgtgaaggaggacatcagccagctggcgcgggctttgcttggcctgccagaggacagcgagccccttgccaggcgccagcggtacaggcagctgtcccgccacgtgcaccccgatcgctgctcccacccggacgctcatgaggtgttctcggccctacagctggccctggaggtgctgcaggaggagatggtgcccgcccctgatatcgcggtgggggagcaggtgggctgcggcaaggaggatgctgggccccgcttccagagcgtggcggagctggggcggagcaatgatgaggctcttgggggcgtgcggaaccccgcccgtctcgtcctgcactgcttggcggtgccctggggcatgctgccgccgcgcctagcccgatacggcagcagccaacgccgggagcagcttcccctctttcttcctgagccgtgtgaggtgtcggcgcaagggagcaggactgcggcaaggatgttcgagcccgaagtgctgccgccagtggccggggctgagggcgcagcgtccccggtgccagttagacacgtagacatggaggttgatgctcacctggagaatcctatgagcttggcagccgagcaggggctggaggtccatgcaggggtggagactgacgcagtgctaactgcagacacaagcctggcggccgacgactctgtcgaccaggtcgacagatgtgctgcatgcttggaagaagcctcagacggtgcctcaccgggcaccatactggcatccaaggaggcagcctgctcgcctgccacccactgccgtggcatcgtcctcctcccagcgtcgacggccctcctgggcaggttcccgctgaatgggacctactttcaggtcaacgaggtatttgcagaccacagcacggtcaccaaccccgtagaggtagcccgagggagtgtggattatggtaatggttcttgcaaacgccatgtctatgacatgcccatgcggtccttgtctcgctgcaaaccggggaggggctcctaccaggccgagggtgattatggggacagcactctctactcccagccctaccctcccacaacccgtctccctgtagattga

SEQ ID NO: 7208 - DNA, 474 bp, Chlorella protothecoides
atgctgaagaccaacaagaatgggggggtgccctacactcccatcctccccctgctgcacgggctgaaggcgtccctgggcctgctcaacgcggagggcctggacaacgtctttgccaggcaccacaggtgtggggctgcaaggcaatggtgtaggctggtgccggggcaatgggggggtgttttcctcgtgcggggacatgcctctgggctggtgtcgcaaggcacgtgtcagatgacgtgcttgactcatgacccatccgccacatcttgcacaagccctccagccccacatgctggctcccttcctcccccgccatgcagactggcggaaggcacccgtgcggctgtcgccgcctggggcctgaagctgctgtgcagggagcctcggtggcagtcggacaccctgacagtcgtggaggtgcccgagggcgtggactcgcagaagatcgtcgacaccgcctttgccaagtga

SEQ ID NO: 7209 - DNA, 792 bp, Chlorella protothecoides
atgctggtcgccgcggggttccttgctgaggagctggcgcatctgcgcctgatgctcgaccaggcagcagcatcagacttgccactcatacccgccacgccccagctcctggacagccgggtatcttctctgagcagcgtgaaggagccggactgggaggtgcccctccctgactctttcgttccaggcggaggctggggcggcacgcgagtgctgctgtgctctggtctcctcggggaggcccaggtccagttgtggaccctgctccagaactcaggccttgggaccatctacctcgcggtgatctcccctggcaatgcacatgaacgcctgggagacgctgagtcaccctcctcctgtaccccgacactcctcaaacaggagcagcagggggccgaggcggctggcgcgtcccctcccgtgaacgccgggggcggcggctggaggtggaactcggcggctgcgccgggcgcgggctctgacggcttcgacccagggagcgatgaggaggaggatggggacgaggacgagggggagagcgatctggaggaggagagtgaggatgaggatggcgagggtgcagtgtttgacgtgctggacgccgaggcctccggatctgacgaggaggaggacgaaggtgatttgttcggggacgaagaagaagctggcgagccctgtgccggccctgtcgtcagcaggcagcaggttctggaggccagccagagctggggtgttgacaccgaggccttgctggccgaggtcgaggccaaggggttcaccttgacgccctga

SEQ ID NO: 7210 - DNA, 366 bp, Chlorella protothecoides
atgttggtactctttgcactgggccccccgcccccctcctccttccccctcctgaccatcctggcccctgccgcactccttttacccacgcctccccgcccaccaccctgcccccctccccgcttcacactcaggtacaacctgtctctgggtctggggctggcggaggtgcagggcaaggtgttccgcatcgggcatctgggcaacatggatgagctgatgctggctggcgcgctgggcggcgtggagatgaccttgcgcgacgtggggctgcccatcgagctgggctccggcgtgggcgccgcgctgaaggtctggcaggagggcacgcccgtcattcccacgcgcgaatgcctgatggcgtga

SEQ ID NO: 7211 - DNA, 597 bp, Chlorella protothecoides
atgaggaccagtccgtgggacccgcgcgagtcgctgccgctggagtacgcgcgcgtctttgcctttgacaactttgtccgaacgcaaaaaagggcgctggccgcggcgagctccgggcaggaggcggcggcccccgccggcacctatgtccagctgcacgtggtggcggtccccgccgacgccgccaagcgagtgcaggagcgcgtgggcgcctggagcgcgcgggtttgctgcgaggtggagggggcggacggaggctgcgcgccactgcaatcaccactcctgcttgccagacacctcgatgccgggccagctacatgtgctacgtccgcccacctctccccaatcgaccaatcacactcgcagggactggccagccccctcaccctcttcggcctgctccagcacgagaccaagctgtcggtgggccactttgccttgaccctggtgcccgaggcgcccgccccgttggcaaacaaggaggagctgctgctggtgactggggtcagggccttccgcgcttgccccgtcttctccagcgacgagcacggcgcggataaacacaagatggagcgcttcctgcaccctggcaggtga

SEQ ID NO: 7212 - DNA, 597 bp, Chlorella protothecoides
atggacgccgaccctgcggtcctggccaccgcggggccagaggagagggcgaatctggaccgggagaatgtgcccgaccctctggccggcgagcagacctggccgaccgaggaggtgggtgtgggtgttggggggcgggcgccggaagtggcgaggggccatcgtcccaccagcccggaagtctgctgcatggtatcgagccatcctgagctgccacccctccaacactctttgcccctccctcgtcaaccacaggagctggtggaggcggaggcggagcgtcgcgccgccgccaagctgaagaagcggcggctgccggccggcacctcagagtaccaggccgcctggatcctggacgaagacgaagggagcgagacggggagcgaggcaggggcgggctcggacgaggccatggaggaaggcgcgccggcgggcgtaccgctggcggaagacgatgtcgactccctgctgaacgggggggcggagggcacggaggccgacatggacgtgagcacagggggaattggcgggatggacgtggcttttctggctttcttggggtatgaaggccctgaggcagggtttacagggttctaa

SEQ ID NO: 7213 - DNA, 1161 bp, Chlorella protothecoides
  modified_base (160)..(169): a, c, t, g, unknown or other
  modified_base (612)..(621): a, c, t, g, unknown or other
atgggcaggcagcgcccggacgcgggaggggggggatccccaggctggacgctcaccagcctggagacacgtgcagggtttcatggtgcccgcctctccatgcgctgcaacagaacccaccctccgacgcctgctaccccaccacatcccgggcaggttnnnnnnnnnnacgtgcagggtttcatggtgcccgcctctctatgcgctgcaacagaacccaccctccaacaccctgctaccccaccacatcccgggcaggtgttcgtcggcccgcccttccacaccatgccgctggcggcggaggtggactatgcgggcatggcgctcttcatccacatcgacgacagcagcccctgggtggatgccacctccccgcgctggtcccagaacgccatggtgaggcatggtggtggtgctgcctgccgcggaaaggggagttttccagagggtggacggctggagtgccccgggagtgcgcgaggcgagggggaagaaagggccggcgattccacggctcgctggaaccgcgacgacgctgcgcgtccctctgccgcagcccctgtgtgggtgtgtcactcacagcacgctcacgctccacccaccctccacctnnnnnnnnnngggagttttccagagggtggacggctggagcgcccggggaatgcgcggggcgggggggggagagggccggcaattccacggctcgctggaaccgcgacactgctgcgcatccctctgccgcagcccctgtgtcggtgtgtcactcacagcaagctcacgctccacccaccctccacctgttcaggccctcacctcgtctccccccacacaaacatgcaggtgggcagcgtgtggaccctggacccgtcggtggcgggcctggtggagcacgtgcccaatctggccgccgccctggccttcctgcgcggcctggcgccggggcgcgtggcggcgctgcaggcggccgtgcgccgtgagcgcctcaagttctactacccccccgccccggctggcgccggggccgtcaccgactccggctccgtcctcgccgacatcgtgatcgggcgcatgtgcgagcgcgcgggcgtggcgcgccgggccatggccgccgggctcagccgcgcggcggaggagacgcgggtgctgcccggcgtggccgtc

SEQ ID NO: 7214 - DNA, 828 bp, Chlorella protothecoides
  modified_base (311)..(320): a, c, t, g, unknown or other
aacacacctccctggcaggttccgtgtgaccaagggcgcggccttcgcgctggcctcccccacccccgccctccagcgcttcttccccgacgacgacgtgtgcgaggagctggccagcgtcctgcacctcgtccccgaggccgccaacctgtgcgtgtggacgcgcggcgcgccggcacgcaatgcgctcatcctgccctacgtcgccagcaccgacctggacctgggggctgccgcggacgcgcgccgcgacctgcacctcttcttccagggcgggtgtggcaaccccgcgccggaggtgcgcggccttnnnnnnnnnncgccagcaccgacctggacctgggggctgcaccggacgcgcgccgtgacctgcacctcttcttccagggcgggtgcggcaaccccgcgccggaggtgcgcggcctcttcggcgcgggcaagatgctgcgctgggagctggtgcaggccctgggctcgccggggccggggggggcgccggccccggccgacgtgcacgcgcgctgcgcctgcgacatctgcgaggggcacctcccgcacgcggacgtcctggcggccatgcgccgcgccgtcttctgccccatcatcgcctccaacgcccagtccagccggcgcctgtcggaggccgtcctctccggctgcatcccggtgggtcgaggggatgggtgttgttttggtcggcaggggaagaggatgggcggagggatgcacggcgtcggctggcgttcggcgaccagtggtgccaaagcatgccggtgggcagggcttgggaccgtcgcggccttgcgcatcgggcaggggaaagggtga

SEQ ID NO: 7215 - DNA, 174 bp, Chlorella protothecoides
atggtcaactgctccgtctgccaccagcgccagaaggacgtcatcatcaccaagtgctaccacatgttctgcgcacagtgcatcaagcgcaacctagagtcgcgccaccgcaagtgccccggctgcggcaccgcctttggccagggcgacgtcgcacacttcttcttcacgtga

SEQ ID NO: 7216 - DNA, 864 bp, Chlorella protothecoides
atggatggagggagtcttgcaagatggatgcccgccagaacatcaggtcaccaacaagatcttgtctccctgcagtgccgtggagcagctggtggagatctcgcagaccagggcggtgggggagagtctgcgatgggctgccaggatgctgtcccagggcccggccctgaccctccctcagcacggttgagtttgtaccctcgacctggctgcgcatcccctgcatactgcagtggtatctctcaaaaccccagttctccccactctcccccaccctggacccagatgctggatcggctggatgctgagatggaccaggagggcctggacgccatcacccactccggcgagccggctggagacctggcgaggcccaggaggtttgagatcgcggcggccatcaacagggtcgtggtacacacctctaggggtggctgggacaggggcaatgcgctatggtacaggaccaacgaggggagacgacaggccggccagggatacgtggtgggggttggtacagagctattggcaagggcgacacactttgagagaagcggggcgcttccgagcagtcctggacacacaggctgcaaacgcttcctgattccgctgcgcaggcatggggagggtacaaccccacgaacggtttgcgcgtggggcaggggatgggacagccaccttaggaggggttggggaaaaataagggtgggagggaggcattggctgggatctgtgctgagcgcggatctgggctatgtaaaaggactggggcccccttctaccagggcgactcatccagggtgcaaaggcccaggtacctggtggacggcaaggggtggtggagcgggtggggaggggggttga

SEQ ID NO: 7217 - DNA, 639 bp, Chlorella protothecoides
  modified_base (175)..(184): a, c, t, g, unknown or other
  modified_base (485)..(494): a, c, t, g, unknown or other
atgcagcaccacgccatgcatgccggccgtggctcagggtttatggtcgcgccgattcgtgggaccggccgacctcgcaccgcccccgaccctgcgcctggctgcatgcgcaggctccccctacccgcccgccgccctttcctgcaggcgcgcgaggcgcacgacatggcgcagnnnnnnnnnnctgcgcctggctgcatgcgcaggctccccccacccgcccgccgcccattcttgcaggctcgcgaggctcacgacatggcgcaacgcctggccgacgagcagggccacgtctgcctgtatgcctttggcgtggggcgaggcgtggaccgtgccgagctcctgcgcatcatctcggcgcgggacgcctccagcgcagactcgcggtgcgtggcaggggaggaaacggcggcgggggcagggtctgagggggccctgcggctgtgtagggctgcactggcacagcaaatccacgtggagggcgnnnnnnnnnncgcctccagcgcagactcgcggtgcgtggcgggggaggaaacgggggcgggggaggaaacgggggccctgcggctgtgtagggttgcgcttgcacagcaaatccatgtagagtgcagggggcccatggcaggggcgccggcctga

SEQ ID NO: 7218 - DNA, 1044 bp, Chlorella protothecoides
  modified_base (47)..(56): a, c, t, g, unknown or other
  modified_base (712)..(721): a, c, t, g, unknown or other
  modified_base (810)..(819): a, c, t, g, unknown or other
  modified_base (908)..(917): a, c, t, g, unknown or other
atgtcacatcgttcctgcgcatgctcgaggaatcagccatctccatnnnnnnnnnngtgcatgaccagctttgtgactcaggccattgaacacctggacacccaggagacggccacccaggtgcagacgggtggtggggcatggctgaggatgacccgaccaggccatcgaacacctgaacacccaggagacagccacccaggtgcagacgggtggcggggcatggctgaggatgaccccgaccaggtttctggtgtctccagaggtagcggtggtccagttcagcaacgactgccgattggagctggcaccctcgcccatcgtcctggatcaaatcacaaacgtcctggagggcatggtgagttgcgacctcgggcggagcctggcgtgcaattgcagtggagtcgtgcctgtcctgtgctccgtctgtccctctgtgctctgtggagtgaggccccagccgagctggttgggcttccccacccgcatccctcctctggaacgccgacccctttctctcctgatcatctgcagtaccgcatgaacgggggtaccaacatcagcctggcagtgcagcgcgccggccagctgctcaagcccatggcgccccagatgcggcgcgtgctggtcctcctcacggacggccgcatcgactcgcaccaggtgggaggaggaggggggctttatttgcgtccgaggaaaggaggtggcnnnnnnnnnncctggcgtgcaattgcagtggagtcgtgccctgttctgtgctccgtctgttactctgtgctctgtggagtggggccccagccgaagttnnnnnnnnnnggcggcatgcagcaccacgccatgcatgccaggtgtggctcggggtgcatggctgtgccgattcgtgggaccgaccgacctcgcaccgnnnnnnnnnngccgcatcgactcgcaccaggtgggaggagaggggggtcttgtttgcgtctgaggaaaggaggtgcggccctgtgccagccgatacctggcctgagcggctgtgggctgcagcgagggagacggtga

SEQ ID NO: 7219 - DNA, 1272 bp, Chlorella protothecoides
atgcccaccatccctcgctgcgcggcggcgccgctgacgtcaccagaggtgcgacttatcgcccagccaggcctcgccgttgcccagcaggaggggcggggtccagctctggatgcgcatggcggagacaaggtccagtatgccggggtgccccgacgcagcaaacacgtccaggatgcggggtgtgagcctcccttgctgaatgaccctctggaaggtggggcatggcaaggcgtcgatgtactgaggaggtgtcttcatggcaaggagaggaacctgaaggaaacactcaccttgaagaggcagaccacgaggtcctccggaacgtctcgtagactgggaactgtggttatgttcttggccaagcagtctaatgtgacatcaaacaggctgggcaccgaggaggcccctgtcgccatcactttcatcagggggaatcgaccagcgtccgaggagggttgggcccaacctcacccagcctggcgccgcccgaggtcagcccgtgcaagcgccatgtcgatcaactgggaggattatgaggagcccttgaaaaagccgaagaaccctctcgtcctaataggtgtgttgttaggagaagcttgcatttatatcgcctcaagtcgacctactgttcgcacggagcccggtgccggaccaccactgctgctcaacccttgccgtacagggtgtggggtgactgccggcgtcctttttgctggtctcgtggcgttcaagaagggcaaccagggactgtctcagaagatgatgcgggcgcgcgtcattgcacaaggggcaacagtagcccttatggtcgcttcctcaggggggggggggggtggagggttgaaagtgtgcacatctgcatggctggaggctcgagtggtatgtggcgctgacatccaagaaggaccccgtcgtcgaggggcttgctggggatctggacaagcaactaaagtgatggtgttgagggtctggctgaaggatgaccaagactgtcctcttggtctgccaagcaatcttttacagaacagccatgaggaaggtgacggggaagaagtctgccaagcaaccttttataaaacagccatgaggaaggtgaccgggaagaagtgcgttggtgtgccaggcatgcaaggaagacaagtgtatcacaagtggcctgggcgtccatggggcggcgggtcgagacctgccgcccaccgtgcgccaggatggaatgctgcagctgggagcccaatgagcaacccccacaacacccctttacctacctga

SEQ ID NO: 7220 - DNA, 555 bp, Chlorella protothecoides
atgcacaccgcagctgtcctggaagaggatgcggcccggtactgggacctcttctaccagcgcaatgccggcaagttcttcaaggaccgacactatctggaccgggagttccccctcctcctgaccgccccctgcatactggagctgggctgtggcgtgggcaacacgctgttccccctggcagccgccaatacgcaggccaggctgtacgcctgcgactttgcgccggcggccatccgggtgctgaagcagcatccgctgtacgggggccgagtgactgcacatgtggccgacatcaccaagggcccgctcgccccggccgtgccggagggccaggtgtcggccgccaccctcttcttcgcgctggagaacttgaagccatccttggcccctgggggccgggtcctcgtcagggattatgcgcgaggcgacctggcacagtcgcggctgtcggagcctggcagggtccagcgcctggcggacgatttctatgtacgctgggacggcacgcgtgctttttacttcacccaggtaggtaatctgcgcgcggcgtga

SEQ ID NO: 7221 - DNA, 285 bp, Chlorella protothecoides
atgtactcggagctgatcagcgtggccatcagcacgggcggcccctatgcggccaagaccagcacggtgaagctgatgcgcagcgtgaagaaggtcacactccgcttgatcgaggcatttgtggagcgggccgaggaccttgcgggcctggccagccagcacgtccccgccctgatggacccggtgctgggcgactacgcgcgcaacacgcccgacgccaggtgggccttggcgggggagtttggtgggttggcgggtacccgggcaggggagtggggggccagg

SEQ ID NO: 7222 - DNA, 1344 bp, Chlorella protothecoides
atggtgcgagggggcgcccagtcacgaggggctgctgccttcgagtccctccttgcgacagaggaagtcaccccgagcactcggcgatctaaaacctcgacatcaaaatcctccaaagggaacttgacgtccggcagtaaccccgtgccaggattccgtctgcgtgccgaagcgccaaaaagtgatggcgaggccaaggtacttgcagatctctgccaggcttttgcgggtgtcttcccccgcgacaccgttgcagacgtgctgcatgcatccgccggcgacccagaccgtgcagcagccagcctcttggctctgtcgggccacgaagtccgggcttcagacgagctggcatgcggcagaagggacaccggcctgccttcccccacagccactgctccagacctggaacccatctccacctcagacctctggtccctgctcccgggagacctcaagaagatgatcctgcgccagctcagcgtccgtgacctggcacgggctgcgagggtgaatcgcgagtttgcatgtgtctctaggaacctgtccagccaggagtcccggctggtgctccctcgaggcctctcgcccgccgccgtcacgggcgcggtgaccgctttccaccatgccacctccgtgaatctgtcccagtggcacgcagactttacaaggccagaagccctggcgaggatcatccaggcaattgcagccggcgagggagccaggtgcggggcctgggttgccgtggcagggagatggatggttgctgacgaactggtgctgcggaaatgcgccacgctgggaggcgactccgtggcgctgatctgccgcggcctaccccacctcacctccctggacctgaggcggtgcatgggcctaggcgacgccgcagtcctcgcactggcaaggtaccgccggcgggaggcggccgcgagtgctggggaagcgccagcggaggcagcacatgggctccttggtgcggttgtgggcccggaacctggcaccgccacatccgcgccgcatggggctggtcccccgctacgcaccgagccgggaccctcgtcctggcggctgggcgatccgctcctggcgccggcagatgcgcttgcccaaatcctggccgctcgtgtggagcgggggcaggaagcgggcaccgctgcgagcggcgccggcgccctcgcctctctagcgctgtccgacgtggacgcgcgcgcgctgcgcgcgctgtggtccgccacggcgcccacggcccagggcctggtgagcttgagcctgcatggcgcgcgtcgcctcgacctgcagcccctcctgaacaaggcggtgggtcaggggagaggggagcggtga

SEQ ID NO: 7223 - DNA, 669 bp, Chlorella protothecoides
atgcccacccgctgcggcggcgccggcgcgtggtggtactacctccgtcgccagctggtcgtcctggacacctatgcctcgcccgccaatcgccacaccaatgccgcgctggctgccgcccactgctactggtcttgggccctggtggcgccggcggcgctgttggccgcgcgtgcggcctgctttggtgcgctgggcgtgcagcgcctcgcgaccggcaccccattaccgatcgccgcccccgtgctgcccacgctggccgcgctggcgctggcggtttcctgggcgtatgccgggctaggcctgggggccatgacggctcggaccctgtcgctgtgcgaggcgctcaacccgcgcctggcccctggggggctgtttccggtcttctcctggggccacgtggccgcgggcgtgctgctcaacaatgcggccgtgccggtgtgcatggcgctcaccttctgcacctcccacgtcacctgggccggcatccggtatcggaggaaaggggggcgcgtcgtggcggtggagcacccagcgccggcgccggcgggcgggcctacgcggcgcggcggcgggcacggttgccggccgaccggacgcggcggtcgcgagggcaaacggagggaggcgcgtggtgcagcacagcaggatgactgcgatgcgcggtga

SEQ ID NO: 7224 - DNA, 345 bp, Chlorella protothecoides
atggggaccagtgactacacgctctgcctggatgacgacgtgcagctccccccccgcctgctgacctggctggtccgcgaccttgcctccgagcccggggcctacatggcgacagggtacccctttgacatcccacccgcccacccctccctcctctcctacgccgtgctgtcctaccacctccccctcgtcatcggcttctccctgtcccggaagaccagcttcgtctggggcggctgcatgctcttcaggtcgccggccttgcgctccgattcagccggcctcctggaggtgaggcgggatatgagaaggaagaaggcgtgctgggatgaggccctgaggtag

SEQ ID NO: 7225 - DNA, 225 bp, Chlorella protothecoides
atgactgctgctgcgcagggcgaccgccacatcgtcaattgcctggccccccacccgacgctcccccatgtcctggcctccagcggcatcgactcggatgtcaaggtgtggggtgtgcaggcgggcgaacccgccgccctcggcgccgccgccagcatcctcatggcgcgcaacgccgaggagcaggggtcgcgctactcccgctcctacatggtgtccgcccag

SEQ ID NO: 7226 - DNA, 987 bp, Chlorella protothecoides
atgcatttcacagagggaatagacagcacatgccagcagcttgtgcccgacacgggcctacgccatggtcgcaaatcaatgctcatgtcagccaaacttgtaggaggtcatggctatgctgcccatctcgaggcggtcgttgaagacctccacctgctcgccctcctgggccgcccccaggacatacagcagcggcaggaagtgctcgccggagttgatggccagccggaagtccggccctttctcccgccagcgcaccagctccccctcccgcccctccctcacccagctccgcacctgggagttgacagccgtggcccaggctgggggcgggtgtgcgcccagtccctgcctcaggttgtgcaccacgttgccggatccgagcaccaggaccccccggtcgcgcagcgggcgcaggcgccggcccatggccagcgtccagcagccgtggtccaggccccagccgtcgtccagctgggcacctgtttcccgagcaatctccctggccagggcgggatcccccggggcggggtactgcatgtcgtacagggccggggggaagccccggaagtcgtggatggtcggggggtgggccatggaggtcacgcgcgtgccctgggtctcccagtgtgcggagatgcagaggatggcccgtggccggggaagctccttgccgagtcgcgcccagacctggctgctctggccggtctccagggcagccatggggctgccatgtgccacaaaaacggtcggcaggcgggtgagggggttcgccatggtatggacgccaagccagacgagggcagcgacggtagcggtgggtccgacactttttcgagaagcgctgccgagcaggagatcgcggaccgccgcggtctgaggcaagtaatgttcaaccagctatgcagacacgtagtgatgatgatggcacgcctccccgacatcgcaagagacccacactgccgttccggcagttcgatcacctaa

SEQ ID NO: 7227 - DNA, 1254 bp, Chlorella protothecoides
  modified_base (63)..(72): a, c, t, g, unknown or other
  modified_base (248)..(257): a, c, t, g, unknown or other
  modified_base (468)..(477): a, c, t, g, unknown or other
  modified_base (647)..(656): a, c, t, g, unknown or other
atgcctatcggcgataagatcaagaatgtcggcgccaacatcaaggtatgtcggaaccccgtnnnnnnnnnngagggcgaggggtcgggcattgccgtgttaccgttgttagatctctgtgttggtagacggagggcttgcgcggtgcctcgatcgggctttagcgagcagcttccgatgccagtgccgaaacatatctcggagggtgtcgatcgccacgagtcgatcgcccgcggcttggacgcacnnnnnnnnnncgataagatcaagaatgtcggcgccaacattaagacggagggcttgcgcggtgcctcgatcggctttggcgagcagcttccgatgccaatgccgaaacgtatctcggagggtgtcgatcgccgcgagtcgatcgcccgcggcttggacagtaacttccctcacgcgtacttaaactcatcttcctatatcattacacgtgcaggacgcatnnnnnnnnnnccaggactccaccaccggcaccggcaccggtacctacaccgagaagggtaccaccggctacggcaccaccggcaacaccaccgggctcgccggcactggcgccggttacggcaccaccggcactgctggaaccaccggaaccactggaaccactggtctcaccggcagtnnnnnnnnnnccaggactccaccaccggcaccggcaccggcacctacaccgagaagggtaccaccggccacggcaccactggcaacaccaccgggctcgctggcactggcgccggttacggaaccaccggcactgctggaaccaccggaaccaccggtctcactggcagcgacaccaactactccaagaccaccgagacctatggctccaccggcggtactgcgggcgcctacggcaccgagggtgttaccagccaccactctggccatggccacagtcacacctctggtgacaccaagacccacatcgagtctgctgccaggcagggcaaggagcaggtccttggccaggactactacaccaacaccgaggaccgttctctggtgaaggagcgtgtggagcaaatccgtgagcaccgccccgtggagaaggagtttgtggtggagacccgcgccaccggcaatgagcgtgacctggttgaccagcgctccaccgagcacctcggcacgcgcgagcgcgttattgagggagctgagcgtgttttcgatggcaagacttccgagacacataccaccggcactggccaccacacctccaccaagtactga

SEQ ID NO: 7228 - DNA, 282 bp, Chlorella protothecoides
atggcgaagcagcggaagctgcagggcgagatggaggccgcgctcaaaaagatcgcggagggtgtggacgagtgggaggacttgtggaacaagtacgaacgatcccacgacatggtgagtgctgaggtgacgctgtgcggtggggtcgagtcccgcgggcgacgccgcgcagcgggagcggttggtcgccgagatgaagcgcgatctgaagaagctccaggtagtacacgcgatacatgggaagggtgtgcagacctgcgagctgcacaaccaagcatctga

SEQ ID NO: 7229 - DNA, 717 bp, Chlorella protothecoides
atggctgccctggagaccggccagagcagccaggtctgggcgcgactcggcaaggagcttccccggccacgggccatcctctgcatctccgcacactgggagacccagggcacgcgcgtgacctccatggcccaccccccgaccatccacgacttccggggcttccccccggccctgtacgacatgcagtaccccgccccgggggatcccgccctggccagggagattgctcgggaaacaggtgcccagctggacgacggctggggcctggaccacggctgctggacgctgctacaccacatgtacccagaggccggcatccccgtcctccagctgagcctggacaccgctaagaccgcggcggagcacctggccatgggccggcgcctgcgcccgctgcgcgaccggggggtcctggtgctcggatccggcaacgtggtgcacaacctgaggcagggactgggcgcacacccgcccccagcctgggccacggctgtcaactcccaggtgcggagctgggtgagggaggggcgggagggggagctggtgcgctggcgggagaaagggccggacttccggctggccatcaactccggcgagcacttcctgccgctgctgtatgtcctgggggcggcccaggagggcgagcaggtggaggtcttcaacgaccgcctcgagatgggcagcatagccatgacctcctacaagtttggctga

SEQ ID NO: 7230 - DNA, 690 bp, Chlorella protothecoides
atggggctcggccgggacgccctagaccctgcggcagggcttggtgcggcagccctgggccaggcctcaggtgccctcctccttgcccccccttctttacacagctgccaagcagcagtgcgccgactggctcacagacgtcatggaccgtctgcagaccgaggtgggtgggggtttctgagcttgcctggtccagattggtccccagtcggccggccccgcgtcgcatgctctgtggcgcaactgccggtgtgcctgtcctccctgtgtcagattgaggcatgcgaggcggatgtagagaacctgggccccgccggcaacaaggccaagaagacacggccgggaggagcccggggggggggggggggcccgggccgtcgccccgcttcctgccggctgcgcctgccgcctgctcgaccgctggagggcacaccccgaccgggcctcatcgcgcggcaccagcagcatgtgacgcacctggagcagacgctgcgcctgctgcgcaacgaccaggtggaggcggaggaggtggaggacgcgctgaaggaggggctggaggcctacctggacacgggcggcgaggcgttcgaccccggggaggacgagggcctgtacgcctctctgcccctggaggaggtgggttgtgagaggagggagagggggaggggtggtggggatgcaggggggtga

SEQ ID NO: 7231 - DNA, 375 bp, Chlorella protothecoides
atggcggggaccacgcgcgacgccgtggacacggagttcaccgcccccgacggcactcggtacacgctgatcgacaccgccggggtgcggcgccgcacggccgtcgccgccagccccgacggcgcggagacgctgtcggtgaaccgtgcgctgcgcgcagtgcggcgcgctgacgtggcggtgctggtcctggacgccacggagggcatcgcgcagcaggacttccgcctggcggagtacgtggcggccgaggggcgggcgtgcgtgatcgtggtgaacaagtgggacgccgtggctggcaagggcgccgccagcctggctgagttcgagaccaacgtccgggcggaggtgattggtgatgtgtctgtgaagtag

SEQ ID NO: 7232 - DNA, 636 bp, Chlorella protothecoides
atggctgacgccgccgcgctgctagcccccgagcacctggccgcggccgcgcgctccatcagcgcccccggcctgcccgcggccatcgagcgccaggccgccgcggcggtggccgaggccgccgccgtcgtgctgtgcgtggacgggcaggagggccccaccgccggggacgaggagatcgtggcctggctgaggcgcaccttcaaccgcctccccgtcctgctggcggtgaacaagtgcgaggcgcccgggtccggcgacctccaggccgctcagttctggggcctgggcctagagcccatccccgtgtcggccatatcggggaccgggacgggcgacctgctggacgccctcgtgcgccgcttgcgggaaggggaggacgaggatgaggacgaggaggcgggcgaagcggccgctgccgtgggcggcgccgcagcgtctgccgccccgggcacgcccgccgcgcccgtggccgtggccatcatcggccggcccaacgtggggaagagtagcatcttgaacgccctcatcggtcaggtgggtgttttgttgtgtgggggggggggccgcagaagacagtggcggcagcgggtgcagagcgaggactggtgcctggacatcccagcatgcgtctaa

SEQ ID NO: 7233 - DNA, 315 bp, Chlorella protothecoides
atggagcacctggaccggtacgagacggagggcctggacacggcgttcatcgacgacgcaaccatggaggcccgcatggatgcgcgcgccgccgcggaggccgccctcgcccggcgcgaccgccaggaggggcggctgacgggccaccgccgcggcctcatcgccgccctggccggggacgaatcggacgtggacgacggggatcggccgcgccgacggcgccggctcgaggaggcgcaggcaggggacgacgacgaggtggggcggcggcgggcagagaggagggagggggttgtaggtttgggagcactctga

SEQ ID NO: 7234 - DNA, 1071 bp, Chlorella protothecoides
atgccctggaatgccgaccccccactccaacacacacgccagggcgtgtgcctgatcgacgagttcgacaagatgaacgacgctgaccgcgtgtccatccacgaggccatggagcagcagtccatctccatcagcaaggcggggatcgtgacccagctccaggcgcggtgctcggtgctggccgccgccaaccccgtcggcggccgctacgacgccagcaagaccttttccgagaacgtcgagctcaccgaccccatcctgtccaggtttgacatcctgtgcgtgatccgggacacggtggacgcggtgaacgacgagcggctggccagcttcgtggtggcctcccacgcgcgctcccaccccgacgcgccgccggaggccggccccgaggccgcggcgggggacggcgaggtgctgtcccaggagatgctgcgcaagtacgtgacgtacgcgaagcagacgtgccgcccccgcctggcgctggccgaccacgacaagatcgcgcaggtgtacgccgacctgcggcgcgagagcgcgctgacgcagggcatgcccatcgcggtgcggcacctggagtccatggtgcgcatgtcggaggcgcgcgccgccatgcacctgcgcgaccacgtgacgggggacgacatagacgccgccatccgcgtcatgctggagtcctttgtctccacccagaagctgtcggtgcagaagagcctgcgccgcaagttcaggcgctacatcgtggaccgcgccgacttcgacgcgctcatcctgtacaagctgcaggagtgcctgcgcgaagcgcgtcgcgccgaggccgagtgcctgcgggaggcgcgtcgcgccgaggccgtgacgggcaccctggccgaccccgcgcactttgccgtgcccgtcaggccactcaccttcatcccccccgctcccccccttcaaaacaaaaggcaattggaggagcggtgcaaggacctggacatcctggagctggggcccttcttcgccagcagcaccttcagcggcgcagggttcagcctgtccgaggacggcgcccgggtcctgctgtccagggtgtga

SEQ ID NO: 7235 - DNA, 2787 bp, Chlorella protothecoides
  modified_base (408)..(417): a, c, t, g, unknown or other
  modified_base (533)..(542): a, c, t, g, unknown or other
  modified_base (775)..(790): a, c, t, g, unknown or other
  modified_base (971)..(980): a, c, t, g, unknown or other
  modified_base (1904)..(1935): a, c, t, g, unknown or other
  modified_base (2488)..(2497): a, c, t, g, unknown or other
  modified_base (2638)..(2647): a, c, t, g, unknown or other
atgctaacacggcgcgtggctggccctgcccagcaggtgggcctcgcgatctgggccagggccgctggcaccctggcccctccccggaataccgagtttgcccttcttcaggacagcgaccttgctgtgttcgacagtatcttgggatccgggggtgtgatcaccgatccgcatgaggtcgatccgtataacaggtggggctgggaggctggagggggcgtgggcgtttatcgtcgggttttcggtggccccatcccaggcccccatgcggcccgaccggcccccatgcagcgttcccatgccggccctcgccacgatgatttttttggtttcttatcgtggggcagggaggttggagtgggcgtgggcgtttttcgtcgggttttcggtggccccatccctggccannnnnnnnnnccgcggccggggtcggtgcgtgctgcgcccacgctccacggcccaggtctcggccctgctgcgccactgctctgcgcggcgcctggcggtggtgccccagggaggcaacactggcnnnnnnnnnnccatgcggcccgaccggcccccatgcagcgcggactggatgggaaaataccgcggccggggtcggtgcgtgctgcgcccgcgctccacggcccaggtctcggccgtgctgcgccactgctccgcgcggcgcctggcggtggtgccccagggtggcaacacggggctggtgggcggctccgtgcccgtgcacgacgaggtggtgctcagcacaggcctcatgaccacgctgctnnnnnnnnnnnnnnnngcgcaggcgggcgccgtgctggcgaccctggaggccgcggcacgggagcgcggccacgccatgcccctggacctaggggccagcgggtcctgcgccatcggcggcaacgtggccaccaacgcgggcggcatccgcctgctgcgccatgggcccctgcacggctcggtgctgggcctggaannnnnnnnnnctgcgccatcggcggcaacgtggccaccaatgcgggcggcatccgcctgctgcgccacgggcccctacacggctcggtgctgggcctggaggtggtgctggccgggggccaggtgctggacctgctcagcagcctgcgcaaggacaacacggggtacgacctcaagcagctgttcatcggtagcgagggcacgctgggcgtcatcaccgccgtcgccatccagtgccctgccgccagccccgccaccagcctggcctatctggcagtgccttccttcaaagcagcgcagcaggcacgtggggttgagggggggaacctggtcctcggtccttcccaagggtcggcgcccgcggctggggaaaggagggcgtcacatgggtggccgacccgctcggcggtatctgccgccccacccctccattcgcgcgtgcggcctacgactgcacatgcgagccctgcgcaggtactgcaagcggcccgccagaacctgggcgagctcctctcggcctttgagttccttgaccgggagtcgctggaggtggccaagcagttcctgccgggggcgagggatccgctccccggctcggatgtgaggctgtgggctggagggaggggggttcttgttggtgcgaggcgggaccagtgccatggagaacaatgtttcctgctgcctcggcgcccgcacccttcttcctcgtggtggagattgctgggagcagcgagcagcacaatgccgcaatgctggaggccttcctggagtcgaccatgggcgaggggcgggtgctggacggggtcgtggcgcaggactcccgccaggctggcgagatctgggcgctgcgggagggcatcacggaagccctcaggcaccgaggtgaggcaagggaggtggggtggagggtgtgagaagtgttggcaatgggaggnnnnnnnnnnnnnnnnnnnnnnnnnnnnnnnngggggggggcaaccgctgtctttgctcgccgggggatgtgtgttgccctggctgcgccgactctaccatgactggggcatcccggggagctctgggtgcacccagggtgcacccaggatgcacacctgtctaacccacaaagggactctccgccgtgcgtggccaccccgtacaggggccatctacaagtacgacctgtcgttcagagtggaggagatgtatggcgtcgtgggtgcggcgcgggagcgcctggcctcggcctacccatcaggcttcctgggcggcggcgcgggctcgacagcaggctctgacaccgagcacgcgctcaaggtggtgggttacgggcacctgggggacggcaatgtccacctgaacatctcggccccgcgctacgatgccgggctggaggccctgatagagccatgggtgtacgaattcaccgccgcccatagcggctccatcagcgccgagcacgggctgggtcgcatgaaggcgccctgcatcggctactccaagccgccggaggctgtgcgcctgatgcgcagcatcaagnnnnnnnnnnctgcatcggctactccaagccgccggaggcgcattgatattggaatccaagcctgttcctctggcaatgctccaggtggccttgtgattggtgtgccgtgcccagcaggtctggccgacaagttgccacggcgcgccctcnnnnnnnnnnaaggtcctgccaccggagtgatgcatggacgagagttttcagtgtcccatgccatgcaccatgtgtgtatgtttccagtcgcaggattgatattggaatccaagcttgttcctctggcaatgctcaaggtggccttgtga

SEQ ID NO: 7236 - DNA, 276 bp, Chlorella protothecoides
atgcacataggctcctcagccacggctccctcccttgtgcaggctcacccccgccgcatcgcaaaggtcgccaagcaaatagagcgagaggtcctccagaaggccatctgcccggagcggcggcgaggcattgatgcatccatgtcggctgtggcctccgttacagaggtccagctgactcgggacatgcaggttgcgcgtgtcttcctctctatattctcagatgaggagggcaaggcgattgccttgcagggactgcagggcctggaagggtga

SEQ ID NO: 7237 - DNA, 1782 bp, Chlorella protothecoides
  modified_base (1243)..(1252): a, c, t, g, unknown or other
  modified_base (1648)..(1696): a, c, t, g, unknown or other
atgtcttccgtcgacgatgggtcggaagacctgtacggtaatgccacgagcaggcttcgatacgaggcgtacaggtgcatgggtgggaacagcagtgcatgccggttgcaggcagccgcggtggcgtttggagagtccctcccgatacctgagatcgtggccataggcggccagagcgatggcaagagctccctactggaagctttcctcggggtgagcggagtttcgttccgctgggacgagcgggccaccttgtttcgattgcattccagattgcaactcgctgcttgccctgtcacctcacagccccctcaccatccctggcagttccgcttcaacgtgcgggaggtggagatgggcactcggcgccccctcatcgtccagatggtgcacgactcgacggcagaggagccccgctgccggctgaaggacgaggaaggcgaagagtacgggccagtgatcgcaccaccctcggccgtggcagacgccatccgggaccgcaccgccgagcacctggcaaaggtcgggggtgcggtgtccagtgtgcccatcgtcatgcgggccgagtacgcctactgccccaacctgaccatcatcgacacccccggcttcatcctcaaggtccctgggactggggcttctgtcgttgttgcaacccggagtggccttgcgttttgctgcgacagggggggtattccatgcaagttcctcagctcgttgcagagttctgtcgttgtacctgagactggggtttctgtcgttgttgcaaccccgagtggccttgcgtttcgttgcgacacggggctaattccatgcaacttcctcagctcgttgcagagttctatcgttgtgaccgcctccccaccatcctcaccaccttgcaccctccgcctcgcaggctcgcaagggcgaggcggcctccacccccgacgacatcctggccatggtcaaggcgcagtgcgccccctccaaccgcctcattctcttcctgcagcagtccagcgtggagtgggcgagcagcctgtggatgcatgtgctcaccgatgtggaccccgacttctcccgcaccgtggtcgtggcctccaagttcgacaaccggctgaaagagtttggggagcgctgggaggtggaccggtacctggcggcagcggggtacctgccgcccagcgtgcagcccttcttcatcgccctgcccaaggtcatccggtgtggagagggggggagggtgttccttggttcagannnnnnnnnntcgccctgcccaagggttctgggtggggtgatgggatgcaagctctgatttggggtgttgagccccccctgaagatgcggcagcgggctggaggccaggtgttcaggggacgcggcgtgacccccttgccacgagggctcgcatggaggcaggccctccatgtgctcccaggggatcagcacaggtccgaccctggtattccacaacatgcactcttgcaggaccgcggggcggtgggctgcgcgggcgagtggcgcgcctccatccagggcgtggacgccgaggtcctgcgcggcctgcgggagggcgtggcgggcgggttcgacgaggagcggttcggtacccgcgtcggcttcgccgccctgcgccgcttcctggaggcagagctggcgcggnnnnnnnnnnnnnnnnnnnnnnnnnnnnnnnnnnnnnnnnnnnnnnnnntcccgcgcggcggcccctgccacgctggccgcgctggaggtgcgctgcgccgcgctgcgcgccgactgcgcggcgctggatggccg

SEQ ID NO: 7238 - DNA, 711 bp, Chlorella protothecoides
atggggagcggtgcataccctggcaaggcagcctccacttatttcacaaacttctcagtcccaccctgctcaacacacatccctcagattctggacctcatgggctacgacaccccctccgtgtggaacaagatcaacatccatgtggggggatcgtatggcgacaagcaggccaccatggagcgatgggcggctgcctacaaccgactcacacccagctgccgtctgcgcatgacagtggagaacgatgaccggcccaactcctacagcgtcagagacctgttggagttacaccgcctttgcggggttccaatcgtctttgacttccaccactggaagttttgcgaagcagtgcatgcagatcctggcactcatcatccctgcccaaactttgccacctcaggcgacatgactcaggaggaggcgctgcgggcagcaatcgccacttggcccaagggcatcaggcccgtcgtccactggagcgagagccaggaggggcgcatcccgcacgcccactcagactacatcaagggacccatgaacctgtatgggcttgaggccgaggtggacgtgatgatcgaggccaaggccaaggaaaggtccctcctctgtttcagagatgggctgcccatccctgcagtggacattccctctgaggaccctggagtgggacgcaaggctgccgcagcagcgccctttctggatgactag

SEQ ID NO: 7239 - DNA, 1536 bp, Chlorella protothecoides
  modified_base (416)..(425): a, c, t, g, unknown or other
  modified_base (851)..(860): a, c, t, g, unknown or other
atgacggcgctggcccgatcgtccaacaggggcacgctggccacatttgcagagtacacccgagggaaacggtcactccctgttccagcgatagtggttccaaccaatgagcttgtgaagcctcatgagaaggagtcgagattcgtcttgccggtaaatgattctaaggagacgagtccgacttacaaaataaaaggttgctcacctccagctgcatgcacatcatccgcacacaaactcatcccgtcgcttcttgatgtagaatccacagatctcgccaatctcgggtacaaagtggactcccctaaagtcaaggcttttcaagacgttgctgctgagctttaccctagagctgtgtctacaacggtccgcatcagctgcaacaccctggcaaacttcgaaatggccggactacnnnnnnnnnnaatggatgtgtctgactatgagaatgaccctagaaaatgtgtcgctgctgcgcacagagctgtgtctacaacgttccgcgagatctgcgtcctcggtcaccaactcctcctcaaactgaagaagcttcgagccaccgtggaggaggcggcggccaggaacattaccctgctcaggctacctcatttattgattacgctaggagacatcccagtctcagatctgcctcaacatgcacagataggggccggcttccgggacataaaggacattgcaagccatgcaggcatccgtatgacgttacatagtgacatcaccacgagtctcgcaagtcctcatgaggccgttttacgttcgagcgtcgctcgcttggaggctctccatcaagtcagtatcgatgggggtctacaacaaaattgtcatgcatnnnnnnnnnntcttttcgccctccccgctcagatgatggtgctgatggggtgccgcccgggggtctacaacaaaatcgtcatgcacgtgcggggattccctggagacaagggcggcgctctagatcagctggagaagaatcttcagtggttgagtcccggctgtcgagcctcgattgcaggtgggtcactatgccgaggacataattactcagagggtgagaatgatgggcatttgcgtgataacgtccacaccatcccgcatgcagttgagaacgacgagttcaagggtcaattcagtatcaaagaccttttgccattcagccatgccacgggtgtgcccatcgtcgacgacctacatcatcatcccctgaacccagtctgtcactccaactggctcctgaaatacccaccaaggatccccttctcgcatacagatggcatgacggaggaggaggcattcctcgcggcaacagacaccttccacagaaggggcgaggtgccggtggtacactacagtgaaacagattggaacaagaggattaattcccatgcaaagtacgtgaaaggacccatcaacttgtttggacgacgagcatatgtcatggtcgaggctggaggtgggctgactgctctcctggcactgcgtggtgacatcccttttccaggcggcccagggtacacatag

SEQ ID NO: 7240 - DNA, 3312 bp, Chlorella protothecoides
  modified_base (178)..(187): a, c, t, g, unknown or other
  modified_base (647)..(706): a, c, t, g, unknown or other
  modified_base (2488)..(2497): a, c, t, g, unknown or other
  modified_base (3154)..(3231): a, c, t, g, unknown or other
atggttgtgttgtatgcggatggaccatgtctccgccagcctggcacgtcaagggcggacgagggcgtcagggccaggctcggtcagggggggccagctgaagcctggcaggaggataaggttgttgcgggcatcgttccctatacatcccccgtccagtgcaatgccccctcctcannnnnnnnnngttgcgggcatcgttccctatacatccccccgtccagttcaatgctccctcctcggccctgccctccacctcttccctcccattgctgcaggcgagcggcagttcttctccctgaacggccgccccgtggacctgccccgcttcgccaaggccctgaacgaggccttcaggtccctctccagccaggccagcgccgacgcacggccctccgcggtgctggacctggtgctgcccacggacgcctacgacatcaacctggcgcccaacaagcgccaggtggcgctgcacggcgaaaacgccctgctggcacggttcaaggaggcgcacaggatctggagcagctcaagtcactctgcacatctgtcaccaccctgtgtgtgagagccgtgttggattcctggcgtgcatacccctgccctgaacccaacaaccacgctcacacttccctccagcaccaacnnnnnnnnnnnnnnnnnnnnnnnnnnnnnnnnnnnnnnnnnnnnnnnnnnnnnnnnnnnnccctcaccagcgggctgcatgccgtcaagcggcagcgcctctccctcaccccccccagccaggacagccagggtggggacggcgctggtcatgatgacgatgaggaggaggaggagggaggagaggaggaggagcagaccgctaggccgggcgacacagggaggcccagcgccctcggcgccaggagccccgtcgcgccgggcctcgcgtcgttcgccatgccaggggcaaggagcgggaggaaggctggctcaggcgccgtgacagccgcccctggcagggcgggggagcctgcccagagcctgccaaggccgatgaggatgggccccttggccgcgtttggtttcctgcccaccccctctccaccaagtgggctggccaggcccgggggcacaagcgtcagcgaccccgggcccatgtctacacaagacgactcagacggggagcagcctgcagacgtggcaggggtctgtgctgccacgctgaccagggcggcagcccaggcccctgcgccggtccatgaggcggcccaaggaagccttgggcaagaggagtcccagccctcggagactgatgaccagccagccgagccgagcagaaaggggctgcacccgttcccccaaccctctcaggccggggaccctgcgacgccagcaggcctgggcgccgcagacaccgatggcgacctgtctgagggggatgacccccaggtggaaatggccgagcaagacacggaggctcaggaaaccggaggggtcaaagggggatcagaggacgaggaggtgccgcctgtcgtcacgccgcctctgagccggcaagcagggccgcttaagatgcgtgtggacctggaggctctgcgacgcaggagcgaggaggcccgccggaagtcaggccatggggaggacactgggaagaaagcgcgcttccgggccgcgacgctgcagaggtgtgctgtggctgcagcaagtgatgaagggactgacaccgccgaccctgccgcaggtgacttggcggaggggagaggatatctgctggttgtggcgttgctgaagcctcaacttgtcatccatggtagtgccttggacccctcccaagccaggccacttccccattatcctccctccccaacacagagcgtgagctggagcgtgtcttcgacaaggccgactttgcgcggatgcaaatcctggggcagttcaacctgggctttatcattgcccgcctgggtcaggatctcttcatcatcgaccagcatgcctctggtgcgggtgcccgatggactaattttgctttgcatcacagtgccccaagacttacaccaggctgtgtgggtatgtgccattcctacaggaatggattgggtcacggtccgtgccgaggagagtgctccctgtgctcctcgaccaagccgccacacccaaacccctctccatcttccagacgagaaggccaactttgagcgactggaagcttccctgaagctgaactgccagccgctgctccagcctcggcgcctggagcttgcccccctggaggagctgcatgtccgggagaacctggatgtcttcaaggccaatggctttgagtttgtcgacgatgcacagggtcatttggccctctcggctgttcccttcaggtggggagcttgtcgacgtccctgggatgggtctcatgggatctcacgcatgaatggtattgacctccggtcctgctgcagggacgaccagatctgcagtgacactgttgaccagcgtcccagtcctgaactgtcaatcaataatnnnnnnnnnngggatgggtctcatgggatctcacgcatgagtggtattgacttccggtcatgctgcagggacgaccagatctgcaatgacactgttgaccagcattccagtcctgaactgtcaatcaataacccccatctctgtatgcagcaagggggtggtattcggagaggcagacatccaagagctcataggtctggtggaggcagggctgcatgccggcatcccttccagaactcctgggagcctactccggccctccagacttgcgtctcgcttcacgcatcccatgcgttggcaccgttcccacagagttcgggccgtcctggcatccagggcctgccggtcttccatcatgatcgggaagcacctctcccacagcaccatgcagcgagtggtgagcaccctggctggcctcaaatcgccctggaactgcccgcatgggcgccccacaatgcgacacctgtggctgctgcccgattgatgagcagctggatcgcaccgaggactttgtgtccagaagccattgctcggcctggggcaagtttgaaaggaatgaagcacgaagcatggatattcgacttggattcaagagcaatgagaacccaggaagtgtgctccatcgtccacgtcatcatcctcacgaacgatggcgtttcgggatggnnnnnnnnnnnnnnnnnnnnnnnnnnnnnnnnnnnnnnnnnnnnnnnnnnnnnnnnnnnnnnnnnnnnnnnnnnnnnnaatcgtctcaattcaagtggtgacctcattccagcctgggatcgtcgagatccaaaattctgcgcgacttctccgacatga

SEQ ID NO: 7241 - DNA, 1083 bp, Chlorella protothecoides
  modified_base (938)..(953): a, c, t, g, unknown or other
atggcaccctcgatacgagccatcgacgcgacctcggtgcatcgcatctgctcgggccaagtcatcctggacctgtccaccgcagtgaaggagctcttagaaaatgccctggacgcaggagcgactgccatcgaggtgaagctgaaggagtctggctctgagctgatcgaggtggcagacaatgggactggggtcagccctgccgattacgaggccctcaccctcaagtaccacacctccaagatctcccagttcacagatctccaggtctgtgtaaatttgattccagccgtcttgagtatatacgtggaacaggggagttcacaaccccaagccgacgcgcctcggcccaccaccaaccaatctcagggcctctccagctatgggttccggggagaggcactttcctccctgtgcacggtagcagatgtctctgtcgtcacccgcaccgccggcgaggcggccggcacccggctggagtttgacgagcggggccggctggcgggtcgcgccgccgtgccgagggccgtgggcacgacggtggcggtgcgcaacctgtttgcccgcctccccgtcagattgaatgtgcgggcgggcgggctgtgcgggctgggatttgggaagtggggagttggagcaagcacaccacgctcctcgttcggccgatcaacctgctaccctggaaacccccgtttcccccctttcctcccgcccacattattgcccaggcaccgtgaattcaaggccggcctgaggcgcgagttctccaagctcacgcactgcctgcaggcctacgcgctggtggcgcgtggcgtgcggctcatcgccacccaccagcagggcagcgggccccgtgccacggtggtggccacccagggctccaccgacgcctggagcgacgtcatcgccgtgtttgggcctaaagcagcagcaggccnnnnnnnnnnnnnnnnggggcgggagggtggcactgaacagaccgacccctcgttcagggtcacggggtacgtgtcgcggccgggcatgggcggccggatgcaaggtgcggtggatcgagggatggttgtgttgtatgcggattga

SEQ ID NO: 7242 - DNA, 327 bp, Chlorella protothecoides
  modified_base (206)..(215): a, c, t, g, unknown or other
atgtgtgacgaccagctcgtattgcagaagggccgaggggcacatcagggtgtggcacccgcggaaagggatatccctgcagtgagtactggatgcctgggacagcggctcaggccatgggcatgtagagggaaggcgtgcgtgcctgtgcgagagcttgttgctgaccaagctgacctgatccttttgcgccctcaacatcgttnnnnnnnnnncctgcagtacatcgagtttgtggcggaccgcctgcttgtcgccctgggctgtgacaagctctacggctcagtcaacccctttgacttcatggaccagatctccctgcagtga

SEQ ID NO: 7243 - DNA, 912 bp, Chlorella protothecoides
  modified_base (177)..(186): a, c, t, g, unknown or other
atggcagcatgcgctgcaaccaaggccacaaacgaatctgtcccatcggcaccccctgttgaattctttgcccgggtcactcagcaggttctacttcaaccaccaccactcccgtctctgggagcacatccatgtcaaagcacaaacacacagtgtcacgctcccccccaccccccnnnnnnnnnnggcagcatgcgctgcaaccaaggccacaaaaatcctgtcccatcagcacccccttttgcattctttgcccgggtcactcagcaggttttacttcaaccaccaccactcccatctctgggaccacgttcatgccaaagcacagacgcacacagtgtcacgctcccacccccccccttcccaaaccccaacacagggaaaaaggcggagtgggccctcagatggattggcagcgggtccagcttcgcgcagcggctggtggcctttgcctgcgtggagggcatcctcttctccggctccttttgtgccatctactggctcaagaagcggcacctcatgcccggcctcaccttctcaaacgagctcatctcccgtgatgagggcctgcacaccgactttgcctgcctcctgtaccgccgcctgaggcaccccctggaccaaaccctcgtgcacgccatcgtggccgaggcagtgacgctcgagcgcggttttctctgcgacgcgctgtctgtggcgctggtggggatgaacgcggaggccatgggccaggtgggtgccgctgagtggggttggggaggcgggaggcgtcgcgctctctgtctgcagtggtggcgcgcgtcgtggggcgggagttgtgacgaccagctcgcattgcaggagggccgagggccatgtctgggtgtggcacccgcggaaaggggttggagggcgagcgactcgcatggctga

SEQ ID NO: 7244 - DNA, 459 bp, Chlorella protothecoides
atgcaagctacatgtgccccctgccatggcggcccctcagcccctacccccttatcacctcactgcaacaggcacaccgacatctacgagttctacaagcaggcccaagccagctactggactgtggaggaggtggacctatccgccgacatgcgggattgggtgcgactgaccgacgacgagcgccacttcatctcctacattctcgccttctttgcggcctccgacggtatcgtgctcgagaacctatctgcacgcttcatgcaaggtggggcgcaggtggatggtagggactgtagtatgcgtgctggcggatgtcagggggtcacattcgcctgtccgatgatgtgtgaaactcttgtttcaccttggagaactagactggtgcaagcaccgcctggagataacgtgatgatgaggacagtgtggagtattggggttgttgggctgctgcgttga

SEQ ID NO: 7245 - DNA, 1185 bp, Chlorella protothecoides
atgacggttgggtccccgaggcctcgcctggcggcaccctcctttccattcccaccgccgctcgccctccatctgtcctgcctcagggatgctcacccccccctcccctggttcacatccatgcacagcctgggcgcgaattactgggacagcgccgcctcgcccaccaagccctcggccctgcgcttccccgtccgcgagaacaccatcccttccttcctgaagtctgtcgccgcgggcgccagcttcatcgagtttgacgtccaggtgacgggcgacggcgtgcccgtcatctggcacgataactacgtgatcacgggcacgcctgaggcccccatcaaccgcctgatcgccgacctgacctacgccgagttctgcgcgctggtgcccaccagcgccgacctgccgctgcagaaggcgggccaggtggcggggcttcgcgccgaggacgcggcggccgcggagcgcgcgcggcgccgcacgcgcctgctgcgcgcgctgggcggggacgagcccgcccaccgcgacgaccccaccctggccggctgggagtgcgacaccgaggagcgcctgccctcgctggcggagctcttcgcggccatgcccccacacgtcgccttcgacatcgaggtcaaggtggccgtgcccagccaccgcgcgcacacgccctcccgcgaggtcgaccgcctgctggggcccatcctggcgggcgtggacgcagcgcaggccgcggcgcgctccgcgggccagcccccgcgccgcgtgctctactcctccttcgaccccgacgtctgcgcggagctggcgcaccgccgccccgacgacgctgtcatgttcctgtccggcggcggcgcgtatcgccacgccgacccgcgccgcaccagctttgcggccgcggtggcctgggccgccgccgccgagctggctggcgtcatcttccacgcgggtcgcctgcgcgccgagccgggcgcggtgcgcgccgcgctggacgcgggcctccaggtcatgacctacggcctggacaacgtggacgcggagtacgtccaggaacagtaccgcgccggagtgcacggcgtcatcgtggacgacgtcagccgggtggtggaggcgctgacgcaggcgggcgccggcgggccgtcgcgcggcgcctcgcccccggccgtgcatgccgcacccgccgtctga

SEQ ID NO: 7246 - DNA, 540 bp, Chlorella protothecoides
atggaccctgggcttctctcccggtactgggagagtcggccggaagctgccgcagcatctcgcttgccggagcctctgagcgaccgcgcaatcattctgcaccgtggcgtggatatggtcacggtagaggatcaattcatccagcagaagatcgactgcctaatttccttctacatcctccagcccctttggaccgcgctcatctccgtcgcccgcgtgtttggcgcagacaaggggctgcaggagaatgcacctccgggcctgggcgacagcccctacgtccagccggatgcctcagacactgggaagcagtcctcatccggctctgagagccccgtcaagtcgtcagaggacctcgcggagtccagtcagcgtgcggggccccggcacaactggatgctggaccgccagactttccgaacgtgggtgaagcccccgggagcaggcgctgttgaggaggggtttgggaggggggcttgggggacaggggagtctgtcccttgtcagcaagtgctctgggttctgatcactctgggttga

SEQ ID NO: 7247 - DNA, 522 bp, Chlorella protothecoides
atggccaaggacggggaggagccaaaggacgtgcctctatggaagagagggggccaggtggaaggcatggacagggtgcgaggggtttgtggttggggccgggagatgctgaagcagacgatggtgctgaagcgcttcaggtctgtccccctggcagacctggagatgatgctgcccgacaagacagtgtacatcccccccaaccagtacgtgtcggttggcatcaccgtcatctccggcctggtggccctgctgaccaccttcctccaggtcaggccacgagggtggcggggactcaatcaccttacaccaagtgtccatgattcccggcagcaaggttcgctcgctctccaccccccctcccccgtctcgccgcagtctgagtcgatgggcgtgatcttcagcggcaacctgctcaaagcactgggcggcatcctcctgtctcgagccggccaggtggccatgcagctgcaggcggagaaggcgtctgtgtcccagcaaatgacccaggcaagggactga

SEQ ID NO: 7248 - DNA, 1194 bp, Chlorella protothecoides
atggccggctgcgtcacattcacgaccagtagaccctcccaggccctgcgccagtcgcggcaggcattccgcgcgcagggcaggcgatgtgcagtcaaggtccaggccaaggttgacctgcagggaggcccgcgcttcgtgaagggcaaatgctacgttacgcgagatgtggggggccgaagctctgtcctttggctcctctcaaagcctcttcctacttgcctacagaacattgacaccgaccagattatccccgcggagtatctgaccctggtgccgtccaagcctgccgagtacgagaagctgggcagctacgccatgatcggcctgccagagcaggagtaccctgagaggtacgtcccggtggacagcatgaagacggagtaccccatcatcatcggcggtgagaatttcgggtgcggctcctcccgggagcacgcgccagtggctcttggcgccgccggcgccaaggtcgtgctggcgcagacctttgcgcgcatcttcttccgcaactgtgtcgccacgggggagctgtacccggtggagacggaccgccgcctgtgcgatgagttggtcacggggcaggaggtggaggtggacatggaggccaacgtgctcaaggtggtggaaaccgggaagacgtacgacctgaaggacctgggcgcggcaggccctgtcatcgacgcgggaggcctctttaactttgcgcggcaaggtgaggggctgggtgtgtggagtgaggggctgggggcatggagtgcagggctgggggcgtggggcgtgggggggcgtcgccgcctcctatgcgatacacggacaggcaccctcacctgcaagcaatctctttcccccatgcagagggagatgccccatgccggagactgtacggaaaccacccgggcacactgggggaggagatgcccggcttggcagcatgaatcgtcaggcgagaaccggggggtccccaccccccgacagcgacctctccgtcagagcttgcatgctggaaacgaagagactgcttcgtacctttatgattgtcattgggcggaggggcttgcgagaaaggcgctgtgcagtggcggaagttactcggcgggggcgcgcgcagaagcggccggaggcgatcctaccgcctgggctccgccatcagaaggccttacgacaaaggtgaggaggtatggcatcgtctag

SEQ ID NO: 7249 - DNA, 1017 bp, Chlorella protothecoides
  modified_base (645)..(654): a, c, t, g, unknown or other
  modified_base (807)..(816): a, c, t, g, unknown or other
atgcgagcagacgaggccagcgaggcgcgagagtgcgcatgtcggtgctcgccgtaccccagcccctgggtgcggcaatcccccccctcggggcagcagtcccacgtccccaccctcccaacctgctccacagggtatgccccacaagtactaccacggcaagaccggtgtggtctggaatgtgaccaagcgcgccgtgggcgtggagatcaacaagcaggtgaatgggcggtacatcaagaagcgcatccacgtgcgcatcgagcacgtcgccccctctcgctgcaaggaggacttcctgcgccgcgtcaagtccaacgacgaggcccggcgtcaggccaaggccgcgggggcgcccaagcccatcaccaagcgccagccggcgggtccccgtctggagggcttcaccctggagaacgtgagcatggagaccatcacccccatcccctacgatatcctcaaggagggcgtgctctaggcgttttcttggtcagaggtcggggagggcatggcgctcgtcatgccgctgcctcttgtgtaactcagtacatcgcgggcatagtagtggttggagcgaggcaggggacgggggcgggccatttgggaggtggtggggctgggttgcatgccacagctacggcaggnnnnnnnnnnaggcgcagtagtgctacggcagggagtgtagatacacgcaaggcgcgttcggataagagtggttttgatgctgcaccggctgggtcgggccgccttggtcgtgggatctttgctactcacttgacatgcacgccccttgcggctggtcagcgnnnnnnnnnntacgcaaggcgcgttcggataggagtggttttgatgctgcagcggctgggtcgggccgacttggtcgtgggatctttgctactcgcttggacatgcacgccccttgcggctgggcagcgctgccttcggcatcctgccatccgaacctgggccccctcccttgctacttctgtgacaccccctggcagtctgtctcggtga

SEQ ID NO: 7250 - DNA, 2076 bp, Chlorella protothecoides
  modified_base (266)..(275): a, c, t, g, unknown or other
  modified_base (945)..(954): a, c, t, g, unknown or other
ggggccgccggcggcgcctcggccgcggccggcggcgcggcgcccaagggcctggtggacaactttgacgacgcagaggggtactaccagttccaggtgggcgaggtgatcggcccggggtacgaggtcttcgccgcgcacggccagggcgtcttctcctccgtgctgcgcgcgcgcgacgtgaccgggcgccagggcgagggcggcgcgccgccgccggagctggccatcaaggtgattgatgatgcccgcaaccagccgctgcnnnnnnnnnnatcaaggtgtgtgtgctctttggggaggggaagattggcaggggttgttggtgtgaagagcactgggttattcaccctgacgggagtgttgcatgctgaatgccagcaggctccctcgcctgatgcgtctcggcccttcctcgtgatccatcctacccctgtacccaccaggccccccccccttgaccccccaaaccccccaaacccaggtgatccgctccaacgagaccatgtacaaggcgggtcagatggaaaaggtcatcctgcgcaagctggcggaggcagacccggcgggcaagcgccactgcggggggtgctgcttgacgtcctgcctggagtcggatggggtgggagggatgaggggattcagctggatggtgggagggatgaggagattcagctggatgtgtgccacccacctaccctcaccccgcacgcgatcccctcgccgacattgtctcatcccctccttcctcacaatctcacactcattcaggacatgaacctgcgggagctgaccaagcggcctgcggcgtgctccatgctgacatcaagccggacaacatcctgtgagatggcagggcagtttgtatcatctttgcgggagtgtgggcacgcgtggcactactctgtggctgctgggtctcacatcggtggcaggcttgcagcnnnnnnnnnnccacctgcaggcctgcggcgtgctccatgccgacatcaagccggacaacatcctgtgagacggcagggcagtttgtatcatctttgcgggggaatgggcacgtgttgcactactccgtggctgctgggtctcacatcggcggcaggcttgcagtgtcgatgccctgtgggcagcagggtgagggccaaggcgcctgaatgtcggggatcggtgcctcgtccccactccaacgaccaactcattcccttcctttcccacacccacaacagggtgaacgcaaagcggacacaggtcaagctgtgcgactttgggtcggcgatgttctctggggacaatgagattacgccctatttggtctcccgcttctaccgagcccctgaagtcatcttgggcctgccttacggtgtgtgtgccggggtgccgcttgagttgattcgagggggccgacaggagaactgcccccagggggactcgggtccgatgcgcgggatggtgccccagggcgcagagccccgatgccgtgtgtcgctcccgttgcttcgagaccgcatcaactatcacacagctaagaagccgtacccacctccaccactggttccaccattgttacccacagaccaccccatggacatgtggggggtgggctgcgtcatcttcgagctcttcacggggcgcatcctgttccccggcaagaccaacaacgagatgctgaagctgatgatggacgtcaaggggcccttccccaagaagatgctgcgcaaggcggagtttgcctacaagcactttgagtcggacgccaacatgtccttcacgctcatggaggaggaccccgtcaccaagcgacccgtgagtcattgtggattgtgccccccttcctccaatgctgacgaacacaaatctgggcgccgcgcagacgcggcgcctgatccccaacccgacggtgaaggccgacgtggcagcgctgctggccggccagtcccccgaccgcaagaagctggcgcagctggtggacctgctggaccgcatgctggcactggaccccgacaaacgcatcacgcccaaagaggcgctgcggcaccccttcatcaaggagccgctgtcggccccgcatgcctgacgtga

SEQ ID NO: 7251 - DNA, 426 bp, Chlorella protothecoides
atggcagcggggtggaaccatctgagggtgaggcactggacagcagtgcgtctctgtggaatgccgaaacgtgccgtctcgcccgaactggtagatctgacctcctcccccaagcgtcagcttgtggacgcctcatcgcatgccgctgtgcctgaggagcgacaatgcgtccgggccgccagctcctcccatggatggcccgactcccccttccacctgatgcgggtgaggggcctccccacatgggcaaacgaaggatccctgggcatcaagctgagcgaggtcgtggccggtcccatgcgcacagtcctgatatccaattatgtgagtggcgttgccggatcagagatcctggccagagagggacaggtggtgagtgctcgcgcctgcaaaactcgctgtgatccgtgtgcaaccatgtactga

SEQ ID NO: 7252 - DNA, 1185 bp, Chlorella protothecoides
  modified_base (547)..(556): a, c, t, g, unknown or other
  modified_base (879)..(888): a, c, t, g, unknown or other
atgtggcggtttgcctgtcgaccggtttcctcttggcctacggcctgcacctgggcgcctgcagagtgcagcagggtccttgggcgagtcatacatgcccaccgcccgtttgtcatggaggcaagccccccactcctccacatccccatgatctcagcggccggcgacccgccctggggccacctgtccctacgccgagagctggcccgggagactgccttccagtgcgcgcatgcgtctacccccttcctggcccagttcagcagcctcggctcggtggacgccaagtgggtggacgccgagctggccggttccgccggagcgggggcctggcgcggggaggggggagggacgggcgggatgcgcgccccgcccggcatcgccaccctggtctggcccaccgtgtcggaggtccagaacagcctggaggggtggctggcgggacgcagcgtgcctggccccacctccaacgtctgcaagcccttcctagagcggtactggcaccggtgggggggccagccggtggggcggcagcgggccatgcccnnnnnnnnnngcgcagcgtgcctggccccgcctccaacgtctgcaagcccttcctggagcgatactggcaccggtggggggggcagccggtggggcggcagcgggccatgccccacatcaagacctactgccgcttcgatgcagcgacgggggaggtgccctggtacctcaccgcctcgcacaacctgtcaaaggtggggtggcattgcatttgctgcaagcgccaaccttgcagtttctggggctgcgttctactccatctctttcgtcctacttgaatacctcacctccaaactccgtccctccctctcaacccctcaggcagcgtggggnnnnnnnnnngtatttgaatacctcacctccaaaatccgttactccctctcaacccctcaggcagcgtggggcgtgctgcagaaaaaggggacccagctcatggtgcgcagctacgagctgggtgccctgcacctgcccagcctggaggcggcctacctggcctcgcagtggagggggtatgatgcagtgaccggggcctgcacagagcagcccatgccaggtggggctgtgtgtgtgtgcagggcgagccagttgtggaggtggaggggcaagaatggtcctcagaagagtctgcactggggatga

SEQ ID NO: 7253 - DNA, 480 bp, Chlorella protothecoides
atgagaggagaagtccctttgctctccgcccacaatgacggcgctcgggaccagcccttcgggccccgccccgtcgacgatcaatcagtgtcagagcttggacctttgaccatagcacagcatgatggtacgtgtgaagtgttgtttgaagagcggccatcatcctgcatcatctccctcaggggacccctggggagggtctcgctaggggtcgggtcactggcaggctgcccagataccccggcatgcgcccctcccccaggtcggagattagaggaggccttccctctcctcagcccttccatccgcaaatggctgcgggtgcatgggcgcaccgtgcgtccccgcatgacagcacagcagctcgccgacatggagatgtgtttcaacatgatggacagcgatgcctcgggcgccatcgacgcaagcgagctctccgacgcctttggagtgagccgcagggacagcttgttgtgttga

SEQ ID NO: 7254 - DNA, 1647 bp, Chlorella protothecoides
  modified_base (1414)..(1423): a, c, t, g, unknown or other
atggagcgttacatggacccctcccacctgctgaaggaggaggtgtacgccgtgttccgggagcacccggagctgctggtgaaggagctggaggccctgtccaaggaggagcaccgggagctggtgcggcgctgcctgcgcgcgctgctggcgtcggggcagagcccattgacgctgctggcctccgacccccggcgctacttctacctgggcgagctcatgtccctggtggacctgagcctgacggtgaagatgggggtgcagtacagcctgtggggcggcagcgtgctgaacctgggctcggaggagcaccgccgccgctactttgacgccatcgaccgcttcgacctccccggctgcttcgccatgaccgagctgcgccacggctcgaacgtggcggcgctgcagaccgaggcggtgctggacgtggagaccgacgagtgggtcatccacacccccgacgacggcgcgctcaagtggtggatcgggaacgcggcggaggacggtctggccgccacggtcttcgcgcgcctcaaggtccctgcggcctccggccgccgcgagctggacgaccacggcgtgcacgcctttgtggtgccgctgcgcaccgcgccggggcgcctggctccgggcgtggacattcaggactgcggctacaaggtgggcctcaacggcgtggacaacggcgccatccggttcacgcatgtacgcgtgccgcgcggcgcgctgctggaccgcttcgccagcgtggaccgcgcggggcggtactcctcacccatgccctccgcggccaagcgctttgcggccacgctgggggagctgaccggtgggcgcgtgggtctcaccgccggcagcctgggcgtgctcaagggcgggctgaccatcgccatccgctactccgcgcagcgccagcagtttggccccgggggcgcagcgccggaggtggcggtgctggactacccctcccagcagctgcgcctgctgcccgcgctggccaccgcctacgcgctgaccttcgccaaggacgcgctggtggacaagtacgtggagatgaagcgcacgcgcgacgaggcgctgacggccgacgtgcactcgctcagcgcggggctcaaggcctacaccaccgggttcaccgccgccacgctgtcggtgtgccgcgagtgctgcggcgggcacggctacgcggccgtcaaccgtctgggcgccctgcgctccgaccacgacatctttcagacctttgagggcgacaacaccgtcctgctgcagcaggtggctggcctgctgctcaaggagtaccgcgactccttccgcggctccccgctcgccgcctcttggtcctacctgcgcgccgcgctgggcgatgcgctgcccgccaacccgctcctcgcgcacgacaccacgccacgccacctgnnnnnnnnnnctggtcctacctgcgcgctgcgctgggcgacgcgctgcccgccaacccgctgctcgcgcacgacaccacgccacgccacctgcgcgacccgcgcttcctcatctccgcgctgcgccaccgcactgcgcgcatgctgcacaccgtggccgcgcgtctgcgcaagcacacgcgccgccacggcgccttcaaggcctggaacaggtgcctgctccacctcctggtga

SEQ ID NO: 7255 - DNA, 261 bp, Chlorella protothecoides
ggagcagaatgactctgccttccccgagaccgtggcggtgaacctgtggggtctcgacgccatcaagaccaagggagaaagcgtggccatcgtgctgcatctggtcggcgcccggccagtgaaggaggggacggggcgcatcgcaagattcgagctcatacccttggaaggcaaggcagatgctctgatgtgggtgggggtgggcggtgcgatagcacacctgcaaacgtgcgctccatcccagggtgccagcttcatctg

SEQ ID NO: 7256 - DNA, 963 bp, Chlorella protothecoides
atgtctatgtgcacgctgcagagggcggctgccaccgatgaacccgaggacgccaacttcatccggaagcatgcacaggagatggcaaaggagggccactctcagacggcagcccgcctcttctccaatcccaaaggatatcatgagggtgaagctggctccggcccattggtggcacctggagcgccctggcaccacaaacgctgcccagatgccaatctccctgccctttggtccccaggcgactacggctccatggtgaacgagcgcgtcggggcctccaactgggagtctggcgaggagctgggcgacacctggtcctcgcgcaatgccttcagctacgggcgcggcggggagcggggccgggctcggcccgaggtgctggactccctgctttccaccacggaccgcgtggtgcagacggtggacagcgtggagtatggcctgaccgacatccaggagtactacgccaacacgggcgccctgcgcgccgcggcggagaccgcgcggcggcggcgcgggcgggagggcgcggggcgggtgggctgctcggtggtggaggccacgggccgggaggacacccccccgcgggagctggaggaggtgctgcgcctggagtaccgctccaagctgctgaacccgcggtgggcgcaggccatggccgcgcaggggtcgggcggcgcgttcgagatcagccagcgcatgacggcgctgctgggctggggggccaccacgcgattcgcccccggctgggcctgggaccaggcggcggagacgtacgcgctggaccccgacatggcagacaggctgagggaggccaacccggaggccttccgcaacctgctgcggcgctgcctggaggcggcggggcggggactctggaccccgggggagggggtcctggagggcctgcagcagctggatgccgacatggatgcagagctggagggtgtgaggagatga

SEQ ID NO: 7257 - DNA, 2280 bp, Chlorella protothecoides
  modified_base (398)..(407): a, c, t, g, unknown or other
  modified_base (2171)..(2180): a, c, t, g, unknown or other
atgacacgaggaccatccagcctcgcaagcctggcgcaggtaggcccatggactcctggcacaacccctcccaccctcactctaccagcccccagccttctcaccgtagatgccggtggaggggtcgtacttgatgcccaggtcgatgtgctcggtgatgccgaagccaaagttgccggagtcggagaagttgcggcgcagcagctcgtactccttgaccttcaggccggcctccagcagctggagcgccttctcgccgcgcacggtgacgtggcaggagatcttctcgttgcggcgcacagaccactggcgcacggtgtaccgggccttgccgaacacgggctgctgcccgtgccggctcgccgctgggccaaggtttcgcctcgtcatcgggagcnnnnnnnnnntggggacagtgccggcttgccgctggggccaaggtttcgcctcgtcatcgggagctgcactgccccagccccaggccggggcccgtgtcgacagccgtccgcgacgtcacgcccactccccgctacgcgacagccgctttgcagccccacatattgtttgacgatcgccagactctcccacgcagcagttcagcaccagcttcgcgacgcggatttcccgcatggggttggatgccttcttgtccgcctgcaggggagggggtgggggggccaacagggctcagcacccattgtctctcgagctggccaggcaggccgccgcaggcacgcctctgtctccgtcaggcccgtgcatccccgcggctcaccaccatcgtgtcgagtaggccctctctacagcctacaggcacctgaaagagggatgcgctcgcgtggccggcccgtatacagagcgaggtcccccgccggggtcgtaagcgcggggggaccctgtcggtttcccgccaccatatcacggacctccgggcccagggcgcaagagccatgcatggacgggaaagatgagcaggctcatgcacgaacttccaaggatgaccagcaacatactcaaattgcacattcaactcatcccagggagagggccccatacatccgatcaaaccctcccaagtacatcagccgcaggctggccccgcgcatttgtcctgcgaacatgtcaggagtatgctcaggagggcctgcttcgcgaattacatcgactcgctcgcaccttctggctgcagtggcacccaggctccttcgacagcagaggcccttttccagtctaggtgcgacaaggagggacaaggagtcgcactatgcaccgttgtatcatgagcgttcgtactccgcatcgggatttcacgaatgcaccatacgtttctccgtaggacgctcctgcacaccagcggcaaggagggatactgtagtgtcagcaagggccatccccccacagcactttgcctccatcatcgagggcgacaccaaggccactcccatcggcgatgagaggtgggatgtttggaggtcggtggttctagaggggcacgtatggctcgatggattcaggcgtggtgcatcgcctgcactccgtgctcccaacagaccccagcagacatggccaccagggcgctgtcgctcgccatctgcagagcagcatgacacaaacctttcctcaccctcagccccattcccacccttcagcgaggtcgaggtgtatgcggagtacgttgcggcgtaccagcgcacgctgggcatccccggcgccgtggagttctcgcatggccccgacggcgtgccctgcgtccgcttgcttcaccccaccggctccagcgccactgtcagcctgtcaggcgccggggtcctgagctggacggctccccagggtcacgagatgttgcacgtgcggcgcggcgggcggcggcgcggcgcgccaccggccggtggcgtgaccctggcctggccgcagtggggcccgggcctggcgctgcccactgacggcgtgctgcgcagcctgccctggacgccaatccagacctcttgcgaggcggagaacgaggacgcggaggaggaggaggaggaggaggaggagggggaggaggaggaggaggaggaggaggaggagggagagggggaggaagaggatggcgacgaggacgacgaggacgaggaggaggaggacgaggaggaggcgggggcagtcgagccggcgccgcagccgctggnnnnnnnnnncgggggcggtcgagccggcgccgcagccgctggacagcaggcccagcgtggtgctgcatgccacctcagaccgcgcggtgcatccctccttcccccatga

SEQ ID NO: 7258 - DNA, 744 bp, Chlorella protothecoides
atggcagcgacactcccccacccacaatcccctggaccttctccccaggcggcacgggagatgcgggagcgactggagcgcgccctaggccctgaagccgccgcccagcccttcataggcaccttccacggcttgggcctgagcatgctgcgccaggccagctctcagctgcccgctggctgccgggtgcgccccggcttctcggtggccgacggcgacgccgccaccgcgatgatgcagcgattggtgaagagcaaggcggggattgacatcaggcagtcgggcgcgaggacgtcggcggagcagaagcgcaccgtcgccaagcaagcccgcatcattctgagtgccatctccaggatgaagaactccgtgcctgggtacgcagcgctgaagggggagcaggccatgctgcgggagctgatgcagcgtcggggcaccgagctgacgatgcagaacaagattatggcgcgggagatgggccagtggtacgaaatgtggtgggatgctgccatgttgggactcattcctgagagcatcctgactcacccaatgcgctgttgtcaaaagccagggcaggaccagatgggcatcgatgcgggtgtctcgttgcgctgtgcccttgattcaggcgatgcacggctgtccgcaccacaacctcccaccactccctccacttcatgcgcaggtatcgcgacagcctggcacagagcaatgctgcggactttgacgacctgctgtccctga

SEQ ID NO: 7259 - DNA, 591 bp, Chlorella protothecoides
atgaggacacagtgctgggatgcgcatggatgtacacatccacatgtcaacaaaaatccctaccgatatcagaagtgggcagacgatgtcccaaatatgtcattgcacctgggacggggtctgaggcttgaccgcggagccttggtcagacctccttcgcatggtgaaatgcagctcagcatgcgcatgcatgggatccccatgcagctcctgggaggttgcagggcgtaccagggaagtgtgaggcccatccatgggtctgtggcgcccctcggctcaggaggaagtgacaccaaagagcacctccagggtctgagcggagagcagcaggcttcagttgcagcgcccttgggcacttccttggtggtggcggggcctgggagcgggaagacccgtgtgctgatctcgcgcatcctgcacctggtccaagcccatgacgtcgccccgcactccatcgcagccatcactttcaccaacaaggtggggcgagggcggagcctgttgtgcggccagaactgtgcctgggcgatgtggggaatgcaccccagactggaccttgtgcaagtgaccacgcctcgggtccctgactga

SEQ ID NO: 7260 - DNA, 693 bp, Chlorella protothecoides
atgccggccgcggcgcagcaggagctgtggccctgcttctcgcgctacccgctcctgcgtctgctggacgggcggcttaatcacaccgcggtggtcctgcgccgtgcggtggcgggggtggggtccacctgccgcgccttcccctggtgccggccgcggtacaaccgcatgccgcccctccccggcatcgtgcgcgggtggaaggagaggatgcaccgctgcctgggcctgcccctggacctcgtgagcaaccacacccacccccgcatcgtcttcatcaaccgcccgctgggccatggccgtgccttcatcaacatggaggagacggtgcagcgcctgcaggtctcgagggtggcgagggacttccccaccgccagcatcgtagtggagacgctggaggacgagtcgctgcgaagccaggcggccaagtacgcggccagcgacatcgtggtgcagatgcacggcgctgcgctgggcaacgtcttcttcatgccacgcggcgcggtgtacgtggacgtcgtgccggagctgaacgaggacaagcacgcctgggcctacttcatgctcaaggactacgcggcgctgggcatcaaccccatcgcgctgccgccgcagcgggtggagctcatggagtacaccatcaacaagaccatgcgcgggcacctcaacactctgaccaagacgcagaggtaa

SEQ ID NO: 7261 - DNA, 792 bp, Chlorella protothecoides
  modified_base (636)..(645): a, c, t, g, unknown or other
atgacggaggcggcacagctcaccgacgagcagatacgagctggctgggggggatccgtgtgggggtgggggaggtgcggggtcttcccggacagggtcacagatcaccagaacacgctgtctgatcaagccagccacctgtcaccgcctgtcccgcgaacgcatatctcacatcctttcgcctttttcactgcaggcgatgcgcacacaatggcagcatgcgccggttcttcactcatacatgatcccgtgaatccaatcttctaccaggggaccatcaccaccaaggagctgggcacggtgatgcgcagcctgggccagaaccccacagaggccgagctcaaggacatgatcagcgaggtggatgcagacaagaacgggaccatcgacttcccagagttcctcagcctcatggcacgcaagatgaaggactcggacagcgaggaggagctgagggaggccttcaaggtcttcgacaaggacggcaatggcttcatttcctctgcggaggggagatcaagctcagggcatggcataggaatagctgcctccactctccggctgcatttaccctggttctttgagacaagggggctagtggtgacgactttcacacttgccacccgtcatccctcnnnnnnnnnncccgtgggtcgcggcagccctatggctcaccgacagtctcctcgttctctcatcattataatttgccatgcagctccggcatgtgatgaccaacctcggcgagaagctcacagacgaggaggtggacgagatgatccgggaggctga

SEQ ID NO: 7262 - DNA, 1872 bp, Chlorella protothecoides
  modified_base (285)..(294): a, c, t, g, unknown or other
  modified_base (532)..(541): a, c, t, g, unknown or other
atgtacgacgacgcccccgagacctctgaacccgccaaggagccggcatcgggggctgcggaggagccgagtgcggctcccactgctgcgcaacccgatgagggcgatcccctctccctgccaccccacggcgccgatgtctttgttgggggcgtgccccgcacggccacgtcggatcagatacgggattgggccagcaagatcggagaggtgggtgctagcgctgaggtgggtatgttcttctcaccgagcataaactccaacagatgcaggcaggggcgcgcnnnnnnnnnncggtgggtctgtacttcttaccaagcaaaaactccaacagatgcaggcaggggcgcgcttgtgagagggggcctgcatgatctcgtcagcgagggatctcagggaggaggtttggactcggcgccccagcactccatgcagcctgctgctcgccgtcttcccgagttgacggccatgcgataccgcacggcaatgctccgatgtggagagaccagcgataccgacacgccaaacccannnnnnnnnngttcccgagttgatggccatgcgataccgcacgccaatgctccgatgtggggagaccagcgataccgacacgccaaacccacgctcactcctccccgctgcccctcccagccccacgcccttccaccctcctctcccccacacggtctccaatccagccaccgccgccctggcccagctccacagcacggagctgccggaccaccccgggttcaaggtgaacaggggttttgcgaggattatgagtttcagtggttgttgtctgatggaaggggcggggggcggggttgggaatctaatgagcttgccagggtggccagcgtggcagccctggacccaggtcggggggcgcggctgccgtcgcctgcacccgagtttgattgctggatggggcctcccccgaaccgcccacacccagctcctcccccctacctccctccaatacaatacactccccaggtgcgggtgcagcccagccagagcaagcaccgcctgttcctgggcggccttcccaactccctgacccaggcggagctgcgcgccgtgctggagccggcgctgcgcgggctggagggcgtggagctgatgatgagccgcgagaacccggagtccaaccgcggcttcgccttcctcgacatgtacaacgcggcggcggccaaggccgcgcgtgccgtgctctccgcccccgacttccgcgtcggcggacgcggcgtcaccgtggactttgcagagccgtcggcgcgggggccaggggccgaccgcagcgccgcggcaaagcccgccccctcgcgcaacgtcttcgtcggcgggctgcccgccggcgcgggggaggacgcgctgcgggaggcctttgcgcgcttcggcgctgtggaccgagtgcatgtaccccgcccccgcgacggcgaacccgcctccaagtttggcttcgtgacctttgcggagcgcgaggccgcgaccgctgcggtggaggccggcgacgaggtggaggtggcgggcgagcacgtcaccgtgcgctacggccgcagcgagcctggcggcgcccggggccgggggcggggcggcggcggcgggcgctacggggcggcaggctatgcggacatgggcatgggcgcggggcaggggggcatggtacccctcgtccccgtgcaactggccaacggacaggtgcatcggaaggggggaggcacggcttcgtggcgcccgtgtgtttcagatgctggcgggttttcccgagcgagacgcgctccctgctattgctcaagcggaacggcctcggtctcatcttccatgacaccctcgatgggtcgatcaggccaaccccccacccagtga

SEQ ID NO: 7263 - DNA, 543 bp, Chlorella protothecoides
atggggtcaatgaccctcctttgctggaatgtagccgcactggtaagtgttcaagatacctttgattcttgtggcattcaaaagcttcatcctggcaagtttccaggaacccatacgactttcatgcaggcacccactctcaagaacattgctctcaagtatggctcgctgtcagacctcttcggcgagctggagttggacattgcatgcttccaggtgctggtactggtcatggtggtggtccagatcaacgatagggaaacaaagctggtagaggctcagctcaccaaggagattgtgtgtgtggatgactgcgaggtgaacgccgtgaagatggttttatttctggcaacgagcttggttggggattcctactgggcggtgtctcgagagaaaaaaggctactcgggcgtggtgacctacgcgaggggccagtggcgtgcagcgcatgccgaggtggactgccttgcctctggagagtcggatatcgatcgcgagggtgaggctggggggcgggtgaggtgcagcagtgcatgtgtatga

SEQ ID NO: 7264 - DNA, 915 bp, Chlorella protothecoides
atggcgtccttcgagaacttcgatgacgaccgcgaccagatatacatcagcgggctgccccgggatgtcacagaggatcagctggcttcccacttcgggcagatcggtaccatcaagctggacaagaagaagcgccccccgacgcccaaggcacgcatcggggtcctcgatgtggcgggcaacggggcgcgctggctgcgtgcaagacatccccagccttcccggatagaggtgcaaggcttcgctcatcctcccggcacccatccagtcaggccccttcgtggtttgacggcaaagaattcttgggcaagtgatggctgccctgggtgtccggtggtgttcgggggttgggtagcacgcctgtggaccgcctggccagccccgcgtccaacccctgctgctcggacaacaacgaaagcagggaagaccctgcacgttagcttggcggagaagcccagagctgcagccggcggggaggcctacggtcgaggtggaggaggtggtgggtatggcgccgcgccgggaggtggctacggcgaccgcggcggctatggtggtggcggcggtggtggagaccggggcggctacggaggcggtggcggcggttatggtggcggtggcggcggctacgggggaggtggcgaacgcggtggatttgctgctctctcccctccgacggtgccacctctgttgaacgcagcccctgcaccccctgacacctggctgtctcacacacttgcaggtggcggtcgtggccgcggcggaggcggcgcgcgcgagggcgactggctctgccccggctgtgggaacaattgcttcggctggcgcgatgtttgcaaccggtgcaacacgcccaagggcgacgccggggccggcggcggcggcggcggcggtcgtggcgactttggcggcggt

SEQ ID NO: 7265 - DNA, 786 bp, Chlorella protothecoides
atggggctggactaccacaccgccctgcggctaaacgacaccctcacctcccccgcggtcgcctggctgccccccggcctgcgccggtcggcgctggaggccggcctggcgctgggtcaggcggcggcgcccgcgctgggtacgctgcgctcgcgcaacatccgcgctgcgctggagggcggggagacgctgcgcctgcagtaccccaaggaggacctaggcttcgtgtatcgcagcccggacgccgcactggcgccctcggctgccgacctggcggaggtggacctggcggcgcggccgcggccgcggcacgcgccctacacccccgcgaccctggtcggagggcggttgccccatgccgcggtggatgccgtcatctcccgcggttggctggccgggggggcggctgggccggcctcgaccgtggacctgtcctgcctggccgccagccccacgcccctgctcctcctgctgccttccggatacaaggctctggaaaggagggcatggctggccgctgccgaacggcttggcccgcagcgggtgcttcctgtggttctgcatctcggccgtgccccagtgggggccgccgccgagcgaaccaatgccctggagctgcagtgtgacccggcatcaggtgcttgggcgactaccgggggcgcgcgggtgctgctggtccggccggatgggcacatcggggccaagtggagcgagcaggtggccgacgcggggcgggcgcagggagccctggagcaggcgctggctgctgttatgcattgcgcctga

SEQ ID NO: 7266 - DNA, 423 bp, Chlorella protothecoides
atgctgggcgacctgctgggcagcgtggaccactttccgggccaggcaagcccccacctgcccctgctgtcgcccgagccggtgacccacctgtcccagcacaaactggtgccgctgctgtggcaggcggcgctggccgatcccctggtcggggcggcgctggccgatcccctggtccaggtgctggcagggtgcagcgtgcgcagcgtgcgccccggcgagggccacgtggaggtggacatccaggagagggccgccggcacgctgcgcacgctgcgcggcgcctacgtggtggcggccgacggcgcgcggggcgggctgcgccaggcggcgggtgtggagctccagggcagcgccggtctgcagcacctcatcaacatccactttgtgtccccagaggtgcgtggattggtggagggttga

SEQ ID NO: 7267 - DNA, 336 bp, Chlorella protothecoides
atggaggactgcatcatcacggagcgcgaggcgcagcagatccgagagcaactgaagaaccggaggaagtctccggggaagtccaagctcgcgggcagcagcgggcccctcgctcggccaatcgcaccgagggaacccccgccagtgaagaaggcgttcaggaccttcaaggaaaggtggctgtcctgtgcgggagatctggacacgagccagcagctgaaggcggtggagcaggggatcgagatcttctcactcctgcccaaggaatccaagtacgcccagcaccgcctgaagctcctgcgcaaggtccagctgctcctcaccagcactgagtga

SEQ ID NO: 7268 - DNA, 627 bp, Chlorella protothecoides
atgccccagcgccacgctcgctgtttgcttcgagccaggcgtcccgggggatgtgcgtctgtaggaaaccctcgaccccgtttcgtgatccccgcccctctttcctcgccagacaccggggaccggcccgtggacgacgccgcgctgcccgcccccgccctggaggagatgaagcaggccgacaaggggcaggtctactccatggcagacaagccctggtggggctggctggaggacaagcaggtgggcaggcagctgggagggcaggggagtcgtgtagcgcagaagggcagagggaaacggcggcacgcgggagtggggctggacccgcgccgccccggtcagccagcagcgcgccggcggcgaggagggcgggtcgaagaccgtgcgaaagcgcctgtcggagcaggagcgcgcgctgcgggagtttgcctgcggcatctgcaagaagacggtggtggacccggtgtccacgccctgcggtgcgtggcgaggaggcaaggacggcagaggggtggtgctgggtggtgcagcaaggcggcggggacgattcatgggcgggcacggtcgacgtctgcgtggcccggggcctcagcggcagagtttgcaaggatggccggttattaa

SEQ ID NO: 7269 - DNA, 282 bp, Chlorella protothecoides
atgaggatgctccgtgcactgcgctttgctccaaagcctggcaagctctggcccagaggcgtctccacatcaccatgccccggtctcgatgcagaggtggtgattgcggggggggggcccactggcctcatcaccgctctgctcctggctcgctggggggtgcgcagtgtggtggccgagcgcagcaccgcgctgactcagcacccccaggcccacctcatcaatcaccgctccatggaggtcatgcgcgccgtgccaggtgggccaacgagctgtacatga

SEQ ID NO: 7270 - DNA, 285 bp, Chlorella protothecoides
atgcagttcagtgccaagttctgcgcaaaccctcgcatcaacaccgcgctcacgatggccatccgtgccttcaagatcggcaccgtcaacccctcctccaagccctttgagcgcatcaacgacgccgaccgcccagacgaggccttcaccacggatcgtgctgtgagggccgggcgtgccaatgccgccaggtgggcgctgagctctggggttgtgtggcggcgtcgcagcctctttgagtgttccagaatgctgccatttgctccttggctggtcccgctctag

SEQ ID NO: 7271 - DNA, 1317 bp, Chlorella protothecoides
atgctgggagggctgttcggtgcactcccaccccccaagcaggcctcctccaatcccgctcaggcaataacagaggacactaaaagaaccagcacgcatgatgtaggcgttccgggacccgcattgatcaaaaggccccgcgtcgaggcggcatcacctccccactcccggatctctgtcgaggcggcgagcagcgaggatgcggggtgccggcccagcatggaggaacgagatccaggcatagatgccagctcagcgtttccagcttgttcggacctgataatcacacctcccacaccggaacgtgtccacccaccgccccaccccaccacctctcgcaggcccggcttctacgccgtgtttgacgggcacgggggcgtaaatgtggcccggctggcatccacgctgctgcacgaggcggtgctggcggcgggcctggcgaggctgtcgggcgaggccgggctcgggcctggcgccatggaccgggctcgcgccgcgagggccgcggtgatcgagggctaccgcgccgcggacgcggccatcctggcccggtgtggggaggagggctggcgcgacggcgcggccgcggtcacgctgtggacgctgggcggcaccgtggtcgtggccaacgtgggggacgcccgggcggtgctggcccgcaggccgtcgaagggagagggctccacagcggcggcggaggccggggatggaagcgcagacacgaatggtgtgcccaccgatgtcctggttgaggcgcctgacgcgagccctgcccctgctgacaccgacgtcggagcggcagacgccagcgctgcccccgccgtcgccggcaccgctgctgacacggacgaggaggagcctgcccgagccggcgccacgcccctcgctctgcatcacgccgcgccgcacgacgcccacgaccgcggcatgcccggcgggcagcgcgacgccggccccggatccggacctccgacacccacaaggaccacgctgcgcgcgctgatgctgacgagggagcatcgcgccgtgctgccggcggagcgggcgcggatcgagcgcgccggcggctgggtcgggcccgacgggcgcctgctggggcgcatcgagctgtcgcgctcgctgggcgacgcggccttcaagcggcgcggcatgtcggccgcgccggacgttgccgtgttcgaggctggggggcgcgacgttttcctcctccttggctgcgacgggttctggggtgaggaggggagggggggggcaatgcaccagcaggaagaccatgtgggtatcgcacgagcctgtggtggtcattgcgcagggtga

SEQ ID NO: 7272 - DNA, 1293 bp, Chlorella protothecoides
gtgcgccagcccctgccgctcaagcccgggacgggcgcggtgtgcattgacgcggcgcggcccccggccgccggcttccggctcgaggtcgggccggcgctgccctgcctggagctggcgctggagggcctgtcgcccacctgcctggccggccaggtggcgctcgccacgctgcgcctgcgcaacgccggcggcgtccccctggccggcctcaggctggcgggcggggcagggtggcacctcgccggcgccgtgcccgcgccgggaatcgacggccacgccctgagcctgggccagcgactgttggtgtcgtccgaggcgggcgactgggccgcgggcggtgtgacggagggtgcagagcccgtgcaggcgccggggccgccggcgctgaggggccagttcgcactcaaaaacctggcctggacgctggtccccgggacccccgcccggctctactccgcgcccgaggtccagctggcgccgggggaggagctgagcctgccctgcgtcatcaggtatcgaacgatggtgcatgcggggcgggccagggggctcgccaggccctgggtggggatgccagtctgggagctcctgagcctggctgggctgaagccgccgggaccgggggcctggggcgccgtggggagggcgcgccagggcatccagcgtcgtggagctgtgggccacccttgcggaagggcgaccggatcgaacttcccagctgaagaccgttccatgttgattccttgtcagacacccctccacctacaaaacaacaacaacaccctcaggctgacgcggcccggcccgcgcttgctgtgcatcgcggcgtcgtaccgtgtggccggcggcgccgtgcagggcgcggcgcagcgctcgacgcgctgcgcctttgagacggtggtccagccgtcgctgcagctgtcggccgccgtcgcggcggggacctgcgagccgggggccgcgctgctgcagctgggggtagtcaacctgcagggcctggaggcctttgagctgcaccggccgcgctgccccggctggacctccagcgacatgggcggggggttggagggcggggcgcacggcgacgccggggatagccccgccgccccgccgccacgagtggacgagcttgcggcggggggcgccgtcacgcggcacgcctggctgcgccggcgggatccggcgcggccgctgccggccgactgcgacgtggtgctgccctggttggccgcgaagcgggcgggggcgggcgcgagacgcgggctctccgccgtgccgcgccagttgtga

SEQ ID NO: 7273 - DNA, 837 bp, Chlorella protothecoides
atgacgcatgagctcgcccacctcacccactgcccattccagccgctcgtacttgtccagcctggagtccttcctgtggcgctttgcatgggccctcaccccacccctaccccaacccaccctcgccccaccccaaacccacccctaccaaatgactttccacatcgccggccagctctgacccccccatcccgcctccctcccaggctcttcatcggcgggttcctcatgttcatctgcggcttcatggagttcctgcgccgcaacacctctggcgccaccatgttcacgctcttcggcgcattctggttcaccctgaccatctacaacctgctcttgtttgccggcgtggccactttcatgctcactgccatgcccaagaccgtggcctgcctggctggcaccctgggcttcatcaccgccgtcatggccattgtcgtggccaacctgaccctggccgtcgccaccgcacagggcctcctggccctcttcctcatcctgctggcggcggcgcagatgaaccccgccaaccacaccctgctcaaggtggggggcgcctttggtatcatcaccgccatagccgccttttatgttgccatggccctgagctgcgaggaggtgctgggccaggagatcctgcccatgctctactccaagaagtttaagatgcacgccggcaacctgtacccccggatctccctgtccgaccccctggcgctgtcggcgggggtgccctacgaaggacgctacgagatccacaagggcgacaatgtggccgccatgcagcagccctccttggtggacctgaaccgcatccaggcggaccagagggtgtga

SEQ ID NO: 7274 - DNA, 1293 bp, Chlorella protothecoides
  modified_base (357)..(366): a, c, t, g, unknown or other
atgaccacaccccaaaccctcccttccctcccctcaggtgatcgcgtatgcggaccagcggtaccgcatctttggcgagacggtggacatggcggtggggaactgcctggaccgcttcgcccgtgtgctgggcctgtccaacgaccccgcgcccgggtacaacatcgagcagctggccaagcagggccggcgcctggtggagctgccctacgtggtcaagggcatggacgtgtccttcagcggcatcctgtccttcgtggaaactgcggcgcgcacgctgctagacaagcgggtcggaattccgccccgccgagcatgaagtgcactacccgcaccctgtgcttggcacctttgacnnnnnnnnnngacgctgctcgacaaggtggggcagggtgtgggggtgggacgggtggggactggggcgttgagtctgggggaagcaggggacagccaggcgatggcctgctcctggggggggtatcagcgggtccgaattccgccccgccgagcatgaagtgcattacccgcaccctgtgcttggcacctttgacttcccacgccttgaaagcgctctgcatgcctcccccgccccggaacctcatgtccgaccaccagacctgtcatcctcaagggcgctcccctatggtcccccactcagccccttccctcccaccgacacagggcgaggccacgcccgccgacctgtgcttctccctccaggaaaccatcttcgcgatgctggtggaaatcacggagcgggccatggcccactgcgccaccgccgacgcgctggtggtgggcggggtgggctgcaacctgcgcctgcaggccatgctggccaccatgtgcgaggagcggggcgggcggctgtatgccaccgacgaccgctactgcatcgacaacggggccatgatcgcgtggccaggcgtgctggcgctgcgcggcgggcagacttgcgccgtggcggagtcggcctgcacccagcgcttccgcaccgacgagctcagatcgtacatgtcgtgtatacattctttacatacatgcgccataccggacgcgggagagggagtacgtgtggggtgcagtgcgggacaaacaagcctagccgagggtttggagcgacaacggggagcgagcgggaatgaaggaaagagtagacgagtggcggctttcgagccgtgggggatcaaagctgagcagagaggtttgcagagcggcgagcgtctccacaccccaggtggaaaagcaggggaggacttggagcagccccagcgcgccccatgttcttcttaa

SEQ ID NO: 7275 - DNA, 1494 bp, Chlorella protothecoides
atggggcgtgacttttataagattctgggcgtcagcaaggacgccaaggatgatgaattgaagaaggcttacaggaagctggccatgaaatggcacccggataagaaccctggagataagcagcgcacgctccgatcatggatcctgccctgcgccccatttgatcaggcagcagcatccgagaagttcaaggaggtcagcgaggcgtacgacacgctgtctgaccctcagaagcggcaaatatttgacacatatggcgaggagggactgcagggcatgccccctcccggcacggagggggccgcaggaccgggcggtatgcccggcggcttccctggcggcgtccctgctggcggcttcccagggatgggcgttcgattccagtctacccccgccgggttctccgaggatacggcccgacgcatcttcgaggagttcatgggcggagacctgggcggcatgttcggcgggggtggactgggcggaggagctcgccgcgtaccctccttccaaggtatttttgcagagtcaaggaagcgccctcaaagagaggcatgcggcggggcttggatgtgttgccctgacataatgcatgcgtttcactcctcctttcatttgcgctcccaccgtgcaggctcgcagggcggccgtctgggccctgagctctttggtaggaggagcagccgcgggttccaaggcatgggtgacgacatgggcgagggccctgcccccaggccacagaagattgaggtgcagctgtcgtgcaccttggaagaggtgggcacgatgaaggctgtggtgtttggtctgggtatgggttggttgacagtcaggtcgagcaacatcctttacattgcactcgccggtgctgggtggctgccctctgcccttgcctcctgcgtcctttctgtccacctcaccaccaccgccccgcctcacgactggatcgacacaacattcattcccaacccacccctcccgcagctgttcaacggcgccaccaagaagctcaaggtcacgcgtaacgtgaccgacgcggcaggcaaaacgagcaaggtggaggagacgctggagatcaagctgaagcccgggtggaaggaggggacgaaagtcacctttgagggcaagggcgactcccgccccggcgccccgcgccaggacctggtgttcgtcatcaagcagctgccacatgcgcggttcagccgccacggcgacgatctgcactaccccgtgacgctgtcgctggtgcaggcgctccaccccgacagcctggacgtgcccaccctggacaaccgcgttctgcgggtccggccccgcgacaccgtggttctgccggggtcgcagaaggtcatccccaacgagggcatgcccaaggcgcgggagccgggcaagcgcggcagcctggtgctcaagtacgacgtcaagttcccgcgcaaggccctggacgccaccgaggcggcgcagctcgccgcgctgctggagggcaaggagtga

SEQ ID NO: 7276 - DNA, 1989 bp, Chlorella protothecoides
  modified_base (505)..(514): a, c, t, g, unknown or other
  modified_base (1868)..(1936): a, c, t, g, unknown or other
atgtctgatccagtgataggtccctccccgtcagatgctacaccatcccctcccgtcccgctgcctcacccttgctcgtatgctctgcagattcagtccgtcccgctcgtcccaaccccctttggtctttgccactccttgacactgcgagggcgctctgtagtgcgtcctacaccccctcctcaaacttggattttaaaagtcgatgaacatgcatcttctcggcgtctacgtcagggcaggtggagagtcacagcgagtggggaggggcagcccaccccgccacgcccctgtgcacatgaagtcttctcgggggtgggggcgcggggggaagcactggctgcccaaagaatgaagcttgaagggagggaaaggggattgagggccgggagggtgcagggcaggaacctcacggccgtcgttatgcagatgctcagggccaggagtggagttttgctgcaccgccatgcatgggcctgcctgccccagtcttggcgggggggcnnnnnnnnnnctgcccaaagaatgaagcttgaagggaggggaaaggggattgagggctgggagggtgcagggcaggaaactcacggccgtcgttacggagatgctcagggccaggggaccagcgtcagcaggccacgccaggcatcacacatccgtgcgccccacggcgccggggcccacccctcacgaccccatgcgctgctggagcatggcccggtggtgagccagggcccctgggtgcatgacggggacgccagcagccacgccccccggggtcacgtgcatcatgcccatgcccggggcggccatgtggtggcccatgccgtaggccagcagggacggctccggcggcgcgggggaggtgatgtcgtggatgctggcgcgccgcttgtccttgcgcgactggctgttgagccggatgaagtacttttgcgcgtggctggccacctgggtgggcgtgcgcgtgatgacaaagttgcgggagatgctgcgccagtcgcccttgccgtacttggccaggcccatgaggaagaggcggtgctcctcctccgtccaggggatgcccttacgccgctccgtctcctgggacttgaccttcttctgcaggtgcgcctggattggcggggggggcagggcttccggagtccgacaaagcgaggcaccacggcagggaacattgattgcacacaagaacagcagacgcaccacggagagggactccccaggcacagcatagttggggagcaggaccctcccctcctcgacgctcatgacatctctctgaacggtgggaaggagcagacagcgaggtcttgcctgctcctcacccgcacaaagcagggcgggcccatcaccgacagaatattcccacgcctgggcggcgtcgctcaaccccaacaaaggaaacaccacgcacctccagctgctccagccgctgcctcacagactgcacatcccgccgagcgagttgggtggcgcagcgctcacatcgatcgacccgatcccagacgtgcgccagggcgtcctcaaaaatcttgtcctcctccttactgcgagacagggagcggggcctggtgtgacgataatctctcgccatgcgctcttgattgtgcatccccccctgccagtacatcctcccacctccacggctcctcgaccatgccggacggtgtcgacgaccctgcgccccccagcatgggcgcggacaagagggcgacctcctctgcacagtcaagaatcacaaaccatagcacggactgccagtcaacatccaaaggtacgggagatcatcgatcaccggggcaatgcctggtgtgcaagctccgacctcgactcggaatgccgtggccttatcgctttgcatnnnnnnnnnnnnnnnnnnnnnnnnnnnnnnnnnnnnnnnnnnnnnnnnnnnnnnnnnnnnnnnnnnnnngacatgaacctcgcgatggttctcgaggaaaagagcgatctgccaagtactga

SEQ ID NO: 7277 - DNA, 495 bp, Chlorella protothecoides
atgagcgtcgaggaggggagggtcctgctccccaactatgctgtgcctggggagtccctctccgtggcgcacctgcagaagaaggtcaagtcccaggagacggagcggcgtaagggcatcccctggacggaggaggagcaccgcctcttcctcatgggcctggccaagtacggcaagggcgactggcgcagcatctcccgcaactttgtcatcacgcgcacgcccacccaggtggccagccacgcgcaaaagtacttcatccggctcaacagccagtcgcgcaaggacaagcggcgcgccagcatccacgacatcacctcccccgcgccgccggagccgtccctgctggcctacggcatgggccaccacatggccgccccgggcatgggcatgatgcacgtgaccccggggggcgtggctgctggcgtccccgtcatgcacccaggggccctggctcaccaccgggccatgctccagcagcgcatggggtcgtga

SEQ ID NO: 7278 - DNA, 246 bp, Chlorella protothecoides
atggcgagagattatcgtcacaccaggccccgctccctgtctcgcagtaaggaggaggacaagatttttgaggacgccctggcgcacgtctgggatcgggtcgatcgatgtgagcgctgcgccacccaactcgctcggcgggatgtgcagtctgtgaggcagcggctggagcagctggaggtgcgtggtgtttcctttgttggggttgagcgacgccgcccaggcgtgggaatattctgtcggtga

SEQ ID NO: 7279 - DNA, 495 bp, Chlorella protothecoides
atgcctcccggcggaaggccaggtcgcctccatcctcgcgtcctggatcgactggaagacctttatcggaatggagcggtccagcgccgcgacctcgacgaacgcgccctcgattccctggcccagctcccccccaccgaggccatagaatccatcgatcgattggagcagagcgtggccgggggccgggtgcgcaacccggccgcctacctggctggggtgctgaggagactgccccgcgacagcggccccccccactcccctggccgtggagacaggcgcgacgaccgccccgacgaccgccgcgaccccgcctcccgcctgacccctggggccgaggccaagctgagggaggtgggggtgctgtcggggcccggcgccctcgacgaccgctccatcgcggggctggcccgcctgtcgccggagatgcagtacctcgtggcagacacgttcagcacgcgccgcctggacggcatccgctccatgtcaggttga

SEQ ID NO: 7280 - DNA, 402 bp, Chlorella protothecoides
atgcaatttgctggccatggggttgatcagccggaccccaccctcatatgccgactcccacctgcacccaggctgaaggggtatggaggtggagctcatgttccttacgcctataaaatgtacgagcattggccctttgacgactacagagtatttacgatggatattgaagcccttgagcagtgtatccctcaaggagcccattcatgccaaattgttggcatggtccagtgcatgcccacgggtgtgccgcagtgccaagcaaacaaggacggcaatgttggcaccggaaacgtcgggagaaataattatggtaattacaatttcggcaacagtaacataggtaagctggacgggcgggcagctgcgcctgctgctgtagactccatttgcagccactaa

SEQ ID NO: 7281 - DNA, 921 bp, Chlorella protothecoides
  modified_base (194)..(203): a, c, t, g, unknown or other
  modified_base (396)..(405): a, c, t, g, unknown or other
atgcctggacaggtcgctggacgtctgcctctcgcccttgcaccgcgaatgcatggccctgaacgaagtctagggttcacccatggttcatctccctccccacgcaggcacagctcgaagtcgcccgtcctgcgtgccgtgaaggacaagacggacaccgaggaggtgggtagtggtgtggaaggagagggtgnnnnnnnnnncatgcctggacaggtcgctggacgtctgcccctcgcccttgcactgcaattgcatggccctggacgaagtctgagacgcaaggatgtgcgtcccaagagtgcatcacaccagccggcctcattcttgccagcgcctccacgaatgtcctccctgcgcagcccgtggacccggcggccaccaccgaaaagtacnnnnnnnnnnaaactgggaagggtgttgcgctgctcgcaggcgcaagggtgtgcatcccaagagtacatcacaccagccggcctcattcttgccagcgcccccacgaatgccctccctgcgcagcccgtggacccgtcggccaccaccgaaaagtatgggctggaggccgggctgtggaaggccctgacctcccgcgagcgcaggcccgacgctccctcccgcgcggacgaggccaaggcgctgctcaagcagtacggcagcgcctacctcctcacctccatctccttcgcgctggtctccttcggcgcctgctacctcgccgtcagcgcgggggtggacgtcggcgcgctgctgacgcgggtggggctggcccccggcgccacctccgagcgcgtcggcaccgtggccatcgcgtacgcggcgcacaaggcgctctcccccgtccgcttcccgcccaccgtggcactcacccctgtggtggcgcgctggctgggaaagcgcggcaaggagggctccagcccctga

SEQ ID NO: 7282 - DNA, 1455 bp, Chlorella protothecoides
  modified_base (233)..(242): a, c, t, g, unknown or other
  modified_base (427)..(436): a, c, t, g, unknown or other
atgccacgatgttgcctggatgaagactcagacggcactctgctgcaacagcaacgctatgcacatctcgcagcttacttctctttgctgctgccgccttgtcctcccgcacagctgtcaacatgcggtggaggtcaccctcaaaggaatcagagcaggagcagccgtccacctcgctggggtccacctgataaggctcggactctgggtgggactgggacggcacttgccannnnnnnnnntgtccacctccctggggttcacctgaaaaggctcattctctgggtgggactgggacggcacttgccacaagggcgagccagggttgccggtggggcgatgacggcagcttcctcaacttggcccgagaggaaagcatcttggagatcctcgcgcgttgtttgtaggcaccgcatcctccaggttnnnnnnnnnngggggcgacgacggcagcttcctcaacgtggcccggagaggaaagcatcttggagatcctcgcgagttgtttgtaggcaccgcatcctccaggtatcgtttctcgggtccaagtccggtcggtgcaatgctaacccgcgacgagaggagtccgacctacggacaggagcatgtggagggcaacgtttcggacttcatcgagagtacttttgcttctcgctacgtggtgagcctgcatggtggtccgatgatgggcgagggagcaggagtgcgcgcagtcgtctccatactttaaccacacgaccttgtcccccctctgacaggcggagcccctgccccgttaccagtgagtgtgtgaatgtaaactcatttcaaaccgacattacatgcatatgtcgaaagccgggcgggcgaagggttgtgccatgcaccgtaagcaccccggtacctcgggcagcttggtggaccccatccccctccggcccctccccggcacgccacaggctctccgaatacggggtgccggcccatgtgtgctaccagctgatcaaggatgtgagggccctggatgccacgcccaacttctcgtgcccatacgctcccccaccttgcaccctgcgctccaggctgaacttggcgtcctttgtgacgacgtggatggagccagaggcccgggatctgatgcaggatgccctggacgtcaactacgtcgacacagacgagtaccccagatgcagcgatctcttcccatgcaagcctcaacctgtgtttcccctcgcgcaagccatggccttgtacacacccgctcgccctatccagcacggaacagatcaacatcaggcctctccgcgccaacccctcatccttgcagttccacggagatccagaatcgctgcgtctccatcctggccaagctgtaccacgcgccctccgtggccggggaggagggtcgcggcgaccccgtgggcaccgccacggtcgggtcctcggaggccatcatgctgggcgcgctggcactga

SEQ ID NO: 7283 - DNA, 1896 bp, Chlorella protothecoides
  modified_base (428)..(437): a, c, t, g, unknown or other
  modified_base (1857)..(1866): a, c, t, g, unknown or other
atgtctgctgggagaagtaagctgtattcggggggggagggaggggaggtgctccagatgggcagggaaggggaggggaattggggagggggggatattacggggtgggcgcgcgattgtcccacttggatgcactactgccgggctcttgatgccccgaccctttctactcaccccaccctcagattctgccgctactttgatgtggaagagcggtacgtgtacgccgaggaggggcggtactgcgcaactgcggagctgctggagccgctgatcgacgagaacaccattggtgggtgggccctgtggaacttaggtttggggttgggtgtgcggcggctggaaccgccggctgcatcccgtacggactgtgcatgcatgggtgtgcacgccgcgacggcgcctgagactcagcgagaatgccgctnnnnnnnnnngttggggctgggtgtgcgacggctggaaccgtcggctgcatcccgtaccgactgtgcatgcacgggtgtgcacgccgcgccggcgcctgagactcagcgagaatgccgctgcccccttcctttcatccccccaggtgtggcagccgtgctgggcaccaccttcactggcgagtttgaggatgtccaggccatcgacgcgatggttggtgagtggcagggtggggcggggcaggtgctggctgtgctgtgtggagggcagtgaccgcgtgaacgccgagaacggctgggggggcaagatccacgtggacgccgccagtggaggcttcatcgcgccgttcatctaccccgacctggagtgggacttcaggctgtccaatgtcgcgtccatcaacgtctcggggcacaagtgcgtgtgccctgcatgctgagcctgcttttggtggggaggacgagggtgcagcagggtgtcgagtgctgcgatctatcgctgagcgggcctgaatccatgccttacgcctggctgcgcctctgttctccttcacctcctgcaccaaatgcccgcaccaacaggtatggcctggtctatcctggggtgggctgggtactttggcgcgacgcagaccatcttccacctgagctggtgcgtattgtgctgtggccgtcgggattttggggaaaggtgacgttcttggggaatcggaccagaagtgttggtcaaaggttgagagtaatgcatgcaccgaggaccttgagagagtaccgagaggggaagggtgacgttcttggggaaaattggaccagagatgttggtcaagcgtggagagtaatgtatgcaccgaggaccttgaaagtgtaccgagagtatggcacacctggtcaagcgaggctccttcaatcttggtacctgtggtgcaaggaaccttgccaccctgcatcacgccttctcctctcacccactactttgtctcaggtattcatggagaactacctgggctcaacagagaggtccatcaccctaaacttttccaagggcgcctcccagatcattggccagtactaccagttcctgcgcctgggatttggcgggtaccggaagatcttcctgaacctggaggtggtgaggaagcgcctgcgtcgcgccatccagctgacggagcactttgagatcctctctcccgaggtcggcgtccccgtggtcgccttccggctgtcaactgtcaccggctccgatggcaagccgcaccacaggtgtgcaggacctgcagagtgcaaacctcgcaagactgttgagccagatgacatatttgctggaggggcttcattatgccccttgactccaaaggatgtcgttccatgcagcccaccttcacccctcccaggatgtacgacgagtttgacctggctgatcgtttacgaatgnnnnnnnnnncgcttcattatgcccctggactccaaatga

SEQ ID NO: 7284 - DNA, 1362 bp, Chlorella protothecoides
  modified_base (131)..(140): a, c, t, g, unknown or other
  modified_base (279)..(288): a, c, t, g, unknown or other
  modified_base (438)..(447): a, c, t, g, unknown or other
  modified_base (779)..(788): a, c, t, g, unknown or other
  modified_base (1064)..(1073): a, c, t, g, unknown or other
atggtgagtgccggcaccgtgggtctgggaattccagggcaccggcggcagcgcgcacgttcgagccttgggcttccgcggaccggtttccctgaacatagagtctgggctcccccggggcagcatgcatnnnnnnnnnnggaagggatggtgagggccggcaccgtgggactggggattccagggcaccagcggcagcgcgcacgttcgagccttgggcttccacggaccggttttcctgaatatgcgagtctgggctcccccggggcagcatgcatnnnnnnnnnnagaggaggcgtcaatacggatgatgtcgccgtcctcaacctgtggaatggtgtgacggagggcatgcgtgtgggaaaaggaactgggtggctggcaggacgagcgggtgcggaacgtgacagggcaggtgcgcatgcgagcgctgtgccnnnnnnnnnngccctcgtccccagccaaacacagcgcggcaacctccccacccgcccacctcctggcccactcctcctcggagacgttcaggacgtccatgacgcgggaggaggcgtcgatacggatgatgtcgccgtcctcaatctgtggaatggtgtgacggagggcatgcggctgggaacaggaagtgggtggctggcaggacgagcgggtgcgggacgtagcagggcaggtgcgcatgcgagcgctgtgccagccctggctggagcagtcattccccaacctcctcataaaagccctcaccagggcaatggggccgccctcctgcgcctcgggggtgnnnnnnnnnnggtcattccccatcctcctcgtaaaagccctcaccagggcgatggggccgccctcctgcgcctcgggggtgacatggccgatcacgaagccgtgggagccgccggagaacctgccgtcggtgatgagcgccacgtcctggcccagacccgcgcctgcgattgggggaagctcagatcgcacccccacgcagccagccctgcgcctgccgcatggcacggcctgggtccgggatggcaccccgcttcctgccgcctccatcttgttacaccaatggnnnnnnnnnnggacacggcctgggtccaggatggcaccccactgcctgccgcctccatcttgttacaccaatggcaccaccaccagccccgcccactcacccatgatggcagaggtgggcgtgagcatctctggcatgcctggcccgccgcgggggccctcgtaccggatgacgatgaccttgcccttgaaggcagccgagttggcctccagggccgccagcatggcctcctcttgctcgaagcagagggccgggccctcgaacagcaggccctccttgccggtgatcttgcccactag

SEQ ID NO: 7285 - DNA, 225 bp, Chlorella protothecoides
atcaccggcaaggagggcctgctgttcgagggcccggccctctgcttcgagcaagaggaggccatgctggcggccctggaggccaactcggctgccttcaagggcaaggtcatcgtcatccggtacgagggcccccgcggcgggccaggcatgccagagatgctcacgcccacctctgccatcatgggtgagtgggcggggctggtggtggtgccattggtgtaa

SEQ ID NO: 7286 - DNA, 606 bp, Chlorella protothecoides
  modified_base (108)..(117): a, c, t, g, unknown or other
gggaggagtcgtggagtgcaggatctggtcggtgtggagggccgcgcggactccagcgtgccagaatggggtacatgagcagggttgcgagtgcatggatggtgcgcnnnnnnnnnnagtgtcgagggccgcgcggacccaagcgtgccagaatggggtacataagcagggttgcgagtgcatggatggtgcgcccaggcgccatactctctgacaaggcacctggtaccgcattggcatgtggccgcgacggcgcaggtcccctcgccggagtctttcccaccttgaatttcccttgcacgtacagctccatgttcccagggcctagcccccacgctttcccccccatctctgttgctccccaggtggcagacgtgctgggcatgccccccgccgagaccagctcgctgtcggccagcgtgcaacagttcctgaccgacgtggtggcctccgtcgacccctttgggacacatgcacgtggcgtgcagcagagcctggacgccgtgtttgccgcccccgcgggccccggcagcggcggcgcacgcagccctaccgctgcggggtccacgccggccagccccgcgggcgcctggggcgcgggcggcg

SEQ ID NO: 7287 - DNA, 1302 bp, Chlorella protothecoides
  modified_base (887)..(896): a, c, t, g, unknown or other
  modified_base (982)..(1033): a, c, t, g, unknown or other
  modified_base (1126)..(1135): a, c, t, g, unknown or other
atggccttgccgacgccctccatcctcaccccactcccttctccaatctccccccaggatcaagcgcatcccgtcccccgtgccggagaagaagtggtacctgaggcccctggtcattgccctggtgggaggcctgcttccctttggctccatcttcatcgagatgtactttgtgttcaccagcttctggaactacaaggtgggcagggggggtcccagcggatgggtaggcccgaactgactgccgtcgcccgaactgactgctgtcgtgcgccgtggggacaaggcacaggcgggactgcgggagtgggtgcacacggataccctggctgggctcaccctgcatccacactgcacccaccccccctcccacgctcaatcacctcctcccgcccaggtatactatgtctatgggttcttcctgctggtgttcctcatcctgatcatcgtcaccatctgcgtgaccatcgtggcctcctacttcctgctcaacgcggagaactaccactggcactggacctcctttggggcgggggcatccacatgtgcgcggggagtggggtggtggccttccttctttcggagcgggggaagggaggaaggggctgcgtgggcgtttgtaatggagctgtaggtcccctgctggagcgagctgcctggatgcatgcaggcctgggatggaggcttgacactgtacgtgttcctctacagcgtacactatttcttctggaaggtgggtggtctgctggaggcacgcatgcaggggcggatggggttggttcggggactgagattgctgcacttcacggcatggagggcattttcagaggaaggtcctgcacctcggtacagccagacccagctttccttccgcaccataccttgcnnnnnnnnnntttcacggcatgcagggcgtttccagaggaatgtcctgcacctcggtacagccaaacccagctttccttccgcaccataccttgcnnnnnnnnnnnnnnnnnnnnnnnnnnnnnnnnnnnnnnnnnnnnnnnnnnnncaggctgcgacttgtgctttgcctccctgattgacccttgcaggggaggcatcctggacactctagcggctccggggccagtccttcccaccnnnnnnnnnntgcagaccaagatgaccggcttcttccagaccgccttctactttggttacacgctcatgttctgcgtcggtgagtttagtgaggggcacgtgccagggcccgaggctgcgacttgtgctttgcctcctcgattgaaccttgcaggggaggcatcctggacaccctag

SEQ ID NO: 7288 - DNA, 753 bp, Chlorella protothecoides
atgtgcaaactgggactcgcctccaacacccgtggcctccccaaatccacagatccaaaggagggcatcactgccatccaggggctgaggaatggctccctgggggcaaccatccttggcacagcagctgcccagctggcctcgcgaacgctggccatcatgaccaatccggagcagctgcggcaagtagccatgtttggcaatgatgaccccatcacaggaggtgagtgggaggggctcctcgcgcagatgcccaaagaagaaaacgcatgtgggtttcaccgtggtgcgcccgtgagcaaggctcgggcattcgcacccagcatcatccactctccgcatgcctgccccacccgctcacaccccacctttgcagacggacagtccatcgccagcccccagttcaagctggccttggcgctgggcaccctactcctgtctgtcatgtgcctggcccagtttgttgcctgcctgaattcatcttctggacgcctcggccgcctcgtagagtggtgtgccctgcgtcccttgggacgtggcgagccaaatcatcatgtcgatgaacaccgcaataccccaagtacctcatcaaccccactgctgcagatgtttgtcatccaggtggtggcggggaacccaatcaagtactcccacctcctcaaactcacgcgcgtcttcatcaagcgctcctccatgtacttttcgctgggcctgcgcttcctcttcctcttccttccggccatcatgtggtga

SEQ ID NO: 7289 - DNA, 552 bp, Chlorella protothecoides
atggtcctgtcgggcgtggtgaagcagatccacgtggcccctgatggcacccgccgggagtactaccagggcatcggcggcgtggtgggcctggtgctcatgctcaccggctcctacctccccggccgccagatggcggtggcggagggcaacgtgctgggcaagggccctgtcctcttccacctgccccagcacgtggccatgacgctgcgctcgcaggcggcctcgggcctggcggatgcccagcgcctggaggccagcctggcgcgcctggccggggtctacgccatccagggcatggagcgggaggtgcgggacgatgtggcgcagcacctgctgcgcctcaccaccgcgcgcgtgcagcactccatgcgccgccaagccagcggcagtgggagtggcggcgggggtggcactgcgcgcggcgcggaggccggcgccgacctggctcgcgccagtgtgcgccctggcggcggcgtggaccgcggcctggcctcggtcatgcaggacctggccgccgccgagctgcgggcgctggagcgcgagggcgcc

SEQ ID NO: 7290 - DNA, 369 bp, Chlorella protothecoides
  modified_base (307)..(316): a, c, t, g, unknown or other
atggccctgctgcgccagcagttcactttcattgaagagctgtacgactcgggcatggtggaccacggggagcagaagatgatggtggacgcggtggacaagaaggcgcggcacctggagatcacgggcccggtgtggaagccgccgcgccaccgctccctcatgcgctccctgcccttcatgtcagggctgagcgaggcttacttccgccgcatctttgctgcggggaccatccgcgagtttgcgacgggggaggccttctgggccagcagcgacgtggtggccgacagcgggcggcgcgagggcnnnnnnnnnncgcgagtttgcgacgggggaggccttctggtccagcagcgacgttgtggctga

SEQ ID NO: 7291 - DNA, 609 bp, Chlorella protothecoides
  modified_base (544)..(553): a, c, t, g, unknown or other
atggccctgctgcgcctgaacaagattccctgggagaagcgcaagatgcgggccaaggccaaggcggcgctggtgcgcttcacgtccaacgcgctggaggcgctgcagaccgacaccgacgagttcctgcagggcgccaactgggatgcggtgctggcctacgtggatgtcagcaccgccctggccgccttcgacctccccgccaaacgcagcgagtccttcgcagagccgcacggccgcggcctgccagcgctgtatcacagggtcaagtccgcggtgtttggccgcatgaacgaccgcgggtcggcggtgctgggcaaccccgcggtggaggtggcagacatcatcccgcacatggttggggtgaggacctcggccggcggggtcggggctgtccccgaaggcgactccccggccaagggcaagctggtgggggcggataccagccccaacggctacacatccgactcggagagcacggcgtccagcaacttcaccatgtctgacatctccgatgtggtcgaggagctgcgcggcgagattnnnnnnnnnnccggccaagggcaagctggtgggggcggatgccagccccaacggctacatatctga

SEQ ID NO: 7292 - DNA, 2730 bp, Chlorella protothecoides
  modified_base (554)..(563): a, c, t, g, unknown or other
  modified_base (693)..(702): a, c, t, g, unknown or other
  modified_base (1120)..(1129): a, c, t, g, unknown or other
atgcatggcatcctaggctcgttgggtcctcaccctccacctagatcatcaagaagctcagagatgcgtgcgagtgctcaagccctaccccaacgcctcttgggctgccaggcttcggcgctgtcccagcatcatcacaggcgcggattcgaccctcccccggagccactcctctgcgccacattccgctgtgcagagtgcatctactccccctttgctgctcggggattggctcgggagtttatcaaggacctagaggtagacaggggtctctatgtggagtcccttgcaatctctgtcaatagcacaataagacatctacttcacactgtttcgtcagtggacccagctcggcctcgtgccatagtggatctgatctctgctgctgaggactttcggatagagagcgaagcgatgcagccaaagagccagccagggagctgcactcgctgtgggtacatgtcgagccagcctgatggtttccgacacgagttacccctgaagctggggttggaggaggttgaccctaccccttgccgactccgatcagctcnnnnnnnnnnccccggcacgcgtgagttacccctgaacctggggttggaggaggttgaccctacccattgccgactccgatcagcttccccattacaacgcgagggccctgggacacggaacatcaagttgcctgctccnnnnnnnnnncagcacctgaacatcaccaaccccccctccatctacggatacgagcactatgagcagctctggctctccaccgcctgcctgctttggaatgtgaccacggggcaccgagtaaccgttcacggacgcatttttgttcgtgggcctcgccctcctggtcatggcgacactgtttgggaaactgtcagcggtgtgggtgctgatcacaggaaggccttggtgagtacacatggcgagctcgcaccctgcctccacaggtggtgtcttgggaataatcaactggcaagtgaacctgggcctcatttcaaatgccatcagcatctggtgagtacggtgccccaggtgaccatggtcacttcatcgctgccttgtgtcaacgttccaaaagcgcctccttgtggcttgattgtctcattcctgnnnnnnnnnnacttcatcgctgccttgtgtcaacgttccagaagcgcctccttgtggcttaattgtctcattcctaccacccgcatccccccccccgctcaccaccaggctcaacattcagccaccggatctcttcttctatgcattcctcccgcccttgctcgtcgactcagccattcgcatcgatttcttcatgttccgcaaggtgagagtcggcagaggtccacctcggccttggaattacttgcaagaacgtgtctgcgacttgcccgaccagcctgccctgcccagcccagctcgtcctatcagtcacccattgccccccttcctccctgcgcagctgagcctccacgccgtgatgatggcgtttgtgatggtggtcctctccgccctcatcctcacgcccctcatcctcttcgtcctgggcttccaggaccggggctggtcctgggtgcacggcgccctctttgccagcatgattgcgcccacagatgccctggctgcggccgccatcctgaaacagggtatgctttgtgtccccgccgtcaaccctgccatcgagagcagcaccggatcagccagctggcgcattcacacaccacatctcctcccaagcgagtcatcgccaccgtcccctcctcttcctcagggggtggcccggagcggctggtggtgctgatggagggggaggcgctgctgaacgatgcctccgccatcaccctgtttgaggtgttcatgcacatcatcgaggaacacatcaaccccgcggagccctacccttcgcatgactctgggatccctggttcccatgaagagggacatccggggtcaaggggcggcctcgaaggccgcacgccggatccagggaaaccatgcctcacaccgcgtccccctttcctcactcccaggctggcctcggtcgggtttgccatcgggctggccatgtcctggctcactttccacttcctgcactggctgaggtggaggggggccaagccgtacgtggagaacagtgtcatcattgcggtggcatacctctccttctatgtcgccaacgatcctgccaagggctcgggcgttatctcggtggtggtctttggcctctatggcaacatgacctccaagtggggcatgctgtcgtcgtccgaggaaagcggggcgtttgacgcaggtgagcgacgtggtggtggggtggtaaggggaaagagatgggcatgcaggcctgggagaggccatggtcattcacagtccagagggcacgtcggcatgcaggttgggttgggtctctgcaaatcagcactggcccgtctggtcatatgtaacccccccaccctcatttttgctgcagtctgggacgccatcaccttttcggctaatggactggtgttcctgtggagcggtgattcccagccatttcccctaaaccctctgtcccccttcggaaaccctcccagctccgtcgccatcctgaacaacacggcctggagttacgcagccatccccctcatttgggtgttcatgtttttcatccgagcagggtgcctggtgctcttcaaccccatcttcaaatgggtcggggaaggtgggcagctggtgacagggtggcagtag

SEQ ID NO: 7293 - DNA, 456 bp, Chlorella protothecoides
atgtctggggcatccggcccacagctgcacatcaatggcgatagaaccagtgggcaggatgtacgcacccagaataccacagccgtcctggcagtggcaaatatcctcaagtccagcctgggaccggtcggcctagacaaggtgcgggggggaccatccggtgtgattaaagggtccagcgggacctacagccccacccattacctcgcatctcagcctcacatcctgtgtgggtcacccttctgcgcgcagatgctggtggacgacatcggtgatgtgaccatttccaatgatggagccaccatcctcaagctgctggaggtggagcaccccgctgccaaggtgacgacatgtgtaggggggtggtatgcggggtatgattaccttgatgaagtggctgactcctcgagccaggccgctcgaaagtatcatgcaccgggccccatacgtgcatga

SEQ ID NO: 7294 - DNA, 291 bp, Chlorella protothecoides
atggatgagattgtggcccagatcggcacgaagaacaactgcaccttctgcggggtgttccgccgacaggtgcgacagctcctccgcgctcgaggcaacagtggactgccatttgttgctggcatgtctgggcacccaccttcccacactacttttacccaggcactggaccgaggcgccgccatgatgaaggctgacaagatcgctaccgggcacaatgccgacgatattgcggagactgtgctgctcaacttcctgcgtgctgacctggcaaggtgggcccgggactga

SEQ ID NO: 7295 - DNA, 819 bp, Chlorella protothecoides
atgggcatcggcttccaccccacctacgagccgacgaacgagccggtggtcccctccttctgcccggagtttggccttaccacctcccagatgagggtgctaggactcacacagcagccggagatcggcacctccatcgatcctgataccctgacggccaaggcgttctacgttggcgaccatgtgagtgagaccagtcgccaggcaacacggatggcgcgggacaccagagccccaggccgggcgcctccggatttgccgtccctcctcctggatgggcgcatttgctacattggcatgccgactgctgctggggagagcgtgggctttgagacggaggccaccgccatcctggacaccatggcctacatccgccctgacatctacactctggtgatcggccaggcctgcggcaacgccgccatgctgctggcgtccgggaagaaggggtgccgctacgcgctgccccacgcgcgcatcatgacctgccccccccgcctgaaccgcgcgtttggcagcaccagcaccgtcatgatccgagccaacgagctggaggccaacacccaggtgtttgtggacttcatgaccgcggccacgggcaaggacgccgccacggtgcgcaaggacattgggcgcaaccgctacttcacgcccgaggccgccatcgagtacgggctgatcgaccgcgtggtgcagcccagtgaggcggtgcagatcgagcgccgcaactacgagctggagatgcggtcgcaccaggccgcgcgccgggcggcccaggcgggccggcagagcggcccagggcccgagacgggcatgtga

SEQ ID NO: 7296 - DNA, 300 bp, Chlorella protothecoides
atgccgcctcggcgccgcccacctgcctcaacccacaccggtacccacactctcctggatcagatcctggtggacctggcagatctgcaggatcaggaggtgggggatgggaccacctcggtggtcatcttcgcctcggagctgctcaagcgcgggaacgacctcgtccgctccaagatccaccccacctccatcctgagcggcttccgcctggcaatgcgagaggtacgtgcctgcatccagcgtctggtccctcaggctggcatggagcgccgaaaatggaaagaaacgagctcgtga

SEQ ID NO: 7297 - DNA, 294 bp, Chlorella protothecoides
atgcccaagcgcgtggagggcgcccgcatcgcctgcctggacatgaacctgcagaaggcgcgcatgcacatgggagtgcaggtgttggtgtccgaccccgccgagctggagaagatccgggagcgcgagagcgacatcacgcgcgagcgcatccagaagatcatcgacgcaggcgccaacgtgatcctgactaccaagggcatcgacgacatgtccctcaagtactttgtggaggcgggcgccattgcctgccgccgtgtgcccaaggaggacctcaagtgggtgatggagtga

SEQ ID NO: 7298 - DNA, 480 bp, Chlorella protothecoides
atggaggggcaggagtcgttcgacgcagccaacctgggcagcgctgaggaggtggcggaggagacggtgtcggacaacgacgtgatcatggtgcgccggccgcgcaacacgcgcgcagtgacggtgctgctgcgcggcgccaatgactacctgctggacgaggtggaccgctccctgcacgatgccttctgcatcgtcaagcgggtgctggagagcgggcgggtggtccccggcggcggcgctgtggaggccgcgctgaacgtgtacctggagaactttgccaccacgctgggcagccgggagcagctggccatcgccgagtttgccgacgcgctgctcatcatccccaagaccctggccgtgaacgcggccaaggacgccactgagctggtggccaagctgcgggcctaccacttcaccgcgcaggtctgggatggagagggggggggggaggcgggggggaaatctggggtacgttag

SEQ ID NO: 7299 - DNA, 234 bp, Chlorella protothecoides
atgaagctgtgtgtggagtgccgcacccagcgggcggccatgcgccgcccaaagacgtcggaagagctgtgcaaggaatgcttttacaccgcgattgagacggaggtccacgagaccatcatggccacgaacctgtttcggcgcggggagagggtggcaatcggcgccagtgggggcaaggattccacggtgctggctcacatcctcaccaccctgaacaggagatacgagtaa

SEQ ID NO: 7300 - DNA, 1083 bp, Chlorella protothecoides
atggctcccggaggtgcattcccagcccctccctggccccctcccttaccccccacgcagcccgtcccctcccccgttccgccggccctccccgcggcccacaacctgctccagcagacgctgcgcatgcaggcggattccggggcgatggcctgggaccccagcgtcgcccccgccgccaccgccccgcctggccccggctccacgtccctgaatccgcagcagctggagtttgccgcgctgctgcgccaggcgggcatgacgggcctgaccgaggacgacatccgccacctgtacaccgtcagcgaggggtacgcgctgcaagcggccagcacagggcagccgctgccgctggtgggcgcgccgccgcccatggtgccggtgcacgcccctggcgcgcctggagcgggggccacgtctgcatccaccagcgcctccctcgccagcggcagcgggggccggaccccgcccgacgtcggcgcgcccgagggcggcgccaagcggcgcggtcgccgccccgccgacaccgcgcagctgacgacgaagcagctgcgcgcgcgcgaggcgcagaagcgcttccgcgacaagcagaagtcgcgcatggcggagacagagggcacggtggcggagctggcggcggagctgcgtgccacgcagctgagcaccgaggcggcggggcgcaagcaggcgctgctggagcggctgctggagtacaaggacgagcaggtggaggcgctggagctgcacaagcgcctggacccgcccccgggcatcatcatccccgccgacatcatggacatcctgcgcagccgcaccgtgccgggcatctacacgcaggagatgctgctgcgctatgcgcccgtgggctaccgcgagcacctggacgagcgcgggtacgtgaaggaggccccgccctttgataaggtctgcgaggactggcagcaggtggtggccgccctgcggcgcctgctggacggcgccaaccttgcgcgccgcacgcccggtgccgaagggcccggcgggggcgggggaccaggtgcggcccccgggggcggcagccacagcggcgcacccctcggcgcg

SEQ ID NO: 7301 - DNA, 216 bp, Chlorella protothecoides
atgacccttttcgcctacttcctcatccccgagaccaagggtgttcccgtggagcgcgtgcccatcatgtttacccgccatgccctctggtcccgcgtcatgggccccgtgtccctggagatcattgagcgcgatgccacgcgcaccatctcccgccaggcggccgccgaccagcgcgccgcctccaacggcgacctcaagaaggccaccgaatga

SEQ ID NO: 7302 - DNA, 2967 bp, Chlorella protothecoides
  modified_base (1085)..(1094): a, c, t, g, unknown or other
  modified_base (2910)..(2919): a, c, t, g, unknown or other
gctgctgcatcggatgccctctctaccgccaacagtgcgcattccctccccaactcccccaaaacgcccgagtcacacccacctttgagccaggcgccccaggcctcagagtgggcccgcggccggccccggacctccctcctcgccccggggaagagggccagtaagatgcccgaccaggcattcagccacctctgccatgtgatgatccagccccggacgacagcctgcggagttgggcatgtgggtcgacagggtccgcggtccgacaatgttgtcgctgatccaggctcccacgatggtgtacagggcttgcaaattcagaaggagacggaccagcctcccccgccgtcccacccgcgacggcattccctcgacaccagctcagagtgtaattcttatgaaatgccacaaggggtgagctcctgccaagtcgatcagcggatcgcagcggcgtacaagcagtcttgtgactcgaacaggtgccctctgaattcattgtacccgaaggccacgtgcgcagctgctgctgcatgcaccgttcctgtcccccgtccgcctagtctgcaccattacttgatacagctgtacattactgactcaaagcgtcacccggatcgctctgtctcggccttgcacctgaccttgcaacccttgtggcagcgcgctcgtccctcccccgtccttcttgaatcggcgaacgggagctcgcactctgcctgtccgtggatgcacgttgcatcctgtagaccatgtgtaccaacacctggcccctcgagtcggagctgcctgcatcccagcgctccgcggcgtgtggtgcgcgcccgagccggggcccggcccacaagagtggacgcggatctgccggccttggaaagcaagcatgaaataaatggcaccggtaccggtgtgcacgatgctcacaagaatggtggggacccggaggccccgctggcaggcacggggcacgggcctacaagacccccaaccccctcgtcacaacctagcctccccagctggctgttgaaccccaacgaccccgccatcctggagttgacgcttcccgccctgctgacactggtggnnnnnnnnnngaccccaaccccctcgtcgcggcctagcctccctggctggctggtgaaccccaacgaccccgccatcctggagctgacgcttcccgccctgctgacactggtggcggaccccatgctgtccatggccacctctgtgtttgtgggccagaccgggcccaccccgctggccgcgctgggcatcaacacctccctcttcgccctctgcttctccctgttcaacttcctggccaccgccaccaccccgctggtggccaccgcgctgcaggccggcaacggcgagcaggtgatgggctttgagtgcggcggtcatggggagggctgtgggactccatccctcccacccgctgcaccctctgacaccaaggcacctgctcccccgatcccactctccaaggcagggcgcacggtgctgcagggcctggcgctggccgtcgtgctgggcttgggcctggccctggccctcaccgccggctctgatgcggcgctgggcgtcatgggcgtcgcgcccgaggccggcgacctcttcctccagtcgcgggactacctgaccgttcgcgcgctggccgccccggcagtactcctggaaagcgtggcgcagggggcgctgtacggcatgcgggacatgcggacgccgctggaggagtgcctatgtgtaggggtgctgtctgaatcagtgcctgaggaagcaagccgcgcggatgggcctgggctggctcttggtcctgcacctgggctggggagtgaaaggcgccgcgctggccacagccgcggccgagggggcatcggcggtggcgtacctcacggtactgcacggccggcggggtatgttgggcgacctggcccctcgcctgctgctggcgcccccgccctccgcgggccccaacggcacgccccccccccaggagctgctccccgccggcgcgtcgctgctgacgcgcacggcgctgctcctgggcagcaagacagcggcggcggccgccgcggcgcggctgggcgccgcccccgccgccgcgcaccacatcgtgctccaggtctggctgctggacagcttcctcaccgatgcgctggcggtggcggggcagaccctggtggcctcgcacctgggggcgggggggagcgtcggcctgcggagcgcgcgtgccgtgtcggaccgcctgctccaactcggcgtgggcggcagcgccgtcctcgccctggccctggccgcgctgggcccggccttccccgccgccttcacctccgatccgggcgtgctgaccggggtgcatgccatctggggcctggccctggccctgctgccgctgaatggcgcggccatggtcctgtctgcactgtgcaccgtggcagggctggagctgagcgggcacttggaggcggggctgctgggggtgtggtgggcgctggccgcactcatggcctccaggctggccacgctgagttggcgatacgccgcgccggcggggcccctgggtgcaaaaagggggcctggcgcagagtcctgagccgctggttgtgttgtgagcgcccatcggcactcgctcctacaaccctgtcacctacccgccgtgcgttgcaccaaacacagcatggctattcgcctcaacgctcaaccccctgtgctttgaatcccacataccctgaagaatcccttcaccctctcaattctttgtatctatcgtgtacattctctgcggcccagcaccagggagcacaccaactgctgcattctgaaaagaagtttaatctttcacattcattcacggggcgccaccgccccagccacatccctaaatcgcggggctggcccggggcaccnnnnnnnnnnagcccagcaccaggaagcacaccaacttgcatttttaaaagaaggtaa

SEQ ID NO: 7303 - DNA, 243 bp, Chlorella protothecoides
atggccggcgcgcgcgtgggccgcgggcggctggactttgcgctgcaggagtccacgctgtccagccagtacctgtcggcactgtcggcgcacttcatctactgggctagccccgatgtggcgcagttcgtgctgcgcgccacgcacggcgcggacgtgctgacgggcgaggccggggagggccggggcggcggagcgccggggtcagtccgtctggtgccccgggccagccccgcgatttag

SEQ ID NO: 7304 - DNA, 795 bp, Chlorella protothecoides
atgggggaaatcgcgagcggcacctggccatgtgccagccagcgtggggctggccactgctccgcagccgccccgcgcctacttgcatccccgtcgcccagcagcacgctcagcgtcaacccccttccctcatcaaccacccggccgtcgcagatgtacatcgacagcacttttgacgccgtgcggccagacggcgaccagtacctggcggcggagctgcgccgcgcgctggagccactcctcctccggcacggtgtggatgcgacgtggcacggccatcaccacagctaccagcgcacctgccccctggcgggcgggcggtgcttggcgtcgggggaggatggcgtggccgccggccctgtgcacattgtgctaggtgagtggcttggccggagcgagtttggatggtcttggccgagaggcgcatgcagggcgggcctggggtaccgcatgcttgcatggcgagcccgggcattccggcgcatcgctcacccccaacacggagccgcagcggccgcgggagtttgtcagcgtgcagctgcagcatgggtatgtgcgcgtcactgcgaatgccacccggctggagcatgtcgtcgtttcttctcaggacggcagcgtcatggatcgatgggtgctggagaagcctgcaggatggtgcggcagccgcggcgtcctgcggcagggagaggagcgcgtggcggcggcatggccgtccctggaattcaaatcgcagcacagactgcggggttgcgacaccttttgatcttgctcaatgtaccatggacagcagaatga

SEQ ID NO: 7305 - DNA, 924 bp, Chlorella protothecoides
atggcgaagaaatgcagctggacgggtcgaggcgtacctgctggtctcccgaggtacctaaagggtggtggtgggatgagatgttgtgtggggcttgtcagacgccgatggggtcgagataggtttgcatgcgccgatggcacggccgttgggagtagttcccccttgaattttcaagccgcggacacccgcccgagccacctcaaaggcctgaagcattgcccccctgcaggaggacttgtgtctcctacagttggtcgagacgtatggaccacagaactggagtctcatcgccaagggtctcctgaagcatccgttctcctcgctatttttttgggtgaagagcttgggcagcggccgcaatggcaagagctgccgcctgcggtggttcaaccagctggacccaaatttaaagaaggaggccttcacccaggaggagggttccctggctcggacctgcgcggcccttgcaccaccggaaagcgcgctcagcgtcagccccctggcgatcactgggcagttggcctcacaccaaacacacactccccccccactatccaggaggaggagatcctgctgcgccacggcgagctgggcaatcgctgggcggccatcgccaagtaccttcccggccgcaccgacaacgcgatcaagaactactggaacgggcacctgaagaagcggctggggcccagccggtcagtcgatgaggccgacgccaagcgcctgcgctccctggccagcctggcattggatactggccaccgccccggcggcggcgcagccagcatggttggcgcgcctgggccgctgcggcgcagcggcagcgtggacgtggatacgccggccaagcacgccgcctcgccgcccgcgcaccgccacggcacgcgtgccgcgacgggcgcgctgcgcccgcgccagctg

SEQ ID NO: 7306 - DNA, 372 bp, Chlorella protothecoides
atgccctgggtcaactgcaccagcctgcggtaccactgcaccaaggtcccggacgtggacctgtgcccattggcgtacgcagacgtcctgctgtggccatgtcctttcgggcccgtgcacggcgagcccagggggggcgagcttcttggttgcaggtgccctcaggtgcttccccccccctcaaccaaaccacacccctttgcaaaagcagaggggcgatttcctcccggctgcacggccaaggactttgtgcgtttggaggaggacgctgcgcccccagacccctccggctggaccaatgaggagcagctcctgctcctccaaggtacgctgctgctcaggctgacagagcagttgtctgccaccggctga

SEQ ID NO: 7307 - DNA, 534 bp, Chlorella protothecoides
ccccagccgccgccgccgccgggcacgccgtcgggtggcacgccccaggagctgcaccgcgtccccgcctgtgcggcctggttccgctggggcgcggtgcacgcgctggagcgcgccgagttccccgacctgctgggcgccggcgcgccgcccggcgcgggcgaggcctaccttgcgcaccgggacgccatggtgtcgcggtaccgcgaggacccgtcccgcgagctgtccttcaccgaggcgcggcgctggctggcgggggacgtgggcacgctgcgccgcctgcacgccttcctgcagtcgtggggcatcatcaatgcgcacgcccgcgtgcgtgcgcgccgcggccgcgaacccgcgccggggccggactccgtgctgcgcctggcgcccttggtcggggcggcagagggcgtggaggcggcgctgacggggccggtggcggggcgggtcgcgcccctcgccggccacgccaatggcgccctgcagcctgccatcgccacggggacccctcaatcccttgggcgcgtgtga

SEQ ID NO: 7308 - DNA, 945 bp, Chlorella protothecoides
atgaattcccgacatgcgccccagcggtccttcctaccacggccgtcctgccaccccgctgcagctgtcgagcgccacggggaggactgggccgccatcgccgaggcggtgggcaccaagaacgcgatgcagtgctgcacgcgcttcctccagatgcccatcgaggaggccatcgtggcggaggcggtggcctccgacggccgccagggctggggttctggggcgagggcgggtgggtgtgagatgggcatgacgcgtgcatcgagcggtggggtgggaggcttgcggtgcatgatgttgtggagatgcggtggtcgatgcgacggatggagtgaggagggctggggcagcgcgggcctccacatcgcgagcctgtcgccggtgacgatcccggagcccggcgaggaggacggggcggaccccggcgcgggcgcgctgctgccctttgccgacgccggcaacccggtcatggctcaggtggctttcctggccaccatggtggggcccagggtcgcggcagccgccgcccaacgcgcgctggaggtgctgggcgaggaggatgcggcgctgggggaggcggagcgagaggaggacggcgcgggggagtggccgaagcgggaggatgaggggaaggagggcgcggaggagccgattgccggcgagggccccatgaaggcggaggaggggtcagagacgcgggacggcatggggttgggggttggtgaatcgtcgccggcaccatctgtggcaggggacgcgccgatctccgcgccgcggctgagggcggccgcggccaccgcactggcggccgcggcggccaaggccaagctgctggcggacgcggaggagcgggagttgcagcgcctggtgctggcggcggtggacgcgcagtacaagaagatcaagatcaagctccaggcgagagaggggttgtcggaggcatga

SEQ ID NO: 7309 - DNA, 456 bp, Chlorella protothecoides
atgatctcttctgccctggctgcagctcgaagctctgcgggcacaagatttcgccatgcattccagaccacatgtcaggcctcggggttccgccaggccggcgccgcggcctatcagtccgctgcgtacagccctcccagcggcagtcgtcccttcgtgtcccggcctaccaacgacgcccccgacccgcgcaaggtcatcatattcactaactacaccgtttacaagagcaaggcagcatttagcgtgaaagtgatcaagccgacctggggcaggactggcacggggagtgggatcaccgtcaccagggacggcaccctcctttttgagtttgccaacgcccgcggcgagcgcgactacgactgggagaagaaggaggtgaggggactgatgggactcgagactcaaaggggcctccttctccatccaaggtggtgtcgaagagcctggctctga

SEQ ID NO: 7310 - DNA, 237 bp, Chlorella protothecoides
atgggcacataccgccgtcaccgttatccgcctgaagcgttcaccctggtcttgcatcgcagggtgaatgtgacgctgggaccccgcgaagaccggcagttcatcaccgggctccacaccgtggctgacatccagtgcacctcctgccacaccgtcctgggatggaagtatgtgagtcttgcagagtgggaaggatgcgtagctgaggcagggagtggtgcatggggcccggcatga

SEQ ID NO: 7311 - DNA, 1749 bp, Chlorella protothecoides
atggaccgcgacacgggcaaggccaaaggcaccgcctttgtggagtttgccacggaggagggcgcacagacggcggctgcggcggctgcggacgccagatgcggcaacctgcacgttctgcccggggcagacgggctcccacgcccccctcagcagcacccaccaacaccccggctgggcccaccccgcagggagtccaagggccctgctgtggtcgtggcagggcgcaccgtggagatcgacatggccctggacgcccaggctgcgcgccacgcctcggccaagagccaggacgactggcgggcgcgggacaagcgcaacctgtacctcaccaaggagggcatcatctcggagggcagcgtcgcctgggagaacatgccggagggggaccaggccaagcgcaagcgtgcagcaggtgggagcggggcggtggcttgcttggtaaaggtgaagggacggcgagagatgaaaccagcacggcggactgatctttcacacgccaatgggctccctcccctcgaaacccctctcccacgctgcacagtggagcgcaaggctaagctggcgagccccaacttcgtcgtgtccagcacccgactcagcgtgcgcaacattccgctggcctggaacgaggccaagctgcgggacgtgtttgtggcggcggtgaaagaaagggcgtccaaggctgtccccgtggtgaagcaggtcaagatactgaaggatgcggagcgccccggccccgacggcgagccccggtccaagggctttgggttcgtggagttcacggagcacgagcacgcgctgtgcgcgttgcgccagctcaacaacaaccccaccgccttccacaaggaccgtcggcccatcgtggaatttgccatcgacaatgtcaaggcgttgaaggcgcgcgagcaccgtgccacccaggcccagacagccaaagcggcggggggaccacaagctgatgggccagtcgccggggaggctgcgggccctggagccgcccgcgaggacgtggcggcgcccgccccggaggccgagccgaagagccggcgccagctgaggaaggagcgcaacatggtggcgcgggagcggcgggcggcggccgccctcgcgaagcaggaccccgaccagcacgagaaggtcgagctggctgagaaggggaagcgcaagaccagagcgccagccgagaggccccagccggcgccaatcgcggcgtcagtcgcggcaccaagggaaaggaagaagggcgcgggcgcagctgccccgtcggccccggcagcgcgggcggcggcggtggcggcgccagagccgggcccggaggccgccgtccagccgcagcgcaaggcggtgctgcgttcccagcggcggcggctgctgcgacagcgcaaggccgggaagcaggggggtggcgagcacgaggaggatgcggcgcccggcgctggtgcgaagaaaggacggcatgggcgcgaggacgaggcgtggacggagcccaggccgcgccgggccgcgtcgccgagcaacggcgtggtcacggcggggaagggccagaccgcgaggaaagcggggcactgggtcggaggggaggccgggccaaaccgcgaggaaagcggggcactgggttggaggggaggccggtgcgagggctgccgaccgtgggccaaaggcagcaggggcggacctcaaggccagggccaacccaatgaagcagaaggcggtcgttgccgccaagactgtcatgggaaccagtaa

SEQ ID NO: 7312 - DNA, 363 bp, Chlorella protothecoides
atggtgaccatgaatgcatgcagggctggcttgggcgcctccagggtgaacaccctgaggcagtctcggccgtgtcaggggatcgcgccttccgcccgccgcctgcggcacgtgtgcagagcaggaggacgagatgtggtggtattgggttcccgtggcaagattgctgcgcgcatcgtgcagcagctgctcagccaaggctatggggtgacggcagatgcggatgagggccggtcccaggacctgttggaattcgcctccaagtttgggctgctctccgcctcagagcgcaaggccctcaagctcgtggactttgacgccacggatgtggacagcgtcggccaggccctcgggggcaggtag

SEQ ID NO: 7313 - DNA, 1515 bp, Chlorella protothecoides
  modified_base (40)..(49): a, c, t, g, unknown or other
  modified_base (851)..(860): a, c, t, g, unknown or other
atgaagggaagctccaccagagggtctcctcttgccactnnnnnnnnnngtgaggtccaacagcacagagcaggtggaatatccgcgagattgtcgatggcgtacaagaaggtggataggcctcccatgttttcccaaaggctacaggcaccccttcaaaattggatatcaacgagatctagagcatcagacaccagagtcgtcttttctttacgcttggccttcctccttccccagcatgctcgaaacagtgctatgcatcttgatcacgctgtcttcaagccgctgcagcatgagagagaggttaccataggctgggctcctcctcttgatgttcatcatgcagtctcagccagattacttggcctgaatatctgcaccatacagatcaggacctcggcagtactccgccaacccaccgtaacagtggaggcaacaagctcttggacggctatacactctgcttgggtcagagtggtaggtcattctgtgtttggggacgatgcaagtcatgttttgcacccttccgcaccagcttcaagtcatgggcggcatccagattctcaggtgggcatgggcccaggtcctgcgagacacagagaggagcatcctggtaacggtctcagtgtcaaacggtatcattttctgggtatgcagcatggaacgtaccatggaagtgctggtctggctcatggccgcgagtaccccctgcacgagctccctcccccaagtcaagcgttgggccctgcacacggcgacacggatggtcctgaattgcagccagctaaactgcatctggccgaggagaaatcgtactcgtatgtggagcgggcgcactttcctcgagctgnnnnnnnnnntgcatctggccgaggagaaatcgtactcgtgtgtgtagctggcgcactttcctcgagcttgacccagcccggcaccaccgacagagtgacatcacgacttgcgagccgctcaacccattccagatcgctaccggtacagtctcccaaccgagcgcgggtgtcggcggtcatgctgacgcttgcaagggcccatagggtggtatccagtaggctcgccctccagtctctggccactcggtgcaagaccaccacgggcatcgtggggttgcccgtggacgaagatgcccgcacgaccctgggggagcactacgcaaaagtgctggaggccatcacagtcatcccagagtctgctgtctaccgccagtcggtggagaagaccgtgaagcaccgcctggcagctcttcagacaggtgctgaggatgaggagctggagcagcagtttggcaggcaattggaggaggaaatcaagatcatgaaggacgagctcaagctcatcccgaagatggcaggtgaggctggacttgtagatgagttgcaccagactgggcagctggactgggcggctgggtggatggagcaattgtgccttgtgggattagtactgcctgtggtttgtggatgtgtacgtcatcctcagacgtgcactgtttactga

SEQ ID NO: 7314 - DNA, 1137 bp, Chlorella protothecoides
  modified_base (45)..(54): a, c, t, g, unknown or other
  modified_base (1012)..(1021): a, c, t, g, unknown or other
atgcctgatactgttgggggcttaggaaggcactgcctctttggnnnnnnnnnngagcagactgactctctgaggtgggtaccctgggctgcatgcctgatgctgttgggggctaggaaggcactgcctcttttcgggaagaggagcttgcaactactctgccacccccctactcaacatcatgtgcttctgcatgggtatgtcgcggaagatggtggggggtgggaaagggttggagagggagggtgtgctgctgttcttgatgaagaggatttgaggacagaagcttgtactccaggggcgccccgagcacatctatcgcatgcatgtccagagctgctctgtgcctgcaaagctcttctgcccaccctttcacagtttggtgccctgcgaccacccaatcatacaggtatggcggccagcatgctgctggcagaggcggcctacagcgtctcggccaatgtgatcttggactctgcgatgcgcagcatctctagctgggacatcctgtcttccatcctcaaatgctgggtttttgggaccatcatctcctcggtgagtagactgcagagcggattggagtacgggatttggggctgtggagtgaggctggcagccaggctcacatgtgggcccaacgtgactgcagagcggattggagtatgggacttggggctgtggagggaggctggcagccaggctcacacatgggaccggcgtggtgagggactgaattaccgacggaacgtcataggaaaccctgccggtcagctgctcgtggggatataccaccacgggaggagccaagggcgttggggagtccaccacctcagccgtcgtcatctcgctggtgctcatcttcatcgccgactttgcgctgtccttcctcttcttccaggggcagggcgacgctctgcgctcacttgcctgaggctcctggttgctggccttcgagtgcttgtgctatgcaaagaggaggctctccaagagacatctggtgatgcttgctccnnnnnnnnnngattcctgcagtgtgctatgcaaagaggagctgtccaagagacatctggtgatgtttgcccttgtgagggtcctctcgcggcgcagagcatgcggcatgctgccccacctcattga

SEQ ID NO: 7315 - DNA, 1044 bp, Chlorella protothecoides
  modified_base (887)..(896): a, c, t, g, unknown or other
atgcctcagctgggcctggagctgggggttgtgagcgtggccatcgacggcacggggcagtacggcgccgcctccagcatggacagcacgatcaacgtatggtcgcaggccgactactcctcggccgcgcgcttcaagctcccccccgccgaggcctggtccgtggcctggctgccgccgtcatccgacggccgcctgacgctggctgtcgccggcggcagctccaacaccgtgtcgctgctggacgtgtcggcgcagctggctggcggcgaggccccccgccccgtcaccctgcacatgccccccccgccggcggccggcgcggccggcgccgcccccgcccagccctttgtgctcagcgtggcggccagcccggacgggcggctggtcgcggcgggggccatggacggcggcgtggcgctgtttgacacggccaccggccgcctgctgtcctcgctggcggggcacgccaaggcggtgcgcgggctggccttcaccccggactcgcgccacctgctcactgcctgcgacgacctgcacgccaacctgtacgatgtcggccaggccgcgctggtggagtcctttgccgcgcacgagtcctgggtgctcagcgtggcggtgcaccccgacggctccgccgccatcaccggctccagcgacgccaaggtcaggctctgggacctgagcacgcgcacgctggcgcagacggtggccgacgcgcacgccgaccaggtctggtcggtggccttccggggggacggggcacgggtggcctctgcctccgacgaccacagcgtagacctgcttggggagggggaaggggtctcccagggaggtggcatgggcgcgcccggaggtcgggacgagatgcacggaaggcggagtannnnnnnnnngacctgcttggggagggggaaggggtctcctagggaggtgtcatgggggcgccttgaggtcgggacgagattcacggaaggcggagttatggtcatgcaggctcccgcgacgcgctgccaggtcaaggcacaggcccgtggccattga

SEQ ID NO: 7316 - DNA, 426 bp, Chlorella protothecoides
atgacattcgatgtgaagattaaacattggcacgctgtggcgagctggacgtgggatgcaggtgcaggacagcatggggtgcactgtgggtgccctcagtgtgatgctctggggtggcatgcggtgaccctggagcctcccatccccgtacactcccattccacaggggacgatgtgtgtggaatatgccgcatgcccttcgacgggtgccccccggaagcccgctttccaggggacgactcgccggttgtctggggcacctgtgcacatgccttccaccttcagtgcataaatcggtggctgtcctctcagtctgagcagcgatgcccaatctgtcgaaggcactgggagttcaagcaagcagcggtttcagatggagagcaagaggaaagcataggtgtcgatatggaggatgccccctcttga

SEQ ID NO: 7317 - DNA, 423 bp, Chlorella protothecoides
  modified_base (154)..(163): a, c, t, g, unknown or other
atgcttcgctccctcggatgcaatccactacggggccacaagatcgttccattctaccccaacgctgggttccggcactggcgatcgagttgtgaagccctgcagaccgcaagtcggcagagctttgcctcctggacaggcaatgcatcccagnnnnnnnnnnatcctggtcaggtgtggcctttaggctgtaaagaagttagtggagttagggaagcattccctcagactgtctgcgatgcttgggtggtggtcttgcttgccacttgtctccatgaagaggatgagctcatgatcaaggatgaatgcatcctggtggacgagtctgatgctgtgacagggcatgccagcaagtatgactcccacagacctctcgatgtgccattggatgttatgaatcacccctccctcctcttgacatga

SEQ ID NO: 7318 - DNA, 297 bp, Chlorella protothecoides
atgccctgcgatgccatggcagtcttgtttgacacctgttccgggccggcagcgctctgcatcaaccccctggtgcgaccgattgccgccctggctgcaccgcagggcgagttcgtggacctgatccaccgctcggggatggtgcagagcgcggagttcaccgccacgggtaccaggatcaaggcgcacgtgccccagtcgctcgccaggaagctggcgcccatggcggtgggggggcagggcgcggcgccccccctccagatcgggctgcagcaccgggactgggaagggccatag

SEQ ID NO: 7319 - DNA, 708 bp, Chlorella protothecoides
atgcaggcctgcctggtcgggccctgcgctctcgggcctagattacaaggaggcgcctttgcaagcagccatcgcgcacatggatttgtaatccatgcccgccccttccagaccctgacgaggggtgtacagctggtgacgagggcatcagcctcggccggtacccctcccgacgcccgacgcctgcccagccctgaggagatgaagcagcgggtgtcggagcgcatcgagcaactcaacaacaggtttaggccgccaaagtacctgtggagatcttttgcagccctggtcatcgctggccagagcatcttccgcatctttcaaggtctgtcggtggagtgtggtggcgctatccatgtgacaaggtgcaggggccggaatgggatctttccgccagtcacacatgtgccccgacaaacctacaccaggcaaaatacactggcggaacaccctggagcaattgaacctggttgggccccggtctctgggggtgtgcctcctcacctccttcttcctgggcatggtgttcaccatccagttcatcagggaattcacgaagctgggcctgacgaggacggtgggtggtgtgctggcgctcgcactcgcgcgggaattgaccccggtcgtcacctccatcatcgtggcggggcgggttggcagcgcctttgccgccgagctcgggaccatgcaggtctcggagcagactga

SEQ ID NO: 7320 - DNA, 411 bp, Chlorella protothecoides
atggggtgcccgtgtggcctgcttgcacagggcatgcttcccatggcagggggaatccgaacccttgggcatccctgcacattgcagtgggagcctaagctggctggctacatgcagttcatggcagagtccaaggtcgtgtacgacacttttgaggagctgttggcggcaggcgcacagccttactgtgagcgatctacggctgcgacccttggcagacaacagcaagggcgtgtgtcaaagagtcacaatgtccctgccatccctgccttgacagacaaggagtttgcggcgacggggcttcagcgcggtgcagctatcgaccacgaccttgcctacctctccgagaagtatggcgtgcccattccggaggcaaaaccagacggcccaggccacacctacgccaggtaa

SEQ ID NO: 7321 - DNA, 573 bp, Chlorella protothecoides
atgtactcagttacgccatttatggggtacttcatgcaaatgcctgtctcccaaccgttggctctgccccaggccgagaaatgcggttggtgtcacgcatgccccttctcccctgccccaccgcaggtccgggccgtccggcccctggtccacaccaccctggcgccctcgcccccgcccaccgccatcctcccctccttcaaccccacatccatccctcaagccacacgtgtgctttacaaggtccggcccagcgagggcatggtggcggtggccagcacagcgactgcggtggagtatgccgtcgcggccgccgggccgggggagagcctgaaggccctggcccagaacctgagcgccctggccaccaccgagtgggtcgcgctggacgaggtcctgcacgtgcacgccctcagggtggactccgtcacccctgacgaccccgacttccccgagcagtgggggctggaggccgtgcatgcacccgaggcctgggccaccgccacgggcgcccccacccgcgcggcggccgtcaccgtctgcatcgtggactcaggcatcgactacgagtga

SEQ ID NO: 7322 - DNA, 1455 bp, Chlorella protothecoides
atgccgtggcagggctttcccgccattcacagggcccctgccccactccagcatccccctgcacaccgccacacactcacccaacccaacctccaacccccccctcgcctccctccccgccaggtggtcatcggcctgcgcaagggctccccctccgagtccgaggcccgcgccgtgggcttcaccgaggaggccggcacgctgggcgaggtcttcgacgtcatctcctcctccgactttgtcatcctgctcatctccgacgcggcccaggccaagctctacccgcgcatcctggcggccatgaagcccggcgcgacgctgggcctgagccacggattcctgctgggcgtcatgcagaacgacggcgccgacttccgcccggacatcgacgtggtgctgatggcgcccaagggcatgggcccctccgtgcgccgcctgtacgagcagggcaagacggtcaacggcgctggcatcaacgcctccttcgccgtgcatcaggacgcctcgggccgcgcggccgacgtggcggtgggctgggccatcgccacgggcgcgcccttcgccttctgcaccacgctggagtcggagtaccgcagcgacatctacggcgagcgctgcgtcatcctgggcggcgtgcacggcgtggtggagtccctgttccggcgctacgtggcgcagggcatgtccgatgaggacgcgtacctgaacagcgtggagtgcatcaccgggcccatcacccagatcatctcccgctccggcatgctgggagtgtacgaggcgctggacgcggagggcaaggcgaccttcgacgcggcctactcggcggccatcggccccgccaacgacgtgtgccgcgagatctacgacgacgtggcctgcggcaacgagatcaagtcggtggtgaacgcggtgtcgcgcttcgaccgctaccccatgggcaagatcgacgagacgcacatgtggcgcgtgggcgccgccgtgcgcgcgcgccgcgcgtcgctggaggtccccctcaaccccttcaccgcgggcgtgtacatcgccaccatgatggccacggtgcagacgctgcaggacgcggggcaccccttctccgagatctgcaacgagtccatcatcgaggcggtggactcgctcaacccttacatgcacgcccgcggcgtggccttcatggtggacaactgctcctacaccgcgcgcctgggctcgcgcaagtgggccccccgcttcgactacatcctcacccagcaggcatacgtggccgtggacaagggcacgcccgcggacgccgaggcgctggccgccttcaagcacgccgacgtgcacaaggcgcaggagacctgcgccgccctccggccctccgtcgacatctccgtcggcggcgacgacgactccacgggcgtcggcgcgggcgcggcgcgcaccgagttccgcagccaggccgtcctggcctga

SEQ ID NO: 7323 - DNA, 312 bp, Chlorella protothecoides
atgtcggggtttgacatgtcgggccctgtccgccttgtctgtagacatgatgcaggacaccccacctcgcaggaattccgatttggagctccttcttcagagaagaacggcccccgctcagaagcgccaggcccccatgaggcctcacggaatcagggctccagcggcaagcgaggtcgatccgaaggcgatgacgggcatccacccctggctctgggtgtccccgagctcctgccccctcacccgctgcgcctgatcatcattgggcacaaccccagcgcccatgcatggcggacgggcgagtcagggtga

SEQ ID NO: 7324 - DNA, 771 bp, Chlorella protothecoides
atggcggccgcggtgggcgtgagcatgctgcccggcagccccggccccatggacgagctggggcacggcagccacgtggcgggcatcgtgggcgcggcagggtccaacgccctcctcgtctccggcgtggtctggggcaacgtcgacctcctggcctgccgcttcatcgacggcgacgggctgggccgcacctccgccgccgtggactgcgtcaactactgcctggcccagggggcgcgcgtgatccaggcctcctggggcggcgccgccgcgcccaacgccgccatgcaggccgccatggaggccgcggaggccgccgacgcgctgatcgtggtgtcggcagggaacgatgaccgcgacctggacgccgagccgcagtaccccgccagctacgccgcggaccgcgccaacgtcctggcggtggccgccgtggggcgtgccggggcgctctcctccttctccaaccgcggcgcgggcaccgtggcgctggcggcgccgggcgaggccatcctcagcacgcttccggggaacgccacgggcgtactcagcgggacatccatggccgccccctttgtctccggcgccgccgccctggccctcagcgtggccgggcccggcgcgctccccgccccggccctcaagcgcctgctgttggaaagcgcggagcccacggcccagctccggggtagggtgggggctgggctgctgcgcctggaccgggtggtcgctgccgccgccgccctggcagccgcacccaccacggcaccctga

SEQ ID NO: 7325 - DNA, 360 bp, Chlorella protothecoides
atgacttccctcctccacccctgcgtcagaaggcatggctacttctgctcgttgcctgagcgcgagtacctgccggtgttctggggcccggaggaactggccctcttgcagggcactgaactgggagatgccatccacgacgagctggactgtgtccggtcagactacacagatcagatcgagcccctgattgccaagcatgggctggagggcatgaactactccttccctgccttccaggcggctgcatccttggtggcctccagggcgtttaaggtggacgacgccgtaggtgggtttggcgccctggtctttccctctcctcgatgtaccttgcccgcccatgtcccgggggagtga

SEQ ID NO: 7326 - DNA, 747 bp, Chlorella protothecoides
atggtcccgctggcagacgtgttcaaccacaaggcgtcagtggtggccctgtcggaccagtatgctgtgtacgagggcgaggagggggaggacagctccgacgacagcgactctgatgcagacgaggaggaggtgcaggagggggaggacacggaggacgccgatggtgacgaagagggcgcggcgagtgggagcgaggcggcttccgagagcctgggcagctccgaagccagcggctccggcggggaggggagcggctcgccgggcgcctcccccggcgccggcacgatgctgacctcccagctcgtgccccccagcttcctggcggacgccgagccagagctgcacggcctgcgctccgccaacgggctgtccctggccctggagatctgcatcgtggatgatgaggagggggccgcgctgaggatcctcaccgccagccccatcggagaggggcgtgaagtgcacaacacctacggcgagctggggaaccgggacctgctggagaagtacggcttcaccctgcccgagaacccgcacgacagcgtgaccctggagctggagcccctgtgggcctggggtgcggcgcggcacggcgcgcgagagtgggaggcgcgccgcgctttcttggacgccaacacgccctggctgcgccgcaggcggtacgcggccgtcgtgggtctacgagtggcgagcgagtttggcagggggatcccgctgggaggtctgcagagcggggtggcgtga

SEQ ID NO: 7327 - DNA, 492 bp, Chlorella protothecoides
atggacgggaggccgcagctggagattgaggccgccgccaagatcgggctggacggcgggccgctgtactaccgctgtgcctcgtgctccaccgccgtctccgaggcgcggcggcagatcgtctggtgccccggctgcaaggagggcctggagggcccagagcggtgcctttgtcacggctccttccaagatatcgcccgttgcccaagcacagttcccccgaaaaatctcccgtgccaggcgacgcccttctgcagcggggactgccaccgccggctctacccctcgcaccgcggcgtgtgcggcttctggccgcggcccctgcttcccagccaggtcgcgctgcgcatgggcgtggaggcgcacatggtgcgagggctgtcgggcggggcgctgcagggcgcggtgctgcggcagatgcaggcggtgcagcgcagctaccaggcggccgccgtcgcggccgccgcagccacgggcgtggtgggcgagtga

SEQ ID NO: 7328 - DNA, 291 bp, Chlorella protothecoides
atggctgccacctctgccgccgcacgggcgccttgcgctgctttcgcccggtgtgcccccaccaccagcattgtcgcccctcgcctgggccccctgacccggcccgcctccctgaggtctacccgcggcaggcgctccctcaccgtgcagaacgctgtcaagtatgactacaacaccaaggtgttcgagaaggagttgctgaccttcgccgggagcgaggagtacatttacaggtacgatgctgtgccaactgcccatgcgcgtgatcgagggcattgcgaagttcgataa

SEQ ID NO: 7329 - DNA, 330 bp, Chlorella protothecoides
atggagccccaggccaaaagggcgaaggccgacggcgcggcacttctgccgggcctcacagcctggctggaccgggagggggtgtggtgggacgacgaggccatgcagatcaaggagtcaaaatctccgaacggcagctccttatccatccactcgcggcggccccttccggccggccaccacctctgcaccatccccaaggacgcctgcctgagtgtgcgcaatgccagctgctccgacatcatcatggaggagaatatgtgctctggtctgggcctggtgatggcggtcatgcacgagcgcctcctggggcccaagtctcggtggtga

SEQ ID NO: 7330 - DNA, 558 bp, Chlorella protothecoides
atgcggctggccttctccccgcgcggcgacctgctggcctcggtcagccgcgaccgcacgctggcgctgtggcgccggcggccattgcatggggatggcggagagggctgcgccccgcccttcacgctcgtggcgcgggtgaaggccgcctcgcgcctgctgttcgacgtgagctgggcgccggacgaggcaaccctggccacagggtcccgcgacggtatagtggccctctggcgagcggcgccggggtcaagcgaggccctcaccaaatcgctggagctgcgcagggggtcggcggtgcgggcgctcgccttttgccctggtgagctggcgcagggcagcttcctgctggccctcggccacgaggacggcacgctgtgcgtgctgcgcttcagggtgcagtccgggaacgcgctggaggtggtctggcagcgcgccacgcacgccgggccggtgcggcgactggcctggcggcgggatgacggggaagaaggcagcttcctcctggcttcctgctccagcgacggctcggtgcgcatctggcacgtggccgggtga

SEQ ID NO: 7331 - DNA, 342 bp, Chlorella protothecoides
atggtgccaaggcccagcaccaggcccctttgcaaagtcagaatacagcggttcgaatcccgaccgcctcgctttctcaacccacaggacgaggacctcacccactccctgaggaagctgctgcgcacaacgcgcggccaggtcacagtggccctggaggtcggagtcctggtctgcatgctgcccttcctcgtcatcgacgccaccatggccggcgtgtaccgccagctctggatcgacccctggcgcatcctgagcaccatcacctacgtgaatcaggggcatgttttcctagagccctgggtggtgggcgatccgttatgtgagcctttgggcgtgtga

SEQ ID NO: 7332 - DNA, 234 bp, Chlorella protothecoides
atgcacgggtccgatgacccgccagcccccggtcctgggctcccggcccccaccccacccgacatgcccgaccactcctccactctgaatgagctggaggcgttcctgcgccagcccgatgccatcatggagccctccatcgtggacaggctgcgcgagtatgtcatggccaatggacacccccagcaggcggtggagtacctgagtgacagctaccagggtgggcacctgtga

SEQ ID NO: 7333 - DNA, 1551 bp, Chlorella protothecoides
  modified_base (273)..(282): a, c, t, g, unknown or other
  modified_base (1106)..(1115): a, c, t, g, unknown or other
atgccccagtcggtcaccgtgccggcgctgcgggactgcctggcgagcctggagcgcctcctggcctccgccgcggcctttgacgacctgggggaaggcgatggtggagtgatactgaggagaggaggggagggagtggagagaactgagcggtcaagtggggggtattgcttcaatgacgaccgatgtcatgcagcaatcgagagccgcacaagtggcatcgcccatttgttggccctaccatgcccagctcttgatgatgtcccgaacttnnnnnnnnnnctgaggagaggaggggagggagtggagagagctgagcggtcaagtggggggtattgctttaatgacgaccaatgtcatgcagcaatcgagagctgcgcaagtggcatcgcccatttgttggccctgccatgcccagctcttgatgatgtccccgtactcgacacaccaagcacctcccgctccccgcccctccacgctctccccctccacagcgagccccagggggtgctgctgctggcggcgctgcaggacggcggcgcagcgcccgcgcacgccctggcacccaggctcaggaaggtggccgccgcctttgccgcgctgcgccggcagtgggcctaccgcctggccaagcaagctgtcggcgccttccgcgcgcgcttcaacccctaccgccaggaccgcgcccgcttcgccagcggctgggccgctggcggcggtcccgggcgggcagcgtcggaccccggcggccaggtcccggacgccgactcggcgtggccctgccccacgctgctggccgccgccgacggcgtgcacggcctgctgcgaatgctgagctcggacctggacccgcccgtgttcgccgacgtgtggcgcgccgtggcgctggccatcaaccaggcattctacaatgaggtggccaccgaggcccttttcagcccgcaggtgaggagatgtgggtggagggagggaaggaggacgcgcaagaggagccgggttgtaagctggcacccgcgaggtgggtacttcggcgatggtggacggatgtatgagcgaagatgctgtttatgcttgccacctgtgagctactcttccttaacaacacnnnnnnnnnnttgtaagctggcacccgcgaggtgggtactacggcgatggtggacggtcgtatgcgcgaagatgctgtttatgcttgccacttgtgagctactcttccttgacaacatacaatcaagcgacctttccatgcccacctggcacctcagggcgcgtggctcttccacgccgacatcggggcactcaccagcatcttcggggagtggacggccaacccggatgcgcattttaaggagacacgggaggcctgtcggtgaggggaagagggtggggcgaggagggccggtaccggactcggtgggattcagtgcgcgcagggtcgccggctgggtgtgcggccactggaggttccaccacccgtccgaaaaccttcgttcctgtcacgatgtgcagcctgctgaccctgccgcggcacgaagccggcgacctgctggctaa

SEQ ID NO: 7334 - DNA, 978 bp, Chlorella protothecoides
atgggcgacacgaatcgtctcagcgataggtttagggcagtccttcccacaaacacggccagcactgctgaaagttcctccccgtcaccacccagggcgcgcaaacgtgatcacgcttcccctgaaggactaggactttggaaaccccccatcgccaccgtcttgctcgtacaagatgggccgagcatcctaaatgaccctccacaccatcaccgagtgtttgtgagtggtcgcgatgctccgtgcgtccctgcccagcacccgtgcgggacgtgttggccacacgagacgcccgggccggggccctgcccgtatgtcgcccccttccgccagtggggcggtgcccaatggggctcccgcctcccccgagtcgctgcccacgtccgtggctcccaggaagtacgcccttgccaccctgctggtgcactctggtgcgctggaggaggaccccctgggcgcctcctcaccgcccatctaccagacggccaccttccggcagcctggagccaccacggggggtgcctacgactacactcgcagcgggaaccccaccaggaatgcggtcgagatccagtgggcggcgctggaggtgggtgggctgggcgacggcccgtgccatcgctgaagctccctgcatgcgccttcccgaactcctgccctgtgtatgtccagcccttcttcctcatcaccatcacaatcctgtccctccccacacccaccctgcgtccgcctgacctccaccccacacgtcccttcacccagggtgcggagcgcgccttcctcttcaccagcggcatggcggccctggccacggtcacccacctgctgagtcatggcgaccacatcgtggcgggggacgacctttacggaggcaccagccgcctgctggcgcgcgtctgccccgccgccggcctggaggtcaccaacgtcgacacctgcgacgtcgagtgcgtggcctctggggggagttctctgtga

SEQ ID NO: 7335 - DNA, 1152 bp, Chlorella protothecoides
atgtccggcggcgatctggagaaagctgctgccgagctcgcgagcctggaggggcagagggaggcggcacacgcagcgctgtccagcctcgccgcgtccgcctaccagcgctactctgcgcggctggctggggcgcacagcggagtgcccctgcctgccgacgttgcgtcgctggctgccgagctggagacactcacagcggcgcatgcacaccttgcagcactgcaagccttcctgcgccaggcggaggaggcgtgtgcacaccctgcccccgccaccttgggtcgcgccgtggatgcgctcgcccacgccgtgcgtgctgctgccggagtcgcggacgacgcacggctggccgcccacacaaacacaaccccatcctcccatgaagttctgcgcgcgctgagcgatgcgctggccgccgacctggcgcgcctctcagcgcggctgcggcgccagctgtccgccggcttccaggcggcgctgggggccgccggctggcccccgccctttctttctgccggcgacgaggccggcggcgcctggcgcggcctggactcgccagacgtgcgtggcgctgcgctgcagctgaccctgctacagcgctcggccggcgaagcggcgcagaatgagggcccctgggtggcgcaggagctggccgcgggcgtgggtgctgcgctgcgccgccacttcgcctcgagctccgcgcccaccgaccgcgcggaccgccctgagtggctgctggccaccaccctccgagcggcgcgggtttgctgcgccgccgcctaccagctccagggcgtgctcgccgctggcttcggtggcgacggtgacgacgcccggtgcgtgcactatagggggggcatcattgtctcgaacgctcgtgccctggtgggtgctggactcggcaagaggccaaccccctcctcagtgccaacccctacccatcatcctcccgctttcccaaaaccacagcctggtccccatgctggacgtggaggtgggccgcgccatcctggcctgtgcgctgggcccggtgctgactgggcacgttctgcctcgcctggtcttgctgggagagccctccctctggctgcacctggcggacgagctggccagcttccaggagaggtgcgatgttcaaaagcacactga

SEQ ID NO: 7336 - DNA, 1707 bp, Chlorella protothecoides
  modified_base (356)..(365): a, c, t, g, unknown or other
  modified_base (473)..(482): a, c, t, g, unknown or other
  modified_base (1591)..(1600): a, c, t, g, unknown or other
atggccgggggcgccctgagcaaaggcctcaccaatgcggagcgcattgatgtcctgcatgttcggcatcccctcagaatctcgaacggatccaatgggtccattcgcggcagagtgtgtatatcggctgaggagggcccctccgcagcatcggagctccggggatacactcggcgcggtgcagagccagcacaaaagcaccgaaaggcctcgctcactgagccactgatgtcggcgcacggtcaggtctcggattcggcgtcgttacgtatcgctggcatgacaatctgtgtgacgaagaccgtggtgatagccagcataaaggaccgaaaggcctcgctcactgagccactgannnnnnnnnnttggcccgatgggctcccggtgtcgcatgcatcatgtgtacattccacaattatctccatggctgacctggataaaaccgccgttgttatcgaccagggggcctcggnnnnnnnnnnatggcccgatgggcacccggtgtcgcatgcatcatgtgtacattctacaattatcttcatggctgacctggataaatccgccgttgttatcgaccagggggcctcgggcatccgtgcgggcctggcgggagaagacttccctctcgtggagttgagatccaggagtgacaatgagcttggcaagggacccgttgatccaggggtgagtcgtgttccacaccgtgaaccgcccccatctcccaaccagggaggctgtgagtcttggcacagcgttttccaagccctgggagtgggtgcagagggcaggaggttgctcatctgtgagccctttggcaccagcgctcatcagcggaaggagcgcttggagttggcctttgaagagcaccgcgtctctgcagtcttcatgcagattctgcgcggcactggttcgtactcatggttctggcccttcccaccttcagctccagcctgtgctcacgctctacgcgctgggcctgctgactggactggttctggactgcggcgagatggggtgccgggcggtgagtgggttacccacatgagctgtactgcttggtgggtcgccctaggcatccagactgaggattcatcacctacctcagagatcacacaatgcctcagttgtaagtatagctcctcttctgatacatcatttacaggcccctgtgatagacgggtatgtcctgccgcatgccttcaagagccaggcggtggggggccgccacgtggcagcccgcctgctggacctgctgcgaaggcgggggtatgcactgagccgagacacttccctggcagccgtcacagcagccaaggagaagctgtgctacctcgctgtcgacagggaggccgaggcaaaggtggggataaagataactgcttcttgattgtccacacatgctacataccgagtccacaaagggtgccctgccctgagcatccttgggcacatcattcaggttcccacaaccctgcctgccgttggggcatgccctacatgcaccggactgccactgcatgctctgctactgtactactcagccgcttgaccctcttccctaccccctccccccagctggcccgggagactnnnnnnnnnngatgcaccggactgccactgcttgctctgctactgtactactcagccgctcgaccctcttccccaccccctccccccagctggcccgggagactacggtgggcgtga

SEQ ID NO: 7337 - DNA, 1287 bp, Chlorella protothecoides
  modified_base (424)..(433): a, c, t, g, unknown or other
  modified_base (1153)..(1162): a, c, t, g, unknown or other
atgcagggctcgatgctcactctgaacccccctcggcactgcccggccttctcggctggggctcggaaggggccccgacccaccgtgcgcagcgccaggctggctgtgcgcgtcagggccacccaggctgccgatgcctacatctccccatcttcgaggacggctgcaaccgagctgcaggctctggagcgcttcagcgagatcgtccccgacgtgctactcagccaaacccttcaatctgtcgaggctcccaaggccgccacctcctcccgcggcgtgctggcaggcatcctgagctccccctccagctttgggcgctacaagggggcagctcaggtatggctccctgccgaagattacgcgtcccaccccatccacctggtgaatcatgctcgcatgcccaccccacgcaagcacagtttgnnnnnnnnnncagggggcagctcaggtatggctccctgcccgagattacgcgtccaaccccatccacctggtgaatcatgcccgcatgcccaccccacgcaagcacagtttgcggtggagcaggcgcggcactacgaccgcgccgcccaggccgcaagccccgcagaggcagcctccctgcgggtggacaaggccctcgtcaacgtcggctccatgttcctggagaacgtctccggtcgcgtgtccaccgaggtcgacccccgcgcccacgacagcgagggtgcggcggcgagcgggcaggggatccttgcgtgtgcctggctgggcgcgctggttgcaggagcggttagtcgtgcatgcccgacacactcggcagcctgctgcacaatggcgacgccatcctttgagcccctccaaacccatgtcctctgcctccgatcaatgacgttcatccctcccctttccgacccacgactgtcccttgcagaggccctggtcgcgcgaggccagagcctcatccggttgtacgaggaggtgggcgtgtcgcgcgaccgtgtcgtcctgcgcatccccgccacctgggccggcatccgcgcggcggccgcgctggaagccgagggcatcgccacccacctggtcctggtctacggcttcacccagggcgccgcggcggcccaggctggcgtgtcggtcatccagcccaacgtgggggccgtggccgactggtacnnnnnnnnnntgccacccacctggtcctggtctacggctttacccagggcgccgcggcggcccaggccggcgtgtcggtcatccaacccaacgtgggggccgtggccgactggtacaagcgccacccgggcgtga

SEQ ID NO: 7338 - DNA, 489 bp, Chlorella protothecoides
atgcgccagggtccgcgggaggccgcgctggctgtggctgacgagtacggcgagagcgtcaaccccgggctggtgctggtggagacgctgtaccactacgtcaagcgcttccaccccaagacgcgcatcatggcctccggcctgcgcaccaaggccgaggcgctgcgcctggcgggctgcgactacctggtggtggggccgcgcgtgctggaggccctggcagcagccgccacactggagggctacaacgacggcctgcgcgccgacgaggatgaggcgccgggcgagctggcgcccgcgctcacccccgccgccgcgcaggcccacgacttctccgaccaggagacggccaccctggaccgagccctgttcgaggacaggcttggcctggccgcgcgggagctgctgcgcgagggcgtggcccgcctcatcggcgacgccgagcgcctggaggcctacttcctgaacctcgccggcgggcaggagtga

SEQ ID NO: 7339 - DNA, 1074 bp, Chlorella protothecoides
  modified_base (166)..(175): a, c, t, g, unknown or other
  modified_base (570)..(579): a, c, t, g, unknown or other
  modified_base (907)..(916): a, c, t, g, unknown or other
atgggtcggcaggcagggcgcaagcggggcggagggccaggtcttgcacacatctcgggtatgtgtgaggagttcagcgcttttgcgcagacgcatgtactggaaagcgattcatccagcggggcatgcccgtcctctcgattcaatgttgggggacgaccctgcnnnnnnnnnnagcttttgcgcagacgcatgggctggaaagcgattcatttagcggggcatgcccgtcttctcgattcaatgttgggggacgaccctgcatcgacccgggacgggatgaccccccaacggacgatcgatctgcgtgtgaaggctgtctcggtgcttcagttccgcgactcacgacccggcccggactccgttgccgcgacgagctgctgcctgccaacgcacctcgcgccccactccccgcagaaacctgccatcatgagtggaaaaggagccaagggactgtccggaaagggagccaagggcaccctcggaggcatcaagggcggagacaagaagaagcccatctcgcggtctgccagggcagggtttgcggcgcgggatcgcggcaacggtacnnnnnnnnnngcaggccagggcactccttactcggatattctacatccttcttgtctgcagttccccgtgggtcgtgtgcaccgtctgctcaagtcccgtgctacggccaacggccgtgtgggagccactgccgctgtgtacgctgccgccatcctggagtacctgactgctggtagaggtgctggagttggcaggaaacgcctccaaggacctgaagttgcagctgcctctcagactattgtgtatgctagacttgctgcatcctctgccctcccaggctctcagcacccacactctccacctgacctcccacagctggacaccctgatcaaggccnnnnnnnnnnccgcatgctgtcagcacccacactctccccctgatctcccacagctggacaccctgatcaaggccactattgctggtggtggtgtcattccccacatccacaagtccctggtgaccaacaagcagggcaagaaggagggtctgcttcccatcatctaa

SEQ ID NO: 7340 - DNA, 1524 bp, Chlorella protothecoides
  modified_base (92)..(101): a, c, t, g, unknown or other
  modified_base (505)..(514): a, c, t, g, unknown or other
atgcgatcgtcgcccatggcagccttgcgtcaccctgcctccctttctcaacttgatgcaggagcgcgtggaccgtgtgtaccagaagcccnnnnnnnnnncaatgagcgcgtggaccgtgtataccagaagcctgaggagtggacggccatgtccatcaacagcacggccgggagcggtttcttctcctccgaccgcactatcctggagtatgccaatctcagccaggcagcgcttgcctcagcttttggggtcagattgcctgaatcatggattcccggctcagtaccctacgccacaatgcctcctggtcgagcaagagccgcggcgaggacgtcgctgccatgccaccgacggcttaaggcttgtgtgcttgatgtcgctgttgacgcgatggaactggagcctcagcgggtgatacatggaggaagggattcggacacagtgacagctggaaggggggaacccacccgagttcgcgcccaggggacggtgggcaatcgcnnnnnnnnnngacgcgatggaactggagcctcagcgggtggtcattacacccaaggtgttgggtactgccaaagagagtgtgcgtcgacatcatcgaccggatgtgatgcaagactgatcggtcgagccgctagacggagcgtccatggcagagggccaggcccagcccgaggtgttcacggacacggatggggtcaggcgcatgaagggagtgagcattgttgtccctgtcgtgacaggcaccatctcgttctggctggcaaagaaggtcggtggcccacgcacgcattcctgggatggctgaggtttgcattgacttgcaccccctccgtgctcgtgccgggacagcccacccaattcctgctgggcccttgcgcaggcgacagaccatgcttcacacaagtggacgatctatttgcgccatgccaagaacgaagacctcgggcacctggtgtccaaggtgcggtagggcatgccgccgtcggcgggattctttcggggcctgttatcatcgggctcttggggcaaatatcagtcggagccattcctcatgtacacttccgagaggatgtcagggaaggacctgtggagctgtaccatcacctcaccctgtacgacgccagcgggagcaacaacgccaagcgtccggtgagtctcatgcctgctggtgttgggacccacaagcctgctggggaagagatgtgtggggccgactctggggcccggggctgcatctggagggcacctcagcattctcctgccccatggtgcagccagcatgaccagcatgtggtgcacgaagtttatgatgagatcgtgctgtgggagccgccggaggaggtgcatcgccgcctggccgcccacacccccgcccccgccccgcagtcccagctggcccagttccacacccagttcaacccggattacgagtaccgccggctgcagcacgctcggcagcgggtggcggccatcaccaacaatgtgaaggtacagctggcggcactggaaagcgcggcctag

SEQ ID NO: 7341 - DNA, 687 bp, Chlorella protothecoides
atgtcgctgctggtggacatggtgcgcggtgcgaacaccgccgccatccggcgcgcgggcctggtcgggctggcggcgcacggctgcggccgcgctttcttgaagaacggcggcgaggcggagcgcctcatccgccgcatggtggtccagggcctgctcctggagcgcacggcgcggcaggaagtgcacatggcggtggtggccacgctgagcgtgtgcgaggaagccgccgcgcgcctggcggccggccggctggccctggtggtgccggtgctgcagcccaggcccggcagcagcggggccaggagcggctcgggcgagggcaggagaggctcgggcgagggacggggggggaggggctcgggcgagggagggggggggtggggcgagggcgccgcgcccgggccccggccgacgctggcgctggatcgctcgctggcggccaacccgctgcaagaggactgggcgggcggggctggacaccgcaagggtggccagcgggcggcgccggtgtgctccgccctggccattgccagggcggggcagggacgggcaagaaagcacggcgcggaggaggaggacgaccccatcgacctgtgcctggacgtcgaggaggtgaaaggaaggggggaggggaggggggggctcggtaagtggcatggcttcttgctctgggcgggatgctga

SEQ ID NO: 7342 - DNA, 195 bp, Chlorella protothecoides
atggcggaggcaacgctggaagggccttccttaagcatgctgcatgtgaccgtgcccagcgaggaggttggccaacagatagccggcgccctggtggagggcaggctggcagcatgcgtcaacattattccaggtggggtttgggattcccggggacctgccgctggggggttggatcctgccttccaagtctag

SEQ ID NO: 7343 - DNA, 963 bp, Chlorella protothecoides
atggacgacgacgatgcctttttcgaggggatcgatgtggacggcctgatcacagggcagtccacggggcttgcccaggaggcactgcccagcagctggccagctcacaatcccccagaacaggcacgtgcacgccctgccccgccgccgccgccaccagcaccccaggctctgtcggagccggagcgtgcccgccggcttgcggccgtctccgcggccctggcggctgcggccgagaagatgctggacgccgagggcgaccccggggcgctggcgactgtgatggcggagagccggcgcctccgcgaggagaagtctgcgctgctcgcacagccaggggagtccagatctggcacggacgccgctaccaggccccagcccttgggaggccccggcccggcctcccagttccccgagggtggcaacccaaccggcggccctccatggcagcagacctcccgcgcctcggcaccgacggtgcaggccgcgccgtaccgagccagctcctgggtccagggccccggtacagctccccctcccctcacaaacagctacagccaccaaggcgcctcgctgggctgggaggagggcggcgccccaccccagccgccggcctggacgccggacaaggccctggcgcggcaggcggcgggagagcgtgtggacgcgacgcacgacgcctcatggcgtggcgagacctttgcctggagccgggagctccggtccctgaacaccacgcggtttggcaattcggggttccgccacaaccagctggccatcatgaacgccagcctggcgggaaaggacgtattcgtcctcatgcccacaggcacgatgatgagcgttcattggtggatggggcatgccggctgcacttggaggttgctgggatgccacgaagcgagggcaagcccagcagaggcgggacctgccgctgggaatatgagtggtagcactcgctga

SEQ ID NO: 7344 - DNA, 546 bp, Chlorella protothecoides
atgggctgggaggagcagcgcgcggtgtacgacgacatgacacgcgaccccgaggcctccaaggtcctgttcatcacacccgagaagctggcggcctccgggcggctgcaggccaccctggatcagctgcaccagcggggctgcctggcccgcgtcgtcatcgacgaggcccactgcgtcagtcaatgggggcacggtgcggccggggggtcccacatgactgctgaaaggggctggacggggggcaaggcgcgatggggaggggaccctgcgaagctggcccatgagcacatggtcccacccacgccacccgtcgcccccgcagacttccgcaaggactacacgcgcctcagcttcttcaagcaaaagtgggagggaggggtgctagtaggctgggctgcctcggtcgtgtctcggggagcgtttgggatgtggcaaggacagcatcaagcatccagacgagcaggggattgggacaagtcgagcgtaccccagcgtgccgctcatggctctcacagccacggccacgccccgggtgcagcatga

SEQ ID NO: 7345 - DNA, 1491 bp, Chlorella protothecoides
  modified_base (555)..(564): a, c, t, g, unknown or other
  modified_base (1240)..(1249): a, c, t, g, unknown or other
gcgctggcggccgccggcgccgccgtggccgcggtggacgccgtcatggaccgcgacagccccgtgcgcaacgccttctgcgcggtgcggccccctggacaccacgcggggccggcgggggcggtgcccagcgcgcgcgacccgcacgccaccaacggcttctgcctgttcaacaacctggccgtggccgcggcctacgcgcggtgcgtgtataggggccgcggcgtagcacgtgtggccctcctcgactttgacgtgcaccacggcaacggcacgggtgcgtggttgggcgtgtggcaggggcgggagatgtggagtgtggggtgggcgacattcagtgtgaaggggggcgaggaggctggatccctccgcgctctccatgtcattcacaccgctgatggacccctcctgtccgctcccggctcatacgcagaggcgtgtgtggtgcgggcggcgccctcgctgcagagggtccccttctccacgccctactcggagggtgttcaggcgagggcggggagtgcgtgtgggttgggggcccgtgacgaaatgtgnnnnnnnnnncttgggcgtttggcaggggcgggggatgtggagggtggggtgggcgacgttcagtgtggaggggggcgaggaggtgtggccacaaaagggaggacctgggatcctgcaaagccgtggtggtgcctctgtggcatcacgaacgaggcattgcatccgggactcctgagccggatttggcctgcgcttccatgcacgcgccgggcaggctggatccctccgcgctctccgtgtcgttcacgccgccgatggtcccctcctgtccgctccctgcccatgcgcagaggcgtgtgtggtgcgggcggcgccctcgctgcagagggtcccgttctccacgccttactcagagggtgttcaggcgagggcggggagcttgtgcatcggggagctgtgccccctggacacctgggtggggccctccctgacccagacctcccccctcctccctcgcagacattcccggtctacaagccgtggctggacgcggatgacaaggacaacatcttcttcgcgaggtgggacgtgggtgggggagaatggcaaggggggccttgcgatggcatgtgcagcggagcacaggcaggagggatgcccttttggcgctgctgtgggaaacccctccggacccttcggcatgcacccttggaccctgcagcgtccaagggtttgggcccaaggnnnnnnnnnntagggatgcccttttggcgcttctgtgggaaacccctccggacccttcagcatgcacatgcacgatcctgcagcgtccaagggtttgggcccaaggcggaaggcatgaacgcctacgtctacccagggtcgggcgccacgggggacaaccggatcgcagacgacgcagcccagagcgtggcaggtaggccgtgcaagggtggccaggggtgcacagggtcggcaggagccgcaaggaactga

SEQ ID NO: 7346 - DNA, 1068 bp, Chlorella protothecoides
  modified_base (156)..(165): a, c, t, g, unknown or other
  modified_base (552)..(561): a, c, t, g, unknown or other
  modified_base (906)..(915): a, c, t, g, unknown or other
atggggtgtgttagcacagtcccaagggcttgcagtgcacatgtggccagatgctgcattcgctggaccgcagagtgcgcagggccgccatcccgagtggctcctccagaggatgttgtcgcgacgccagggatggtgtgcatgtcactgcccccnnnnnnnnnncgtggaagcatctgggactgcaaccattgtggggtgtgtcaggacagtcccaagggcttgcagtgcatatgtggccagatgctgcattcgctggaccgcggagtgcgcagggtcgccatcctgagtggctcctccagaggatgttgtcacaatgccagggatggtgtgcatgtcactgccccctacgagccctgtgcaccatgcagttcagcaaagcctgtccatgaggcaccagctccctcgtcttgtcatgcaggcattgccgaggatccggatgccgagtttctgcccacaggtatggctccgaggaatgctgagacgttccccgggcgtgcagaggaatttacttgcatcaacatccgcacctctgtcgccggtgcacccccnnnnnnnnnnattccctgggtgtgcagagaaatttacttgcatcaccatccgcacctctgtcgccggtgcacccccgatcccacatgcaaaccatgccacactcctcccgcaggcgaggacagtgtgggagctgcgccgccctctgcaccccgcgtcatcgacgtggggattggcgggcccggcaccaaggtcgcgctctggcggcgttcctggcgcgacaagatcatccccgcgctcgtcaatttccgccccgacttcatcttcatctcggcaggatcctcaccatatagggcgcgccaaggcgccagggggtgctcggctgagtggggtggggttctgccggcgtcatttgcnnnnnnnnnnaaatgtgcatcgttaagcatagaatgctggggttttgggggggcaagattctcaccatataggcgtgccaaggcgcaagggggtgcacggctgggtggggtggggttctgccggcgtcatttgcccccgcctgccctttcccggcctgctatt

SEQ ID NO: 7347 - DNA, 633 bp, Chlorella protothecoides
atgagcacaggcgcttttgagagtgtgggactgggcccctttggcgggccgggcacgctggcggtggcggaacgcgtgaccgcggcggtcaagtcgctgagcgggatcgacaccacggggtactgcggcctgatgctgcccctggcggaggacacggggctggccgctgccagcagggcgctctccgtccagaccctgctcttctactccgccgtctgcggctgcggcctggacacggtgcctgtgccgggcgtgtcggatgagacgccggctggggaggcggcgcgcctggtcgccgccgcggcggcgctggtcctggacattgccggcatggccgcccgccttggcaagcccctgacctgccgcctgctgcccgtggcggggggaaaggcggggcaggccacggcatgggacagcccctacctagtgccggggacggtgctggagctgtgcttaacagcagaggcaagcggtccatggaagggaggagtaaatgggcagtcaatagcaggggcaaaactgacgcccgaagtcaacatgggacgcggggcggccgcgaaacgcaggggccaccacagcgcctaccacgagggccggtcctcctgccgcttcttagcgcggatgtcggcgtag

SEQ ID NO: 7348 - DNA, 1221 bp, Chlorella protothecoides
atggccagtgacatcaccacctacccatgcatcatacgatccgtcacttactttcttcccgaaggagatgtcggatctgcgggctgggagggggccatgcaggaggctgcagccttcctggccaccgccagggggagtctcgagcaggaaggtatgcgctcgaccggtgtggctggtggatgggggacacattgtgctctgcatgggattgctgctcagggctctggttgcgtggcgccacgccatcgcggtcaaccagcccttcagatgcacattcgatcctcctgtcttgcagggatcacggtgcagacgctgcgagtcgccaccgacatcctgacccgggtagaaagcgtggaggaagctctgcgcaaggcccgcgtggtgcaggccgccgcggccgccaccggcatctcctttgtatcctacggcgccttctccaacgcccggcttctggaggaggggctcgccacgaaactactcgcgacgcccggtggcgatgcctacacctgctgcaccttccgctggcagccggtgagctggtggggactgtggaaaaatgcgttggacgacgctgcacgtttgtattgggggtgtcacgaggtgggaagctgttgctggcaagcagggcgccgttcaggcccgcccagcaaccacctcctcccctcgccgcagggcatgggcgtggaggaggcgcgcagcgccgcccgcgccatcttctccctgggcagggcgacgggcgacgtgggcccctttcacttcgccctgacctttgccgaggagggtttccagacccccttcttccccgccgccagcgcgacgcgccccggcttcgccatcgccaccgagaactcggcgcagtacgccgcggcgctggcctcggcgggggaggggggcccggcgggcgtgaccccggccctgcgtgccgccatggcggccggcctgcgaggcgtgcaggcctgcgccgtgaagctggcaacggccacgcacgtgccctacctgggcattgacaccagcatcaacccggggctggaggggcccagcctcgcgggtgcgtacgggggctggggcttgtgggcatgcatgagctggggaggaggggcaccacgcgcggggctcccggcccgcgcctgcagccgccctcccgtgctcgtgctgcattccgcgccggcgccgcgctgcaccatgcctggcttcctggactcccgtcacagacctccatga

SEQ ID NO: 7349 - DNA, 333 bp, Chlorella protothecoides
atggtcgtcctgggatcgggcgggcacaccgcggagatgctgagactcttcaagaactttgatgcctcggtgtaccgtcctcgggtgtatgtcgccgcggccaccgatgccctgagcggggtcaaggccactgccttcgaaaaggcttgggccggcattcctggcaagggaagtgatccctcgggccccgcctaccaacaggccgtgataccacgcagcagggaggtgggccagtcctggaccagcagcgcactcagcacagcccatgccatgctgtatgcgctggccttggtgttccgagcaaggccagacctggtgcgtgtcttttgttga

SEQ ID NO: 7350 - DNA, 501 bp, Chlorella protothecoides
atgcccgggtcatggctcctcgggagagatgcttgtgcccctcaccagctctttacccacaccttccaggccctgcactcccaaccatcaccctcccgtgcgcccaggaagcaatatgtggaggcccagttggccgctcggctgggcaggccggcgccggggtcggagcagccggcggcaccgcgcggcatcgacgacgagctgtttgcgaccagccagtatcagcgaaaggacgacctggagctggggccctcctggatcacgggcatcacggaggtcccgctgtccatggatcagaggctgaagaacatcgaggacaccgagaccgccaagaaaaagatgctgacaaggagtggcatggtcagcatacacgatgccgacgatgatgatgatgaagaggagggtgcaggctcccgccaggccctacggcgtggccagtaccccgtcttctttggaaagcaggaccccgccatgctcaagcgggtggaggaggcgcagtga

SEQ ID NO: 7351 - DNA, 1242 bp, Chlorella protothecoides
atggcatcccgtttgttcgaggatctgccggagcccagtgctgccagggagagagaggtgccaccctctaagcggccccgtaatgaaactgtggactctgaagtcagagaagaagtgggtgagggtggaagttccgcacctccatccaaggagacacaggcgactggcacagagcccagaggggagacagtaccccaagaggccgctgctggatcgggggctccccagtggaccacagacgatgacgaagtgcccccgccaccgccacctccaccacctcctccggtggacggcatagcccttgcactggagaagattgcatcgcacattccccaaccttcaaagctcgtcaaggcctctcgcttgctgcgccagctcctggaacagggtaccttggaccctgaagcgcatgggccacttgtctacagagcccttgtcggcagtctgtctggagcggctgcaggggacgagactccagtggcactggagctgagtaaggttttcaccttggccagcaagcgtggtcagctcttcacgcccagccagcgagaggtgctggaggtcctggctctgcgcggcgtcctgcggtcgcagctcctcaccacagatgactccttccagttcaacaaggtcgtggctcgcctgaaagaggcggtggcggccctcccagaggagcctgcgacactgcctgagtcagagggagcgtccgagccaggcattgctgctctcctggaggcagatgcaaagggcgcggttattgcagccgaggtcctggagggcgtgaggagaagccacctgctggactgcctggaagccggcagggtcgtgtacaggtgggctggcgggaaggaccaggtgggaaacttgcgatccagaattgacgactcgtcaacgacagcgcaccttcctgtgctctcccaccactttggagctcaatgtcttgggcacaccaacagtccaccgcaattccaggacacccatccacctccccccccttgcaatcctcacaggctaccgtgggcccggacctccgtggatctgctggtggaccactttcgacagcacgtgcggtgcttcctacccgccgagcaggaccgcgtcgcggccatgatcgtgtttgtgaaggagcagcgtgcggcgaggcggcaggtgggtgagggtctggccgggggccgcgggtgctgggaccatgcgccgcatggcggtccctccatgcatcggcttgacctccctgcatcgtag

SEQ ID NO: 7352 - DNA, 351 bp, Chlorella protothecoides
atgccccctcgcagcttgaggaaacgccctgtgacgttggatgaggcacacgagtctggcgaggaggatgccgccccaaagctgagcgtggaggacacacgcctcctgcagaggcagcgccagcgccagacgtgcagttgtctcggcgccaactccatcgacgcttccatgctccaaggcacgcagggcgtggatgccgcggccctgttgcaggggcgcagggatgatgaggacagggagctggcgctggcgagcgctgcggcctcggccgcgccggaggaggggggcctgcacgccgccttcaagcgtgaacggcagcaggatgagggcgccgacaacccgcacatgtga

SEQ ID NO: 7353 - DNA, 450 bp, Chlorella protothecoides
gcggcgggccgacgtggcgccgccatcccggccatcacgctgctgtcggtggcggcggccaccgccgcgccgcgcgcgctgcgcgcgctggtgcacccgggggaggtcctggccggcctactcatgcagatcttcttcgccgctgtcggcgccagcggcgacgtggcggctgtggcggccgccggcccggccctgctcgcctggtccgcagtcagcgtcgccgcgcatgtggcgggggtcctgctgctggagcgcaccgcggggttcacccgcaaggagacggtgctggctagcaacgccaatgtgggcgggcccaccactgctgccgccatggccgcggccaagggctggccctccgcagtgctgccggcgctgctggtgggcatcttcggctatgccattgccaccttcattggtctgggcatggtggtggtgtacgcccgcatgtga

SEQ ID NO: 7354 - DNA, 2769 bp, Chlorella protothecoides
  modified_base (1913)..(1922): a, c, t, g, unknown or other
  modified_base (2148)..(2157): a, c, t, g, unknown or other
  modified_base (2678)..(2687): a, c, t, g, unknown or other
gtggcatgcgcgggcccggcagcccgagcggcggctccaccccgggcgccgcgtcccctgcgcggcgtggcgcgggcggagaggggcccgcggacgtccgccgcctcgcggcccagttggaggcctgccaggaggagtgcgagaggtgggtggggcctgggcgtgggggaaggggagagcctccactgcgcgcgtggatggtatccaggtgtggtgtcgtgctgtgctcaccctccatccaccaaaccgccgcctgtgaacaggaggggggccgccctcgcggagtgccaggatatggtggatgagctgcaggtgggatgctggctgggccctggcggtgcctgctgggtgtgggctcctgactgcctgcttgtgaggcccttggctgcaagggttgtgcatttgggccccactcccgaccccggggttcgcgcgccggcacaggcctttgcggagcagaagaaggccgaggcagcccagctggcagaggccctggaggtgcggatgacgtgtgcaacggtgatagtgggggggcggaggtgtccttcgagcatcccgcacgacctgcttgtcagctggcacgtcaggctcccttccctccccacgccagcgttccctccttttccctccctcactcccacggatgaccccccccggcacccccagggcgccaacgcgggccagcgcgagctgggctcccgcctgcgcgccagcgaagcgctgttggcggaggcccaggccgccgccgccgccgccgcgtcgcgggtggagcgcgcggagcgccgcgccgcggcgctgggcgaggagctggcggcgctgcgccagatgcacgacgcgctgcagtcggagcacacgggggcctgcggccagctggccgccacgcagacggggcacgagctcgccatgcgccagatcgccgacctggccgcgcagctggccaccgcgcgggccgaggcggtgaggcgtgccgggtcgtccgttcgttttctgtttgggagggaggggggggggaaagaggcgaccgcttgcgaggcgttgatcctcctccagccactcgatactcaaccccctcccgcccgtcacccctccccacgcccaggcgagcgcggccgcggaggccgcgcgggcgggcgagccgcgcgctcggccgtcgaggcaggacggggagctggccgactacctggtggcctccctgcgcacctccatctccgaggcgctgggcgccgccccgggcgaggcccgcgcccaggagctgggggcccggcccggggacaatgggcctgccgcgcgcggggggcgtctggaatcagacgaggcggcggcggccgaggcggccgcggaggccgagctgcggcggcggttcaccgcgatgcgcggggatccgccgccgggcgccggcgccggccggctgcagcacttcccctcaccgagcgtggatggcacgccgcgggcgccggggtccctgaccccggcctgcgaaaccccccactccgccatgagccaggagacatcctggtccgacacgggcagcgaccgacagtcgatggacgtgatgacttgggaggccaccgaccgtgcccatcctcaggtcaacctcaagacttatccttcgaccgccgcctcccttcctctcaccccctcgtcgcagtggtggagctggcgcccagcgccatgcagcgcaagaagtccaagggcgcgctgcacaagctggccaagatgctgcgtggcggcggccgctccaagaaggccaaggaggctgcggcggccgcggcggctgcgggccccacgctgcaccgcctgtccaacggccagaccgcgggcttcctgggcccccaggtggcggagtgggaggctcggcaggaggcggcggcggtggcggtcggggaccgggacggccaggacggcgcagagannnnnnnnnnaggctcggcaggaggcggcggcggtggcgggcggggaccgggttggccaggacggcgcagaggcggggcggggcgcccccccccaccgcctgtccacgctgcacgaggtggaggagggcgaggccagcaccccgcgccccctggcctggtaccggaacgacctctctgttcggcaggacgccgacccggtgacgggcgcaggcgagtcgcgggacgcctcgccgannnnnnnnnngtaccggaacgacctctcggtgcggcagggcgccagcccggcggagggcacaggcgagtcgcgggatgcctcgccggttcagccgccgacgcgcggtctggcgctgaagcgcgcgccgccgctgctgcacaccgacgcgccgctggtggaggaggcggagctgtcggcgcgcctgcaggcctggcacaagggccagggctggcaggcggcgccgctgggcgacagctggcagctggcggcggggcgggagtcggtggaggacctggcggaggagcgcgcgcagcgctacagcagcgtgcacagcaacgcgctgtacatccgggcagacccgggtcggtgacgtgcggggctctggcccgggcggggacgtggaagttgacacgatctggagcagtgatgagacgtgtgaccaattgccagacggcggggagggggggtttgcgatggagccaggcgactgatatgatcggtggggaaggaaggggccgaggagtgtgtggcgggagaaggagcagggacgnnnnnnnnnngaccaattgccagacggcggggaggggggggttgcgatggagccgggcgactgatgtgatcggtggggaagggaggggctga

SEQ ID NO: 7355 - DNA, 1743 bp, Chlorella protothecoides
  modified_base (850)..(859): a, c, t, g, unknown or other
  modified_base (1085)..(1110): a, c, t, g, unknown or other
  modified_base (1171)..(1180): a, c, t, g, unknown or other
atgggccggcctccagtcatgacacgcacctgccaccctggagctgaccctgaagaccgtagcccgccgtggcggccccctggaggccctgcaagccctgcatgttgttgggcaagccaccatagcctggcaacaccccctggccagcgtggaactgcgcgtagcgaccgtccatgccaggcccattcccgttgttgttcatcatcaaaggctggcaagggggaccgggatgtggggagggtacagcatccgatcgcgagaagagcacgatcagctcaagcacaacaacgtcgccccgacagttcgcatgacgggccctgcaatgctagccagcatgcacctccggtcccataccatgtcgatggccctaacatcctgcctcacctcatcccttcagcctcctctgatgctatcccaggccttcttggcgctcacaaggaagaatacagtctccaccagggctcacgaggggctgtcggtgtctcggactgggaactcgccagcctggaggaaagcagcaggctcggatacagggcgcgcaagctgagccaccgctggggcaagccagcaggtcccctctacgcgataatgaccgatcggggcgcccgtcgcagtccttacagttggccaagagcggcgcacgcacattcgatgggcgattcctgggaggattgggatgatgaggaggcggtgccggtagtgcccgtgcctggctccaccctggcggcagcagacatcaactccaagtttgcgggggaggacgaggaggaggaagcccccaagtggaaagccaatgtacccaagccacagctccatggtaatgcaatcaggggtggctcgataagcactnnnnnnnnnngcgaggatcggatcaaaaagggatctgaggagtctggttcctcacagctccatggcaatgcaatcaggggtggctcgataagcactgtgcaccgacccctccacccccgccaggccaaagccaagaagatgtccaagtatgacgagagcaagggactgaggagcgccgcggatgagggtcccctcgatgatcccattgcagaaaaactgcgcctgcagcgactggnnnnnnnnnnnnnnnnnnnnnnnnnnttgctctgcaatactactcctaatatactccctcaaacacgtttctgtgcagtgcgagacnnnnnnnnnngctctttggcacagggcacaggccagccccatttcctgctctacaatataactcctaatgtactgcctcaaacacgtttctgtgcagtgcgagacttggatggcttcgtgccaaagtctgccaaggattttgaagagtatgcggcctctattgttgccaagtacctgctcccacatgctagcaactctaactacaagacgctgctgaagcagctgttccggaaggcactcacccctctcactgccacagacaccaaggacgtggagacatctgtggctgatcttcattcatacttcggccaccgtctgaagggccagcgtgaagcttcctgctgccaggtgcctgcagttacccatcccagcaagctccaagacagacacttcacgcaattctgtcgatcaggtgtgcgctctgagaagctgaaggaggagaaggcggcaacagcggggaagaaggcgaccaagaagggatccctcaatgtggggcggagtggcggcacagctggcctggacgactatgtgtatgacgacgtgggtgtggatgaggactacgacttcatgtga

SEQ ID NO: 7356 - DNA, 450 bp, Chlorella protothecoides
atgcagatcgtgtggggtcatggctcagcaggggacgttcgggtgctgggcaacatcctcagcacacaaccagcatcggattcatctctggggctgaggaccgaggctcaacccctccctaccccgccacccccacctgcagtcacccgcttcaacctggagtgcttgggcctctgtccctgcctggtggacatcgagatcatggacacccggaacggaaatgaggtgcagcttgtgaccgcggggcacgctgcttgtgcctgcgactcgcccgcgcgcaaggtgggctggggggggtcaattgttgaaggctggtctcgcagtcggagggggaaggtctgcacagagatagcggcgcagcgtgcgctacatgacgtgccttctttcaaaggtgtaaatggcctcctcagggtacctgaggtccactggaagcgctctgcaaggcgctaa

SEQ ID NO: 7357 - DNA, 624 bp, Chlorella protothecoides
atggagatcatagacggcttccgcatcctgcgctccaagagtgaggaacgggccctgaggtcgactcgccctgtcatgcaaccctgttcatcttgcaccctcaatcatccaccgctccatctcaataaccctcacatcgaccccccggatcacgttgacacgctgcgcctgctgtgcacgctgacccaccacgtgatcgaggcgtgccgggcgcggcgcggcgcccccgccaccgcggggcctcccgcccctgacgtgctgcccacctggtcggagttcaagagccggcgcgaggcgctggggcggggctccatgagcctggccgacacctggcgcctgatgctggccagcgtccgcggcgcggggcacgaggctgtggccgccatggtccagcgccacgccacccccgccgccatgcacgccgccatgcgcgccgcacaggcggggggcggggcggcggccgcgcggcggctgctcgcccccttggcgccgaggcccggcagccgcgccgtgggcgagggctccgcggcccgtatctacgataccctctttgccctggaagaccaggcagctggggacggcgccgtgcttgcaaaggtggattggggcatgggctgcggctga

SEQ ID NO: 7358 - DNA, 786 bp, Chlorella protothecoides
atgtttgaatctcctgcccctcccctgggtcaaagcgcagtgtcccggggcgaggcggggcagggcaagcgcctgctggtcctggacggcgacacctggcgcgtcagggaggagatcccgctggacatcgggccgcgccacttctctgccagcgccttcccggatgcccagggcccggagagcgcggcagatctgcgcagtggcgacaggctccggctggtgctgaatgaggcacaggtcatcgatgggatggccgccatcgaggccctgcagcagcagggtgagtcgagttttatcctggacaagggctgcccaggctctgatgcgggaggcagagactggtcactacccatgcactggtttgtgaagggtctacaatccaccctcccaagcctgcctcgtcgcaggggtggaggtggagatcctggcgccggccccctccgcggctccggtcaggatccaggactcggaggacctgacccccccccagctctttgccgcatacgcaaagtccacggggatgccggccggcgtggaggctcgaggcctctccctgctgcaggtgtgttcagcgggtggtggactgcggtgacgtccaccgagggaatggagcgtgtattcggttcagtgggggttggcatgatgaatgtctcaaagcctgctgccagccctcccacctcccctgttcctgccccaggcgctcttgacgagccagggcagctcagctgcagccacggtgttgacctttgggcaggtcaccctgtcaggcttcctttcctttgctga

SEQ ID NO: 7359 - DNA, 567 bp, Chlorella protothecoides
atggacgaggacgagggcgtgccggggtcgcagcgctgccccgcaacccaccatcccggcccctgcgcctcgcagccggaggcgctgagtcagccgctggtggagcgcctggcggctgccctcgaccgcgccaggatgaacggggccgtcgcatcgctgcccgtccagcccggcgcgacgacctgcagaccgagcccaccgcctcccccggccggtgcctgcgttccagacgctgcccccccctccccacgggccccagcgccactccaggctgccgccacgctggcgggcgccccgccgccccgggcctcctcgccgccctgtgccgcgggcggctgcgtcgccgcctccgagcgcctgcccccccttcacccgggggccccgtttgaggctcagtacgacatcatcttcctgctggacgcccgcgaggtcttcacacgagccgccgaccagggccggtcagaggccctggcgcaacacctggctcgcctccgcgccatgggcctggtggtggaggagcggacgctgcccgcgggggacgggctctggatcgcgcgctccaagtga

SEQ ID NO: 7360 - DNA, 483 bp, Chlorella protothecoides
atgacccgagctgctgaggatgaggacgaggatgaggagggtgccgagtcaataccgggtggtgacccgtccacgaagcccaagctcctcccggcgctcacagcatttcagagtgtgtctgggcctcccgccttcctgaatcccgaggtaggcatgcgcggggaatctatccctgaggaggggcctcgctgggctcggtctcacctcctgtcctccctccctcaggccacgagacccgtggcggccccagcacgtcagccaaggcctgcacagccagattcaatcgcgtctggcaaagggaagggcggtggcaggggcgacggctcctgggacgtcagcaagatggcacccaagctcaaggaggaggcggcagcggcggggcctggcgtcatcaaggcatcagccgtgcagtatcgtgggggcgaggggcccacgcctgtctcggctgcagccatcgccctccttggaggtggggggtgttga

SEQ ID NO: 7361 - DNA, 249 bp, Chlorella protothecoides
atgacaggcggtgaaaagccggatcgtggcaagcccagcaaggccatgggtgtggaggaattcctggacaagggcgctggaggagcggtgctgcccaggaagaggggcgatgactggcggaacccaccccttgttccacacagacaggagcgcaaagacagggagaaggacaagcgcagcaagggccagagctcgcacgccgcctggaagtcggaggcggagatggtgctgcgccagcagtacgactga

SEQ ID NO: 7362 - DNA, 1605 bp, Chlorella protothecoides
atgtcttcctgcttgcatggtgcgctgtctggcccacactcgagcacccggctcagtaggagcatccggtatggagccatgcaacaatgtcgggcgccgcgcgcgggcgctatccccatcatgcactctcttcacaagccacaccgcttggcaaggccactgcatgcagtaggttcagatcagccggaggatgcagccgagtccactgccacagagcgggagctcctcatagaacaagtgagagtcatatcagattgccgagccaattggacttgcgtgcatcccttggaactgcatgccccaatgtgcaaggcattgtgctcagcgggatacttcccaagttctacccttcagatggtaaggaagaagggccccaagaagcaagccgggtccaatgagaccaggagctccagcagccagccagcgtccccacagcaggcccctccatctgcacccgcgtctgtcatcgaatcggtgctgctgaggctcctggtcggcatcttcaccgttgccatcctagagggcctggcactggcagcatctcaccgtccctggctcccattcgcaccttcaacccccctcacacagggcttcctgagctcagaggtggactccaccatttccaagtatgtctacccagccttcacgcccaccatcctggctttcctgggtggggtcaggcaaggagctcccgcaccctacattgtcagtgtgccaacaatcaggtttgcaagtcgctgttgcacggcatgccttgatggcatgtcaccacacgtgcagtgtcaaggggggttgagcgccagggcccgcacatacaggtcgccaggcgtcctgcccgcgacaaggctctcgccaaccaccctcctcctcatcatcgcacgttggcccctgcctccagctgcaccaccccggtgtcgcggcccaggtagtccagcgcgaccttggccaggcccagctcctggcgcagccaggagagcatggtgccggaccaggtgctgcccgggtcctctgccagccgctcctcaaagtagcgggccacccaccgagactccacctcccgctcgatcttcagcgcctggggaagggaaggagtgtaccggttctatgagagcaaagggagacaacgacactgccaggggctgggcccggtcacggccgccagcgtcaggcttcgtatccctgcctggagaacttgcagccggcggcgcattgaccatgacacgagcgagagtcagtcgccacagccccaaggcggaacagggcctccggggtgaaaggcgggccactggtcgccgcatcggtcgctgcaccatccgtcgccccgggcccggccccgcccgcgctcgccagcgccgccttgagctgccagtgtgccagcagatcgctgtagcgccggatcggggaggtgacctggacgtagccgggcaggccaaggcccgcgtggggcagcggccgctccacgcccatggcgctgcgcatcatgcgcgagcggagcagcgcgtcacgcgccagacccgccggcagcgccccgagttcttcctcgctgggcaggacgggggcgggctggccgcggtacggcagcgccacgcccagtcgcgggcctga

SEQ ID NO: 7363 - DNA, 1527 bp, Chlorella protothecoides
atgctggcgcagcagggtctccatgctgacgcgcatggcctccgcctcgcccagatggttcaggttggagctgtagaagggcgcgtgcatgttgaccaggagccagggcgtgcgggcgcggtccacggccgccaggtcggcggccagccactccgcctggtccgagtccgcgccgtggtcggtgtaggagccgagcatgaccacgtgggcgcccgccaggtcgtacgagtagtacagcggcgaacccgacccggaggcggcgtggggaaggtggaagcgggaggtgtaggccagccagctgggcacgcccgaggcgcgctcgcgctcgtgattgccctcggtgaacatccacacgctgcgcgacgtcagcggcgacaccatgcggttccagcatgccctcacaaaccagctcatccatacacgactcattctcccggctcaccaccgctcgtggtcgccgtcggcgtaagacaggtcgcccaccagcatgacagaggcggggccggaagccaccatgtgctccagcgtctccagcgagtcctcggtctgaccgaggtcgccgatcacgcccagcctgtggtgatgcatccgatacttgagattgcttggggttgggatgcgtggcaactgatgtgcaccaatgcactccaaacagggtggacaggcatggcgtggggactgcctcgaggaatttcttcacaggaggggacggttgcgcctcccccccgcttcccatacaccatcacacctgtacgacccgctcacgcggtaaaagatctcggtgctggctgggaggggacctggggattggcgtcaagggatgagtggtatgaaatggaggattgcatgtgcctggggacatgcaagaacattatgtcatgcctcgacctacgacctcctctgacaatgaggcacccgatccaactcaccgtccagcccaatgacgacctcgtggagcaccccagagtcgtagtccccaacagagtaacaggtggggactgcgcccctggcctggctggtgtacacccccgactcgagcccgtactgcacaatggaggtgccggggcacagccgcctccccagccgcgcatgccgcagctggatggggaggtggcggctcagtcggtgcaggatgctgtgcgagctggaggtctccgggccgggggtcacccagttcaccgcgaccgccccagggcccgccagggagatgtggatctgggaggcacggggcaaaggagtgactgtgatccaggtgaccgagtcacattagacataggatccaaaaggggctgcaatgaacatgctggcagccgacttgagcgcattaatgctcgcatcgcacatctttcattgtacccttacccttttcgaaaccaagaacgctgctcacctgctccggagctgaaggcccagccgaggggtgcctggccagacgagtgtgagttgcaggcaagtgccccttgggagctttccgcacaaaatgcagggagttggagaagtcgccctgtgaccccgcgcagagtgtga

SEQ ID NO: 7364 - DNA, 468 bp, Chlorella protothecoides
atggttgagaagaagctcccgatcatgcttgcgccacacaagaccgcgcagacggccgcacacaccgtcacggcgcaagtttgggagatcgtgcgacatgggctgatccgaccgtcttcatcgcccagggcgtcgccggtgctgctggtgggcacgaaggatgggtcgcagcgcatgtgcgtcgactaccgcgcgctgaaaaagcctgtccatcaggtcatcggcccgcggcggcgggtaccgattcttgatggtggccttgttgagcgcgaggtagtcgacgcacatgcgctgcgacccgtcctttttgtcgaccaggaggacgggcaacgaccaaaagtagggcaggagcctgaatggtgtcagggttacacccctctccaatggcactcttgtgctgtcaaggggtccctatatggcatatggagaatctggaggttcacctctccagtgtctgggggacgctga

SEQ ID NO: 7365 - DNA, 522 bp, Chlorella protothecoides
atggggtcagcatctttcgcgcggcaagcactgaccgtggtcctcgcgctggcctgcgtcacactctgcgcggggtcacagggcgacttctccaactccctgcattttgtgcggaaagctcccaaggggcacttgcctgcaactcacactcgtctggccaggcacccctcggctgggccttcagctccggagcagatccacatctccctggcgggccctggggcggtcgcggtgaactgggtgacccccggcccggagacctccagctcgcacagcatcctgcaccgactgagccgccacctccccatccagctgcggcatgcgcggctggggaggcggctgtgccccggcacctccattgtgcagtacgggctcgagtcgggggtgtacaccagccaggccaggggcgcagtccccacctgttactctgttggggactacgactctggggtgctccacgaggtcgtcattgggctggacggtgagttggatcgggtgcctcattgtcagaggaggtcgtag

SEQ ID NO: 7366 - DNA, 747 bp, Chlorella protothecoides
atgcatcaccacaggctgggcgtgatcggcgacctcggtcagaccgaggactcgctggagacgctggagcacatggtggcttccggccccgcctctgtcatgctggtgggcgacctgtcttacgccgacggcgaccacgagcggactcggtcatggcgtgtcatccgcatctcttcctccctcccacccaaagccctccccacgatcacactccatcccccctcccgcagggacacctggaaccgcatggtgtcgccgctgacgtcgcgcagcgtgtggatgttcaccgagggcaatcacgagcgcgagcgcgcctcgggcgtgcccagctggctggcctacacctcccgcttccaccttccccacgccgcctccgggtcgggttcgccgctgtactactcgtacgacctggcgggcgcccacgtggtcatgctcggctcctacaccgaccacggcgcggactcggaccaggcggagtggctggccgccgacctggcggccgtggaccgcgcccgcacgccctggctcctggtcaacatgcacgcgcccttctacagctccaacctgaaccatctgggcgaggcggaggccatgcgcgtcagcatggagaccctgctgcgccagcatgccgtggatgtggtcttcgcggggcatgtgcacgcgtacgagcgcagctaccacgtgtacgacggcgcgcccgacccctgcgcgcccatctacatgtgggttctggagaggagatgttga

SEQ ID NO: 7367 - DNA, 399 bp, Chlorella protothecoides
atggtcaatgcgccgccggctgcaagttctccaggcagggatacgaagcctgacgctggcggccgtgaccgggcccagcccctggcagtgtcgttgtctccctttgctctcatagaaccggcgctgaagatcgagcgggaggtggagtctcggtgggtggcccgctactttgaggagcggctggcagaggacccgggcagcacctggtccggcaccatgctctcctggctgcgccaggagctgggcctggccaaggtcgcgctggactacctgggcctggagatggtggtgcgggtcagccgccccgtcacgcccggcacgcgctttgcgctacgctgcaccaacgtggaccgcgacaccggggtggtgcagctggaggcaggggccaacgtgcgatga

SEQ ID NO: 7368 - DNA, 543 bp, Chlorella protothecoides
atgctgctggaatgcacgccggagcaggagccagacatgttccggctgcatgcgggacgctccgtcccccatccagtgatccctctgcactcattcgctctggaatggggtgacgctcagggtcacgaggccacagattctgatcggtgggagtcccgagcggtagccgacagcatgctgctcctgcaatcctcacaccccttacggaacccactccctggttcatccccacaggcgtcactcgcgcgcgtggcatggcgcacaagccagggcgccatccagttctccatgccggaggcctccatcggcctggccagcggccccgacgggcggcagcgtgtgaccatccaggacctgcagtcacgggagtcggcctcgcgcctgctggtggcggagatgatgatcgcggcgggggaggccgccgcactcctaggtgagcgcggtgggattggaggaggtggtgtccggcacagacttccgagcaccggcaagtgttccatgtggtgccacgcatgcacaccctcctcgctttcacccaactga

SEQ ID NO: 7369 - DNA, 1755 bp, Chlorella protothecoides
atggggtcgcactcccactttaatccccccgaggaggttccccaggcagagggggcctgggagtggttccgtggcatgggcagcccccagttctgggtggcgcctatggttgaccagtcggagctggccttccgcatgctgtgccggcgctacggctgcaccgccgcctacacccccatgcttcacgcccgcctgttcctggaggggcgcgcgtatcgcgcggagcacttcaccacctgcgacgccgaccgcccgctgctggcccagttctgcgccaacgatcccgacaccctgctccacgctgcgcggctggtggaggaccaggtggacgccgtggacctgaaccttgggtgcccgcagcgcatcgcgcggcgcgggcgctatggcgccttcctcatggacgacctgcccctggtggagtcgctggtgcgggcgctggcgggcggtctgacgcgcgcccgcgtcacggtcaagattcgacgcttcgacgaagtggggcgcacggtggcctacgccgccgcgctggagcgcgcgggggccagcctggtggcggtgcacgcgcgcacgcgggagcagaagacggcggccgccgtgcgcgccgactgggcgcacatcgccgcggtcaaggccgcgctgcgcgtgcccgtgctggccaacggcaacgtgcgcagcctggcggacgcgcgggcctgcatgcacgacaccggcgccgacggcgtgctcagcgcggagccgctgctggccgacccgggcctgttctggggccggcgcggcgagcccggcggcgacggcggccccaccgagggctgccgcctcctgctggagtacctggacctgtgcgacgcctaccccgcccccttccgcatggtcaaggcgcacgccttccgcatgctggggccctggctggccgagcacaccgacgtgcgcgacgagctcaaccgcgggcccgacctgtgcaacgagcgggtgcgggagctcaccatggagctggtggacaggatagaggagtgcgggcgcgacgcacccatccccaagatctccgccaaactcgggcacagcagtgtgatgagctgcctcattccaagcgctgctccatgggtcaggctatgcagtgttcagtgtatcctgcttgggctgcatgaggcgaggctggtgccaggtctggaccctgccattgagaggaaactcgcggccatggaggccgaggcagcgcgggcggctgccatagcggagcaggccagggaggcagaagggctcgcggaactcggggttcacatcagcaggagtgcaggcgtctccatatttggcacgtcgcgggccagtgctccctcagtaaacaacagcgccgctcggcactcacgccgccacggcctcctctgcgccatccagcccgacgtcgtccagcgagacctcaccctccaccacgcgggggttcaggtctatgagccgtgtggacagctgcgccagctcagcaatggctattcgtccccgggaggtgatggcttcggccacggcctccagctccccccgcgagatgtagatgaactgcgtatggggtggggcggcgtcggccgggggttccctgcacttaccacaggcccaagcacccctccctcatcacatcaggctcgcgtccccaccctcgccacgcaccttgccccggtcgtccatgatgccggtcagcttctgctcggcttccaggccctggaccttcttgatgacgtccgcgaccttcagcccaaactcggccgctag

SEQ ID NO: 7370 - DNA, 2691 bp, Chlorella protothecoides
  modified_base (1078)..(1087): a, c, t, g, unknown or other
  modified_base (1185)..(1194): a, c, t, g, unknown or other
  modified_base (2010)..(2019): a, c, t, g, unknown or other
  modified_base (2305)..(2314): a, c, t, g, unknown or other
atgctgggctggaggtgtgaaggggtgcatgctgcgccaaggcggcctccgtgtccagcacagctccattcgagatacacattgacacgcagctttgtatctcaaacccccatcacactcttcagggcaaaggcgggcgggaagcagtcgacccaggatgcgacgggcaaatttgccaagtctgccgggtcgaggctgcggcggtacaatgaggccgccctggcagaggacgtgaagagcgccctcacctcctggacggccttgctgggccagtgtgatctcatccatgtgcaagcgccggggtcaaactggaaggacctgatgacggctgcaccggcagtgctgagccccagcgaccccaggctgaggaccgtgcctttcaccacccggcggccgacgttctccgagaccaagcgtgtcgccaggatcctcatctcagtctatcgcatgcctgccaccggtcagcccagccagccttcagttgaggcgccggggggggaagcggtgcgaggaaagcagtccgaggctgggcctggatcgcagcccggtgcaccccgccctggagtgtcagctgaggtcatcagtgcagctgaccagggccctgcagaacctgaggcgcccaagggcctgtccaagaaacagaaggcaaaggcgcgggccgcgcgcagtaaagccgcagccaaggagcaggcagcgatggggggtgagtcccaagaagaggagcccgcgcccaaatcctccgagcctgttgcggacgagggtgacgtcctaagccgagcggcggccctggcagccgccaccgccagcgcagcgcgcaaggggggtgagattggcgacagctatgacatttctcaaggcctggttgatgccctgggattggcggccgccactccggcgcgaagcggccgacctgccacccaggcaaggagggccgatggtgggaagaaaggagggaaggtcagcgcagaggacattgcggctcggcgcgtgcggctggccgccgccgccgaggcacgcatggcggccctggcttccgcttcggctgcacagaagctgtgcactcctggtcagcctcttnnnnnnnnnncactgcccacgttcctttattcagtgtacttgccactgttggctcgtcgtggcactgagtgctcagccaatcaccaatcgccacctcgtcccattccnnnnnnnnnncggctctggcaggaggaggatggaggcctgataaggaatagaggaggatgggggcctgatgaggaatacttgctgacacaggttgaaatatccaatactgaggcagcttctttgtctttgtcatgctttgccaggagcactccataccttcctttcagaatcagcaggggaactgcccacattcctttattcagtgtacttgccagcgggaacctctgcgatgaagcactgcacggtcaccacagctggctactgtgcaacatacaagtcccagcacgccagctgcaccgccccggctgccgctcgatccaagagctccaggatgcgcaggcggaaggccacacaggggaagcacgactcggtgggcaggtcaaaggacagcgcactgccgcgctcggggaagcacagcccctccctttcgtccagcgtcacccattctattgtttgtgggacgtggtgggaaaacatctgaggcatgtgtccagcaaacctgcaccggctggccagcagtctcagcagaagccggctccctccccaccgctcggtttccagcctgaggccacagcctggttggcgttcaaacagccgccccgatacagaagtgacccctccatccacctgagctgccgggccgctggccctccagggcaacagccttggggtcccttgccggcgcatcgttcccggcggtcagcacgtagcgcgccacctccacgccagccttccctgccccaccccgcacacggtactcgagccaggggaccgcgccaggggcgccgcccccaaaatccagccacttggtggctgggtccccgnnnnnnnnnnccctcgcacccggtactcgagccaggggaccgcgccgagggcgccgcccccgaaatccagccacttggtggctgggtccccgtcaagcgcccgcacagcggcctccgcctcgccgttctgcccggaggccctgaccgcaccccccgtcagccggccggggaggcgggcggccaccccctcgtccccggccaggcgatatcgcaccaagggcggcccagctgcggctgggccctcgtctgcagcgccagctttgttccccccaccctcgccacgggacgccacccannnnnnnnnnctccccgactgccggcccggcaacctctggcgggtagggactgggtttgggtccctggccgcgtcagccgcgtccctggccgccagctctgcgagttggtcggccgagaggttttgagacagaggtcggggaagacagaaggacgaccatggacaggggcatgcatggaggctagctgggctctcgtcaagcagcttcccaacccagctgcctcccaggacccctggctgccactctctccggcccacctgcgtccacgagcactcggcgcgccttcatggcctcccagtcgcgcgcatacctgcaggacacatccaccacaccgttctcgtccacagcaatcacgtacgacagccgcttgccccagccagccttga

SEQ ID NO: 7371 - DNA, 708 bp, Chlorella protothecoides
atggcacaggacgcaggtctatcaggcccatgcatcgcatctccctggcctcccccagaccgaccggccggtgtgcgggtactgcgatggcaaagacaccacccgcctggcccggacggcggcgcccgattcgcgggaggcagcccacctggcttcggtcgtgggtgcgcgtactggggagggttgcctggctggccgcgaggctgcaaggctcttccttgcctgtccatgtgccgcgtgggatgggcgtggtggtctggaccacgccctgtggctcccagaggcctcatgcacgagagtcggacacccagcatcccagcactgaccctcctcagcctgccctccgcaccgacgccagaggtgtacacctgctcggcctgtggcgcggagacccgcttcccgcgctacaacgacccgctgaagctgctggagacgcgccgcgggcggtgtggggagtgggccaacgccttcgcgctgtgctgcgccgctgcaggcctccgcgcccgccaggccctggactggaccgaccacgtgtgggcggaggtgttcctgccgctgcgggcgggggaggcgccggggcgctgggtgcacgccgacccctgcgaggccgccatggacaccccgctcctctacgaggtggaaaaggggaaaggggaggaagggggacggcttttgagctggacggcggtgcagcatggccgggtctga

SEQ ID NO: 7372 - DNA, 1833 bp, Chlorella protothecoides
atgacaatcaagagtgtgagcaggggtatgggaggtcgccaggggccctgtctcctgcagcggactctcaacgcgtcttggtggcaccgttcatctgtgacccaccccctggcactgctgactgcagatgagctcgactctgaggcccgtgacgaggacaccaagattgcacaggctgccgaggacgacctgggccttgggcaggtacgacgtgttgcgaccctggctgttgaggcctttttggcggcggatctcaccacaactcgagggcgttcacggggtgggtctacagggagcactcacgggagacccatcccccacccctcatccactcgctcacgcgcttgcgctttcctccagggcgccaccctgctggccaccgagcccagcgtgatggaggaggagcaggtcgtgctctcccccgggtcctccatctcgggcctccccgcccgcggcgaggcggaggacggcacggatgacgcggccagcgttggcactggccccgccagcccccgtggcgcctccagactccgcgagtcggtgctgcgcgccgacgagccgggcggcgacctgtccggcgaggcggccgagctggaggctgagcgcgcggacacgcaggcgcaagccggctcgctgcaggacgcggaggaggtccctcccccggaggcgggcgcggaggtggatgtgcaggggagcagcagggcgggcgaggggtcgcgctccggggagcctgccccgagggctgatgcggggggtggggacggtgccaggcgcgaggctggaggggtcaccacggcagggcccagcgctgaagaggcagatgctgcgtcatctggggccgacggggccgcgccgccagccacgcccggccccgctccagcgcccgccgccgccctcaccgaggatgactcatcccccagcagcgaggccagccacgagtatgcggccaacgagtctgcgatagtgcgactgaagcacagcctgcaggcagagcccagcgcggacagccccgccaccctggcggagcagggccgcgcgatgctgtcgctgacgacggccggcggcgccccggccccggcggctgcggctgcgtcgcaggggccgggcaacgaggccgaggccgaggaggaagaggagatcgaggacctgaccatctaccgcagcggggagagcgccggcggtgtgccacagcacggagaggcgggtggggtcccctcaaccagcgcccctcccaaggtcgaggcggcgtccttctccatggaggccgggcccgacagcggcgccgcggccgcgcccgccccgccgtcgcccgtggtgctgcccgaggagttcaatcccgcctgggaggagaccttccgtggcctggtgtacgccgacggcgtggactcgctgggccgccccgtggtggtgctggacgcagaccgcgtgccggcgggcatgaagtcctcggccgcacgctatgtcaccgcacacctcgcgcgactggtggagggcggggactacgtgctggtgctgaccgcgcgccgcgcgacgctgcccagcatgtggatcatgggcgcctacaccacgctgccgcgccccttccgcaagaacgtcaaggtcatcgtgctggtccgccccgcgggcttccttcgcgccgtcctggccctgctccggcccctgctgtcggccaaggcggcgcgcaagctgcgccaggtggcctccctggcccagatcggggaggccacggggggggaggtgggtgtcgagcacctgggcgccgccttcctggccagcgatgccgcgcgggaggagctgggggagctggccgctgccgcgcggggcgaggcgtga

SEQ ID NO: 7373 - DNA, 759 bp, Chlorella protothecoides
atgcccctgcttccgcagcccctgcttcattcccagcatccccacgctccatccctccttcccccactgacccaccatcaccgctccatctgcagtggtgtgcaactacgacgggcgcgagctgcccaaggttctgggcgagcgctccatggaccgcgtgctgctggacgccccctgctccggcaccggggtcatctcaaaagaccccacggtcaagtcctccaagaaccaggccgagatctggaagtgcgccttcctgcagaagcagctcctcctcgcggccatcgacctggcggacgcggggtccaagacaggtggctacgtggtctactccacctgctccatgatggtggaggagaacgagaacgtgatcaattacgctttgaagaagcgcaacgtcaagggttgttggggctggctagagaaggggcgcttgccagtcgcccggtgcctgcaggcccagagcagcctgcctcgcacgagggcacagcagtggtgcccaccggcctcgagtttggacggcccggcttcgtcaagtatcgggagtttcggttccacccctccctgtccaacgcccgccgcttctacccccatgcgcacaatctggatggtgaggctggggcatgcctccctgattaccttgagaatggatgggctgggatggtaggctcacactggctcatgcagggcctgactggcaaggggggccatgctggaggcagcttggatgctgcctcctggccaccaccgccaagataa

SEQ ID NO: 7374 - DNA, 780 bp, Chlorella protothecoides
atggcggggcactacatgctgcagggcgcctcctcctttcttcccgtcatggccttggccccgcaggagggcgagcgcattgttgacgtcgctgccgcacctggtgaggagggacagcaggagtggtgctgctgtgctggccggggttacaaactcatggaggacgtattctttgcctcaagggagcagaccacctctccttgtctgctcctcgcccctgcttgctgcaaaattgggagattttcgctacggcagatggacgcagtccgcctgatgccaccggctgttctcctcccaaagagcgacctcaccgagccgaccctctgcgcgagcgaggggtcaacccctgcggtcgtggcgtgggaaggggaagaggcaccccggtgcctcttccctctccccgcccctccagacccctcacttgtgtttgggacggccacatctcgactttattctccgcattgcatgcatcttggcccttccctgttgttgccccctagcgtgtttcccaattgccccatcttccacgggaccccctttcatactgcccccacccccctctccctgctgctgacctcaacccccggaccccccttgcccaggcggcaagaccacgtacatcagcgccctgctgcggaacacaggcatggtctttgccaacgagatcaacaaggaccgcctcaagtccctgaccgccaacctgcagcgcatgggcgtcctcaacacaggtgcggcgtggcggctgtgctgctcgcgaaagagcctcccctctccctgtag

SEQ ID NO: 7375 - DNA, 1356 bp, Chlorella protothecoides
  modified_base (1063)..(1072): a, c, t, g, unknown or other
atgagcattggacgagagggacgcttgtaccgcaggaacaatgttcaccagaacccctatcattcgtgcgtgctcaaacccatgcccccacccctcaaccccctttacccccccacacatccactcaggtatgtgtacgacgtgtggcaagacatcaaggagatccggcagaaggtggtgcgcaacggcgtcgagaccgtgctctccattggctcggaggacaagcgctacaacatctacccccaccgcgaccgctggggctgctggagctccagcctggacggtggcggcgcaggccccacgctgcagggcgcggaggtggacagcgtgcccctcaagggcgcggcgcagagtacgctgcgcgcgctggggcaggagcagggcgcgaagctggtgcacggggagcgtgagcgcctgatcaaggccctcacctttgtgctccccgacctggccgagtcgcggtgggcgtaccgcggcaaggcccgcctggccggcgccgaggccgatctgtacgtctgggcaatgcacgaggagagcatggccatggagtaccgcatgtacgtcgaccccgccacctcggcgcccctccagctgcaccagctgggcaccaacctgctcaccggcgggcacaaggacgagtacgtgctggattattatgattatgcccccggcgccgtcgccgacgccgacttcaacctgcccgccgactcccactgcgacacgcccgactttgccgtcgcgcccaacggcggcgacctggcggcgcgctgggcggcccacctcccctcccagcactggggcgagccggcctacgacgcctttgcccaccgccacggccgccgccacgcacacgccgaggagtacgctgcgcgcgccgccgagttctccgccaaccgcgcgttcgtcgcgcgctggaacgcagaccccaaccgcacgcacgacgtggcgctcaaccgctttgcggactggtcgcgcgcggagtacgaggccgtggtcctgccgcgcgctacggcgggcgccgccccgcgcacactgttcagccaggcgcccggggtcgcgcgcnnnnnnnnnngcagcgggcgcggccccgcgcacgctgttcagccaggcgcccggggtcgcgcgccacgtgcccaccacccccgcacacatggtcccggcctcgctgtcctgggtgggcacaccggccgactccccggtcaaggaccaggcggcctgcggctcctgctggaccttcagcaccgtggcgcccttcgaggcggcgctgttccgcgagacgggggtgcagaccctgctctccgagcagaacctcctggactgcaactggatggagaccaaccacggctgctttggtga

SEQ ID NO: 7376 - DNA, 654 bp, Chlorella protothecoides
atgcagaaggcttccttggaggtcttgtgcgtgaccttgcagccctggatgtgtgtggagggcagggacgagtgggtggctgctcacttgaacatgagcaccggccccataggcctagaactgaacatacctcttcaacccccgacacatcctttcaccctttcttaccttgcgctccgaccgccaggcgggcagcaagtggccgccatggactggatctttgccaacggcgggctggccgcgcaagcggactacccctatgtgggcgtgaacgactggtgcaagaaggacgtgcccaagaaggccttcacgggcaaggcggtgctggtggaggggggcgaggaggctctgaaggaggcgctctacacccagggcccgctcaccgtgtcggtggacgcctcggccgactctttccgcttctactccggcggtgtgtaccgcaacgaggactgcaagaccaaggccgctgacctggaccatgccgtcatcttgagcgggtacgggaccaccgaggagggcgtggactactggctgatcaagaacatgtggagcacctactggggtgagcaggggtacatgaagatcccacgccaccccaacgactgcggcatcgccgccgagcccgtctacgtggacctcaaggtcgagggctga

SEQ ID NO: 7377 - DNA, 2703 bp, Chlorella protothecoides
  modified_base (71)..(80): a, c, t, g, unknown or other
  modified_base (276)..(285): a, c, t, g, unknown or other
  modified_base (578)..(587): a, c, t, g, unknown or other
  modified_base (1556)..(1565): a, c, t, g, unknown or other
  modified_base (1940)..(1949): a, c, t, g, unknown or other
  modified_base (2031)..(2040): a, c, t, g, unknown or other
atgcccttgtgggggtgcgcattgaagagaggcaggacaggttgccttcccgccaacccgggagtcttgcnnnnnnnnnnccgaaaggatgcccttgtgggggtgcgcactgaagagaggcaggaccagttgccttcccgccaacccgggagtcttgcgccttcgtgcccactacgacacgaccgctgggcctcggtgggccctctattcatccagctcgtcccctcgtcgcagccaccggcgggccatcgaggcgaaggagctcgacaccgcatnnnnnnnnnnccggtaggccctctattcatccagctcgtgccctcgtcgcagccatcggcggaccatcgaggcgaaggagctcgacaccgcatcgccatggagtctctgagtcgggaagatgtcgagaggtacgtccaggggcaggccatgcaggagcgctcacgcaacggtgcttggcgtggggcagcaatgcaatctctcacgccctcaatgcaggctcatgttcttcgatcagactcgcgaggctgcggagcgggagcacaaggccaaccccaaggacgccctggtcttgaccaagtggnnnnnnnnnntacgccactttctcaaggcaattccagtgtttatgcaccgaactttgcccatgtgcaggtcttgaccaagtggggcggtgccctgctcgagctggcgcacttccgccagggctccgacgcctactccatgatcgaggaggcgatcgagaagtttcaaaaggccctgggcctcgacgccgggcggcacgacgccctgtggtgcctggggaacgcctacaccagccagggcttcctctcgcccgatgcggcggcggccaacgccttcttcgcccaggccaacgaatcgttccgcaaggccgtggacgcgcagcccgccaacgagtcctacaaacgggccctggagatgacctccaaggcacccgcgctctacctggagctccagcgacagctggcggccgcggggcacagcacggggggcgagagcgccagcacatctgccgggcccgggaccgtgcagaagtcgtcgtctttgggatacaagggctgccctgttgttgccattgcggagctgtctgaggccagcacagacggttcacattgccaactcactccatgggcatcgcctgcctccttttctttcccagaagcaggtaggcggcatcagcgacttctggtacgacgtcgccggctgggtgaccctggtcgccctaggtgccttgcctgtcctgccttcatccagacacctgcccgccgtctctgccctgcgctccttgctagctggggcttggctgcttgtgtggtattgccggcccctgcatggccgcaggcacacccgctgacgatatttcctgtacaccccacttgcacgagatcaagctttgcacgcacatccgtcacgatcaaggtctcaggttctcgtgatgggctggatgcccaaagactatcattacgatcaggtagtatcagcatgcacatggatgcgctttgggaattccaaactctgctctcgcttgcctccatcaaccaggnnnnnnnnnnctcaggtagtatcagcacgcgcatggatgcgctgtgggaatcccaagctctgctctcgcttgcctccatcaaccaggagcgtcagccatgcagcctgtccaaacctcgaagcgtatgcacgtactcaaactgcagtgcctgctcgtctcgtcaccgcagcgaccgtgggtctgggagcttgacgccgagcagggccgccaggtttgaccccgggccggccgtgccctcctgcattcccaccgaggccagcaggttgcgcaccagctcagcatccaggtctggggcggccaggggggcggtggcggggccacccgcctccccgcccggtccgccggcatcggcctctgccggcgcggcgctggccgccagctcagnnnnnnnnnnggcagaccgcagctcggcgaggaaggcgtgggcccccagctctggcgcactgggcccaggactggccccttcctggcgccgnnnnnnnnnnagggggcggtggcggggccgcccgcctccccgcccgatccgccaggatcgcccgctgccggcgcggcgctggccgccagctcagcctgcagcgccgcatcatacgccccctcgaagtcgtcgctgtcggtgtcggtgtcgacggcgtgcgcgccccagcccgctgggccctggtccccctcgcactcatcgctggcagagccctcgtagaaggaggacgcctccgaggaggatgtcgaacgtccctggccggcgcccgtgccggcctccatccccagagcagaccgcagctctgcgaggaaggcgtgggcccccagctcgggcgcacggggcccaggactggccccttcctggcgccggggcggggtcagcttgtcgcgaggagcctggcgcagggatgatgtttggggaatcaatgtgtgaccagggcctagcagcggcattgcctgctggcctgttcggttctgcggcgacggtttggagaagtcaacccaattccaggccctggctcctccacctgcgagctctgcctggcgagcggcgaggcgagcctccagctctgcctccccggccttcagccaggtcaaggaaccctcggagggcagctcagtgtttgcctgggaggacggttcggggtcctcctccagcttctggtgctgtgtga

SEQ ID NO: 7378 - DNA, 2097 bp, Chlorella protothecoides
  modified_base (107)..(116): a, c, t, g, unknown or other
  modified_base (1967)..(1976): a, c, t, g, unknown or other
atgtgggatccaagcctggaggagggcacttactctgggtatcctgtttgggcagaggcgggtgtgtttgtgggcccgagtcctcagatctccccttcaggatctgnnnnnnnnnncacaaggacttttgaagaggcgggtgtgtttgttggcccaagtcctcagatctccccttcaggatgcagcactggcgcccacacagcgggcgcgcagcgctgtatccagggcgcggacgtagctcatgcatggctatatggagatcgtaaggggacagtcccatcaaaaagtgacaggatatcggatgatgagctgaataacaagatactccagctgcaatggatctgcggcgtgcgctgggcctcgactcggtggcaccggaggagaacacagtccactacgagctcttcccacacacaggcacgcctcacgcctttgatgtgcgcggatcagtcgtctatagcctcctacctcatagtaacttcaatagcatctaaagctcccctttcgtgcacagatgtggacgctccccagctgagagctctgaagacctcctgcctggagtccctcctcccctggctctcccagcacatctggcagcggggccgcttcgacatccagtcctccgccgagcgagcggttccgtggcgccagaagaaccaaagaaagggatcgaaatccaccccagctctcgatcctccccggctcagtctctggggttcagtgtgctttgctgacaatgtggaggacgagtggtgtgtggtttggctgctgacgcagctcacacaatccttccctctggacgtgagggttgatgtggtgaaccgtgttcacacgcaccggctcagcatggctggacaatgtcgctgcaacgcagtctccaacctgccaaaccacagggtgtgggataatgacggcgagttcctgctgatcgaggcggcgcacagtctgccacgaggactcaagccggagatcgcagataacagactttggctctcctgtgccttcaagtcccggatcatttctcgctgtccgaatcacgaccccttacctcactcacgccagctttggccctcctgtgccttcaaatcccggatcatttctcgatgccctacccacgacaccttacctcacccacgccaggtgtggatcagcgggggcaggttccacatcgtgccgacccacctcctccccggcagcataaatctggaacagggtctgcaggccctgcactcaccctcggtgcccacagcggcgcctgccggcgtggctgccgcgcttgaacagcgcctggacgcctttccacgtttcctcgccgtccagcgtcacgtcgcacatgctgtgctccctctcgcagcggtgcgtctcctccaaaccgccccccagctcctccccgccgcagtcgaggccttctactaccgcgatctggacgatgccaaggtgggagggcctggatcatgggtgatgatgtcctccagcccagaccccagccgttctctccctgccttgcaggcggcggggcgcccggtgcacttcccgcccagggacctacggaccaccgccgtcaccttcagcaggtgcttgtatgcccagctggccctccaggagttccctgggatggcagggtttgaggttccgctgccctccgaccccaaggtgcacagtctgatgacgctgtcaggccctgacggctgttctcactcaattatcaaaccgccatgcctcaccactgtgtgccctcccccccttccccagtttcctgcagcgagccttggcgccaagctggcagcagggctggagatgctcgtggcccagcgtgctcagcatgctaatgatgctagcatgtctgacaccggctgctcactggtggcgacatgggacgactcctcaccagcaggctaccttgctgtcaacgagagaccccggactggcggcgtatgcgctcacacagcatcagaagctggaggatnnnnnnnnnnagcaggctaccttgctgtcaacgaggtgaggaggtgcagatcgatgtgggatattcttggacgagcaccactcaaagcctgcactacccttcccatgatgcctgtggagcctcagtgctga

SEQ ID NO: 7379 - DNA, 681 bp, Chlorella protothecoides
  modified_base (420)..(429): a, c, t, g, unknown or other
  modified_base (666)..(675): a, c, t, g, unknown or other
atgacccgcatcatgctgaccgtcgttatctccctggtctacggcgccacctacttcggccagggccgcatcccgactgacggctcgctgaacgtggcacgcgtgcaaaacgtgtcggggctcatcttctccatgtccatgttcctgggcatgttcaactgcatgtccatcatgcccttcatctccgccgagcgcaccgtgttctaccgggagcgggccgccgccatgtatgcgcctgggccctacacgctggccacctccattgctgagatcccctacctcctcatccagaccgtcatcatggcggccatctcctactggatggggggcttcgaccctgtggcctggaagttcttctacttcctgctcatatttgggctcagcctggtgggtggggagagggaagtggggaggggtgtnnnnnnnnnnggcctggaagttcttctacttcctgctcatgtttgggctcagcctggtgggtgggaagagggaagtggggagggggtgcaggggggaagagataggggatcatacagggctgagcagggaaatgggtggtctgagggtacaggaacggccttgatcgatgccggggaggctcatcgcatgccctggggcttggacagggggcgtggcagccacgaagtggcatggcagcgtgctttnnnnnnnnnnagatag

SEQ ID NO: 7380 - DNA, 369 bp, Chlorella protothecoides
atgacccgcagagcgacacaggtccctttcacagagaagctcaaggtggtgaagatccagggtgatggtcgatgcatgttccgagccatcgggctggccaggaacaagggcatcttcctaggacctgaagtggaggtccaggaagcagaccagctgcggggtgctgtgaccgaaggcctgtgtcgctccaagaagcgccgggcggacttcaaggaggcgctcgtttccatccagaccgaggacagccttgacaagtgcgcgaggatcgcgtgggatgggagggaagcttgggatgacgggtgggcgtctggcaagcttgaaagtccacgatatatgacaatgcaatcgtgttgtgactgtctgagctga

SEQ ID NO: 7381 - DNA, 381 bp, Chlorella protothecoides
atggccgcgtcgacagcggtggacagggatgacacggggatggcgggaccaggagcggacagcggcgctgccacctcgtcagcaggcacccaccctcgccccgggtcgaccgaccccgctcgcctgctcttcatggcgcgccggctggagcgcacgctgctgtcctacgagcgctgcggctgggctgacgacctgcccacgcgggtgctgacgcggcaggagctgcgccccgcggcggagcaagggcccatcctgctctgcctggatacctcggggtccatgcagggcgaaccggaaagcgtggccaaggccctggcgctggaggccacgcgcgccgcgctgcgccagcgccgccgctgcctcctttacgccttcaggtga

SEQ ID NO: 7382 - DNA, 552 bp, Chlorella protothecoides
atggcggatcaggagcgcagagtgttcctcactgtgggcaccacccgcttcgacgcactggtggaggcagtggacagcacggccgtcgcggccgtgctgcgccggcgcgggtacacccacctgaccatgcagatcggggccgcggccttccagggctcgcgcctgctgccggcgggcacgacgcgcggcgtccttcccgacggcctcgtcgtggagtggtttgactacagcccatccctggccgcgcatgtcgccggcgcggcgctggtggtcagtcatgccggggcgggcagtgtgttcgaggccctggtagcgggggtgcccgtcgtcgccgtgcccaacccgcagctcatggacgaccaccaggcggaacttgccaggaagttggaaggcgcgggcgtgctggtggcggcgacgctgggcaccctggagcatgtgctggccaccgcggacttccaggggctcgaatcttacgtcccgggcgaccccgggggcatggtggcggccgtggactggctcatgggagtggggagcgcggctgggaagaagtag

SEQ ID NO: 7383 - DNA, 1158 bp, Chlorella protothecoides
atgcgatcggtgtgcgattgcaggtgccaagtgcgagcaccggcccaaggtcgtgaacaggcatgcacgccggtgtcgcgccacgcaggcggtgccgcgacacacatccgaccgatcggtcgtagtccagggcttgcatcgttcctcacaggggctgtagcggcgggcatccttgccgtggcaccccccagccaggccgtcgcgccattcctccagtcgcaaggcgggcagggcccgctggtggaggaggaggcccgcctctttcgcatgcgcgagcagtacgagggcgaggcggcggagagcctggccaaggcgcgcagcgcactggaggaggagacgcgcacgcagcagcgctcctcctccctcctctgcgccacgccctttggcgtggacgtggtgggcatcaccgaggcggtggccatcacaggcgcgctggtgggcggcgtctccgcgcggcggcgtaagctggagctcgagaagctgaacgagcgcctgcgcaccatcaaccaacagctgcggcagcaggcgcgagcgggggtaatgtatgcgccggggctcacctatgccccccccgccggcggccggaccgacaacggggcgggggctgcgcagggggccgtggcgctgcccggcgcgagcaacttgaccctggtgccccccatgcccgtgcccatgccgggcacggcggagggggcggacccgccgggtgactggggcggggtgtcgggcggcgggggaagccccgccctgggtggcatgggcctctccgtcctgtccatggacgacgaggaggggcccagccccgagtcggcactgaaggagggcaagcgcctgctcaaaaacgggtcggccggcgctgccatggtgcgcttcgagaaggcgcacatgctggcgcgcagcctgggcgaccgcgtgaaggagaggcgcgcggtgcgtggcctggcggcggcctcgcgcctggcgggccagccgcggcaagccgtcaagcacctcctgcgggtgctggagatctcgcgcgacatgggcgactttgtgggcgacgccgacgcctacggcaccatcgccgacatctacaccgacattggcgagttcgagcacgcggccgagtactacgacaagtacatcgcgcgcatggacaacaccggcagccctgtgtga

SEQ ID NO: 7384 - DNA, 444 bp, Chlorella protothecoides
atgcaaccacttcctgccacgcagtccctggagggtcagattatagaatacatccagacgcggaagacggtggagcttgacgcgctagcggccgagtttgggctgaaggtcgcggacgtcatcaagaaggtccagggcctggaagccgagcagaagctgaccggcatcatggacgaccggggcaaggtgcgtggcgagggtggggacgcgagcctgatggaacccccggccgacgccgccccaccccatacgcagttcatctacatctcgcggggggagctggaggccgtggccgaagccatcacctcccggggacgaatagccattgctgagctggcgcagctgtccacacggctcatagacctgaacccccgcgtggtggagggtgaggtctcgctggacgacgtcgggctggatggcgcagaggaggccgtggcggcgtga

SEQ ID NO: 7385 - DNA, 918 bp, Chlorella protothecoides
atggcccggacaaaggaggttaagaaggcggcgaccaaaaatgcagtgtctggtggcaagaggtgcgtggtgtgcgaagtcgtggcgcagcatgccttctgcatggcggtcaccgtgctgacacttttgccgagcttccccctcaacaggtctgccccccctcccaaacttccaaccccggatgtcagcgaggacgacgatcccagcgagagcgagctgaacgacaagatggagctgttcagcgacatggagggctccgatgcctccagcgtcctcgacgacgagttcgacggcgaggcctctgccagcggtgacgaggccagcggcgacagggctggcgaggggtctgaggaggaggaggaggacgatgacgaggccaccagcgcctccggctccgaaggttccgactacgacgagtccgggggctccgacgccgacggggacatggagcgcgcctcggcgcgcctggaccgcgccgccgccggccgccgcgcggccgccgaggcggagactgccgagctggcgggcgagggcggcgccggcgaggggctggtgctgcccgatgaggcggcgcgcgccgaggaggccattcacccagacctgccgggcgtgcgccgccgcatcaaggacatcgtgcgcacgctggatgcttttgccgcgcggcgcgacggggtgcacacccgggccgagtacacggaccagctcaagcgggacctcgtcacctactactcctacaacgacttcatgatcgacgcgctgttcaacctgttttcggccagcgaggccgtggagctcatcgagtcctgcgagcagtggcccgacgcagcggctggacagtcttcagaggctgtgcttgcagtgcccagtgtcgatgcgcacgggcagctgctcgccgtgccccggcatcacgttgcctga

SEQ ID NO: 7386 - DNA, 423 bp, Chlorella protothecoides
atgcgccggcaagggaccccaaggctgttgccctggagggccagcggcccggcagctcaggtggatggaggggtcacttctgtatcggggcggctgtttgaacgccaaccaggctgtggcctcaggctggaaaccgagcggtggggagggagccggcttctgctgagactgctggccagccggtttgctggacacatgcctcagatgttttcccaccacgtcccacaaacaatagaatgggtgacgctggacgaaagggaggggctgtgcttccccgagcgcggcagtgcgctgtcctttgacctgcccaccgagtcgtgcttcccctgtgtggccttccgcctgcgcatcctggagctcttggatcgagcggcagccggggcggtgcagctggcgtgctgggacttgtatgttgcacagtag

SEQ ID NO: 7387 - DNA, 753 bp, Chlorella protothecoides
atggcggtggcgattgccacagtgttcgaccttccggagaagacttttgcgcggtgcactcccctcgatgcggggccctccacgggagtccagctcactctggagaggctggaggcattggagatagcagatcgccgaacagatgccgacgcctccggcctgacctgcacctcctgtggcctgggcagggcacaggagccggccttcccatctgtggagtcccagcgggagcacttcagaggggactggcaccgcttcaacctgaagcgccgcctggcgtcccttcccgcctgctccgaggccgatttcgaggccctggtggcacagagggacggcgccgaggtgggcagcttgtccggcagcgagagcagtgacgacgaagatcacaatggcggcggggagggcaaggcaccagacagggcggacggagggcccagcgcctccacgtctggagcgcgcgggccctacacctgcttctgggacccgggggaggaagagacgctcggtgtctggcgcagcattgtgggcggggccagggatgcggcccccagcgaggaggcggcctggagcacgctgcgcacgctgcggacaaagggcgccacctgggcagtcatcatgctgcgaggcgggcactttgcggcctcggtgctcaggctggtccccgctcgcatcgccgacaagcggattgcggacaagtttgacgtcgtgggcaacacctcggctcaccgctacgtcacaaggtgggtgctctga

SEQ ID NO: 7388 - DNA, 630 bp, Chlorella protothecoides
atgcctgctcatgtctgcgctccccatacctcgtcccgtgctcctcaaccccccctcttatcaaaggcgtttgaggacctggagcccttgatggacagtgaggaaggcttcacgcccgagggcgccgtctggcagaagtctgggtggcgcgaggtcgccgagctctcgcggcgtctggccaggctgcggccgctgcagcgcctcattgcggagctgggaagggggggcggcatgggtgccatgcgccgagctccggcccaggcatgtgttgggggagaaaggaaggccaggaacgaatggaggtgtcttccgtatgtttccagacctggaagctcgcgccggtctgaagaatgcgccacatcttgctccggtgccactgccgctcatgggcgagtgccccgccctcctcacccccttcccccacaccgctcacccccagatctatgcgccccgctccccgctgggggtggtggagagcgaggcctcgccctcccagacaaagggcctgacccggtccggggagctgtcacgcaccctgccctccgagctccacctgctggccaggggcggcgcactggggcgcggtgggaaggatggcatggccgcgtcgacaccggtgggcagggatga

SEQ ID NO: 7389 - DNA, 303 bp, Chlorella protothecoides
atgacggtcaaccctgccccaccgccagtagacgcgctgctccttgatttggacgacaccctctacgatgttcctgccatgaaggcccaggtcgcggccaacatccaggcctacatggtcaagtacctgggtgtacctcaggaagaagtgtacgatctctgcttcaagtgcgtgggctggggctacaaaatagatgcagaccactggcatgcggaggtccaccacagcctcccatacgagcagtacctgcggcgggacgcgaagctgcgctccatgctgcagcgcattccccttccgaagtga

SEQ ID NO: 7390 - DNA, 504 bp, Chlorella protothecoides
atgaaaaacctctcccccaggtacattttcaccaacgccgaccgcaagcatgcccgcatttgcctggacctgctgggcgtcgccgactgcttccggggcgtggtcgcgttcgaggacggcgtggtcgcgtttgaggacgtgcaggcggccgccgcggcgcgaggctgggcgcgacacggccgccccgtggtctgcaagcccgagcaccaggcctacctgctggcgctggaggccacaggccttcaccccgcgcgcaccgcctggttcgacgacagcacgcgcaacgtggcggcggggaagcggctgggcatgttcaccgtgctggtggggcggatcggggtggagggcgcgggggcggacgtgcagctggcgtccatacacgacatgcccgctgcgctgccatggctcttcgaggatggtgaggagcgggggccgggccggggggcggcggaggcggagccgtccgagccctgctgcacggcacccgccctggccgccgcttga

SEQ ID NO: 7391 - DNA, 1347 bp, Chlorella protothecoides
  modified_base (504)..(513): a, c, t, g, unknown or other
  modified_base (975)..(984): a, c, t, g, unknown or other
ccgactggcggcggcacccccgccggtcccgcgaccgctgtgccctcgctggacgcggggcgcgcggcggccgcggcgccagagcgcggcggctgggacccagccacgctgacctgggtgtcggcggtgttcccggtgcagcccggggttgcggaggtgcaggccttccgcctgccacgccccgtgctctgcgttggcgggtgcgtcaccgtggagctgctgggcaagacgcagcgtcaggaggaggacgggctgctgtacggtgcggcgccgggagtgggagtacattttcggtggggggttgggggaggaggaagaaagggtggatgggacagctctggaggggggcagagtgcgcggcggccttgcgacccgtgcacatccgtggcggccgtgcggcggccgtgcgggccaggcgaccgtatggcgccatgcaggtggaaacgccctttcccaaagtcatatcccagccctgcgcaaactcccccccccaacccccccacnnnnnnnnnnggcgccatgcaggtggaaacgccctttcccgaagtcatatcccagccctgcgcaaactccctcccccaatcccccattacacgcccgcgcagtgtgcctgtcgtacgtgcacgtggtggggcgcccgctctacagcttcgccatggacccgtggcggcgagagggcggcgtggcgctggaggcgctggcggtcgaccccctgaccgcccagggcgggctccagaccatggagaagcggctgcatgccgcggtgcgagggagtgggcatgtgtggaggggggggagggctctatagctcggctgtgcatgtggcgccgtcctgcgccagaagggggggagggacagcttgtggcggctcaagcagcggcgttgtgctcgtggggtctctctcagatggcatcccagcaggggctagactccccgatcgtacattgcggccctagtcactcgggcaatgacccnnnnnnnnnngctgtgcatgtggcgccgtcctgcgccagaggggtgggagggacagctcgtagcagctcgagtagcggcgtcgtgctcgtggggtctctctcagatggcatccctgcaggggccagactccccgatcgtacattgcggcctaggcactcggacaatgaccttcctcaagaagtacgtcgcaattgcacgtttacaggtggcgatgtggcatgtgcaggcggacaggggcgcctggctcgtgccgggggagggctgggaggccttccgccgtggagcggactgaggggtagggaggggagcggggtcgacaaagccgagcaggccttcgcgatcgtggtcctcgaaggaccgggagcggagtga

SEQ ID NO: 7392 - DNA, 1191 bp, Chlorella protothecoides
  modified_base (1004)..(1013): a, c, t, g, unknown or other
  modified_base (1072)..(1081): a, c, t, g, unknown or other
atgagcgggaagcacgggtcctcaccggtccccgtcagcggcggccatcccacccgggctggtgcagcagaggagactctgaagggtgggtggcctcgcgctctgggcctggctggtgccccggccgcgagccgtgggtgggaaggaccccccttgacgcaagtaaggcactcgccgtcgccatcacacctgcgcgcaggtgggaagctggaactcaacacccgcgtggacagggggctccatgccctgtacgccgccccgggggagatgtacctgtgcccctccggcaccatggcctggatcaccaagaggctgggcagcgaagggcgcatgcggctcaggcgcggctacgtgccccccacccaggccagggtgagggtggcggcaaggagggggccgggcccgtgggtggcgcagcagtccagcagccaggcagtcggcgggctgactcccatgcgcaccctgcccgccagtgccctgggggagggtctgctccctgatctcccaggctcctcgcctgccgaggccgaccctcatcccctcccggcacaaaatcagggcatcttggaaaaggaggcggaccttaaggcggaggcagcggacgcggccgcctcatccacccctgtctctcacctcatcctggcggtgcacgggatcggccagaccctctcctccgccagcatctcgacggtgggtgggagccctgtctggaggctgggtgggagtgggtgtcactcggcgtcgagtggccactccatcgcccggaccctgtcgtacttgcagacaccccagcgccccatcatccctcctctctttcacaggacacctccaccttccggagcatcgtgcgggaggctgaggcggacctctaccccgtgggcgtcgcggggcgcgtggaggtcctgccggtgcagtggcgacgcatcctggacctgcgcgtcgatgaggtggccagggggctcatcccccccggtcttgccgccctgcgccaggtgggcaggcannnnnnnnnntgttgccggccagccatttcagcacgatccaggagaaaagcaacccccgggctgtcggnnnnnnnnnnggacctgcgcgtcgatgaggtggccaggggactcattccccccggccttgccgccctgcgccaggtgggcaggcgggaaggaggaaggggggccaggaggaggcgcttga

SEQ ID NO: 7393 - DNA, 2925 bp, Chlorella protothecoides
  modified_base (21)..(30): a, c, t, g, unknown or other
  modified_base (677)..(686): a, c, t, g, unknown or other
  modified_base (1571)..(1580): a, c, t, g, unknown or other
  modified_base (2035)..(2044): a, c, t, g, unknown or other
  modified_base (2223)..(2232): a, c, t, g, unknown or other
  modified_base (2438)..(2447): a, c, t, g, unknown or other
atgccagctgcttgggaaagnnnnnnnnnncaagatgttggaaagggtgatgagacaggcaaggcccagcgcactattgtaggtcagtgggcttcttggggaccctttggggcccctccagcacaaggcaatggcagggatgtcgatttgcagagtttaaagtcgagggtccttcctgacaggcctgaggctggcatgggcatggagtcatatactcgggctgtgctggaaggcatggcgcggtatcgaggggatctgggcaacgccagtggcgctgttgagggcgacccctcctctgccctgcaggcaagcctgatcctgagcatcgacaggcggcatggcgcggcgtccgcctcgcgagttgtggacctcgcgattcgcctgcggcgggagggtcacccggtggtaggcatcgacctgagcggcaaccccagcctgggccggtgggaggcctggtccccagcgcttgatgcagcccgccgcgctggcctcagggtcaccctgcacgccgccgaggtgggggggggcagggtggccggcgggttgggcgtggctggaggtttctactcgccagggcgccaaggaatgtgcatagcccgcccattggccctgcggtccctcctcatgaacccaacccccaagccttccaggtgtggaacccagaggagactcgggcnnnnnnnnnntgctggaggtttccactcgccagggcgccgaggaatgtgcatggcccgcccatcggccctgcggtccctcctcatgaattcaaacccccaagcctcccaggtgtggaacccagaggagactcgggccatgctggaatggacaccagaccgcctggggcacatgtgctgcctggacgctgagctggagggcctgctggtcagcccgccaaccccatgccctgcctgcccgccaaaccaacacaaaattcaggtcccacattcccctggagctgtgcctcaccagcaacgtcgtgacccgcagcgtgcccagcgtggcagatcaccactttggctcgctgcaccgtgccagccaccccatagccctctgcaccgacgactgggccgtgttcaggacgagtctcagccgggaggtggctctggccatggcaggctttggtctcagtcggaggcaggtcaagggcctgatgctcgacgcgacacgcgcggccttcctgggagaccaggagcgcgcagacctggaggccagatttcagggcctgctggatgccctcccggactgaacggcaccggtagtggtcaacaacctggactgcaccatgaaaatgtcccttgttgccacagcgagcaaggacactacatgatatttgatgcaggacatcgcgggcctatcgacacacttgtcactgagctctatcggcatagtccagcaggtctggttgcagggatgggtttcagtgaagggccatacagtcctgcaggccgtcttacacacggtcggccagcacccgcagatggtgctcttccctcaaagccgtgggtcaggatgatcccccgggggcctgccaggcttcacattcatgcaatcttgggcaggtctgcctcttnnnnnnnnnnacccccccaagccgtgggtcaggatgatccctcgagggcctgccaggcttcttgttcatgcaatcttgggcaggtctgcctcttgtctattttacatgtttgctcatctgaaactgatccatgtcccttttcatctgcttggttgtgttggtggcatccagggaggaatgatgagacccacgggtcagcctcaagcagagtcggtccttgtcctgatggtgctaccctgacgggtcaccgttccacccttccacctgtacccttgcactgcccagcccacgccccccggcgcattctatgcaacccaattcttacactgcattcgggtgcttggatgatacctcatcaccccccacctctccttcccggacgcgatctaacctcgcctctccaagggggaccaggccctttacaccctcctacaccctcctccaggctttgttctagggcatgcnnnnnnnnnncaacctcgcctctccaaggggacccaggcccttcacaccctcctaccccctcctccaggctttgttctagggcatgctccattgggatggaatcctgtcggtacctcagcatggtggtattgctgcatttagatattgattctcatgttgctcagtctccccaaaccaggccggatacnnnnnnnnnnccctgtcagtacctcagcatggtggtattgctgcaatcagatcttgattctcatgctgctcaaggccctgctggtccagacgaccaaagacggggtcaatacctgttggcatcaccttttcagcgagactctgcacagaagcaaggagctgacaggtccagactgaaacccgattgggaagccatcaggttctgcgtttgcaaagnnnnnnnnnntcagcgagactctgcatgcacagaagcaaggagcagacaggtcccgactgaaacccgattggggaagccatcaggttctgcgtttgcaaagcatgcagcaccctttcagaatagtgtcgcaatgtttgggcagcactgcggcgttacagacgaagcgggcattgagtgctggatcagaatgggaatcaaacagtggtttaatcaaaggagggggttggggcaggggggcacgattgcaacggtgggcaaacaggggtgtacggaaccagggtgggtcggcacatcacaccacgagcaggagcaccgcagcaagggcggtggtggccgcggcgagcgcggccgaggtggcggccgcgccggaggcgggcgcctccgccgtcgtgctgacgggcgcttgcagcggagagggggagggggtggccactggagccaggatggggctgggggacgccttggggctgggggaggcggccttggg

SEQ ID NO: 7394 - DNA, 858 bp, Chlorella protothecoides
  modified_base (588)..(597): a, c, t, g, unknown or other
  modified_base (805)..(814): a, c, t, g, unknown or other
atgccaaaatcaaccacccctgcctcgcccacgccaggtccgcatgcaagccgagaagaagctggcccccggccagaagccgcgctaccccggcgcctttgcggcctatggcatcatcgcccgcaccgagggtgtgcgcgcgctgtggacaggcctggggccaaacatggcccgaaacgccatcgtgaatgctgccgagctggccagctacgaccagatcaaggagaagctgctggcgtcgggtggggtctgggaaagtgggagctaaggggtatgggctttggctgtgtcgacgagcgcctcactcccatcctattcttcccctctgttgctaacccaggtctcttcaaggacaacgtgtattgccacatcgcctccggcctgggcgccggcttcttcgcggtgtgtgtcgggtctccggtggacgtcgtcaagtcgcggatgatgggtgagtcattcatcgtttgtgtccctcgcagcggcccggcggtgtgtgggggaggaaacccagggacagcagccgcacatcgccacccaccgagcctctccccacctccttaccgcttcacactgtccctcacgccacannnnnnnnnncaagaccgacggacccctggccttctacaacggctttgggcccaactttgcccggctgggaacgtgagtgggcaggctgggactatctgtctggaaagtgtccccttagcatcccttggcctgggtgagggacagcagccgcacatcgccgctcaccgagccccccccccgcctcccctaccgcttcacactgtccctcacgccacgnnnnnnnnnnccctggcaagagatccccagtcgccacgtgtgcctgaaggctga

SEQ ID NO: 7395 - DNA, 246 bp, Chlorella protothecoides
atggaccccccgatcaagggccctggggccacccaggatctcacacaggagttccggacccagaccagggggatacattccatctctgatgccctggtgaacgcccgcctcgtgttcctcctcgctgaccggaccctgtacgggcgcgccctcacctgcttctacctagtgcacaagcagctggacatcagcctgcatgccgcggcggtctccacgtccaatacaggtacctgggcattggagtga

SEQ ID NO: 7396 - DNA, 201 bp, Chlorella protothecoides
atgagccgctccgagctcgccgtggtgtacgccaccctcatcctgaacgacgacggcgtcgaggccgagaacatcaactctctggtgcaggctgccggcatcgaggtggagccctactggccctccctcttcgccaagctggcccagaagaagagcgtggatgatttcatcatgaacgtcggtgccggtgagtgccgttga

SEQ ID NO: 7397 - DNA, 411 bp, Chlorella protothecoides
atgctgggagggggacaaggaaagggattgccatttcaggtagcaggaaagtctagcttcagagcctaccacgcccacggaaagcctagcttcggagccttccacgcccacggtgctcggcagcagtgtccccagggccatccatcttccctttcccacataagcgcaggcttgcagcgccaggtcctgtttgggggcctgcgcatcggcatgtacgacccggtcaagtccctcttcgtgggcaaggaccatgtgggagaggtgggcctgctcaccaagattgcggctgggatgaccacgggggcgctgggcatcgccgtcgccaacccaacggacctcgtcaaggtgcgctccctttctcgccggaggcttgggctggttgcttggactgcgggcaagtgtgctgtatga

SEQ ID NO: 7398 - DNA, 510 bp, Chlorella protothecoides
atgtcgggccagagcccccttccatccaccaccgtcctcccacacccgccccaaaccctgtgtcccctctccccccgcacaggtaccggcttcttcatcaacagcttcctcatcatgaccctggtgtacctcaacatctgggtgatcctggtgctggccctgaccaactccatgctggttgtcgacccctacaccctcactgtgatcaacgcgctgacggggcaggcggtggctgtgtcggtgaaccaggcggtgcagctgggcatgctgtccatcatcgtgtttgccgtggagctcctgctggagtatggcatcgtgaagatgctgggcacgctcctcgtccagtttgtccaaggtgcctggaagggggttccaggagtgggaggtgatgcatggacggctgagcatgtgccaggtcccgaagggggatgcgcggtgcctggagggggggccgtggcgaccactgctcccgctctgaggtctgcagggatggattgtggggtgtcatga

SEQ ID NO: 7399 - DNA, 903 bp, Chlorella protothecoides
atgacacggtctcgctggaggataggcccagctctcctgcgcggcagtagtttggtgtaccctacccgtgcaccccccaaccgcacgcatccagggaccatcaacaagtacgagcgccccttcccggacatggggcactcccccgtcgtactggtcggcttccgggagtgggtcttctcccaggactcaggtgccatggggcctgggtttgggaggggggtgggggggggcgcagcgctgccgcggcctgcatgcggcgccgcgctcgaggacgtctcgtgcgctggccagcttcgccgccgcgaccgagttctcctttggctccgtggtccagagggtgatgacctggccgggggccgtgcgcttccactatggccacccagacatgtggaacaagctgtttgtgatgacgcgcggcggggtgtccaaggcgaccagggcagcaggctgtcggccgggcagcagggtggggtctgtgttgggggcgcggcggtgggctcgcctttgccagccctgcctgtggatgcggggcgcggcacccctgccgtgcacctggcctcaagccctcaccaaaacgacgccagggggttccacatcagcgaggacgtgtttgcggggtacaatcacacgctgcgtggcggcaagaccaagttcaaggaatacatatccgtgggcaaggggcgggacatggggttcgactccatcaactcctttgagtccaaggtgtgtggggtgggccgggtatgcaggagcctgggccgacccagcgcgctgtccgggggccaggtctgctggccaccggacagggatctgccacctcaggattccttccttcgcctcacccccctcccattgcatcctgtaggtgtctggcgggaatggggagcaggccatgtcccgtga

SEQ ID NO: 7400 - DNA, 2427 bp, Chlorella protothecoides
  modified_base (509)..(518): a, c, t, g, unknown or other
  modified_base (1286)..(1295): a, c, t, g, unknown or other
  modified_base (2240)..(2249): a, c, t, g, unknown or other
atgcgccaccgccccgccatgccactgttacaggtacctccgcgcccaggacgttgcgcaccaggaaacaccgcgcacgccatgcattcgttacgaaagcttcggccagcgtggcagaaggtgagacctaggggggcgttgtgggaggcctgcctgaagcaggtcatgtgtgcggtggtgcccgctctgcatggggaggtgtgctgtggtggcagcagtttcatctggagcacttcttgcggcctcgacaatctcacacacctcttccgcccacgccctttctctgcgccagccccacccccgagctccgcaccatccgccgagctgggtcccagggagggcatcaggaatatcgccatcattgcccacgttgatcacggtacggcagcgcttggaggtgatgcacttgctaggtgtcaaacactttgtgcagccattacattcaaagttttgggcgcggcacggtatgggcccgcgccccactgctcatccagtcacgagctctgctnnnnnnnnnntaaagttttgggcaaaaccacgctggtggatgctatgcttaagcaggccaaggtcttccgcaccaaccaggcggtggagatccggatcatggacagcaatgacctagagcgggaacgtggcatcaccatcctctccaagaacaccgccgtccgatacaaggtccgagattactggcctggaaggactggcctaacaagccctgcaagggacagtcatgctgtggccccatgcacaatctcatacctagaccccccccaccttcatccatctggcaacaaggctccctcttttcctcatggccccgaatccctcttgccaccccccatccccttaatatacacatgcgcgcagggtgtcaagatcaacatcatcgacacacccggtcacgccgactttggcggggaggtggagcgcgtgctcaacatggcagacggcgtgctgctgctggtggacgcggtggagggccccatgccccagacccgctttgtgctgaagaaggcgctggcgctgaacaagaaggtgctggtggtcgtgaacaaggtggaccgccccgcggcgcgccccgactgggtggtggaggccacctttgacctcttcgtcgacctgggcgccaacgatgagcagtgcggtgagccatgggtgactgttccattgtggaaggatcgctgcgtgaggggaggggtggcgggcgaaggtggcaagtctgctggaggttctggtgcatgcacggagcggtacgcagaccgaggatggcaatcgccagcgcnnnnnnnnnntgtggcagacttccccgtcgtgtttgcgtcgggcatgggcggcgtggccggcaccgacccaaacgccctggctgaggacctgggcccgctgttcgagtccatcctgaacgaggtggacccgccccaggtggtccagcaggggcccctccagctcctggtcacaaacctggactatgacgagcacaaggggcgcatcgccatcggtcgcgtgcagagcggggccatctccaagggcgcgcccgtggtcttcctcaagccaggcgaggaaggaggttcaggatggtcctgtggcagtctcgatgggagtgcagtccccaagcctccaaaggctgggcgctgctgcaggatatcgccatcctttgaccaaccaccctccaccgctcgactgcccaccacgtcttgtacgctcactcgtccctctcacctcatccaccgacacacaggctctccccccaccagcgccaaggtgaccgagctgtttgtgtacgacaactttgcgcgcacccctgtggacacggtggaggcgggcgacatctgcgccttcacgggtctgtcggcggtgtccatcggggacacagtgtgccagccggacgcactggtgccactgcccaccatcgaggtggaggagcccaccgtgcgcatgaccttttcggtcaatgcctcgccctttgcggggcatgagggcaagtttgtgaccagccgcaacctgaaggaccggctggagcgggagctggagaggaacctggcgctgcgcgtcgagccgggaaccggcgctgagtccttcgagtgcgtttggttggtggggaaggagctcccacacagcatggtggcggcgcgccccctccccgcaccagtctttgaccaccctctcgccggcttcccccagtcaagcctcccctcccccactccaactctcctccagggccctgcacctgggcatcctgnnnnnnnnnnatgcgtttggtcggtgggggaggagcttccacacggcatggtggcggcgcttccccctcccgcaccagtctttgaccaccctctcgccgacttccccgagtcaagcctcccctcccccaatccaactatcctccagggccctgcacctgggcatcctgatggagaacatgcgccgtga

SEQ ID NO: 7401 - DNA, 528 bp, Chlorella protothecoides
atgctcaccgccaccaagggcaccgccgtgctgtccaccatcctgtcggggtacgagccctgggcgggcgacatcagcacgcgcgagaacgggtcgctgaccgcgcacgagaccgggcaggtcaccgcctacgccgtggagtccgtgcagcagcggggccggctgtttgcgcgcccgggcgacgcggtgtacgaggatcaggtggtgggcatccaccagcgggcgggggacctgaaggtcaacgtgtgcaggaagaaggcgctgaccaacatgcgcgcctcgggcaaggacaacaccgccgtgctgaccgagaccatccccgtgaccctggactatgcactggaggtgaggctagtgtgcgagccggttggtacggggtgctgctcgtgggctgtgcccgagaccagagctagaatttggggctggtggttccaatctgtagtttggggcctctgggtgtgggagaggggtagggatctgaaattcatgcgcaagaaccccgcgccagctgcccgggacacttcctga

SEQ ID NO: 7402 - DNA, 1038 bp, Chlorella protothecoides
atggaaacatatcattggccagcaatgccaacgctttacatagagagctactacagccctcgaacagaggcttgcaccgaccatgaagtaaccaccaaagccctgcccttaccacctgcccgccaggtgctcttggagaagaatgtgaagctgcgcaccatcgtgaacaagctgggcagcatagacaacgagtacagggtgtttgacatggaggttatcgctggtgaagaagacacagtcaccgaggtggggacagtaaaggggctcacgcttgtgttccgtgtagatgccctgttggatgcggcagacctgtggtgctttggagaatgggtggatgaccctgcccatgaatgctctccatgtacgagggaggtgtattggaactcgagattggagcgggaacacacccggctggtgaccacctttgcgccggggcaggtcatactggacgtcatggccggcatcgggccctttgcggtgcctgctgctgcgcggggctgcacggtgcgctgtcagcggggaattggatgccaggaggaagctgggggaaatgcgcttgtctcaagggggaggaccatgccggcgtgccatgtgcagcgtggcatggaagagagatgtttcacagtgtacgccaacgacctcaacccagacagccataccttcctgtgcaagaacatccagcgcaaccgcgtgactgagcgggcgtttgccttcaacatggacggcgcggccttcattcgcgaggcggccgccgggcggctggcgccggcggcgctcccgcccctaagcgcggccaaacggcccgtgccgtctacggcagtgcaggagagcaagccgacgcagcgcctccctttccaccacgtgatcatgaacctgccggccagcgccgtggagttttgcagcgcattccgatcggcctttcctgaggagctttgggaggccggctccctgccaaaggtgcacgtctatgcttttgcgaaaggcgtggattgtgaaccaggtgaccgaggcattgcaggttatgaggaggatggatag

SEQ ID NO: 7403 - DNA, 555 bp, Chlorella protothecoides
atgccatcaggcgggtcgtggagaggggctggtgtagcgtgccccttgggcctgaggctaagcattgccctggagccggcttctgctcctttgcctcgagaagaatggattcctcagggtgctcatcactccatcccctccacccttgagcgcaggaagtcgctgggcgccctggaggtcagggtcggggtgctggacggcgccgagcgctgcgcgcgctgcgggcgctcgctgcagggcccgccgccgctgtcggcaggcccctcgggtggcgccgtgccccaggtgtacctcttccccacgggcaacgccttccacggcagctgcctggcggccgaggtcgccgcgctggcgcccgcgctccagcgtcggcgcatcggcgccgcgctggcggagctggccgcaggtcgcgacgtggcgcgccatctggcagacctcaacgccgacgtggcaagcgaggacccgtactggggcgaggcgatggtgcgccaggtgcgcaagcccttcctggacggccccgacgccgcggcggagctggcctcctgggcgctttga

SEQ ID NO: 7404 - DNA, 1092 bp, Chlorella protothecoides
atgcagaagcctgagtccattcccctcttcctctacatgcctgatgggcttaggccttgctatgaaacacctcgaccatcttctcgccggcgtacttctggcactggcgcagatcgacgaatccaccggtgccacagaagacgccatgctgatactttgagtattcaatgcatgcggttatggaccagcgggacctcttgtgcttgtgcgtccgtctccgtgctcatgtgggcagcctcgcacgctcagcaggctgccacgccgagacggcacggccggagccacgtggctgagccagagggatgggtagagggtgctctaagaagtgatctcaaggtgctcccaccggccatggatctcctggaggactggaacaacatcgtctcggatgatgtggcaaacccaaacgccgaggatgagccggatatcttcgatctggcgctccttcgcgacttcatgtcacgtggccggggcacgccggtggccgtggcactgtcaggagacaccctggtggtggccacctcgcgcaacttcctgctccgggccgatctctccgacggcggccaggcctcttgtgtcgagatcgatctgcagcgccctggggacgcggtctgccgacaggtgtggctggatcccttgggcagtcactgcctggtggcagccagcgcggccacgggagcgcccgagacgctgtatgtggactcggcctggaaaaaggcacgcatcttgtccaagatgaagggcatggccctcaccgccgtcgcctggtggccgagcttgcagccctcgcacacaacgcggtgggtcttggggagacctagcaagcacacatcgcatgcacgttcattcacggtggtctcaggaaaggacggcctcaaaccaggcagcgtgctgctgcctgccacacctggacctggcagacccgaggaaggagcgggtgcagcccctgcacagcctgcagggccaaagcgtgcacagcgtggaacagactgtctcgccagccactgggaagctgctcgtgctggccctgaccccctcgcacatccactgctttcacggggagggcagcctgcaggactgcttcagcggtga

SEQ ID NO: 7405 - DNA, 2022 bp, Chlorella protothecoides
  modified_base (661)..(670): a, c, t, g, unknown or other
  modified_base (978)..(987): a, c, t, g, unknown or other
  modified_base (1659)..(1668): a, c, t, g, unknown or other
atggaccgacggtccctccgcgagaggaaggtgtcggagaggttcgccgtcctcgacaaggccgaccagcgccaggctgtgaacgctcggctggaggcccttgaagaggatgatgcccaggagaacgccctggcacccggctcggacgacgaggactttaccgttagagaggactcagatgggggtgagctggatcaatgcgccgggccagcaactgtccttttgatcctttacccctgtcacgggagcagtggagagcctcgccacccaccatgcgcagagtcaatcccggccgccggcgggagctcaaagaagaggaagctgaagacagggagcatgcggaagacgcgaggcatggtggcggagcgggctcggggccccaagctcttccgggactggctagaggaggtgggtgttttggcagggaatgtaggcccccgtgcatggcgcaggcattttcccacagcggcttcgcccatctcgggcgtggagcgccgagctgccatggtcctcatgtcgagcgcaagtgccatgggatggcatatgactgcgcgggcatcgggcgcgcagtcctgctcgcccggcgagtctcacatccgaggccctgcgcgcaggagatcaccgctcccccccacccacccacccaccccgcaggccgacnnnnnnnnnntggcccacgatcctggacccaactacctgacagctgcgatgggcccgccgcgcagccgctccacccgccacagctgcacggtgtgcggcgacgcctccaagtactcctgcacccgctgcggctcgcgcttctgcagccccagcccgccgtgcagacaggtcgggtttgaggccaaagtggaggaaaggcaggcgtcccgtgcacagtgcttcaagcctgacattggtggagcgacccagccaagcacacgggctgccccgcctgcccccgtcccccgcccccagccacgccttccaccccccttcgcnnnnnnnnnngggtggagcgacccagtcaagcacacgggccgccccgcctgcccccgtcccccgccccccagccacgccttccaccccccttcgcttcatcgcatgctgtgccaggtggcagagcgcgcgcggtgcagggccgcccgcaccgccgcctccacgtcctcgaccaccagacgggccgggtggcgctcactgttccctgggccgcggaagacgccggtgcgcaccaggacgctggtccagggtgggccggcggcgttggcccctgccacgtcggcctcgggattgtcccccaccgcccagatggcgccaaaggcgcggtctccccagcccagcgccgcggcctgggcgtgcagcgaggcggcggccaggcaggccgcaaaggcgccgccgccgaggcggggcgcggcgtgcgccccggcccactccacatccgggttggagaagacgacgtgcacgggatcggggtcgcaggtccctgcgcccggcggaggccgggtgacggggcgggcaccgggcaccgcccgccccagcacgacgtccagcgaagtctgcagcgcgcagtaccagtcggaagggtcgttgagcaccagcactgcgcggatgggctgggcggagccatccccggccgaggggcctggggaaggggtgggacgggcggcggcggcggcggcggcnnnnnnnnnnctcacctccaacagccacctcggcaaagggcacggaggcggggtccgcacgcaccagctcctcgacggtcacgcagcggcgcaggccgtagccggcagccagactgtggaggtcgccccgccccaccagcagcatgcggtggtcggccagggagggcgcaagcgccttgagcggggtgtggctctgcaccacctgcccctcgcccacccgcacgcccagctgggcggacaggcgccgggcacgctcctcctccagccagccgccggagttggtcaggaagacgatggggtagcgcgggaagccggaggcgtcgtgcagcagcgccagggccctggtgtgttgggggcggggtga

SEQ ID NO: 7406 - DNA, 513 bp, Chlorella protothecoides
  modified_base (44)..(53): a, c, t, g, unknown or other
atgccagcaatacgtcgcggtatcagcagtccagccccgccagnnnnnnnnnngcgaggtgatggtttccggcgagggtgtcggattctgggacatgcccatggcctcccccgcctcatgaaggatccactcacacccctcacccagatccgcatggcacgcaaccgcgagaatgcgcacctgtctcgacagaggaagaaagcgcagctggagggcctggagcagacgtgctctgcgctgaccaagcaggtccgcgccctctccacctttgtgggccagctgacggcggagaacgagctcctgcggcgacacttggcggccgcctgcacggcggcagggcgccccctcccggacctcccgcgtgcacccggcccgcaactggtcctactcccgcccccggcgccgggcgcggcgcccgtcgtggcgctcagcctcgcccagcccctcagcggtgctaccgtgcccctggctgcagctccagcgtgcccggcgcaggggtcggcaccagagggc

SEQ ID NO: 7407 - DNA, 567 bp, Chlorella protothecoides
atggacgagatgcgtgccatgctggatcagctgatgggggaggacaggaatctaggcgccactgagaaagccaagtacaagcccaggaagcggcaccacaccgataaagacgtgtgcaagttctacttgtcgggattctgtccctatgaggaattcagacgcacgaagaacgactgtggcgattgccccggcatccacgacgatggatgcagggcacagtacgaggcggaggacgaccgcaccaaggagcgcctgggctacgaggcggagctcctgcgctggttggagaagctcctgaccgaccttcggaagcgcatcgacagcaacaccgtgcgcctgcgtgccgtggagaaccccctgctcctgcatgaggaccaggccaagctggacgccatgacggcccagatgaaggagctggtggctcgtgcggagagactgggggaggagggggaggtggacggcgcgatggaggccaccaacgaagctgagaagctcaaggtgcgtgtttctgaagaggaagtggagctgccctggtgtcgctggtgtgggctgggggattttcagtga

SEQ ID NO: 7408 - DNA, 405 bp, Chlorella protothecoides
atggagtacctgcggacggcacgatcgcccctggggcgcccgctgttcgacccggtcctggcgctgcgactggcgcgggagcgcggccgcgaccacgccgcggtggcgctgtaccaggacctgggcttgcacgacgacgcggtgcggctggcactgacgctggatcgagacctggcggtgcgggtggctggtcgggcagggggcgacgcggggctgagccgccggctgtggctggacattgcggggcacctgatccaggcctcgggggatcccaaggaccaggggatcgcgctggtgacctcgctgctggaggagtcggggggcctgctgcgcatcgaggacgtgctgcccctcttccccgactttgtggagatcgatgccttcaaggacgtcctgtgcacgtga

SEQ ID NO: 7409 - DNA, 345 bp, Chlorella protothecoides
atgggcccgtatgccgccccactgcgcgacgtggcggagctgccgctgggcctggtgcccgacacgcagcgcggcgggcgggtctgcctctgggcgggggacgacctgttcgagctggacgcggggtcggaggaccgcgacatgtggcgcaccttcctggacgccggcgagttcggcgccgcgctgctgcactgctccaccgccgcgcagcgctccgccgtgttcctggcgcagggcgaggcggcagtggagggcggtgactgggaggccgcaggcacgctgtttggcaaggtgagtttgtcgggggtgggggtggggggcgaattgctcgtgcatggggcctga

SEQ ID NO: 7410 - DNA, 792 bp, Chlorella protothecoides
atgcgggacggctcccggctcctggtcagggcctttgagcaggaccccgagaacccctacacccttgtcctcttggcctacttcagcctgcagcagggctttgcggatggggccgccaagctggccaaagccgcgctggatgcttctgactcggagccgctgcggctggagtgcacaacggtgctggcgcgcgcgctgcatgcgcagggccgcaatggcgaggccttccgcctctactcccaggccgcgacgttggacccgcgcgcaccgctacccgcgctgggcctgggccagctgtcgctgctacgcggggagctgacaaatgccgcctcggtgctggagggggctctgactgtcgtgccggcctggaccgacgcattgcaggtgctggggaagctgtacccgcggctgcggctcggacccgatgcggcgggcatcccccacttcaaggccgcgctgaagcgattgggcgagcgcgccgacctgtgggagatgctgggcgatgtgctggcaccgctcgaccccgggggttccctggcggcgtaccagcacgcggtcgcactgtgggggcctgccaacgccggggacgaggtgcaggcgggggctgacagggccccatcggccacgccctcatccccgtcgccccaccctgctccctctgcgcgcctgctgaacaacacggcggtgctgcagctgcgggcggggcaggcgccgcgcgccgcggccagcatggaggccgcgctggcggcggcggccgaggggcggctggacgggctgggcgcggaggcgcgg

SEQ ID NO: 7411 - DNA, 900 bp, Chlorella protothecoides
atgaccctggcgctgtccgccagcctcggaggccgcgcacccctccatgccaccacaactggtcgctctggcccgaagccgtgccccctggccgtcccccgcctgccatgcctgatccgccgaggcacaccctgtcggctggccccacaagcccaatccggatccacgaccagcttcgggtctcagcccccgggcggcgatggcggcagcggtggtgggggcggtggtggggatgggcaggggggtgaggggagggactcctccatcactgcagccctgctcctggcaggcaaggctgccaccgaccggttccccgaagagatcgcggccgccatccgtgccggccgcatctcccaggaggtcctggcgcggtacctggacatgctgaagaaccccttcctgtcctggctcctgtccttccccggcgcccgcgcccgcctgctggctgaccccaacttcctcttcaaggtgggcatcgagctcggcatcggcctgaccatgaagctgaccgcggagtacaccaagcgcggtgacgagttccagtcccagctcgactttgtgctggccaacgtcatcatggccctcatcgctgacttcatgctggtctggctgccggcgcccgcctacaacctcacgtgcgtggctgtgatgggatgtcttcctttctggttttggtgggaaggaggtggggtagtcatgaggatcccagagtgtagtagaagaagtgggtttgagcagatcgtgtgcgcgtccgatgacacatcggaggaggtgaatctccggcccagtccagctgacacaattgcatggagcgccctagctggaggtatcataccagcgcggtgtgcctgcacaccttgctggtgcaccaactcggaggactccctgttgatcagctga

SEQ ID NO: 7412 - DNA, 1203 bp, Chlorella protothecoides
atggcagccgcttgtcggacgctcgcccgaggatgggctctgaccggcctggtctcccggatcggggcccggggcctcgcgacggacatatatgagcacacacccggtccggcggcctttgcgtttgacatcgatggcgttttgatgcgtggcggccaggtcctgccagcggccaagaggcgagcgagtggtggctactttgcgggacggggaaaccaaccaccttcaccccgcccccaacacaccagggccctggcgctgctgcacgacgcctccggcttcccgcgctaccccatcgtcttcctgaccaactccggcggctggctggaggaggagcgtgcccggcgcctgtccgcccagctgggcgtgcgggtgggcgaggggcaggtggtgcagagccacaccccgctcaaggcgcttgcgccctccctggccgaccaccgcatgctgctggtggggcggggcgacctccacagtctggctgccggctacggcctgcgccgctgcgtgaccgtcgaggagctggtgcgtgcggaccccgcctccgtgccctttgccgaggtggctgttggaggcccctcggccggggatggctccgcccagcccatccgcgcagtgctggtgctcaacgacccttccgactggtactgcgcgctgcagacttcgctggacgtcgtgctggggcgggcggtgcccggtgcccgccccgtcacccggcctccgccgggcgcagggacctgcgaccccgatcccgtgcacgtcgtcttctccaacccggatgtggagtgggccggggcgcacgccgcgccccgcctcggcggcggcgcctttgcggcctgcctgcaggcgctgcacacggaggtgacgggcgcgcccctgccgcgcgtcacccgcttcggcaagccccacgcgccgccctacgacctggccgccgcctcgctgcacgcccaggccgcggcgctgggctggggagaccgcgcctttggcgccatctgggcggtgggggacaatcccgaggccgacgtggcaggggccaacgccgccggcccaccctggaccagcgtcctggtgcgcaccggcgtcttccgcggcccagggaacagtgagcgccacccggcccgtctggtggtcgaggacgtggaggcggcggtgcgggcggccctgcaccgcgcgcgctctgccacctggcacagcatgcgatga

SEQ ID NO: 7413 - DNA, 444 bp, Chlorella protothecoides
atggtcgagcttgtgtcgagttctcgtgcagctcgctggaatgtcaacaagagtctcgggaagcgatctgtactgcagaatcaatctgagtatacaagctctgaatatttttcaagcagatcaaaggatgacttgcagcagatgtgaggtgtatactccggtgcctgctttctcgcaccaggcatggccacggaggccgggggggcccggaccctcatcgtgaagagcgtggcatttggggttacagacgagcagtttgggagctacttcagtgacattggtcccgtgtcgcgatctttcctggtcaagcagggcaaggagggtccccacaaggggtatggcttcgtgcagtttgcgctggcctcggatgcagagcgggcggtggcgaacctgaacggcaccgacttgggaggcaggaagctcaaggtggaaagtggggcatga

SEQ ID NO: 7414 - DNA, 744 bp, Chlorella protothecoides
atgggcctgctggcccgtccaagcttgccagaccagaggaggtggaggtgcggaaggtgcaggggtgtggggaccattgctgctggcgcgctgcaggcaggtctttcgagggttccggtcgctgacttgggaggcaaacccaccccacaggactcggccgaggcacgacgccagcctgacgacattgccgacgaagagctaggtgattatggaatccccagcgggtggaagcagtgccctgcccagggccagcctatcagcaggttcatcccttccaaggtgccgctgggcgcccactttgacgactacatcccggcagcacagcggtacaacgtggaccaggcgcgggagagagctgacgcaaagggggctgcccttcaggcgcgctgcgccacggtgatcgacctgacccgcagtaccaggtactacgacgtgcgccgctggcaggagctgggcgtgcgatacatcaagcccctcacccgagacaagcacaggtggcagcaccctcacttcaccctgcccatgtgcccctctcagatcccctgccgaggtcgggggcaggtcccacagccggaggctgtcaacgactttgtctgggaggtcgccagtcagagggcagggcagtccactgtcctcgtgcactgcacccacggcttcaaccgcacaggcgaggagggttgtggagtgggactggcgtggagcacatctacctcagtgctgtgccgctgtgcattcctcgggtaa

SEQ ID NO: 7415 - DNA, 327 bp, Chlorella protothecoides
atggaggagctggagcgcctgctccactggctgtccagcagcctggacacgcgggtgtacgtagccgtcacgcgcggactgtgggacctgacctcgaaggacgtgctggagtacgccgaggacctgcaggaggggggcggcggccagcgggtgtgcggcgtggattggtgcagggagggggagaccgggagggggagaccgtacctgtgggaggtgacccgtggggacggcgcgaggcgctgctggtggctggtgcctgggagggatcgtcccgagcggaggacggaacaggcgcggctgcaggcgagcctgcctcgctccgtctga

SEQ ID NO: 7416 - DNA, 258 bp, Chlorella protothecoides
atgcaaacattcacgcgcacggcgacctcccccctccctgctctccctttccacctcccacagggcgcctggcgcggccggcagaacgccagcgtggcggtgcgtggcctggatgccttcttcaagtccatgctcacggcctccatgggcaacgacctgctgtccaaggacctgggcctgcccgcgcactcggaccgcgcgcacaagctgctggcagagaacctgtcgggcatcaaccactcctacgatgtgtactga

SEQ ID NO: 7417 - DNA, 780 bp, Chlorella protothecoides
atgtccacccttcaggagaggtacgacatgataaagcgatacgtgatggacccaagaaagttggaacggcacgtcatcgagaccaagcagtggtccttcccctaccagtacggcgaggaactgtttcacgtgcgacgaaaggagttttggccgctgacccaggcagacaagctgctgcacgacttcatccccaaccaggtctcccacgagtctgacggcctcattctgcaagaggagggtgcgccaccttgctgtctgtcatctccccgccctcaccatgcctctcaaagttcccccaccccacccttcaaccatgccaccctagggtacgaggacgcctacgtccccggcacctgccaggagctgctgaagtggaagttcgcgcacctcaactccgtggacttccggctgcgctgggaccccaagacctccacggcggggttggagctgttggagactcgggcggggggggctcgacctcgtggctaccacctcctccccggcgccaccatcgccttccccggcggcgaggacccggccgcgctgcatcagcggattgtggaggcagcctacgatgccgaggcggggtcctgggtgtacatgcgcgagcggcgcgacaagcccacgcccaacgcctaccacgtgtacgagagcgtggcgcgctccatccaggacaacatccaggaggaggagctgctggaaagcatcgctgcggccctgcagctgccgctgtacgagcgagaccgggcgcgccaggcggcagggggccgggccgcctga

SEQ ID NO: 7418 - DNA, 672 bp, Chlorella protothecoides
atgcaccactggaccgtggagaaggcgctgcacgcctttgcgctctcccgccccccgggcatctacaagcactactacatccgccagctgtaccggtactaccacgaagcggtccccgccgcggctgtcatgcccgcactgccggactggaaggcgggcgacgcacccgactcgggcgacgagggcggggaaggggagaatggcgccgaggcgccgccggagcacatggagcatgacgacgtgctgggcgaggaggtgtcccccgccgaggcggccacggtctgcggcagcatcgtggagatgatcgcggggccggggcaggaccaccgcagggcctggttcccggggtcgcagcccgtcagcctggaccggagcaacctggagctgctgcgccagcgcagtgcgcggctcagggacccacttcaacccccccatctcgaccctacctgctctcccccccttcccaaaacggcgcaggtactgggtgacgtggaaggccgacgggacacgctacatgctggtcatcctgccgtcgggcacatacctggtggacaggaagctggccacgcgccgagtgcagatgcgctggcccctgccagccaagccccaggctggggtgccccagaaggcccccgtgggaccaccccactccctggtgtgtgtggggtgtga

SEQ ID NO: 7419 - DNA, 1005 bp, Chlorella protothecoides
  modified_base (694)..(703): a, c, t, g, unknown or other
atgcggcccgaggaggggatgagggacggcaacgtgctgcgcatgccacgcgaggtcgagccgctcggacggcatcgtgaaatgcactttcaaccgtcaaagctgcgatcgatggtgggcatttgctgtcgagagagtgctgggctactgaatcgacaccgcggcaggcctcggccccaggtgacagagcccgcgatcagtccaggagcccaagcgcgacacctcccattccatcctgccccgccgaccgccatggttcgggtggaggtgaagtggcagaaggaggtgttcaaggacctggaggtggacatctccgcccctcccgccgtgttcaagacgcagctcttctccctcacgggggtggcccccgaccgccagaagattatgggcctgaaagggggcctgctccgcgacgacgccgactggggctccacggggatcaaggacgggtcccggataacgatgctgggcactgcgggggctgtgccggtggcccccacccaggcccccaccttcctggaggccctgccggaggaccagcaggacgtcatggggctcagcaagtacggcgcggggctggagaacctgggcaacacctgctacatgaacagcacgctgcagtgcctgtatggcgtggaggagctgcctcacctcactcctccttcaaccccctccatccctcagcctggcacannnnnnnnnntggcgccgcctgggcctcccgcctgggcaggtgtccctgggacaccccacatgatcgtacacgaaggcagctcaccttcactcctccctcaaaccccctccatccctcagcctggcacgatatgccgcggcctcgctgacatccacggaccccaacgccacgctcaccacggcgacaaagtcactgttctcctcgctgtccacctcggcccagcccgtgccgcccatggccttcctcctgagcctccgcaagaagtttccccagtttgctcagcaggccaggcaaggcatggagtgggttga

SEQ ID NO: 7420 - DNA, 333 bp, Chlorella protothecoides
atgcgctttggcacgccgcgccaggacgcggagcggcgtgacttcaccatcaacgccctgttctacaacatcaacagcggggaggtggaggacctcaccgggcgggggcttgccgacctggaggccggcgtcatccgcaccccgctgcccccgcgccagacgctgctggacgacccgctgcgcgcgctgagggccgtgagattcgccgcgcgcttcggcttcgagctggaggagtccctggtgcacgccgccgcgcaccccgaggggcctcactcccctcctgcagcagcaaaggttgcatggtggccgaccagccagccacaccaagactag

SEQ ID NO: 7421 - DNA, 333 bp, Chlorella protothecoides
atgtgcccccactcccctcacaggctgctcatcctccgtgctctccacctgcggaccctccccggcctactggaggtgctgccccacatggccctggtctggcgggcgtcgccgggggtcctctacatgctcgtgctcacggtgggcatctgcatgggcaccgctgcactcctgggccgtgcgctgtggggcacggcggcggcgctgaccaccaacgagatgatcctgcgcaggaggtacgcctacctccaggacacgcaggggctgtacaggtgcgagggcccaaggggaggtctcatggggttgggtggttgtttgaggaccccaggctga

SEQ ID NO: 7422 - DNA, 189 bp, Chlorella protothecoides
atggaggttcgggaggaggccgacgtgctggccctggcgggcggcggcgactggcacatggcctacctactggtgtaccgcgcgatgcgcgcgccgcaggccgccgccaccgccgcggcgctgccggagggcggccaccgcgcggccagtcccgtgcccatggaggaggatcccaaggcacaggcctga

SEQ ID NO: 7423 - DNA, 777 bp, Chlorella protothecoides
atgctgaggccttcacgtcatcaaagcctcaatatgaatcttgctgggttgagacggattgtgaatggaggagaaactatccatgccccagttagcagggtgtcggatcggcggcatgcgacgaatccccggttacgacgacatccgcagtgccctgagcaaacatccaattccgcctcattccttttgcttcgttggagaaagcaaaagaacctcccttcatgttacaccgagctgaatgagagcgggtgcccgcgggggcgttgcagtgccgaacaccacggcgagcaaagtgcagctctagctgtgcagaagggcgtgaccctccctggacatcccggacctggagccagtgagggagggcgcgacctttactcagacccttttcaatgtggtgagaagcctggagggttacgcgcgtctggtgcagtgacggatcgtggggcagatactgacaagactcctgtaccctgcaaccagatcaacattttcgtggggctgggcctcctctccacgccctacgcttaccgggctggcggctacattgctggtgtggccttgctcctgctctcctccctcttctgtctatcagggcacctgatagttgctgcattccagtatctgcctgttgatgctccgcggcagaagaacacccctgcgcattcctgcgtgttgcctgggagggatcaaaggacgcatccaggtggtgcatctgtagccaggaacggtctggcagtgccctcgtctcaacgtacagctccaggattctgtgcctga

SEQ ID NO: 7424 - DNA, 501 bp, Chlorella protothecoides
atgcgcatgcgcagggcacggcaggcagcagccacctgtcctaacgccaaggcctccaagtctcggggagtgtatgctcatcattttacaggatgcctgagtgtcacaggggactggcatgagacactgcttagaacaggacgacatggaatccccgcagtatcgagtgcgttcaagtattcgaaagagctacctggtcgaggggctgcacctcttctcgttgtgggcgccatggcgactccagtggtggaatcgctgttcatcaccttgaagcgcggcatggcaggcgtgcggcatcaacacgtgagaattgtgaaggctatcggcctgacatatcggcagcagactgtggagaggacaaacacgccagccatgcgaggggccgtcgccaagatcccccacctcctgactctggagaccaacctacaacgagctgcgcggcttgctgctcaggcagaggcgagaaaacttagacctcctgtcattgttaggcatgcttaa

SEQ ID NO: 7425 - DNA, 2304 bp, Chlorella protothecoides
  modified_base (638)..(647): a, c, t, g, unknown or other
  modified_base (1482)..(1491): a, c, t, g, unknown or other
  modified_base (1671)..(1684): a, c, t, g, unknown or other
atgcccttcacagccgacgacaaagtgccgcggaatactatcgcatgcaagacaaacgaaattgatccacgggatgtccaggcggctcatctctccatgctagctcggttactccacgtctgccggccagcactgatcagatcgccacttccttggaatcctagccatccatcaccaatgtacgatgcagcgggtgggttcgttatgaatttgtctccaaaggacatcccgctgcacctcactactgtcaccactggacttcaccccaggccgccccgacggggcaggaaagccacagcttcagcagatgccaagaatgcgccgcacaacatggccacatccgacacaccgaaacgcccggagcccgagccggaagaggcaccggtgagaaccaccaccaagaaggctcgcaagccacgctccccctctccccctcccccacctttgtacgacgtctccatgcgcgcacccgccctgccctccacggctgctgccgccacgatcctgtgctggaacgtcgcaggcctgcgtggcctcctcaagaaggtgggattgggaggagggtcgggagaggaggacctacacccatgaccccacggccatcgcgtcgctgatcgcccgggagcagccgcacgtcnnnnnnnnnngacctacactcatgtgtttggccagctgcctggcctgctgggcgcacccggcgacaaccaaagaaagccacgcccaccccctccaggaccccacggccatcgcatcgctgatcgcccgggagcagccgcacgtcctgtgcctgcaggagatcaagctgcagaccagtcactgcgacgaggagctgcacgacctcctggccctcggtcccgagtggcagatcacttggaactgcagcactgccaagaaggggtactccggcaccgccatcctcaccaggtcttctgggaggctgttggtagagtgcacagccatggtggggtgaagcagagaacggccagctgcccatcgcctcccattgcacgttgggagcagggcgggcgtcgggcctcacatgctgcactgtgtccgaccctcacacaaaccctggattcttcagcgcgcctgcttgacgccatgaatgcactgctctgcatccgctacgccacaggatcccccccctcagcacggtgtgtggcatgggctcgcccggccatgacgaagagggtcgggtgctggcggccgagtttgacaccttctaccttgtcaccgtctatgtccccaacaggggatgtatggccttcctctgtgcaccctgacatgctgccagggattgggttgaagaccgagcgctcacctcccagccccactcccccctccctcggcagcggggagggactgaagcgactggagtaccgagtgggcagctgggatgaagtgtctgccataccgatcaatgatatggcgctcacaatcctaaagccctccctgacaattcattcctcgcactgtcctcannnnnnnnnngttcacccagcccttcctgacaattcattcctcgcactgtcctcacaatctggtgcagccttctcgtccttcatcaagaaacttgaagcacggaaaccggtggtcgtgtgtggggacctgaactgtgccaggcagagcattgacatccattcgcccaagaccaatctgaggagcgcgggnnnnnnnnnnnnnnacaggcctggccaccatgtaaatacgcccttcacacctcacattcacgacaaaacacacaactccaatcattcacaatgtctgcaggaagagagagactccttccagcagcgatacatggatgctggctgggtggatgccttccggaccagatatccagagcacaccggatacacctactggtcctacaggttcaacctgcgagcccggaacaaggggtggagactggactacttcctggtgagtggcaggagagtagtgaagggtggggtgggtcagtggcagcctgtggccgtctgtctacgatgttttccatctgcacgatgttatgggttcagaccattgccccctcggtctgaccgtccgtctcgacgaggaaaagggaggatgatagccatacgggtccggtctgctcggaattccctccatataataaggtattgtcctttcaaatcagaccatcgctggggccatcatcgggccgacatggggctgggtttagggcatggtggaatcctcgtgcttttccatcttaaccagcttcgtggcgtctacctgaacgcgaggcgcacacagcagcactgcacattccccgggaaagtctccggaaccattttctga

SEQ ID NO: 7426 - DNA, 1842 bp, Chlorella protothecoides
  modified_base (519)..(528): a, c, t, g, unknown or other
  modified_base (1179)..(1188): a, c, t, g, unknown or other
  modified_base (1623)..(1632): a, c, t, g, unknown or other
atggtgacaactcgtgctcgtgccaaacgcgtgaggaaaggtgatgacactggtcagtcagatccagcagccaaggccatcgccgagagatcgggtgggtctcatgactatcttgaaatgtcacccgagccaatgtcgacctgcccaactgtgcatctacctgctatagggtccagtgcaaactcagaggggaacgatgctggtagcggagatcaggggcttaccaaggcatccagccttgatgaagcaggcccccagcatcccagtataccaccggcaggaggcagccctgatgcagacctccaggaaaaggtgggcactgatgtggctagcgaagagcctgccgcaaagcaggcaaagaccagccatcaaggggatgcatcggagtcgcgctcctcaccagagcacaccagccccactggaggggaccagagccaggctgagagtccgaaaggcacaacaaacaacagcagttctggggacgtgccagctgacagcaaagatcctgtagagtctggnnnnnnnnnntcagccccactggagaggaccagagccaggctgaaaggtgagactttcgcggatgagatcctgcttctgaccggcaacgttggtctagaccatgttgggaaacttgaggatgtgcagaggttctacctcctcctggagcctagccagcctgggtcaaagtcgaggctcatcgtgattggcaagaaacgtctgccagccatctccaatcacgagattgcttcgcattgggtagtgagccttgtagactgtgcatgtcctgcacagctggcctggccgccaccactccgctccctgacaccccagaggtattttgcatttgtcgaggcggtggccgaagacaaggggacactgcttcaggtactgcatggtgtgggagcagaggcaggatgcttggtcggcagagtctcccgcgctgatcaccacgattgccctccttgttgccgcacagggcatgggggtccagcggtaccagactacgacgatgggggagagggtggtgggtgcctgccgggctgcaggggagggggcctactccattctggagcatggctcgggcaccaactttgtgtacaggactggatgcctgtggcatcggtcgtgatcattgagacagccagcattcctgctcaaactcccgaccaggctggagcnnnnnnnnnngttgggggagcactcctgctcaaactcccgaccaggctggagctgcctactgagcccggcgaagcccagagaatgtgtggcatcgagctggaggggtcctttgggctcagcgtcaaggtgaagcctggtcaggcatgctgtgagcattcctggtgcgagcttgtgttggaccagatgattgctggcaggagcatgacagggagcacagccgggctcgcggtgggcctgaaggagaaggctgatctcccagaggcactggaagacgagttccaggggtatgcctggattgctgccagggaccccaaggtgaggatccatctgcagagggctgtgggtccatggctcctatcgttggtcgcacgcatcgctttcagaagctccatgtggcaccaaacaccagtcactggcccccattattgcagcttctggattatnnnnnnnnnnattggtggcacgcagcgctttcagatgctccatgtggcaccaaacaccagtcattggcccccattattgcagcttctggattatgagcgggtcgaactcttgttcgtgggggcgtcaaaggacttggctgcagagctgggtgagtgtgtagggcagtttttgctgtacagtcgaggggtgatgggtccactcggcataccctgtgtgtaa

SEQ ID NO: 7427 - DNA, 2031 bp, Chlorella protothecoides
  modified_base (911)..(920): a, c, t, g, unknown or other
  modified_base (1439)..(1448): a, c, t, g, unknown or other
  modified_base (1502)..(1511): a, c, t, g, unknown or other
  modified_base (1610)..(1619): a, c, t, g, unknown or other
atgtcaggcaaaggttatgccatccgaacacgtccacgtcattccactgtgcaggagattggactgcagattgagcctgcagagacaggggaagtgtccggcttcagcactaccccacatgaggcttcacgtgcacgtgcatggcatgaggccttcgcgatgtgggcgttcgccctgcagctcctcatgagcgtctcggcagatctcgagggatcactggcttacacatcctccagacatgacagctatgtggaagagctcaaggagattgacatcatgcacgtgtcgcggcaggccttcgcgatatgggcgttcgccctgcagctccttgtgagcgtctcggcagatctcgagggatccctggcttacacatcctctagacatgacagctatgtgaaagagctcaaggagattgtctccattccctcagtgtctgcccaatccgctcaccttcccgatctattggaggcagccgattgggtgaaggagcgtctgctgtctgctggcctgcaggatggaaacctcgtgatccctctggctcagttgtgcacctgtttggaggggaggggggccaaatatgggggtacacgccgcgggccccccccccaaggcgaggcttcaacctctgcgctacgacccctcttggcccccgccgtcctgcagatgacgtccagcccccggaacccctcgacaagtggacctccgggccattcgaccccgaggagcgggacggcttcctgtacggccgcggcgcgtccgacgacaagggaggcttcctggccgccgtgcaggcgagcggccgggtggcgaccacacaggatgcggcgtgccgggggccagtgcggtgcatgctgctgtgatgtgcgttgcgccgagccatcacgacgtgggcactgcgacgcgccgcaggnnnnnnnnnngcagtgcagtgcatgttgctgtgatgtgcgttgcgccgagccaccacgacgtgggcactgcgacgcgccgcaggcggtggaggccgtgctgcgcggcggcggcgggctgcgggccctgaatgtcaaggtgctgatcgagggggaggaggaggtcctcagcccgcacctggaggacttcctggccgcccacgcctcgctcctggccgccgactttgcgctgtcggccgacggcggccaggtgggggagggccgcccctccctgaccctgggctaccgcggcgcggcggggatcgaggtccaggtcgacgcgctggcgcgcgacgtgcactccggcatgtacggcggcgcagtgcagaaccccgtgcgcgcgctggcccagctcctgggctccatgttcaacgccgacggctcggtggccgtgcgcggcttctatgacagggtgaggcccattacacaggctgacagggacgacatcctggcctacaactacgacgaggacgaggagctgaagggcggggnnnnnnnnnngcagctgccacccttgcttcctgccccgatgcaacccctccgttccacagggtnnnnnnnnnncttctcctcgctggagcgcctctggctgcggcccacgctggagatcgtcggctttacgggtggacccaccccacagcctggatcatccagaacagcagnnnnnnnnnnagggtgggtaagggcatggggggttgaacgcagggttgagggtggagaggtgatcgggatcaaagaatgctggtggtcattacgcaaggctagagtggtggagtggaatgtgtaccgcatgcatgtgtggacatgcatgtggaggtatggttttgtggtctacgcagaccacccccacagcctggatcatccagaacagcagtccggtgtatgtacacggcgttgcatgaggtcaagggggccgttcgatcttgtatgccctgcagccacatctgctttcattttcacccctccttctctacagcccgggcttgcttgcaactccatacttcatgcccccccccttccccccttcccctcctcctccttcctctcctcctctggtagcgctcaatccccttcgcttctctga

SEQ ID NO: 7428 - DNA, 1431 bp, Chlorella protothecoides
  modified_base (719)..(728): a, c, t, g, unknown or other
  modified_base (840)..(849): a, c, t, g, unknown or other
atgcgcacatataccgcatgcattgccatcagctcaatatcgttgattcgaaggtctccggcaggcgattccgattcgcgcgcgctccatatcttcctcctccacagcagtctatcgcgagaatgttccttgtgcgtcgctccatccacttttgcattcatcagccaatccgactttaaccctcgtgtatgcccaagagcggaaggcgttaaggcagggaaggactctgggcctcagacctgtagccgcgctgcgccaggcgccgaccaccgccgtctgtcgaggagcccttaccccaccagcgagtgctgcggcggcatgccgagtgcatgtgtctaccgtgccagcctgcacgccgtgaagcacaggccgcagcccctgctcgcatggactgcaaggaggttccggaccatagcgcccttcaccgcattccccacacccgcacgccccagactccacgcctcggcctcatgcgaggcggtgtcaggatggaacacgtcctcccccagcagcgcccccccttcgcacggcttctccagtaacggggggagtgaccctgacaccaaggagagcgcagcaccctttgcagggccgcctgtttacgtcaaagcccctgggcgcatcgtcgccggtgagctggctgggggatttgggtcaatgtcttgcttgcattccctttggaaacggggagccagggcatggctggacctcgcaagcgnnnnnnnnnntcaggccagtggccagcgtgatctgcgccttcaaccatcgctgctgcgtggcccctctccaccaagaccctcaatgagcaatcacaacaataattcttccacgcacacccannnnnnnnnnggtgagctggctgggggatttgggtcaatgccttgcttgcattccgttggaaaggggacagaaatcatggcatatcaggccagtggccagcgtgatctgcgcctccaaccatcgctgctgcgtgccccctctccaccaagcccctcaatgagcaatcacaacaataattccccctcgcacacccacaatgcgcgccccccccctcccccccatatccgcgcagtgggcgacatccacggcgacctaaacaaggcggtgtccagcctgcagctggcaggggtgctgggccgggacgaggagggccgcgcgctgtggacaggggctgacacgacgctggtccagctgggcgacgtcctggaccgcggcgactgcgagatcggcgtcctgctgctgctccgggagctggaccggcaggcccggctggagcagggcgcggtgtggatgctgaatggtaaccacgagagcctgaacgttgccggcgacttcaggttggcccgggggggggcgacaaggagggtcggggaaaggaagaaaaagaggttatggctgggtgagcaacagtatggtgggtgcggcgcatga

SEQ ID NO: 7429 - DNA, 1488 bp, Chlorella protothecoides
  modified_base (183)..(192): a, c, t, g, unknown or other
  modified_base (431)..(440): a, c, t, g, unknown or other
  modified_base (825)..(886): a, c, t, g, unknown or other
  modified_base (1379)..(1388): a, c, t, g, unknown or other
atgcgccagtatttgatgatcgacgtcgaatgcgccacgcagggacagcatgcgggcagcaggcccttcctcacttggaaatacgagccagagcagagtccgatccaccatgtgagagagcgtgctgatgttgagaatcaaacgcgcccattgccgatgctgattatgaaaggggctccacannnnnnnnnnggggacagcatgcgggcagcaggcccttgctcacttggaatacgagccggagcagagttcgatccaccatgagatcctcgcaacccatctgaggaggggctcgcggctcctgctctcacacgagggacagtgcccatgttcagcagcaggacccaagggggtgtggttgatcggtccctggtgcgaccccgcgttgaggtacgatgcgacagggcaccctgtcaacctgagcacctttnnnnnnnnnntgatgagacgctttatttgagacggctcaggtctggtctccacagacgattatgcctccccatcgacaagcccacaggtcaacctgagcaccttttcctacctgttcagcgagctcatccatacctcgcctttgcactgagtcggctgcccgccctgggcgacgtctcctgctgtggcagcacatggagcttccccatcacactccgcatgcacaggctggacattgtgggatttggcgtgggcgtgcgcctgctggagctgctgagctatcgcgagcgcagtagccgccgcgacctgaagctgctggatgcgttgcgattcgtgcacaccacgctttggcggtacctctttggccgccccgccaaggacctggagcagagcaannnnnnnnnnnnnnnnnnnnnnnnnnnnnnnnnnnnnnnnnnnnnnnnnnnnnnnnnnnnnngcccagttgccgcgatgccttctgagccagagatgggcagatgcgcaggaatccaaccgccaccttaccccatggacccttccccccttccctctcaggctgaggacgagtacatgatctccgacgtcgacctctttatcaccaagtacatcagcgtgcccaaggagatggggcacctgaactgcgcagcgttcgtggcggggatcgtgaggggcgccctggatggcgctggcttcccatccagcatgttactgaggacccaccacttctactcacgattgcagggttacagcccacaatgtggccgtgccggggcagtcgcaggccaagaccacgctgctgataaaattcgatgccttggtgctgcagagggagcagcggctgccctccagctgaggagaacagggcaggacggagcgcaaaccctcacaactctccaacaaaagggggtggaatctcccaatgcaccccgcgcgcgcgcgcccgaaggcgnnnnnnnnnntagaacagggcaggacggagcgcaaaccttcacaactctccaacaaaggggggtggaatctccctatgcaccccgcgcgcgcgcgcccgaaggcgcctag

SEQ ID NO: 7430 - DNA, 4029 bp, Chlorella protothecoides
  modified_base (273)..(282): a, c, t, g, unknown or other
  modified_base (3582)..(3591): a, c, t, g, unknown or other
atggaaaaaggggaaatgggggcagtgggtggcacagctgatgtccaccccgcccctgcagggttgtggagggaagggctctcgacacccctccccgctcagcacagaaacatgggtgcatgccgcatcgtcatggtactcttctctcggcaggctctgtccaggcctgccgtgcacaccccccggcgagtgagggccatgtggcccaccaaggcctcgccgacgcacgctggggccctcccgctcaggccttcttggggaagtagtcctggnnnnnnnnnnggggccatgtggcccccaaggcctcgcccatgcacgctggggccctcctgctcaggccttcttggggaagtagtcctggagcgggacctgctccagggccccctccttgagggcttgcagcgcgcccaccgtcgccttggcgccggcgatggtggtgatgatgggcaccttgtgcgccagcgccagcctgcgcaggtccctgccgtcgcgcacgtcggcctcgtcgcccgtggaggtgatgatcatcatggcgatgtcgtcgttgcgcaggaggtcagccgcggagggcctgccctcctggatcttgagcacgctggtgacgccgggcacgcccgcggcggtcaggtgctccgcggtgtgcttggtggccaggatgccgtagcccatgtcggccagcaggcgcgcgctgggcacgatggcgtccttgtacttgtcctccatggtgatgaagacgttgcccgaggcgggcaggcgctggcccgccgcgatggccgccttggcgaacgccttggcgaagctgacgtcgatgcccatgacctcgcccgtgctgcgcatctccgggcccagcagcgtgtcggcccccgggaacttgtcgaagggcagcactgcctccttcaccgccacgtggcccaggacgggctcggcggtgaagccgatgtcggagagcagcgcgcccgacatgaggagcgacgcgtacttggccagcgggtgccccacggccttggccacaaagggcactgtgcgcgaggcgcgcgggttggcctcgatgatgaacaccttcccgtcctgcaccgcgtactggatgttgaggaagcccaccaccttgagcgccttggccagcttgggggtccagtcgcggatgacgtccaggcactcctgagggatggtctggggcgggatggtgcaggcggagtcgccggagtgcacccccgcctgctcgatgtgctgcaggatgccgcagatgacgacgttgccctcgcggtcggccagcgcgtccacgtccagctcgtcggcgcggtccaggtacttgtccaccagcaccggccgcgcggggtccacctccacggcggtggtgatgtagcggtggatgtcagcggcggagtgcacgatctccatggcgcgcccgcccaggacgaaggaggggcgcaccatgaccgggtaggtcagccgctccgcgatggccagcgcctgctcctcgttggtcgccacgccgccgggcggctggcggatggacagccgatccagcagcgccatccagcggtcgcggtcctctgcctcgtcgatggcgtcgggggaggtgccccagatggacacgttgccgcgcccgctggcggcggggatggggtgcgcctccagccaggccgccactccggcggccagcttcagcggggagggacacacatgttgggatccgagagcgggcgtgagctgcagtctgagaaaccggtccgtgccccaaccctcccctcccagacatcccaccgtgaggggctcgaagtagaggcgggaggaggtgtcgtagtcggtggacacggtctccgggttggagttcatcatgatggtctcgtaccccgcgtcgcgcagtgcgtagctggcgtggcagcagcagtagtcgaactcgatgccctggccgatgcggttgggcccgccccccaggatgagcaccttgggctgggtggtggcctcgcactcgcactcgccgtcgtaggaggagtacatgtagggcgtggcggcctcgaactcggccgcgcaggtgtccacgcgcttcatggagggcaccacgcccgcggccacgcgcgcggcgcgcacgtccaggtcgctggctcccgtgcagcgtccgatctgggggtcggagaagccgcggcgcttcagctccagcagctccgtgggggagagctgggccagggtgcgcgtcttgagccaggtctcggcctcgtgcagctcctggagctgggccaggaaccaggggtcgatggaggtgtactcgtgcacctcctcgatgctcagcccgtcctccagcgcctgcttgatcaccaccatgcgctccgggttgggcacgcgcatgttgtactgcagcttgtccggggtctggcgcttccagttggggggaaggctccagccgtccagccccgtctccagcgagcgcagcgccttctggaaggactcctggaaggtgcggccgatggccatggcctcgcccaccgacttcatctgggtggtcagcacgggggcggcgcccgggaacttctcgaaggcgaagcgcgggatcttggtgaccacgtagtcaatggagggctcgaaggacgcgggcgtcttgcgtgtgatgtcgttgggaatctggtcaagggtgttgccgcaagccagccgcgctgccattttggcgatggggaaccccgtggccttggaggccagggcggaggagcgagacacgcgcgggttcatctcgatgatcaccatgtcgccgttggccgggttgatggccatctgcacgttggacccgccgcactccacccccatctcgcggatgatggccaccgaggcgtcgcgcagtcgctggtactccttgtccgtcagcgtctgggagggggccacggtgatggagtccccagtgtgcacgcccatggggtccacgttctcgatggagcagatgatgaccacgttgtctgccaggtcgcgcatcacctccagctcaaactccttccaacccagcagggactgctcgatctggacctgcaagcaggtggggtggggggggagagtgtgtgtagggatacgagcaaggagagatggagcccaccatgcgaggaacgagtctgcactgtcgcccggcatggagaccagactgacaacagagggcaatgcctggccccctccctggaacacgcgcacacacacaagcgcacaacgtgcctgggtggtcatggaggcggtgagcccggcgttcacaatctccttgaactcgtccatgttgtaggcgatgccgccgccggtgccgcccagggtgaaggcggggcggatgatgagggggaaggccccgatcttgtcggccgccaccatggcctcgtccatgttggtggcgatggccgaggcggccatcttcaggttcagcttctccatcgcctgcggggtggggagggcagggggggctggggtgagaagggggggcgatggaagcggcgcgtcgccgtcagacggttgtgttgtgtaaggccagcgcagggtgggcggagcaacgtagggcgacgtcgatgtcgggcggcgatggatttggcaaccgtgcagcacaccaggagccctacnnnnnnnnnngtgggagggcaggggtgggcggggcatcgtcaggcgacgggcggcgatggattcggcaaccgtgcagcacaccaggagccctaccttggagaagaggtcgcggtcctcggccttgttgatggactccagctttgcgccaatcagctccacattgtacttggccagcacaccgttctcagacaggttcttggtcaggttgagcgccgtctggccacccatggtgggcaggatggcgtcggggcgctcctgcagggttggatcatggcaggagtggggcgttgggggccttgcaaggggtctgtgcaagccatgcacagtcccagaaaacaagagctgccagggtgtttggtttgcagagtcatgagttggcaaggctcccatcccgatggtgcaatgtcatggcactcagagaccctctggtgcgacttcaacatctga

SEQ ID NO: 7431 - DNA, 1173 bp, Chlorella protothecoides
  modified_base (163)..(172): a, c, t, g, unknown or other
  modified_base (995)..(1004): a, c, t, g, unknown or other
atggcatactgcgcgttgggggacatcgtggaggtgcttcccaatcagtgctggaaggcagtaccgtgcacggacacgtcacctggtcagcatggtgctgtattttgtaggccttggcctagcggacgaaaaggatatcacagtcaagtgagaaaaggcgatnnnnnnnnnnccacatggcatactgcgcgttgggggaaatcgtggaggtgcttctcaatcagtgctggaggtcagtaccgtgcacggacccgtcacctggtcaggatggtgctgtactttgtgggccttggcctagcggacgaaagggatatcacagtcaagggcctggaggctgtgaggaagtctgagagggtctacctggaggcctatacctctgtgctcctagtacccaaggagcagctggaggagttttatggccgtccagtgatgatcgcggacagggagggggtggagatgacctgcacctttgctgacctgcaggaagccgacaccattctccaaggggcacaaaccagcgacgtgtccttccttgttgggacccctacgggtgagacacagtactggaagagctccaggcatcttctgtttggcactctgggggcatggactgccaccacacacacagatttggagctcagggcgcgcgcagccggaatcacagtgaaaacaattcacaatgcttccatcatgaatgccattggggcggcggggctgcagctctaccgctatggcgaggccatcagcatagtattctttacaggtgggcggcggggggcgggaaacctggagccgcatcagggcatgatgcttccagatagccgtcgcctttcgctcgtcaagacctggagacccgacagtttctatgaccgcattgccgccaacaagaagcttgggctacataccctgtgcctcctggacatcaagagacacttcagcacatgtgggcatggtggtgaggcagttggggttgagcacagtgatggcatgacctnnnnnnnnnnaaagctggggctacataccctgtgcctcctagacatcaagagacacttcagtgcgtgtgggcatggtggcgaggcgattggggttgagcacagtgatggcatgacctgcatgcacaataacagcagcagggcaaatgtcgctcaacgccttgccagtccatacacctag

SEQ ID NO: 7432 - DNA, 330 bp, Chlorella protothecoides
atgcaagctgcctctccaccacaggtgaaggagccatccctggaagccttgtgtcgaggcaagaagatctatgagccaccacgtttcatgaccatcaacaccgccgtcgagcagctgctggagattgaggcgaacaggggcgagggcgcctgcaccccggaaagcaaggcagtgggagtggcacgcattggggccgactcccagcagattgtcgccggcacgctggcggagctagtggaggtggactttggggcgcccttgcactcccttatcctggcaggggagatgcaccatatagagttggaggcatgggagcggcaccggttgtga

SEQ ID NO: 7433 - DNA, 1044 bp, Chlorella protothecoides
  modified_base (643)..(652): a, c, t, g, unknown or other
  modified_base (729)..(738): a, c, t, g, unknown or other
  modified_base (816)..(825): a, c, t, g, unknown or other
atggacgctgacgacgccactgtcgatttctatgccaagttgagcgcccgactggacgctgatcttcagcatgaagatggcgccctgtggctttgctcccccgtccgccatgtgccctccactcatgaggatgtggggtggggctgtggatggcgcaactgtcagatgctcctctcgagtaccctgaccagcgactgtcaggtgtggggaacatcctggcattcacaggggtgggccccagttgttcagcatgtccacaagacttggcatttgtgcttgctcacacccttgccgctctggtgcaaacattcccagcgctctcgttccctccctccacagagcaccgtttgcaaccaagtcctgtgccaagatgacggctccgcggcactccctgacatccccacgctgcaatgcctcttggaggctgcctgggcagccgggtttgacccggatggagctgcacagctgggtcacaaggtgcagggcgccaagacctggatcggcacaaccgagattgccgtcatcctgcgtttcctcggagttggtgcccgcatcatcgactttggtgtccgggcccattcaagggctggggcccctcctcatgccagtttttcctgcgatgcctgtggcatggccatcatcnnnnnnnnnncgtccgagcccattcgagtgctggggcccctcctcatgccagtttctcctgcgatgcctgtggcatggccatcatcnnnnnnnnnnccgggccgtttgagtgtgttcagtccccaccaggtagggggttggcgcagcatggagcctggccatggcaggggactnnnnnnnnnncagggcacctggtaccacagcttggtgctggacgactacgacctctgtgcgcggtgccaccgccagcatggaggggggccagttgggccgtttgagtgtgttcagcccccaccaggtaggggggtggcccagcatggagcctggccatggcaggggactggaccaagtgctgcgaaaccttgtcagctacttcattggcgcgcaacacacacttgctaa

SEQ ID NO: 7434 - DNA, 552 bp, Chlorella protothecoides
  modified_base (105)..(114): a, c, t, g, unknown or other
atggagctctcagcccggtccccacctgcaggttcagctgacaggactgccgtgcaactgctcaactgggcgcacacctacttcaccgagggagggcccaaggannnnnnnnnngctgccgtgcaactgctcgactgggcgcgcacctacttcaccgagggagggcccaaggaaggtcaagccaggggactcttgcgcaccagcaggccgccactgtaccttcagcaccagggccattccaggacagtcattggcctcttggagaatgctcaaggggctgctgtagctgtctggccggtgagccttgcccgtgaccgcgccctcgtgaccccggcaggagcgcaggctctcctagtgctcgatccagccgtgacatcctccgcgatgcacaaagcgctgaccgtcccaaagtattggcgtagcggcatgctcttgcagccacgatcgttgggtcaccctcaataccaggtgctacgattcgatagtacaggagctggtgtcccggaaagcgacctttccaaagtcatacttgcggcggaggcatttccctga

SEQ ID NO: 7435 - DNA, 1398 bp, Chlorella protothecoides
  modified_base (822)..(831): a, c, t, g, unknown or other
  modified_base (1335)..(1344): a, c, t, g, unknown or other
atgattggagatccttggtcagggtatacactgcgtcgtcagtggttttccagcggccagcatatcacaccaggttccctctcacgatttttgctactgattcctgcttctgcaggttgtgagggcatagtggttggactgccagtcatcagcagcgggaacctggcacggccctcctccgactctcagcagggccgaagatgccgtcgcttcgcagagcagatcgccgatggcgctttcccctgggacatccgtgtgtttctcataggaaagcctgcttggcacgctgctatcagcgcagctctatatgagcgaaacacaacgctctttgctttgaacgacatgaaggcctcgggaatgaagaaaaagaaggccttgcagatgaaggattcggtggctgcagctctgatgctgagcgcgttctacgatgctcccggagcctctgtgcacgttcccccgtccacgcggctcacatctgcgctaatggctaactatcccgagacacgttgtaaatggtggatggcaagagtttgtagtcttctgattgccgaacttctccatcacaaactagacgaatctggcaggagatctcccatgtggtgccgaaactcgacggcgctcgatgatggtctgaacggcgttgacataatggctaactatcttgagacgctttgtaaatggtggatggcaagagtttgtattcttttgattgccgaacttttccatcacaaactggaaaaatctgacatgacatctcccatgtggtgccgaaacccgacggcgcttgatgatggcccgatcattcaatcggcacccagcctnnnnnnnnnnaccccggctgtttcccgagagccctcgcatctcctaaggcccgatcattcaatcagcacccagcccgaagctgaggagctgaacgacaactctgatggcgagaccacccatcgacccgtcgatgacgcccgggacgcttcctttgacccagccgccagagacgttcccctctccctcgcacgggatctggccagcctcatgggcaccattggaaacatgacacgcgagggagtccgtcaaaagatagcctcaaaggctgagagaatgctaaaacagttgcaggtgggccattacatgaagtgcgccagctgcaccgcgacagaaaggcttggctggatgagcggggcaggctcaaagcgcaggcatgattgggggctggattcacacaggggcaaggaggttggaatggccagattaagcaatacagtatccggtggatggcgaacctcagtcacaatgagcgaggtgttgcttatcagaggaggccatcgactcttcttgacnnnnnnnnnncgcgacagaaaggcttggctggatgagcggcgcaggctcaaagcgcaggcatga

SEQ ID NO: 7436 - DNA, 273 bp, Chlorella protothecoides
atggcgctgtggggcacggagaccgaggagggcgtgcagctagacgatgccaagctgaaggcagccatccagaagcaggagcggctggagcgggaggcgctggagcaggacggcaaaaagcgtgggtacaattcgctctccgcggacgggctggaggtcacggcagaggatatggaggcgtaccgcctgaaaagggcgcgggacgacgacccgctcgccgccatcacgaaggcaaaagcggggccggcggcggatgggtatgacctggtgtag

SEQ ID NO: 7437 - DNA, 198 bp, Chlorella protothecoides
atgcagttcatgcccttcatccaagggccccgcaactgcctgggccagttcttcgcgctcctggaggcgcgggtgatcctgggagccctttgccgggaattcaacttccggccggtgcacccggaacaccagggggtgacgcaccccaccgtcatccctgtgggccccgtcaacggcatgcgaatgtacgttgactag

SEQ ID NO: 7438 - DNA, 186 bp, Chlorella protothecoides
atggcccacaagaccaaggactgcctggagaggccgcgtaccaagggagcacgctggacggggaagaacattgctgccgacgagaaggtgcaggacatccagctggcgggctttgatgcgaagcgtgatcgatggaatgggtacagcaatgatgagtgggtgaaggaagctgaaaggtgcgattga

SEQ ID NO: 7439 - DNA, 660 bp, Chlorella protothecoides
atgcggcaagaccccaaccccgacaaggatccctcccagaaaacgtttgcgggggacaactttgtgcgccagtccggcgccgtggcgggcttctcctcgctaaacgccttctcggtcaccgcctacgagcgcgggcaggacgtgcacctgcaagccaccccctcccaggccgaggccgccttccagcagttcaggacgcggaaggaggcgctggggcagagcagcaaggccgacatgctggccaagtatggcaacgctgcagccccgctgacggaggacgtcgcagcactgcgtggcagcgaggcctacgttgagtacgacgcctcaggccggctgctgaggggccacgaggtggtggccctgagcaagtacgaggaggacatccacccgggaaaccacacgtcagtgtggggctcctactggaaggatggacagtggggctacgcctgctgccaccagtttgtaaagaactcgtactgcacgggcaaggtgggggagacggcggccatggaagccgccgagcagctgcatcgcaacatgcagaacaaggtgcaggacctcgaggcgcgggaacccacctcgagaccccagggcacccagccaaatgtgaggagtgggggaagagtgtgtgctggagtccatgctggtgtagtatcttag

SEQ ID NO: 7440 - DNA, 645 bp, Chlorella protothecoides
atgcccatcccccaacagcatccatatacgaatcgctgcctgctgacaccccttgcacccccctccgccacccaggccgctacactggacctgctgacggggcagtgcgaccgccatgcaggcaacgtgtttgtggatgagcgcggccggctggcgctgatcgacaacgaccagatgcttggcgtgtggtggcagggcacaggctgcgccgccagctccatgttcctgcccggcacccagaagtttgccaagcatgaacgcgccgtggacgactggggacccgaggccccagcaacggagggggcgccgggcccttacccgctcaacccactcctggcctttgattaccgctgccatctggcgccggggcgccagggtctgggcacggacttcccggggcccctggccgcgtgcatgcgccggctggcggcgccgcagggcgccgcctgggccgaggcgatggggttcagcgctccgactgcgcaccagctggcggcgagggcaggcgacctgctcaggcacggcttcgagtgggtgctggagcagagcaggcaggccagcatcccgcgcatgaggtacccggtgccgccaccctgctgcgccgtggacgctgggggtcggtgccagtatgtgcagcggcgctga

SEQ ID NO: 7441 - DNA, 222 bp, Chlorella protothecoides
atgcagtggtcgtcaaagctggcactgacctgctttgcaccgacaaaggtggacgtctgggggcgtggagtcgtcgatcctttgcgctttgccaaggtggagaaggctgtgcggacagtgggtggcgggtccaccgggaccgtacggaatctacgcatccgcgaggacacagccaagtacctgctgaacctggacctcgactcaggtgagctggggctttga

SEQ ID NO: 7442 - DNA, 2955 bp, Chlorella protothecoides
atggagaagctgaacctgaagatggccgcctcggccatcgccaccaacatggacgaggccatggtggcggccgacaagatcggggccttccccctcatcatccgccccgccttcaccctgggcggcaccggcggcggcatcgcctacaacatggacgagttcaaggagattgtgaacgccgggctcaccgcctccatgaccacccaggcacgttgtgcgcttgtccagatcgagcagtccctgctgggttggaaggagtttgagctggaggtgatgcgcgacctggcagacaacgtggtcatcatctgctccatcgagaacgtggaccccatgggcgtgcacactggggactccatcaccgtggccccctcccagacgctgacggacaaggagtaccagcgactgcgcgacgcctcggtggccatcatccgcgagatgggggtggagtgcggcgggtccaacgtgcagatggccatcaacccggccaacggcgacatggtgatcatcgagatgaacccgcgcgtgtctcgctcctccgccctggcctccaaggccacggggttccccatcgccaaaatggcagcgcggctggcttgcggcaacacccttgaccagattcccaacgacatcacacgcaagacgcccgcgtccttcgagccctccattgactacgtggtcaccaagatcccgcgcttcgccttcgagaagttcccgggcgccgcccccgtgctgaccacccagatgaagtcggtgggcgaggccatggccatcggccgcaccttccaggagtccttccagaaggcgctgcgctcgctggagacggggctggacggctggagccttccccccaactggaagcgccagaccccggacaagctgcagtacaacatgcgcgtgcccaacccggagcgcatggtggtgatcaagcaggcgctggaggacgggctgagcatcgaggaggtgcacgagtacacctccatcgacccctggttcctggcccagctccaggagctgcacgaggccgagacctggctcaagacgcgcaccctggcccagctctcccccacggagctgctggagctgaagcgccgcggcttctccgacccccagatcggacgctgcacgggagccagcgacctggacgtgcgcgccgcgcgcgtggccgcgggcgtggtgccctccatgaagcgcgtggacacctgcgcggccgagttcgaggccgccacgccctacatgtactcctcctacgacggcgagtgcgagtgcgaggccaccacccagcccaaggtgctcatcctggggggcgggcccaaccgcatcggccagggcatcgagttcgactactgctgctgccacgccagctacgcactgcgcgacgcggggtacgagaccatcatgatgaactccaacccggagaccgtgtccaccgactacgacacctcctcccgcctctacttcgagcccctcacggtgggatgtctgggaggggagggttggggcacggaccggtttctcagactgcagctcacgcccgctctcggatcccaacatgatgtgctgaacgtgatcgagaaggagcgtcccgagggcatcatcgtgcagtttggcgggcagaccccgctgaagctggccgccggagtggcggcctggctggaggcgcaccccatccccgccgccagcgggcgcggcaacgtgtccatctggggcacctcccccgacgccatcgacgaggcagaggaccgcgaccgctggatggcgctgctggatcggctgtccatccgccagccgcccggcggcgtggcgaccaacgaggagcaggcgctggccatcgcggagcggctgacctacccggtcatggtgcgcccctccttcgtcctgggcgggcgcgccatggagatcgtgcactccgccgctgacatccaccgctacatcaccaccgccgtggaggtggaccccgcgcggccggtgctggtggacaagtacctggaccgcgccgacgagctggacgtggacgcgctggccgaccgcgagggcaacgtcgtcatctgcggcatcctgcagcacatcgagcaggcgggggtgcactccggcgactccgcctgcaccatcccgccccagaccatccctcaggagtgcctggacgtcatccgcgactggacccccaagctggccaaggcgctcaaggtggtgggcttcctcaacatccagtacgcggtgcaggacgggaaggtgttcatcatcgaggccaacccgcgcgcctcgcgcacagtgccctttgtggccaaggccgtggggcacccgctggccaagtacgcgtcgctcctcatgtcgggcgcgctgctctccgacatcggcttcaccgccgagcccgtcctgggccacgtggcggtgaaggaggcagtgctgcccttcgacaagttcccgggggccgacacgctgctgggcccggagatgcgcagcacgggcgaggtcatgggcatcgacgtcagcttcgccaaggcgttcgccaaggcggccatcgcggcgggccagcgcctgcccgcctcgggcaacgtcttcatcaccatggaggacaagtacaaggacgccatcgtgcccagcgcgcgcctgctggccgacatgggctacggcatcctggccaccaagcacaccgcggagcacctgaccgccgcgggcgtgcccggcgtcaccagcgtgctcaagatccaggagggcaggccctccgcggctgacctcctgcgcaacgacgacatcgccatgatgatcatcacctccacgggcgacgaggccgacgtgcgcgacggcagggacctgcgcaggctggcgctggcgcacaaggtgcccatcatcaccaccatcgccggcgccaaggcgacggtgggcgcgctgcaagccctcaaggagggggccctggagcaggtcccgctccaggactacttccccaagaaggcctga

SEQ ID NO: 7443 - DNA, 309 bp, Chlorella protothecoides
atggccctcctggtgacctggcagcagctcctcatcctcctggacaaccatggcctcctggccctgagccctgtccacaccgccgtcgcgctcagcctcctctggctggtgcccatgctgagcgtggggggcttcagccggctggccatcctttccaagctgggcatgctgagcgtgtgcatcgtggtgacggtggtctactccctcctggtcctggacccctcccgagaggatctgccgcaggtggttggctggagggtcgagaccggggcttgcgggggggtcacgcgctggcgtggggccgtatga

SEQ ID NO: 7444 - DNA, 1206 bp, Chlorella protothecoides
atgggtcctcggaccctcccgcaattggccagctggcatgccgctccacggctcccttccccttgcagaaaggctggtgcacacgctgggagtgaaccacgagtatccactgcacaagtgggtagggtcgccggtgctggcgtcgcggcagtgtggcctgtgaccgccattttggtcctaccagcactggagccatgcagctgccacatgcagcaacccctgctcaccctccctcaaacccaacgacgacacagggctgtatttgatggggacttgcacgccgtgcgccgcctcttgaaaggagtcaacccacccttggtccagtcattggatgcccatggcaacactgtgtgtggcgcagagaagaacgggaggggggggatagagggtgctgtgcgcccagaaagcacccgacggatccctgcctgtggtcctgcacccgtacccgccaaatcaccgcattcgctcctctccccttggctcgctcagcccctgcacctggccgtcatccggggaaagcgcgagattgtggaggccttgctggaggctggggcctcggtgggcgccaagaacatagcgcgctggaatgctctggatgaggccattgccttgggcaatggggagctggtgcacctgctcttcctgcagctgcggaaggagtggaagcaagagaaagcccagaagaaggagcggctcctggaggtcttgaaggagctccccgatttcagcatgaaggtggttggctggagggagtttgacatattggagcccggaagagccctggctcagatgagcaggatagtgtttggcggggctaggagttgcgggcgaaggctccacatccgggatcaccccaggacccagcttgcacctcacaccctcgcctcctgcgcactgtcggagtgctgccctccttgcacccgtgcttggcacggagtccttcaagattcacacacacacaagtacccccctccctcgcagctgaaatgggacctgggttctggcatgtttggcgtcatcctgcgccagtttgcgccggacgacacctacaccatcaccaagctgggcagccggctgcgcatcgatggcagcctgatggggctggaccgtggggccgggggcgtgctgccgcgctggagacggggcgccttctccctcctcatcgacgcggagcccagcccggcgccggtgagtccccagcggtga

SEQ ID NO: 7445 - DNA, 1296 bp, Chlorella protothecoides
atggtgcgccaagtgatccgcgtgccctactccgaggaccggccccgcctgaccaaggcggcccccagcctggcgggcaccctcccctgccctatcccccgctctgccatgcaccgggtgccctccctcctcttcgacatggacctagacctggagcacagccacctggcccgagtggccaccctggacgagacggatctggcatccacacgcgccgccatcctggcagcgctggagcccaccagcgatgccgagtacatggtgctgctgcacgtccgcttcgcgcgcgaggacgcgctgcgccgcggtagggccctcaccctggcctccctggccgaggttctgcaccggctggggtacggggtgcgcatccgcaccgccaacggcggcgggcgctgcggcgcctgcctgcgcaacctgcgccactccttcctggccgtgtcgctggcagggccggggacgccctgtgacctcatcgtcgaccccgcctttcgcgaacagttccagattgcgcacatgatggagcgatacaggagggtcatggccatggtgcccgaggaggtggtgctcccccccgctcgtctcgagaagctggtggaggtgctgtgcggcgagatgcagcgcgccttcagcgagaaggacctctccctgcccccctggcgcgccctgggcgccatgctctccaagtggcaccccggccagggcaagtccaaggacgtggcagtgcagccgcggagcaggggcgggggggggagcgccgcgtctgacgcccagcgccgtctgatccagtcgctgcagccccaggcagacgcgcaggacgcggctgccgcgattgacacgccggatgcgggggcccgccgtctgctccagtcgctgcagccccaggcagacgcgcaggacgcggccgccgcgatcgacacgcccgatgcgggggccgccccgccctccacccgcgcagacggctgccccgagtgcggctcccgcgcctgtgccacacacgcctgcccgccctcgttcctgggcccgcgtggcgacgaggaggagcacctgctggacgacctggaggccgacggggaggcagaggcgctcctgggttcgtccccgggggccatcgccacgccctcctcggccagcgacagcgagggcgactccccgctggtgcgcgcccgcacggcgcggcccaccccctccctccacgtcagctggggcctgggcctgggcctggcctcctcctgcagcggcagcgccctgggcgacggctcccaggcctcccgcagcgccctccaggcgcgctag

SEQ ID NO: 7446 - DNA, 444 bp, Chlorella protothecoides
atggatccccccccctctcagccgccccccgggcacgcactggcgcgctggacgctgccccaggctgtcggcatcttcgcggtttccctgtccgggcacagcacgctgcccgcgctgcgcgccggcatggccgccccctcccgcttcccggccctgctcaccgccgccttctgcgtcatggcactgctgtacggcacggtcggggcgatggggtactggtactacggcagcaccacctccgccctcatcaccaccgacatctcgcgggcggggccctggaccgacaccgccatggacaagctcctggcctgcctcctgctggtcaactgcagcaccaagtacccggccctcgtcctggtgctacaggcaagtgtggtttgtgtgagggcggggggttgtttgattgtgccacgaggagatggcaagtgtggaaaagaggtttga

SEQ ID NO: 7447 - DNA, 684 bp, Chlorella protothecoides
atggctccaggtgcggggaccaggcatggcgccctggtgccccttgccggcgggacatggccgggctttgcttgggcctggcaagggtgctggtcaggcgtggcgacaggctcgccatccccgaggactgcaaacatccacagtctattcttgaagcgcaacggtgaagcgatgcgaagccccaccgatccacacttcctccccgcaggcgacaagtccaaggccgtgaaggccctgaaggcggtgaagaagagccagtggaagaagacgaggaagcctcggtactccactagcttccaccgccccaagaccctggtccgcacccgggaccccaagtacccgcgcgtcaggtgcggcctggtgtgggctggggatgcggtggtgcaggcctggatggctcgcgttgctcctggccagcagaagctcgactctttcgcggtcatcaagtacccgctgaccaccgagtccgccatgaagaagattgaggacaacaacaccctggtcttcatcgtggacatccgctccaacaagcgccagatccgcgacgccgtggcgcgcctgtacgacatccagacccgcaagatcaacaccttgatccgccccgatggcgagaagaaggcgtacgtgcggttgacgcccgactttgatgcgctggatgttgccaacaagattggtatcatctga

SEQ ID NO: 7448 - DNA, 735 bp, Chlorella protothecoides
atgctcaactctgggggccgcttgcccttctcgggagccgcacatcagactgataccttgaactcccaacttcatggctccgattcccgacctgctattccccctcctgcgctgcagtccccctctggtgccccgtctctttgtatgtcacccaccagccctggcaccccgaacaccctgcagatcctctgcgccccctccctcctgccccgtaacacacacactcactcaacccccccccacacacacaaacacaggtacgtgacccctggcgccttctgggagtgcgccgtggctgccggcatctccgacgcggagctggagcgcgacccgcgcgccgcgctgcgcgcgcgctgggagctgtaccgccccggcggccgcatggcggtggacctggcggccaaccccaccgtgctggtggtgaacgacattgtgtttgcgcacggcggtctgctcccccaccacctggtctacggcctggaacgcatcaacgccgaggtggcggcctggatgagtggggcgaagggcggcgagccgggagcggccgcgccgctgccgcccttcctcgccatgggcgacggctcctccatcatgtggaacaggacctacggccgggagcagtttggccacggtgagcggcgtggaggaagttcttttgtttcgggtgtgtgtgtgtgtgaagaagaggggttggtgaagagaggatgcagcggagtgggcttaagcgtcgtctga

SEQ ID NO: 7449 - DNA, 537 bp, Chlorella protothecoides
atggcgtggaacccggacgggagctgcctggcggtctgggaggcgcccaccgcgggccacggcctgctggtgctcagcccggtgggcgaggtcctggcacggagcacctcgccgggcgcggggctgggcatccggacggtggcctggtcaccctccgggcagctgctggccattgggagctacgacggggaggtgcagctcctgagcagctacacctggcagcggctggcgtcctttcctcaccccggggcagtgcaggggccagttggcctggtggcatactcggaagtggaggaggagaggaccgtcctggggccacggaatggtgtggccggagtcagtggcccggcatctcgcatcccacgctccccgccgtccaaggacggggagggcgggtggagggaggaggaaccgatgacgagcgcgtgctgccctcagtcgacaggcgaggcttgcttgggaggggccaggggggaggactttggcgttgcatggtgggtggtgcgtccatcccatggcacatgcctggccccctga

SEQ ID NO: 7450 - DNA, 450 bp, Chlorella protothecoides
atgagcacagcgcccaaggcggcacagccgctgtgcggtcgggaggccggagcaggcttctctctcgctccgcgtcctgccctggccaggccgcatgcgggcctcagtcggcctgctccattcaggggaacccgcctggtagtaacctcagtgtcggctcccgagaaggccaactccaccacgcccgctgcggagaccaccaagccgccgttcaccgcctgggacacggctgtgcagcgcgtcgccaagcgtaccgacatcaagagcgtgctggtcttgggcgccggacccatcgtaattgggcaggtacgacccgggcaagggttcgcgggggatatttggggcccaaaccctcgaagcccagtgctcaccatgccgtgcctccctggcacgcaacaggcctgcgagttcgactactctgggacccaggcgtgcaaggctctcaagtag

SEQ ID NO: 7451 - DNA, 831 bp, Chlorella protothecoides
atgtttccgttgctcaaggatacccaggtttccacatcgccgcgcacacctccaccggtctgtaaagacggcctgggaaaccatgcaggttcatgcaagcggctgagcggcttcacagacgctgcgcagaccgtcagtcgtgcgtcggtgcgccggctggctcgcagggcaggggtgaagcgcatcggttccgagttctactccgatgcggaggggagcctgaggcgctttttgggcaccctcgtcgaggacatcggcgtcgtgacggagcatgctcgtcgacgcacggtcacagtgggcgacgtgctcctggtcctcaagaggaatggcaggaccttgtatggcttcgaggagaagcagcgcaagaggcggctcgtccagcggttgcctccccactccctggcggagtcgatggcccgcgtctgcagtacaagttctgaggcacagggcgaggcgacgagcaagtcagcctcgatggagcgtggtgcaccgactcagcatgtcacaaggcctcccgcagaggtggccgtggtagccatggccgggagcaagcccacgtccaacggctcggagccaggagtgccacagacacagctgggtccccgcacccctggccccatgacaccacaccgcgctcaagacatccagatcgggctcagcaccttcagggacagcgtgctcgagcgccaggcgcgcagctgcgcccccgtctcgcaggccctggagtgggtctcggccgagctggcgcggacagggaagggaccctgctcgcggacggagtttgaggtagggaaaggggtttggcttgaagggtgcgagattgatccatga

SEQ ID NO: 7452 - DNA, 471 bp, Chlorella protothecoides
atgttggtgcaccgcctggtccctccccaccccgccccactcccctcccctcccctcctccatccacatgcaggcgaccgccaggcgatggaggagcagctgctgagcacgctgcgcgcgctgcgcgcacgcgccatggtggtcggccacacgccccagacgcgcgggctgaactgcgagtgcggcgggcgcgtctggcgcgtggacgtgggcatgtcggccggcgtgctggacgccgacccggcgatcttggagctctccgcgccggacgagcggggcctggtgacggccacggccaagaaggcgccggggaggtggtcggcagccgccatgcgcggggcggggctggatgacggcgtgcaggtgcggcgctggagcatcgggcccctggcgcagcaggaggagggggcgggcgtgggcggcggcggcgccgacgagcccgcgcccgacgcacccctgtcccggctgtga

SEQ ID NO: 7453 - DNA, 813 bp, Chlorella protothecoides
atggagggtgacgagaggccgctgtacctgcctttagaccatcacctgcaccccctcgtctgtagtgcttgggaccagggtggaggagcgccagaacgccgcgcatgcgttcagcatatggttggtggattgggctctggcctcctatgcccatgctgctttgaaggatgggggccgttccaccacagtcgcttctacgccatccacgaccccagcgatgccacgtgccttgcctcgacgcggaccgacttccccttctccccctcgctccccctgatcaagctgcccgtcgcctcggtggcgcgcgcggtgggcaacctggccaccgcatggctccccggcctgaccctggtgctggaccaccccaccccggcaaccgccgagaagctgggcacgtgggtagaggccctggccgccgcctggtcccacctgtcggagggccccgccgccgcgcccgccacggtgttgatcccggggctggagcgaggggccgccgcccacacgcccggcgtgtgggcgctgctcagcatggtcatgggccgggacagggccgggcccctgcccacgctgctcttcttcgacgacctggcccgccttccccccggcctctggctgggcctggagcatcgccggcagcgtgggtggttgtttgggcgggagttccctgatccagcacgccacggcatggggggctgcggggagagcgcgtgtgccgatcacaacttggccctcagctgcggggagcggcggcaggcggtcgcgattcagccggccctggccgagccccaacttcatcgacagccaatgcgttag

SEQ ID NO: 7454 - DNA, 1041 bp, Chlorella protothecoides
  modified_base (220)..(229): a, c, t, g, unknown or other
  modified_base (846)..(855): a, c, t, g, unknown or other
atgtcggtatgtacatgggtgggaggggggatcatatcatcagcgctggagcccacagaccaccgacggcagcatttcctccatccctccgccgcccgcacctgtgactgccctgcctgtctggtccccgcacgccaccgccaacctctggcaaggtcccaccacccctcacaccctccaccccccaccccacaagcaacaggctcgctgcgcatcaatnnnnnnnnnntggagcccacagaccaccgacggcagcattccctccatccctccgccgcctgcacccgtgactgccctgcctgtttggtcccggcacaccaatgccaccctctggcaaggtcccaccacccctcaccccctccaccccccaccccccgagcaacaggctcgctgcgcatcaacggccggtcggtgggcattcccgacctgcagagcgtggttggctttgtgccgcaggaggatttggtgcacgaagatctcacagtgcgtgagaacctggtgtactccgcgcgcctgcgcctgtccaccagcaagccccgccaggagcagatggacatcgtggacgacgtgctggatgtgctgcagctgcgccacgtccaacaccaaatcgtgggcagcgtggagcggcgaggcatcaggcgagcggtggtgggggggggaggggcgttgagcatgggagtggaacaccccttggggattcgggtcaaggctcgggccgggcacagggggtctctggtgcaagatggtttggcgcggtgcatggctgaagagcgctgtggtggagggaatggcggcgtcttgacaggcctggagttaagcttgccttgcagcactgctccgtatcgnnnnnnnnnncgtggagcggcgaggcatcaggcgagcggttgtggtggggggaggggggttgagcatgggagtggaataccccttggggattcgggtcaaggcttgggccgggcacagggggtctttggtgcaagatggtttggcgcggtgcatggctggaagagcgctgtggtggagggaatggcagcggcttga

SEQ ID NO: 7455 - DNA, 813 bp, Chlorella protothecoides
atggcgggccttggcatgaacgtcatcgccgtgctgcaccagccccgcttctccatcttcgcgctcttcgacgacatcatgctgctgggcaagggcgggcgcctggtgtatctgggcccctcctggctggccatgccctacttcgagtcgctggactttgagctgccactgcatgagaaccccgccgactttgtcatggacgtgatcagcggcagcgtgccccagcgcggctgcgacgccttccaccccgagcgcctggtggggctgtggcagacctacggcctcagctgggtgcgcacccagagcaagctcatgccgctggaccccacctacggctcgcgcccgccggagcagctgcgcatcgaccccgagcagtttgcgctgctgagcgagcagttcgatgcggcggacgccgacggcgacgacgcgctgcgcgccggagacctgcaggtcctgctgcgcgcgctggggctggagcccagcacactggacatccagatgatcatggcggagctggccatcccgcgcaccggcctggtcagcaaggaggccttcatgcagtacgtgcagtacggcggacgtccgcccgcctccgcgcccgacggcccgccctccgcctcgggccggcgcgctgtgcagagcatctaccgcgtgtacagcatcgagcagtacacgctgtcggcggccatcgcggagctgtccgccgcggcactgccctccggcctgcgccccgccggcaatcttaaggagctggccagcgcggtcgtggcgggcggcgagctggggcggagccgcggcgggcgcggggacgcg

SEQ ID NO: 7456 - DNA, 1074 bp, Chlorella protothecoides
  modified_base (957)..(966): a, c, t, g, unknown or other
atgcagtcatccatgcaaccaccaccagatcagcaggagcgtcactctcgaagtctgacttacaaaacctcctcgaccgccccggcgccgcggttgccaagtgcacgtttaccgattacatctgccgcgccaccaactcctgactatactaggcagaattattcactgaaatacgccgccttgaggatggtgaagaagcggaggcagccggacgtctaccacaagcagaatctgggcgatgagctcgagaacccagaaaactttggcgtgcggcctcatactctgcccaggcaaatccctccttcctcacgcccctcacagaccaagccccggggccagaagaggacaaagaacggcgacaatgaggctgctggctacaacagcgccgatgaggacgttgagcagagcctgccagccgacatcagccaccgcatcctgagggtggctcgtgaacaggccgaggagatggcggcggtggggtccggcgagggcgccggcgtggcctccaatgcggcctcgctggcagccctgcgtgagtctgacagcgacgatgagggtggcttctccccgggtcccggcagtgcctggggtgacgaggatgatctggatcaggaggagatcagccccgaggatgaggccgcgctggccgccttcatgcgccccgccggcgcaaaacagaagaccctggccgatgtcgttgctgaaaagcttggccaggcaggcggcggcaccggtgggaatacaatagcagatgcctggcctgtgaagggccgaagtgaattgcacgatctgcgctgcgctgtcgcgcatgtgggcagcctcaacctgcatgcagtcctagtgcgaacgctactagcatcccccctcccgctccctggtatccacatcgtttactgtgcactcagaaccctcgctttggctctgcccccttgttcattggcgatgtcccccccatannnnnnnnnnctcccgctccctggtatccacatcgtttacagtgcactcagaaccctcgctttggccctgcccccttgttcattggcgatgtccgccccatgcctgcgagcagtatga

SEQ ID NO: 7457 - DNA, 1023 bp, Chlorella protothecoides
atgggccctactgagagggacatggacgcggatgacgaggtccccatggcagtctctttgacggagcaggctggcaccactcgagccacgagggaaatcccatcatatcgacagaatctctccctggatggcccactaaaacctgtgcctgtcacgctcatcaccggctaccttggggcaggcaaaagcacgctgatcaacaggattctgaacacacagcatggctaccgctgcgccgtgctcatgaacgagtttggggagagtgctgatgtagagagggccctgatcaaggagccagagggtgaggaggcaagccccctggccaactgggtacagctggagaatgggtgcatctgctgctcagtgaagaatgacatggtcaaggcgctggaggcgctgctccagcaaagggcctccttcgactacatcctgatcgagaccacaggcctggctaacccaggcccggtggcagctgcactatggacggatgccgagctggaggcaggggtatgcctggatgcggtggtcaccgtggtcgacgcccgcaatatacgccgccagctggcagatcccccgggggagggtgctgaggtgtgcgaggcggccgctcagatagcatttgccgacgttgtcctgctgaacaaggttggtgctgctgatgggctcacgctggacagcaaactgggccccgtgcctcgcaccctgagtggctgggctcctgtcctgtcagccagccgtgccctggcgtcgattcaacgccggctccccatgtctcctcgcctcgcgccatcaggaggacctggtgagcgaggaggaactgcgggcggcgcacgccgagctggccggcatcaatggctcggccgccgtcctggcctgcgctcgctgtggagtggacctgaagtacatcctggacaccggcatatacagcggcacgggccggctgggcgtggaggaggaccccgacgcctgccgccccggctgcagcgacccctgccaccgccatggcgtgtcacacggccatga

SEQ ID NO: 7458 - DNA, 384 bp, Chlorella protothecoides
atggacaatgaccacaagaccctgccatccttccccggcctcaccttcctttaccccccctcacacctgcccctcaggctgacatctgaccccagcacccgagtcacacccgcggggctggacgagcggttggtggagatcttccggggcgtgggcgcgctgatgtcgcgctacaccgtgggcaagctgcccaaggccttcaaggtcatccccaccctgaagaactgggaggaggtcctggccctgaccgagccagaggcctggagcccgcacgccatctaccaggccacccgcatctttgtctccaacctcaatcaacgcctggtaggttgtaattgttctttctggcgaggtggagcctgggtccaagtggtgctggcatga

SEQ ID NO: 7459 - DNA, 243 bp, Chlorella protothecoides
atggatggcctgctgtgggagcggcatccgcacggaccagacctgttccgggtcaaggccgtgctttccttggccggcgagggtcggcgccacgtcatgcaggctgtgcacgacctgtacgacgtcgtgccggccgcaccctgggccgaaggtgaggcccgggccagcaagttggtgctcatcggccggcggctggaggaggggcctttgcagcgggggctggacgagtgcgtggcgagctga

SEQ ID NO: 7460 - DNA, 3759 bp, Chlorella protothecoides
  modified_base (238)..(247): a, c, t, g, unknown or other
  modified_base (549)..(558): a, c, t, g, unknown or other
  modified_base (657)..(666): a, c, t, g, unknown or other
  modified_base (806)..(815): a, c, t, g, unknown or other
  modified_base (1336)..(1345): a, c, t, g, unknown or other
  modified_base (2360)..(2369): a, c, t, g, unknown or other
  modified_base (2433)..(2442): a, c, t, g, unknown or other
  modified_base (2773)..(2782): a, c, t, g, unknown or other
  modified_base (3651)..(3660): a, c, t, g, unknown or other
atgccgtggaaggcggcgcgggcctcggcctccggcagcctcctgcccgcctcgagggacgcacgcgtcagcacgggtcccccctccgccagcgtcatgaccagcaggatcttggtgtgccccgggtcgtcaatcacctggggtgcgggatgggtgagaggcacgtcgcagggtccagggcggggaaggaggtggggggcacggagaagaaggcaagggggcgcatcgtcgctgcgannnnnnnnnngcgtcgcagggtccagggcggggaaggagggggggtgctcggaggagaaggcaagggggcgcatcgtcgctgcgacggcgccgcatcacccctcgcgatcctttcccgagccccgtggccacacagagcgccaccgcctcccgatggaatgccacgaaaccttcccccccccgtgggatcccacctcgtacagccggggcaggtttgggtggtgcaggcgcgccatgacctcgatctcccgcgccaggtcagcggccgggtctctgcgccggcccgagcgcgacaggccgccgcccggcggnnnnnnnnnnaagcgccaccgcctcccgatgaaatgcagcaaaaccttcccccaccgtgggatcccacctcgtacagtcggggcaggtttgggtggtgcaggcgcgccnnnnnnnnnnctgagtcagcacgtccatgaccaggaacacgcgcccagacacgccgcgacccaggaagcggaccatagcgtactggttgaggagtacagtgcccgggaggtgcatcatctccagggtcgctgtccgacggatggcggtgnnnnnnnnnnggcgtactggttgaggagtacagtgccctggaggtgcgtcatgtccagggtcgctgtccgacggatggcggtggccgcgcccgccggcggattggtgagtggggcgttcaggcgtgagttggtggaagtcttggggtccagcctcactcccgcgagaggcacatgggggagcgccatcctcgctactgctgctgctgctgctgctgaaactgccatcaagattgcaactgggcgtcctgaggggagaggggtggggaggtgcgctgtcaggctcttggagagcgcttcggatattcccagccgggcccctgtgcacagatcagagacccgcaccgacctctctgcttcagggaccgcagatccaggacggctctctgggaggggccgatcacagctcacacacgcccccatcccctgcgccaacagggagcagggtgctgcgcttgacatggcatgctcagtcaatcttgatccctctgactacaggtgccggcgcagcccaccatctctgaggcccaaannnnnnnnnncctccctgtgcacagatcagagacccgcacccgacctctctgcttcagggaccgcggatccaggacggctctccgggaggggccgatcacagcttacacacgcccccatcccctgcgccaacagggagcagggtgctgtgcttgacatggcatgcccagtcaaccttgacccccctgactacaggagtgcgcagcatgtaaacccctgtggcaggcactggggtggcagcagtctctggatcagagcgccctacttcaagttgcagcagcccagggggtgcctctcaggctgcgtgcatggtcgggtggctttgatctgtgcgcgatccaaagaatgcgatggtggaatggtcgctgatggtgcgagcgggccatgcggagcacacccggcactggctcggcatgattccaagatgatgagatccatacgcaaaaccaaggggcagacgggggtcccggtcgcccgggccgggctaggaattctggccatttccatcatcctgttcgcttatcaccaaggcaaactgtacaccggtcccgccgtcatcgtctacccttctgccgtgggcttggagggctccaccttccaactgtacaaggggtttccatacctgacgaccgccgatgttgtggtctctggtgtctcccatcatgcggtggcccctcgagactgcgcggccaaatgcgagaccacccccacgtgcacctggttccagtactgcgcctccaccgatcggtgctcgccacgctcagcgagtggggaggtgggcagagaggggaagggttgtcgtgaggctggggtggggattgccacggctatgccggctgctgcaggggggtttgaaaagcccagccccatcttgcacctccaccctctgaaaactgccgcagtgctggctgatggcaggcaacaccgacaaacttccacgaaaacgcttcaaaggtctgtgtgccacggggcgcgggccttgaaaccgctgggacgtgccgaggacgggtggctgaacgggatcgnnnnnnnnnntgttgtcgtgaggccggggtggggattgccacagctatgccggctgctgcagggaggtttgaannnnnnnnnntggtgtgatctgagaaatcccgcacaccccggtcactctgcagaggacgggtggctgaacgggatcgccatctccaccaagcagcacacggagacgcccaaggcaaaggctgcctcagcgaactccgacaccaagaccaaggcggagacgagcagtggcggtgccgccaaggcagcggaggtggtgcagtcctcggaagcagccaggagcgacgctgttgcgggtccgggtgccactgccaagcccgaggaggtcgcggcgggtgcgggggtggggcctgacgagaccgcaacgccccctgtcaagcctgccgaggccgcgggcggcaccnnnnnnnnnnaggcctggcgagaccgcagcgccccccgtcaagcctgccgaggccgcgggcggcaccgaggcgcagcaggggacttcggcggccgatgtcaccagccctgcgaccccggccgcagccaccgaccccgcggtcgccggcgtcggcgtgcggcccgagaaggtgccggagaacaccatggcgcaggagcagcccgcggccggcgatgcagcgggccccatcgccaaccagtcgatcatcatgcccgagtacgaggcgctgcgcaacaacgccaccctccccctggtcttcctggacgtcgcgatcaagggcgcgcccatcggacgcatggagatcgtgcttttcagcgacgttgccccgcgccacgccgagaacatgaggctgctttgctcgggggagaagggggccgtgcccaagccacgcgaagacgggcacaaggtgtaccacctgaaggtgcgcgcgctgtgctctgcgggacatgccggggcttgtatatcttgaccctgatcagggtcgatgccgctgccgccggcacccgggaccgctgcgaccctgcatgctgtgcagtggcgcagcggcagcaggctctgctcgctgcccatttgccgctgccaagccacttcatggatgctcctctctcccccctcccaccactgctcgcccgcaccatcacacagggcgggacgttctaccgcatcgtcaagggctggatcaaccagggcggcgcgaatgtagagtcggcctttgggggcacctttgcggacgaccccggcggcctggcgctcaagcatgatcacaaggtgcaggagggtggtgcctggcatgttaaagggaggtggggaaagctccatggggtacactgtgcaggagcnnnnnnnnnnggggtggtgcctggcatggcaaagggaggtgggaaaagctccatggggtacactgtgcaggagcttgtgtatggtaaccgctggtcgaggtggccgtga

SEQ ID NO: 7461 - DNA, 1104 bp, Chlorella protothecoides
atgagcgctctaaccccctttgtcccccaggacaaggcctggatgctggacgccgaccaggcggcgcgcaggggcgagggactggactgggtggtggcccgccgcctcgccgagtacgtggcagcgtcgtactgcaacacctccaacattgcggcgtggaactgcacccgctgcggcgacccctcctctgaggatgatcaatcgagcgggccggagtttgagctggaaacgctggcgtgggatgcggcctgggacctgctcgggtttgtgggctggagcaactcgctgcaggccacggtcatcgcctttcgtgggaccgactcccggtctatttataactgccagccgcttcaaggcttccacattgggtcgcctccaccccgacccccgtccacactaccctcaccacccaagatttctttcctgtcaccacccaaattcccctcccccctctacatcacgctccagggtgaccaacatgcgcacctggcgcaccgacctcaacctgactacgcccggcgcgcccgccaatgcgttggtgcacggcggcttcctcacctcctggagcggctcctccctgtcccgctcggtgacgcgcgcggcagcggcgctgcagcgccgccacggcccgcacccggtgcacgccacggggcactcgctgggcggtgcgctggccaccatatgcgccatggagctgcgcgcgctgcacggcctgcacgacgtgcggctgaccacctttggcagcccgcgcgtcggcaacgcggtgttcgccgcctggctgcaacgcgtggtgccggagcactggcgattcacgcacaaccgcgacatagtgccctccgtggcgccgccctacatgggcttctggcatctggcgcgcgaggtatgggtgctggaccaggcgggggcggccacgctggtgggcatctgcgatgctactggggaggacatccgctgccacaactcggtgtgccacctggggctgtgctcctccgtcgccgaccacctcctgtacctggcagagatgtacacgccccggcccatgggctgctgaggggggttgcatccaagggaagggggggcgaggcgactcgtgaggcggcctga

SEQ ID NO: 7462 - DNA, 2940 bp, Chlorella protothecoides
  modified_base (79)..(88): a, c, t, g, unknown or other
  modified_base (893)..(902): a, c, t, g, unknown or other
  modified_base (1219)..(1228): a, c, t, g, unknown or other
  modified_base (2911)..(2920): a, c, t, g, unknown or other
atgcccccccctgtagctgtgtctccggcgcaagacatacactgtcagccttcaagcctcagctgccacagacatgcgnnnnnnnnnnaatgtcacttccgggaattgaacccgggtttgcacgacttcgtacttcagatgttgaacaatgccaataacgcagaatatagaatggaaggggagttccgacctccctttccctcatcgtacgtttggccgagactggctgacatctccattgcagacttggcaagcacttcattaattaactatagatctgcggaagtttccttaagtattgacatgtatagactcggcttcacacagcctgctgatacgacaacgtgcaagagcatctcctcactacactaccatacgcccttgcttgaggattggccgaccgctcagggcagcttcaagcattgcctgaatcccgtcagggagtggcgacatgccagacactcagaccccggaggattgctaggcgcatggctgcgcgcagactcccccgtggtgtcgtcggcaagtctggcctgtgcatggccagtgctgccggcatggagctggcgccagcctccgcccccggcccgctgcaccagcaccgaggccaaggctcctgagagggaggctccgcagggcgaggcctctccccgtggcttcctggcggggggccactctgtggaggacttcccaccctcccacatcaggaacttctccatcatcgcacacgtggaccacggcaagtccaccctggcggaccgcctgctggagctgacaggggccatcaaccccggcgccaagcagtacctcgacaagctccaggtgaggagcgtgtgggtggttggggggttgagggggaggcctgcggaacggccgtcacccctgcaccccannnnnnnnnnaggtgaggagcgtgtgggtggttggggggtagtgtgggaggcctgcggcacggccgtcacctctgcaccccgcagcgctgccgactgtggtgtgtgctggagtatccgctcttctgcagtggccttccggcccactccactcacctcgtctgcctcccacttgtacccctgcccacatcaggtggagaaggagcggggcatcacggtcaaggcccagacggcgagtctggtgttcaaacacaagggcgagcagtacctgctgaacctgatcgacaccccgggccacgtcgatttctcgtacgaggtctcgcgctccnnnnnnnnnngcaggcgccatcttgctggtggacgccagccagggcgtgcagacggcgatcctgttggtcctgctccagggcggcgccattcatcagcaccccgcccaacccctctcttccctgcaccgtcccctcttgaccgaccgccacaccttcaggcccaaacggtggccaacttctggctggcctttgagcaggacctggccatcatccccgtgctgaacaagatcgacgcccccggggcggagccggcgcgggtcaccgcccaactggcggaggcctttgacctggaccctgccgcggtgctggcaatctcggccaagaccggggcggggctggaccgggtgctccccgccgtggtcgagcgcgtcccccccccgcgtggcgacctggccgccccgctgcgcgcgctgctgtttgacgcctaccacgacgagtaccgcggcgtggtgtgcctgctggcggtggccgacggcgccgtggcgcgcggcgaccgcgtcacggccgcagcggccggccagagctacgacgtggtggaggtgggcctgctggcgccggagccggtgcccacgcccagcctgcgcgcggggcaggtcgggtacgtgctggcagggatgaaggacacgcgtcaggcgcgggtgggcgacacctggcacgccgcacgcgcgcccgtgccggctttccctggcttcaagcccgcacagagcatggtgttcgccggcatcttccccgtctccgccgacgggcacgagcgcctggccgccgcgatggcccgcctggcgctgaccgacgccagcgtggcggtgcgccgcgagaactccaacgccctgggcgcgggcttccgctgcggcttcctgggcctgctccacctggatgtcttccggcagcgcctggagcaggagcatggcgccgacgtgctggtcaccgcccccaccgtgccctgtcgggtggtgcgttctgggggggttggatgcgttccttgtcttttgggtgggtggggggaaggttctgagagggggcacggctcctgggtgactccctctgccctggttgagcaaaggcatcctcgacccaactccaccatctccccaaacccaaccataggtgctgcaagggggcgagagcatcgagctgagcaaccccgccgacttccccaccgacgtgcgggtggaggcggtgtgggagcccactgtgcgcgccacggtcgtgaccccggaggagtacgtgggggcgctgatgcagctgtgcaccgccgcgcggggggagctgctcgaccacgtggtcctcgaccccgggcgcaccatgctcaagtgaggcgaggggggaatggatgggcatccttgctgcatgggagccatccatctcctgcccccactgcacgcctcgccactgatgctcaacacctagccgcttcccaaaggctcccttccgaacctgcctgcaccccacgtcacgacccctcctctctacacacatcaaattccccccccccctcgcccaccaccaaaaaactcccccttcctccctgtcttgaaaggtacacgctgccgctggcagagctgggcggcgatttctacgacgagctcaagtcggcgtcctccggctacgccagcctggactatgaggagggcgaagcgcggcgcgcacccatgcagcgcctggacatcctcctcaacggcgagcccgtggacnnnnnnnnnntacgccagcctggactatga

SEQ ID NO: 7463 - DNA, 642 bp, Chlorella protothecoides
atgtacctttcaccagcctctcgctatgggtgccagtaccttgagcatggcatgcgatacatacctccttctcggatacacacagggtcgaggcaaacctcagcacccctggaaagccctatggcggctgggaggcccccaccgtggaggttcgcggtcagttcatgggtcactacctctcggccctggcctttgctactctcaacacagaggttgctacctactcatgcgctagtagctcttggtccaccagaacgctccaaaatcatcgcaggccgtgaggacctggcacagcgtggtctgctgatggtagatgagctgaagaaggcgcaggatgcacacggcaacggctacctgtctgcttttcctcaggaacattttgatcgtttggagagtctgaagccggtctgggcaccatactatgtggattaccacccgtcttcctcccttctgccacgctctaccacgcagatccacaagatcatgcagggacttcttgatcagcacaccatggttgccaatccgctcgctctggggatggtggaagacatggcaaagtacttctgtaataggtgtgtcgagttatcatcttggcctcttgagattcctcgccatgttctctggaagacgacaatgggatag

SEQ ID NO: 7464 - DNA, 282 bp, Chlorella protothecoides
atgagcgtgccacgtggaccttgctccctccccgtcctgcgcgaggcctgggtgcatggggtggtggatgagaacacgctggtgtggggccagggcctggcggactggcttcccatccgcaatgtgcggacactggtccctcagatccgcaccgtggaagtacaactaggcacatggttcaagaagaactttgccctgcggcccgccctggaccgcatgcggagggcgagggtagatgcgcggagccccgacaagagcacccaggtggagaacatgtactga

SEQ ID NO: 7465 - DNA, 267 bp, Chlorella protothecoides
atgggtcccaacaccaacgagggccacttctccatcatgatgggcccctctccccacctgaacggcgggtacaccatctttggccaggtggtggcgggctgggaggtgagcgaggccatcaacgccgtgtcccatggccagccagaggacacagcgcacggcgacgccggcgtcgtgatcgtggacgcggggcagctgcgcaagggaaccattgtgcccgacctgcgcctcggcctgcctgccaacgccacggggtacaattactaa

SEQ ID NO: 7466 - DNA, 543 bp, Chlorella protothecoides
atggaacacgtcggtgggcacctccaccgaccccagctgtcgcatccgctttttcccctccttctgcttctccagcagcttgcgcttgcgcgacacgtccccgccgtagcacttggccagcacgttcttgcgcagcgcgcggatggtatcccgagccacgacgcgcccccccgccgccgcctgcacggccacctggaactgctgctggggcagggcccccgccagcgccgcgcacagtcgccgccccagcggctccgcgcggtcgcggtgcacgatgcgcgccagcgcatccacgggctcgccgttgagcaggatgtccaggcgctgcatgggcgcgcgccgcggttcgccctcctcatagcgctgcatgggtgcgcgccgcgcttcgccctcctcatagtccaggctggcgtagccggaggacgccgacttgagctcgtcgtagaaatcgccgcccagctctgccagcggcagcgtgtacctttcaagacagggaggaagggggagttttttggtggtgggcgagggggggggggaatttga

SEQ ID NO: 7467 - DNA, 570 bp, Chlorella protothecoides
atgacgctggcggaggggggacccgtgctgacgcgtgcgtccctcgaggcgggcaggaggctgccggaggccgaggcccgcgccgccttccacggcatggccaagggatcagtcgggcggtggcgagttttgcaccaggtagagcagaggctggtcaggagcgaggcctgcgtctccaaatcgccaatcaaggacccggtgctatgggactgggcctgcagctcccaggcctggtgtcgccgtgccggctgggcctcgacctggggtctggcggagctgcaccgcttgggcattgtgcacggcgatctgaagccggagaacgtgctgctggggtcccgggtgatgctcaccgactttggctgctccggctgggagggcggcggcgtggggatccacaggccccggggcacgcccgctttcctcgcgccggagctggcctgcgccgaggccggaccctggtgggcgtgtgttgtggggtcggtgtgcatgtgggaggagggctgtcgggctggctgccagaatgagtgggaaggaaccctgtgtgatgcacacaacggcgccccagagtga

SEQ ID NO: 7468 - DNA, 231 bp, Chlorella protothecoides
atgtggtccatctggattttcactgtgccttccttgcgggcacggcaatgcagcagtaaggagaaggaggcactcaactacctcttcctggccatccccctcgtcaacattgccatcccttttgttgtcagatccttcccactcgtcttcacttgtgacctcctgctcctcgccgggatgtatgcctggaaaggagtgaaaccactgtcacagcttccttcaagcaagtag

SEQ ID NO: 7469 - DNA, 381 bp, Chlorella protothecoides
atggctgactcgagtggtgcagcgacagcatccctcagggaatgccgaccgctccacgccccccttctcccctttcctcatccacccgcagactcggtgctgccccacatccacgcctcgggctacaatgccatccagctgatggccatccaggagcacgcctactacggctcctttggctaccatgtgaccaacccctttgcagcgagcagccggagcgggacgcccgaggagctcaaggccctcatcgacgccgcccatggcctcggcattgtggtgctgctggacgtcgtgcactctcacatctcctccaactgcgaggacgggctggcaggtgctttgggtggcggcaggatggagggggggaggggtaggtgctga

SEQ ID NO: 7470 - DNA, 633 bp, Chlorella protothecoides
atgcctacccaggggtacggtggaagctcacaccctcgccccgacgtcgggcaccaagcaccttcacatcacaccccacagggcgccaaggactacgggatccacaccactgacgagctcaccgtgtaccgcgagtgggcgccggccgcccaggctgcgcagctgatcggggactttaacggctggaagcctctggacatgagcctgggcgacaacggcgtatggttcatcgaactcccccacggccccggcggtgcgccggccatcccgcatggcgccctggtgaaggtccgcctgcggctgcccggcggggagtgggtggaccgcatccccgcctggatcaaatgggccgtggtcccccagggcgagatgggggccaagtatgtcggcgtgcactgggcgcccacggaggcccacgcctgggtgcacccccggccgccccgccccgccaccctccgcatctacgaggcccatgtgggcatgagcagcgaggagagggcggtggccagctacacctacttcaaaggtggcggagatggggtagaggggcggtgtgtgatgatgtttgtatgcatgtgtgcttgggaggatggaggcaagtggggttcagcgtttggtcgagggcgagtgtga

SEQ ID NO: 7471 - DNA, 318 bp, Chlorella protothecoides
atgtggtttacccgcagcgacgtcgaagctccacgccctcacactccttcgttccccctttccaccagcccttccaccaacatcgacgccctggtgtacctcatgctggccaacgacatggtgcatgagctgctgcccagcgccatcaccatcgccgaggacgtgtccggggcgcccaccctttgccgccccgtcggcgagggcggcgtcgggggtgctggagggggggcgcatgcaggatggagtgaccaggaatctgcgcagaagggggcgagggactggtcacgcccacggcatgccgctgccgcgccggggtga

SEQ ID NO: 7472 - DNA, 927 bp, Chlorella protothecoides
  modified_base (724)..(733): a, c, t, g, unknown or other
atgtcgggtctccgcgctgcaggcggtgtggccaagcgctcggccaagaaggtcgcaaaaggcttctcaggtacggtgggtggagactcgcatctgccagggagcactcacgcagcaagaggcattgagttccacaagtccaagggccagcatatcttgaagaaccccctggttgtgcagtccatcgtcgacaagtctggcctcaagtcgaccgatgttgtccttgaaattgggccaggaaccggtaacctgaccatgaagctgctggaaaaggcgaaaagagtggtcgccgtcgagcttgatccgcgaatggtgaggcagggggcaggagcctcctggtgggaggatgctaatgctgaaaacccctcccctcactacctctgtgctgtcttgtcgtgctgctcctcaggtgttggagctgcagcgaagagtggcggggactccacacagcgcctccctccagatcatccacggcgatgtcatgaaggtcgacctcccatatttcgacgtgtgtgtggccaacatcccatatcagatctcctccccgctcacattcaagctgctgtcccacaggtggcacgagtttgccatgcggctggtggcaaggcccggggaccccctgtactccaggctgaccgtcaacactcagctcctctccaggtctgttgcggggattcgttgtgggcgtcgtccagcttgtacagcctggatggggtactgagtnnnnnnnnnnccagctcctctccaggtctgttgcagggattcgttgtaggcattgtcgagcttgtacagcctggatggggtactgagtgtcgggtgtgcggctttccgaaggttacaaaggcaggcgcacgacttgaatgcctcgagctgtcatttgggagcggcttcagtcctcttctcctaaaaatctctcaccctttctga

SEQ ID NO: 7473 - DNA, 1125 bp, Chlorella protothecoides
atgaagtggagggcatgccatgctgcagcctccctaccccaccgcaatttgctgttcccttgctacagggaggagctggatcggccagagaacaagtccttggtgccgctggtcaagcgcctgtccaaggtcaaggcggagctggatgggcaggcggagaagcggggtcaggcccccatctcctgggcggatctcatcgtgctggccggtgctgcggcggccagcctggactggaaggccatcaagctgggccgcgccaccgacgccgcagggggggagatcatcgcctcgcagctggccacccccatccccgtctcgctggggaggggggactcgccggcgcccaaccccagccccatcatccctatcccgaccgagaacgccagcccccaggaagtcaaggtggggcccatggagggtgaggtgtggtgtgtgagagggggcgtaggccaccttactgctggagcatgcaacagagaaggcgccagcagcgcagcaggggaaaggattatggagcatggtcggcatgctcagcaccttcccgcgacatggttctgcacggacgtatgccgattcctctcctcaacccagcacatgcctgttgtgccctcaacaaccctgcaggactttttcaaccgactgggcaaccccagctccgacaatggggagggtctgttctcacgcaagccccccttcttccctcgggccgcctttgtgctgtggacagcggcgcagccagaccccgcagcggcggaggcgaagctggctacggacccggcctttgcggagtggaagaccagctacgaccgcagccggcgcaccgtcacccgcaacatgtgtttcattgccactaggtgggatgcaggtccaggaaggtgccaagttgcgcattatgtcacctcaagcagaagcttcctgctgcagtgcccagcacctcaatgtagagcagcctccgatgtcccccaactgtgcctgcccaaacccctgattccccctaaacccctcaacccagactacgaggtggactttggcacctactacgagcgcctggccaacctgggtgccaagtttgatcgcacccgctacctcattcccctgaaaacagccaacatcccccggctctga

SEQ ID NO: 7474 - DNA, 483 bp, Chlorella protothecoides
atgtccacgctgagcaccaacatccccctcctcccacacatacacccaactgacccacagctgctgtttgcggacgaggacgcctgctcctgggagtgggaagtgcagcgtccgcctgcctccgtctggaccagggtgggcggcgacccggcttgctctgccgggcgcggagtgcagcggacctacatccccaccccagaggatgtgggcgccctggtcagggtgcggtgcacccccggacggcgtggaaaaggtggcgcggcgccgacgtggggcgaggcggctcttgccgtcgccggcggcagggtgcagccccaccctgcaactcagcctggccccgccaaggtctgcatcccccccgccaggctggaggcgacggtgcccccacggctgagggttgtgtcctacaacatcctggccgaccagtatgcggccaccgagcgagccaagtcggtgctcttcggccactgcccagaaaagtag

SEQ ID NO: 7475 - DNA, 618 bp, Chlorella protothecoides
atgcgccaaggcccaactcaccccacgcgctcccatcaatccgctcacagggtgcaccatctgctcaaggtgggcaagaacaacttccgcccgccccccaaggtggactccagcgtggtgcgcatcgagccgcgcaacccccctccccccatcaacttcctggagtgggacgggctggtcaggctgtgctttgggcgcaagaacaagacgctgagcgccctgttccggcagtccacaacgctgcaccagctggaggagaactacctgctgagtaacgcgctggtgaagggcgcggacgggaccacccaggacctggcctcggcgctggctacgatggccatcgaggcgccggctggaaaggaggcggaggagggcgaggaggagggcgaggaggaggacgaggacgaggagatggacttggagggtggcgcacagcaggccaaggctgcgcaaccgaggaggaagaagcgggggagggccagcgaggagtttaagcaaaaggtgctgggcgtgctgcagggcggcggcttcagcgactggcgcgccgccaagctgagtcaggacgagttcctggccctgctcgcggctttcaatagggcaggcatccactttgtatga

SEQ ID NO: 7476 - DNA, 387 bp, Chlorella protothecoides
atgcgtctcctcaacacccatgtggcccacctcccaggcaagaaacataagggccggagccagcaggccacagacccctcctcggcccagccagcctctgcctcggtggcggtcctggcagggctgacgcagccgagcctggatgcatcctctgtcaccaacgaggcggcctgggtgacggggcacattctgcagctcggggaggcgaggctgcccatcctgcggaacccgcccctcaccgccaagctggacgtgtatggggatgcctttgtaggtatcccgctcgtccccgtgccccagctagacgtgtatggggacgcctttgtgggtatcccgctcgtccccgtgccccaggtgaggatggaggttgtgctgtgggcaccgtga

SEQ ID NO: 7477 - DNA, 1347 bp, Chlorella protothecoides
atgaacagcgacctgaacgacggcatcccaggtgggcggcagagaggtggtggtagctgttccacacactctgacctgggtgctattgctgttttggacgctcgacagggcatgcaacgcctcagagcaagcccggcgggcactacggggtgcagccatacaactcaatcgttggccccgctcaagttactcgctaccctttgccattgcaatcgcgcaggtgccctgcagctgctggagactgggcagctgggcgcagactattgggactgggaggcgggggtggactttgactggcatcggacggggaagaacaaggggaattccggcgacgagatcggcgaggaggacgagggcgagccgaagggggggcctgctcccttaccagaggcagccgcggtccggcctgaccctgccgcttgtggcctggacttgagcctcgcctggccaaggccgttgaggccagcgggcgacctgcaggcgcccttcagcaactacgtctccggctaccagggcctcttggactatgtgtggtgcgtgtatgaccctgccgcgctggagtgcgtcgatgtcatgccgacgcccagcgccgccgagctgggctccttcctgccctcccgcagcctgccctccgaccacctccctgtggtctttgacctctccttcctgccctctcgcgcgagggcgagcggctctcaaggaccgagggtcgacggcggagcgtcgcccgagtcgccgcgctgcgtcagcacccaaggaccgccccccacctcggccggcggcgtgcgccccgccgccctgcacgctgtgcgcgctgcggccgctgcgctggccggcggcggcgtcgtggcgctgcccactgacacgctctacggcctggccgccagcgcgcgcgacgagggcggcgtggcccgcctctacgccgtcaagggccggcggcacgccaagcccgtggcgatcgcgctggccgacacgcgggcgctgccgcgctacgtgaccgccgcccacctgccgcccggcctggtgggggccctgctccccggacctgtcaccctgctgctggaaaggagggccgacgcgccgctggcgccggggctcaaccgcgggacggcgagcctgggcgtgcgaatcccggactcggccttcgtgcgggcggtcgcccgacagctgggcggcgcgctggccctcacctcggccaacgcctcggggcagaccagcagcgtggcggtgaccgagtttcaggtgaggagggggattttgggggtggggtggggagaaagagaggcggatatgttgtggtcaggtgatggagggggtacccggctgcgtaacggtgtcgagggatga

SEQ ID NO: 7478 - DNA, 264 bp, Chlorella protothecoides
atgaaggaggtggaccgagacaacgaggtcaaccgcatcttgggcgccttcaagctgaacccctatgagcagctgggcctgcgctttgacgcgagcatggaggttgtgccgcggcagtaccgcaagtcctccctcatggtccaccccgacaagtgcgcgcaccccatggcgaagaccgcttttgagatcatcggcgcggcactcaaggacctcaagaacgaggacaagaaggcgacgctggactttttcctcaactttgccaaa

SEQ ID NO: 7479 - DNA, 324 bp, Chlorella protothecoides
atggcctctctccagctgaacagtagcctcccccccgtctcctctcatcttcccccccccccaaaggtccggctggcgctggagctgctgttcgagggcgtgcatggcgccggggacctggccctggtcagcagcgaccagtgcgccacggcaaacgaccgggagggtgcgcctgtggcgccgcagatcctgcgcgtgggcgaggcggtgaccgtcagctacgacccggcgagtgcgcctggccggctgacgctggagtggcagggcgggcccggcgcggacgccgtcgccgacgccgtggtggcggtggtgctgggcgccggg

SEQ ID NO: 7480 - DNA, 1005 bp, Chlorella protothecoides
  modified_base (75)..(84): a, c, t, g, unknown or other
ggggggggggtcggtgggtgggggcgtggtcggtgcgtcgatgggctgggccttgattgtgcaactcaaaccttnnnnnnnnnncgggcgcgcaccgccccgcctccgcgccgccgcagcgcccgggctccgtcggcgccggggttaaggaggaggccgcggagccgctgggcgtggcgcgcctgcccagcgccaacggcgtcggcctcccgttctcccacccaggtgactttgagtgggggttttcggtgggtgggggtgtggtcggtgcgtcgatgggctgggcccccattgtgcaactcaaacctcgttcgtccccgcccgagcatgcctcgcaagggcactcctccgtcctcctgcctccctgccctccgcccagttcatcccctgcgaacacccatccctcccgtatcatccctcccaagcaaccctccccccccacccaatgaacaaccaacagggtcctccacgtcgctctactccgacgcccaggccggaggccccgttcccggcgcggcccagcttcccgacgcccccctggtcggcgaggggctgggcctgcttgcccccggcggcgcgctgccccccggcgcggggcgcggcgaggtgcggcgccagcagatcctgaagcagcagcgctggctgctgttcctgcgccactgcgccaagtgccaggtgccggagcgcgagtgccagtacgggcccagctgcacggtggccaagcagctgtggcaccacctgatccactgcaaggacgcagcatgcgcgtacccgcgctgcctgccctcgcgcgagctgctcaagcaccaccagaagtgctccagcccggagtgcccggtgtgcgcgccggtgaagcagtatgtctccaagcagcgcgctctggacttccagcgccgcaccgcgcgcctaccggaggatcagcgcgccgcgctgatgaggcagctcaaggccgagcacgccgccgccgccgcgcgcgcgcagggcagcggcggcggcggcgcggcg

SEQ ID NO: 7481 - DNA, 726 bp, Chlorella protothecoides
atgcatatattgaacattctcccccgctgtgggaccaccagcattcctctgagcaccttttcaagtcatcaatcctccgccgtgaccagggccggtcccggtgatggcggccttggtgctgctcagctgaacctcaggacacctgctggacgtttcgatttggaaattatatttgcttcccgcctcaactcgagcaatcgcaacatacctcggaaagttcagcctccttcccggaggttcgcattgtgcacgtgggatcggcaccattctcaacaactcttccaacttcctactcctccatttccaccttccaacccatcaaaacctcctatcatgtctggctccggcaagcccatctctgagcaggcgcaggatgccctgaacgccgcctccaacaaggccgcggagacctgggatgcagccaagaacaaggcctccgaggatttcaatgcgcgagccattgttccggcaaacaacgatcgctcatcgccttttaaccccttgcttaatctattgcagctggccggaaccgcccagaacagggctgaggagacgaagaaccaggcctcctccaggcagtccggcaccggcggcctgatcgacgacgccaagaacaaggccaacgagttcggcaaccgcgtgggcgagaagaccaccgaggcaaagcacagcctgcaggagggtgccgacaaggccgccaaccgcgctgacgagaccgctcgctga

SEQ ID NO: 7482 - DNA, 1989 bp, Chlorella protothecoides
  modified_base (1595)..(1604): a, c, t, g, unknown or other
  modified_base (1685)..(1694): a, c, t, g, unknown or other
atggcagcgcactgcatggtgggcagcaccatgtcagcgcggaccaggccccgggcctggagccgttgcgccgtctgcttgaggaaagcgtgggccttgtccaccttgatctggtccagctccacgccatgggtggccttgaccccgggttcgatcagggcatgcaagaggggtctggcatgggaggggggtgtcgggggtgcggaggtgagtgcggggatgggatcatgggtggggcgccaacgaaccaccaccaggacaggtggtgccagtgcacgtcagttggtatcgtcgagagcctcacctgcccaggcccgcgccaatgtccaccagcacggagtccttgtccaagccacagtgcttggacatggcggcgagcaccttttgcgtaccggtgcaggtgatggagccgtacaagccttccactccttccccgcctcccagccggttctgcgagatgcatgggggtgtgtggagcgggcgcgaagggtggccgtggtccccgaggacggggtcgtggacttgggcgggcccggggccttggtggccatcgtggcagcgtccaatgggcaaaatgtgcgtcctcccaaattgctcatgtgcctgaaaatgaagaaagtttgtcgcttgcaacccccccggtgctatcgcaatgccaggcatcagagaagcatacagaactggtcagcactatataggccaatctacaccatgttatatctcttcctgcttgccacggagtcatcggcgttcaaacatccgtgctactgccactcaagccaattacatgccaggaaaacacggaatgtctctcggcgaaatactggatgcccctccagaataggtcaaatgtacagcagcattgagttcaatactccagtctctgagataaatcctaatcaagtaagcctgccaccccgggacgttctctggggcgattcctgcagtctctcagggggtgtgccgtcgtggctgcagctcggtatctacccaggcccacaacgacgagcatcaggagactcatcgggtctggatgctgccgaccccatcgcctcgacctccggtgcgggtccctccgccgaggcgacgcccccacctcaaggctaccgcaccctggatggtctacccttccccacgacgatccagtccaagaagaaggatcgaatggctcctattcccctcgcaacagccctcgcccgtgtcaaggcctccaagcgtgccaagttcgacgagacggtagagctggccctgactctgggtatcgacccccggcggggcgaccaaatggtcaggggcgtcacccagctcccgcacgggacggggcgcagcgtccgcgtggccgtgtttgccagtggcgaggacgccatcgccgcccgcgaagcaggtgctgcaggggaaagtggccctgcgttggaaatcgtggccttcgtggggggattggtggtgcagggagccggtgaggcggtctcaacatctggcgtggaggggagacatgggtccgggtgcgacgctgacgtctccgcaacgccgcgacacgcagacatggcgctcaagagcccccccctacacacctgtgcaggagcggaggtggtggnnnnnnnnnngcagtccgcaactccgcgacatgcagacatggcgctcaagaacccccccgtacacacctgtgcaggagcggaggtggtggnnnnnnnnnnagtgaggcggtctcggcatctggcggggaggggagacattggtccgggcggtggccacgccctccatgatgcccaaggtgggccgcgtggctcggatcctggggccccgcggcctcatgcccaaccccaagctgggtaccgtgactgccaatgtgggcgaggcggtggcggcgctgaagcgggggaaggtggagttcaggtgagggcagggcaggcggctcggggttggggttggggagtatgggtgagggtgggccgaggtcgtgtgggaggaaggggttcaacaggagggtga

SEQ ID NO: 7483 - DNA, 837 bp, Chlorella protothecoides
atggcagatgatgtcagccctcccttatctgtccaatcagccccctccatccgctcttccaacacgtcacccctccctttccaggatggggacgagacagtgctggaggctggcggcatcaacatcctctttgaggcggagggcgcctcccaccctgacgactccccctccgtcctgtacgtcaccgatgtcgactccgacctggagatttacctggacggcgcggagctgaagaaggggaagcgcaccaaggtcaagcctggcgccaagctggactttggtgacgaggccagttatacggtgggaaagaagagcatgtgggggaagaaggaaggggaagcgtacctggtggcggtccatagtgccgatggccatggcactccctgcaatctcaggtatcactctttccttcccagatcctgcgcaacgtcgccacgcatgcctgattggatgccaccccggcgcgggtgcagcttatttgctcccctcgcgagcgggcattcggtgcatgcgccgaactgggacggggcggcgcggggccctgagagcactctgttcttcaccaattcccttgacacccctgaacccggccaaatggccttgcccctccgctctgcaattggaatggttctgcattgcactgcccctggcctctcttctctctgtaacctggcgatgcagcgtgacatgcagtctcaggcgtcgactcacagagcagctcagactgggacccatcaggcgttgacctgggccgcagcggccgcctgggtgagggaggccaggctgacggggatgcccgggcccattgtggaggaaagcgtggcggcgcgcacgtag

SEQ ID NO: 7484 - DNA, 1074 bp, Chlorella protothecoides
  modified_base (209)..(286): a, c, t, g, unknown or other
  modified_base (357)..(366): a, c, t, g, unknown or other
  modified_base (812)..(821): a, c, t, g, unknown or other
atggtttacggcgtgggccctgggcaggcggccatgttcaccgcggtcggctggcatgggaacacaactgcttgcccttccaaggtggcccatacctgggcaaagcaatgccagcacgaggacaccgttgcgaggtggcatgccaatgccctgcattctgtgcagtgcactcacattcgagtggtgccagtgtgcttggaagggagtannnnnnnnnnnnnnnnnnnnnnnnnnnnnnnnnnnnnnnnnnnnnnnnnnnnnnnnnnnnnnnnnnnnnnnnnnnnnncactcttcccatttaccatttcccctaggtgccaaacgcataagacggcgagcacggacgcgaagcttcannnnnnnnnngcacaactgcttgcccttccaaggtggcccacacctgggcaaagcattgccagcatgaggaaaccgtcgcaaggtggcatgccaatgtcctgcattctgtgcagtgcactcacatttgagtggtgccagtgtgcttggaagggagtatcatcggtgaacttcctggcctgtcgtgattgcaatgccccggctctgcagtcgtcgagacctgcgggggggctggctgaaacgatggcgaagcctgtccaagtactggcctccaagcctacctgcggcgccaccaggcgatcaacaagctggccgagcgtttatacgcagccccccccggtcaggcaactgttgttggcgttggccattgtcgtgcccaagcccgcgtgtgtgtgtgtgtttatgcgggggcatccgctagggccctggatacggtttattcggcgcctgcggagggnnnnnnnnnntgctgagcatttatacgcagcccaccccggtgaggcaactgttgtcggcgttggccactggcatgcccaagcccgcgtgtgtgtgagtgttcatgcggggcatccgctagggtctgggatacggtttattcggcgtctgcggagggtgtgcaaggtggtatcggtagatgagtacaggacatcgaagctatgctgcgcctgctacatctccttgcacacccaccagtataagtgggtgcggcgagaggtgtag

SEQ ID NO: 7485 - DNA, 1737 bp, Chlorella protothecoides
  modified_base (154)..(163): a, c, t, g, unknown or other
atgagcgaccctgctccgaccagcaatggcgccttccatcccgtagagcatgctccagaggccctggacgacggcatcgcggattacaccagcgtggaggccctgttggaggataacctgcctcaggacaagctcgaggctgtgaggcggctcnnnnnnnnnnccccaactcaatcacaggataacctgccccaggacaagctcgaggctgtgaggcggctcctgtacggggtgaaccagggccagctggtctccgcccttgccctgcccccccacctccaggaggcagtggagtatgggggctttgacgtgcaggcctacgccttcaccgcgcggcgggagcagctgcgcgagccacgggtcgtgcgcctgggcctcattcagcacgggatccaggtctccacttccaagccctacgctgtccagcgcgaggtcaggctctgcacaggggactgtcctcgtgcacggggccggcacggcgcggccctgcgccctgcagcccgcgcatggccagagagcatgatcgtttcctgcggagccaccgtgcgtgtgggcctccctgcgccctcctgcaccgatggccctgactgcatgccagacctgtttctctccccctcaacaccccctcgaccacggccttccccaccaggccatattcacgcgcgtggaggagttggtgaggatggcgggccaggccggggtcaatgtgctgtgcctgcaggaggcctggcccatgccctttgcattttgcacccgcgagcgggagtggtgcgagttcgccgaggacgcagtcacggggccgtccacggcgctgctctcctcgctggcggtgcagtaccgcatggtgatcatttctcctatcctggagcgagactcagcgcacgccgacgtcatctggaacactgctgtgaggaggggagccaacccaaaggccagcctgtgggccgtgggatgcttgggatagccgggcgccaggactgccgggcagcctggcccacctcttctgcactctcaccaatcctacttctgccctgctcggagaccgcctacggccgcgtcgcggtcaacatctgctacggccggcatcaccccctgaactggctggcgttcgggctgaacggtgcggaggtggtgttcaacccctccgccaccatcggcgcgctcagcgaaccgatgtggggcgtggaggcgcgcaacgccgccatcgccaactcctactttgtcgccgccatcaaccgcgtgggcaccgagctctacccccacgccttcaccaccggggtccaaggccagggcccccgccaggacatggggcccttctacggcagcagctatgtggcggcgcccgacgcatcccgcaccccgggtctctcccgcgatcgggagggcctgctggtcgtggatgccgaccttaacctctgccagcaggcacgcggaggtcttggcgtggattatgccgtgaatgggggccagatgttttgcaaagaggtaccatcaagcatcaagtggaacatggggcgtggcgcgacaggccaccatgcccatcctccaccctctcccccatccaaccccacacaggtccgcgatcgctggggcttccagatgacggcgcggtacccgctgtacgcccagctgctcagcgacttcatcaagccggggtacaagccgcaagtggtcgtggatcccaccctggactcctctgcctcgcgcaaggccgcagactgcgagaagggacggtga

SEQ ID NO: 7486 - DNA, 423 bp, Chlorella protothecoides
atggacgagaagacgggcgaggtgcagctgcagtatgactcccgcttttcggcagccatcccatgctactccccgcccagcatccacgtggcctgcacgctgagcacggaaggccgcatagaaaggggaaacagggaattcaaaggcctgcgcctgcagcatgggcatgtggtcctggtgggcaaggccaccatcccggcgaccaggcactggttgacggacaccctgctgcagctcccagctcagtgctgttgcgtcctctctgcgaccctgaggtttgaggaggcaggacagcatggccagctgcaggagctcctggcgtacccttcaagcacggtccacactctgcccatgcccaaacggcgatcgctgtatttacagttcgtaatggcctcatcgccccgtgttgagatcaggtcgtaa

SEQ ID NO: 7487 - DNA, 258 bp, Chlorella protothecoides
atgcaggtgcggctggacaccaggaaggattgctggctggctgtctcctacatgccctggttccagtacgacgcctcggcagggcagggcagaggcatcgccactcccagcaagactcccggaaggctccggctgaagttcagcccttcagatctccacataccatccctgagctggcggaccaccagtgtcggaatcgtccccctcccgccaggcatcgccatccacatccatccccaggtcagggaggagggctag

SEQ ID NO: 7488 - DNA, 450 bp, Chlorella protothecoides
atgatagccacccccaccctctctttgtttccctcacccaacagagtgaggttcgctgacgccccctccgagatctctggcaagtatggcaccagcgatgggcacagtctggacgaggggaggggggttgtccctgtgcggtgctccgaccggaagtgggtggcgcgcatcactccttcggaggtccgccaactcgagtcggagctgggggaggagtatcaggcatccctggaccgactcaagcggaggtggggccccggggctgggatgctgtcgagggtgcagctggtctccctgggcctcctcaaccagtctacgagtcgcatggccatcaaagctgatgccggcgaggtagatgctcccaagccaaccctccctgggtcgagtattcgcctgggctcgctgacagggtcgctgcgcggatcggccccactcaagaatggtttgtaa

SEQ ID NO: 7489 - DNA, 810 bp, Chlorella protothecoides
atgccaccccccgcaccccaccacacacaggtggcccagctgaccgactgcacgcacgcctactccttctgggagggcgttcccccccccggcagagctgccttcgggcgcctcttccgctccagccccagcctgcgcggagttgcggtggtccagcgcgccatgcgcaccgacccagaggccgccatggctgccatgggcttcgggcccctgctcctcagggcctccttcccagtgtccatgtcgggcagcggccgcagcttcaccgcctacatctttcagaggtcagatggcggctcagaggagcagcagccggaggctgcccccagtaccagcgtgcccgaggaggtcccaacgccctgccggtcccaagacgacgccgtcgtccctgcagaggagagctcgggctttgagaccagggaccgaccggacggggccctaaccgcgcgccagtcacgggcgagcgcgcggcggacggctgcggtccatccctcggccgacgaagaaggctgcgtgacagggcccccgccgctgggcggtaagaccggtgcagccaggtgtgagggagcccctccccagcaaaccagcggccgtcaaccgggtgtgagggagcgcctccccagcaaatcagcggccgtccatcgggtgctgacgcggcagcgcccattcccatgcccatgccgccgcagcactccgcggagctcggcgccacacagctcagcagggcagcaagcactgcttctgcatcgacaccaaaggcgcctgccccatcccccatcaagcaagccagctgccagaggcctggagtga

SEQ ID NO: 7490 - DNA, 252 bp, Chlorella protothecoides
atgtccaagcactgtggcttggacaaggactccgtgctggtggacattggcgcgggcctgggcagacccctcttgcatgccctgatcgaacccggggtcaaggccacccatggcgtggagctggaccagatcaaggtggacaaggcccacgctttcctcaagcagacggcgcaacggctccaggcccggggcctggtccgcgctgacatggtgctgcccaccatgcagtgcgctgccatcgagcaggtgtga

SEQ ID NO: 7491 - DNA, 1377 bp, Chlorella protothecoides
atgcagacggtgtattgtcacaccgagcaccggcagttttcggtgccggaggggtgggacggcgtctgcccatcgtgcggtggagggttcgtggaactgcagggcgctgcacccctcccagtgagtttggttctcgtggaccccgggcttcacatgcccacccctgtagggctccctgcccggccgtccgccgactggatcgctcccctctcccccgcccaggtgccgaacaggcctcgtcccgggccccgccctgcctcattccagctacccggaggccatggagtcgtgcacttcatcagcagccccatggacgccccacccggcttccccgtgttcgaggtgcatggccagggggggtccctgcgcgacatgctgatggaggccctggtgcagtccggcatcatgacgcaggagggcggggcgggggtcttccccggctccgagtccatggatgacatcatgacgcgcatcatggacgactaccagcccgtctcccacccgaccgcgcggcgcgcgcgcgaggccttcccccgcctgcgggtgcggcccgcagggcagaaggacccgggggagggcgaggccgcggccgcggcgggggagccctgctccatctgccacgagacttacagccccggggacgaggtggtggagctgccctgcgaccactgcttccaccccgactgcgtcatgccctggctggagacccacaacacctgccccgtctgccgcctggagcttccggcggaggaggggggcccggcggcgggggaggcggcgccgcagccctcggcagggcggggcgcacgagcgagcggcggcatggcgcaggggccggtggcgttccacttccccgcaagccaggcggggacgctggcggcgcgcgtgacgcaggccctgggggagctggtgagacagcgggaggcccaggcgctgcaccgccccgcgaggggcgtggtcgacggcgtggggccctcggccgccgggccggcgcagcccggcggcaggagcgatgcagggtccgggggtggggcgccgagggtcgacgatggtggcccagctcgtccggggacaagggttcagggccccggcgcactgcaaggcgctgcgcgcacagcgctgggaggcccagggccgtcgcctgccccgttgcggggcccacccagcgtgcttgcagaccggttggagcctggggcggccggcgccgcggccggacaggcacgcggccgctctactactgccgccgcagggcccagctccacccccgccgagcagccgttgtcggcgatggcgatggtggcgggggccttggtggcagccctggcggggaccgcgctgggcgccctgctgggatcgtctcgccgctcccagcgctga

SEQ ID NO: 7492 - DNA, 525 bp, Chlorella protothecoides
atggtgaccgctgggcagcattgccgatgctcccccatctccattgcccctttcctcccgcaggaggccattcagtacgagctggaccggcggcgcccaggccagagccggatcaccaccccccgcaaggagagcgacaccgcggagatcctgtcgggcctggccgccgaccggcagaccacgctgggcacgcccatctgcgtgctggtgcgcaacgcggaccagcgctccggggactacgcggagatggaggcggcctaccgccctagccacgccgacgccacctacgacttcaagtacggcatccgcgccgtggcagggggcggccggtcctctgcgcgcgagaccatcgggcgtgtggcagctggggccatcgccaagaagctgctgcacgaggttgccggcacggaggtggggccggggggcggggtaaccgggtcggtggtgtttcggaggggggttgggaagaaggtggggaggtgggagggaccttggaggcggcgcgagagaggcttcgggatgtga

SEQ ID NO: 7493 - DNA, 438 bp, Chlorella protothecoides
atggggggcgtggagtacctgcagtacctccgtaccctggccaagcgtgttgactccgactgggagggggtgcgccgcgacctggagaccatcaggctggccctgcccctgcaaaggcctgctgaaccccgccatgctgttcgcatgccatcaaccctggacgtgccgactgtcctgactgctcatcaccattccacccccactgttgcaccggctcacttctccacccacacgccaaattctcgatgcaggtccacgctcctgcagcgcgacggcgctctggtgaacatcaccggggatgaaagcgtgctgcgtgcgacggaggggcccctggccgacttcctgtcggcgctgccatccctgccaggccagcgcgctgattggaaccagaccctggaccccgcaagcgaggcactggtcgtgcccacccaggtatga

SEQ ID NO: 7494 - DNA, 372 bp, Chlorella protothecoides
atgtggtctgaacagctgccggccttcttatgttgtcatatccttctcaagggtgaacaccatccactggccacggcgaccctctgctcatctgcttcccccctcccccccctcttctcctgccaggtgaactatgtgtgcaaggcggccaacctgtacgaggatgcggggtacaagctgtctggcacctcgtacgtgatcaacaagttccttgggacgtcctggatctgggacagggtacgcgtgtccggtggcgcatacggcggcttctgcgactttgacagtcacaacgggatgttcaccttctcctcttaccgcgaccccaatctcctcaagacggtggacgtgtatgacggtgagaggcgcggatga

SEQ ID NO: 7495 - DNA, 237 bp, Chlorella protothecoides
atggggttgaaaggaggaaacgaggatgttgggagggcgtggaaagagaaggagctggcgatcgtgatgccctgccttttccgggaggcagttgtcttggtgccacggagcggctcacccgccgcccacgcacccacactccagatggtgctggaaacgaggagcgggatggaggcgggcatagtgggcagcgggcactcctttgccgggtcccgcctggatgctcagaggaggtga

SEQ ID NO: 7496 - DNA, 306 bp, Chlorella protothecoides
atgctgtacctggcggccttctccccggggctggggcccgtaccctgggcggtgaacgccgagctgtacccggccgacgtgcgcggcacggcggtgggcctggcggggctcaccaactggctggccaatgcggcggtggcgcagaccttcctctccctgctgcacgcgctggggccggcggggacctgggccgcgtacgccggggtggcggcgctgggctgggcctgggcgcacgccttcgtccccgagaccaagggcaggagcctggagcagatacaagcggccttcgagggcggcgggccgtga

SEQ ID NO: 7497 - DNA, 696 bp, Chlorella protothecoides
atggcgcccgcgaagcgtgctcggggacaccatgcccgccagcggaagcggtcggaagtggatgcggaggaaataaagcaaatagaggctgctttgcggtcaaatgcgccagagcctggaacaaacccactgtccctgcctgccgcacctgaaggagtgaccacctggcctgcctctcgcacctttgacggcctgccgctctcccggcacaccaaggaggggctggctgctgccaaattcactcgtcccaccgcagtgcagagggcggtcttgccccatgctctgctggggagggatgtgctgggggccgcaaagacaggatctggcaagaccctggccttcctgatcccggtgagtggtgcggatggaggtactggatggctggcctgccgctgcttccatgcaccacagccactggggagatgtgaagcccatcagatccctattggctccagaatcgggtccgcagtccccaggattcaggaactcaccaatgatgatgcctttcacctgtctccccttgattgccaggttctggagtgcctttacaggcagcagtggggcgccttggacggtctgggtgccctcattctcactcccacgcgtgagctagcacttcaggtactattggtcgcatttgggattgcctgttgcagggcttttcaatgtcttctcttgcgactagagcctacctag

SEQ ID NO: 7498 - DNA, 216 bp, Chlorella protothecoides
atggtgctgtttgccacagacattgctgcacgcggcctcgacttccccaccgtcgactgggtcattcaggtggttcagggtctagggaaggtgggcatttggggctcttgtgagtgttttgcacgaatacccaaacgtcaaggagcagctgctgtgcaaggccacttcatcgggcagcgccttgcccctcagccgccggctgtgcgttccgcatga

SEQ ID NO: 7499 - DNA, 942 bp, Chlorella protothecoides
atggactccgactaccccatcttccaggctagcgcctcccgggacagatccctggactggaggcgcaggctgcaggtcatagcctatgcggcagccctgggtgtatgtgtgcagtgctacaaccggggcgtcacccgggtcctgaaggccatccggagcgggccgggcctgcatgcatcaacagcaaggctccctgccagcccacacacatgcaccggacgtaaaaccctcacccggtgcccagacgatctggacgacggccacccgcacgccctgcgcacgccgtttgcccgctacgccgcacgctacgcacgctctggcctcaaatccgggggtgcctccccccacggcgaggagcacagccccacctcccccctggccggccccgactcctccgactccggcagcaccaagttcttctcctgcctggaggcggaggacgtgcggggcctgtacgcgggcacggggcgcgtgaccctgggcccccacgagcccctcttcaacgccggcgaccccagcgagtccggcatcttcatcgtggtggaggggcggctgggcacctacctacccgcacccgagccgcgcggcggcggcgccgacccctccacggaccgcctgctggtcaacgtcctggtctacggcgagagcgtgggcgacctggacgtgctggacggcgcgccgcgcgccgcctcggccgctgcgctggccgaggggtgcacgctggtgcaggtgccgcgcgacctattcttgaacttcatcctggcgcgtcccgccaccctgctggtgtacctgcagaagggcagtgggggctggcggaggggcagggctgagcgcgctgatcaggtccatgcccagccctgccagcaacgggcatgcaacctcaccgttgacccagccgtggacctaccctccctgccccggctcctcgggctgcgaccctaa

SEQ ID NO: 7500 - DNA, 684 bp, Chlorella protothecoides
atggcggctggcaagagcctgctcctgctgctgcccagcgagagcgaggggatgctggcctcgctgggtgaggccaagatacccatcaagcagctgcgccacaacccggaaaagatccagtctgtgaccccggcgctgcaggccctgctgtcgaaggacgccgagatcaagggcctgggccagagagcctgcacctcttacctacgctcggtgcacctgcagccaaacaggtccgtctttgacgccgctgccctgccggcgggcgagtacgctgccagcctcggccttgcagccgcccccaagctacgcttcctcaagcgcggcgcagctcagggcccgggtgctgaaaggcgggacgaaggcgagggcggggccagtgatagtagcggggaggaggaggaagcagcagagggcagggcacatgcgagagaggcagggccatctgggccccctccagatgagaaggatgacttcctggtggtgaagcagcgtgacgccctgggagtgagcgaggctgtggccgaggaacccatcttgaatctggccgcgagccagtcaacaggaaagaaaaagcggttgcgcatccgccccgaccgacccagcagcagcagaatggtgtttgatgaggagggggaggcggtggacccgctggcgcagctcgttccagagggagcggcaaggtag

SEQ ID NO: 7501 - DNA, 495 bp, Chlorella protothecoides
atgcctgttttgggggttggggtgtggtgtgggctgttgagcacctgccgagtgcagatggctccacacagtcccgacctgggatcaggtcatcacccgtcccttccctctgcaacccaaaggagcgatgaggggcacgagacggcggcgcagcgtgcacagcacgtgcggacacagatggcgcagcgcgacgctctggacaaggcggagcagcgtgccaggagaaaggaagagcgggagtccaagagggccaagcgcctcgcacgtgagagggaggaggccatggaaggggaggaagagtctgccagtgccgcctcggatggcgaggagagcgaggaggagaagtttggcgggcgcttcaggaatgggcgtggggcggagctgcgggaggaggctggcgccgaggtggcgcacatgggcatggtgccggcgacactcgaggaccaggaggccttggccctgcggctcctgtctggacggagaggaggagcctga

SEQ ID NO: 7502 - DNA, 582 bp, Chlorella protothecoides
atggcagagtcttgggatccatccactcgggcaactgtgcagaagatccccctgctcacagtcaaagccgggccacgcgataaggatgcatggcaagcccgactcaaggaggagattcaagccctcatcaagtacatcgagatcaacaaacgaggtgacctggactggttcaccatcaagcccacgaacaaggagggcacccactggcagggaaagtgctggtacatccacgagctggtcaagtatgagttcaacttccaggtgccgaggaagagatgggagacagccatgctggcgacctatactgcccctggcgccacctatccgacgaccgcgcctgagatagagctcccagaacttgacggcaaaacagcaaagatgtaccgaggggggaagatctgcctcaccatccacttcaagcccttatgggccaagaacaggtggggaggcatgggtggatgcagcacatgctctggtcctcatttcggcgttgcacatgctctgtgcctgggtctggcgccttggcttgcggcggaggtgccatacctggtggaaagtggagtcgtcaaagccaacaactga

SEQ ID NO: 7503 - DNA, 984 bp, Chlorella protothecoides
atgtgcgctgcagcctacaaggcatgcttctcagcgggatgcatgtcacatgcgcatggttggacatggaccggcctaactcccactcgccgcggtctggcaaaactgagcgcgtgccgggctgggaagagctcgcctgagacacgacagaagcttgaattgaccatcagggatttgcagggacccgaggagctgcaagcggttgcgctcctgcgcgctcatgccttttacacttaccctccagagagggcctttgccgggcagttgcaccagctgatgaaggtggaggaggaggtccgagaacttgggcatgcgatagcatccttcccactggaccaggccggcctcgatcttcgaatgaccagccttgtggctctggctgacgccagccggcacgctgacctggacccgggctaccacatccccagcaaggacggagtggtgctgtcaacactagatctctacattgcatcggcccttcctggggagtacctcattggtgaggaggagagcagaagggaagcatccctgattttaggggggaagacgatgcccctgggagcagtaccggagtcctgcctgtgtcgctgtggtaccatgtgcagctcggtccagcatgcatccaccttcacttccagtcaagatgctactcctgggacggagcgtgcccctccctcaattcccgcaggccgcaccaggaatgcagcataccttgcaaacctggcgacagccgagggggtgaagaggcgaggcatcgggcgcagcctggtgagcgctgcgaggcagctggcgcgagagcatggcgtggatgccctgtacgtgcacaccctggcggtgaacacggtggcgcgcgacttctatgccagctgcggattcgtggtggagcgggaagagagcagcaacaccgcgcattacagaggaaagtgcctggatggggtcgaggggaagggtcgcaccgtcctcctccgggacacccagttgtaa

SEQ ID NO: 7504 - DNA, 867 bp, Chlorella protothecoides
atgaagttgttggacacagtccccccatccatgacttcccatctcgtggctacagggcgccaagcagggcgggatgcagatgacctggtagcagagcaactaggcctctcctcaagccgagagttgtcgggcgtgcaggagcgatacaaggacaggatcaaggagtccctggaaaaggtcaggaggagagaacgactgcgttgggtctgctgcgagcctagggcaaaggagctgcagagccagcaggcgcagcgtgaaaggggcatgaagctggggaagattgcctacggcaggggacgctactctgcagctgtcacccttttcgaagccgcgctggaagaggagggccccttctcccacctgggaggagacatccaaatgtggcttgctctctcctaccaggcaagtttattttgggttaaatggccactcatctctagagcctgcgaagggattatactgtgccaccacagtacagcatgtgggcgggaggctgagtgcatcgacgtgtacaagcgcctggaggagtcgcacccgctcccatccacgcggcgtcgggcggccgacctgcgctacatcatggaggcccccaagctgcccctcagcgacaaggacagggtgcacatccctgtgctaaagaatatggacgtgaacaggggcgtccgggcacccacaaaccggcccagggccccgccgacgaccgcgtcgaagcgcgagaagacgtgggacgagcggttctgggagacctatgaaccgccccaatacctgaccaacaagtacgtttggtttgcatccagcctgctggctgtggccgtgagtatctacggcaacatggcccggcatgggctgggcaggctcagcttgtga

SEQ ID NO: 7505 - DNA, 702 bp, Chlorella protothecoides
atgttctccaagcccttccccgccttctctgcgagattgaatgcttgggccacggcagtcacctgccagtggctgatggggccctgctcagtcgtggccgtggacgatggggacggtcagccaaaggccggccagggcgtgaaagtcgagaggcacgtgggctgctggcattgctcgcggagattcttgattcgggccggtgccggtatgggtgcattctgcctgccccagcgtgatgtcacgagagaagcgtggcagcgcaacgtcttgccgtctccaggttgtgctactggccaattcgcaaagatgtcgcaagccattccccttgggtgcaggtgtaggtacctggaggagtcagggtgcgcgtccgtctgcctgaacagctgcaagttccccacccagcgatttttcatggaggacatgggactgcctctcacgatgacgccaaactacgacgatttcaggggcaccagcccagtgctgggacctgttcacacctacacgtccactcaccaccatctgccccactttccagctgtgagtttgcctttgggagaacaccgccagaagcctttcgcgatcccgctctggagacggcctgctttgccaattgccctaccaggcataaggccaggctccacaaatcgaaagagcggccgcccgagcaacaatgtcctggcgcagtggcctgagcgtagatga

SEQ ID NO: 7506 - DNA, 543 bp, Chlorella protothecoides
atgatgacttccatcccatgcctcgcatgccctcgcatcgtacaggccggcgtcgtcaacgctgtggccacttggttcgagctggagctggacgaggagtgcacactttccaccagcccccaccgctccggcaagggcccaacctggcagcaggcagtgcagtgggtgcgggaggagcgggtggccccgggccagacgcgggtgctgatcgcctcacacgacacctattccatcagctacgctctggaggaaggcgcagcgcccggccccgaccacgccggcggcgtgcactttgtagagctgtcggacggggctggggagctcgaggatcgggcgacgggcgtgcccctcgtggaccctgtctggaaggaggcgttcgattcgctgcagcccctgaactcccagatcgtgcgggcatgcgtccaggaccccctggagtacagagccattgcgctggaggccgtggcctttgcctcccggccccacgactacgacctggacgccagccaggccaccgacttttgcgtcaagatgatgggctga

SEQ ID NO: 7507 - DNA, 414 bp, Chlorella protothecoides
atgctccgcagccgggccgtggcgcggctgaaatctcggaggccgggcggggtgcatgtcctggacatgggcgccggcacgggcctcctctccatgatggcggtcagggcgggcgcggcgtcggtggtgggcgccgagatcaaccgacacatgtgcgatgtggcggaggagtgcctggcgagcaacgggtgcctgggacgagtgacgatgttggaccgcgacgtgcgccgcatggccgccgagccggggccggacggcgcgcccgccgacctggaaaggcgcgtggacctcctcatctacgaggtggggggcctggcgaggggagagggcagggggtggggggaagggaagcggtcacgcttggtgtctgcggtgcatgggggaccaacctcgacgctcaagatcccaggatga

SEQ ID NO: 7508 - DNA, 324 bp, Chlorella protothecoides
atgggctggagcaatgcgggagtctaccccccatccctgctcaaacccttccacccaaccccacccccatcccccccccctcgccagttcttcgatgtcgatgaggtctacgaggccctccccaagatcaagaacgacctgctgctggttggaggcgaggacgacgtgatgatcccctcccagggcctgagggtgattgccaggcgtaccaccaccccctggctggtggtgctgagggaggccggaaacgccgcctggatccagtacctgcccagcttcgtcagcatgctggacttgttcctggatgcatacccggacatgtga

SEQ ID NO: 7509 - DNA, 1587 bp, Chlorella protothecoides
  modified_base (1054)..(1063): a, c, t, g, unknown or other
  modified_base (1466)..(1475): a, c, t, g, unknown or other
atgaccttcccggcctcgcccgcccgggaggcactggaggagtgcgcggtgcagcgctggctgcctgtgtacaggaggcatacctttgagacacgactgattcctgtggacaaagacctttgcaactggctcgtcagcgatggggtgtctgcctcgggcgataatcgagcggtgcgtgcatcggcaatggtggtgggtgcgcaggagaacgagggaatggggccttgccgctcctggctcattccgctggcaccccgggacctggccgacccagaccagcaggggtgggagtctgacagcgaggagggcgacggctcccactccggcacccctcctcccgcctccctccccaccctccacgcctccctggcctccgccatcgccgagctggggggccgcgtgcaccccaagttcacctggagctgccccaaggacgcggtctggctgtcacccggcaacaccctggcctgcacctccccagacgaggtcctgctcctcctccgagcctcggaccgtgtggctcacgacgttgccgccgcgccggcagattgcccgcatgccatcgtgctccggcggtggcgggcgctggaccctgggcgcgagttccgggcgtttgtggtcggcgggcggctggcgggcgtgagccagcgcgacctgacccaggagtttggctggatgcaggaccccggcgcgcgcgccgacctgctacaccttgtcgccgccttcttcgacgaccacctgtgcgccagcttcccgctgcacgactacgcctttgacgtgtatgtgagctcggggaggagcacgctcaagctgctagacttcaacccgccggggggcaccacttctgcgctcctgtacgactgggaggagctggggtggggtgggcggcgcgattgtgaggctgaggatggcgcggggactccgaaggcggatggcactgcggccatggcggggccagatgacgtggcctcgggagggccggcgcccaggcatgcgacagcagggcctccgacgcgagacgctccggaggctctgctgcccccctgcgtcgatnnnnnnnnnngcggcgtggcctcgggagggccggcgcccaggcaggcgaccgcagggcctccaacgcgagacgccccggaggctctgctgcccccctgcgtcgatgcgacatacctgcagcagctcagggcggcccagggtcgaagagaggactctggtgtgccacgctcgcccagcagtcatgcgagcaccactggcgctatccctcccggccagcctccacctggccagcctacgcccggtcaggctccgctggaactcagggtggtgcagggaggcctgcagctgcgtccgcacctggcagcctacggcgtcccctttgactttgttgacacctctgagggcagcgcgctaaatcagatctccgcaaggggggcattgaaccggtaccaaccacccgattgccgccgctnnnnnnnnnncgactttgtcgacacctctgagggcagcgccctaagtcagctgctggagaacgtcggcgtgccctccgacctctggcaggagctgaagaggcaaggcgctgcggcgtcgtag

SEQ ID NO: 7510 - DNA, 1491 bp, Chlorella protothecoides
  modified_base (1285)..(1294): a, c, t, g, unknown or other
atgcactcctctacccagtctcacccttccgcatctcagctgcagtcaattctgaacagcacgaatgagcaagtagctcaacttgcgatgcaggtaccatttcagtccgcatgtgaaccgcggcatcattgctgcaccccgacctgttcctggtaccatttcattccgcatgtgaacagcgggatcattgctgcaccccgacctggtcctggtcaacgccatgccttttgcatccatcgggcaggatccattggcccagcatcattcaatactaccccaatgttgcaaggtctggtgcctggactggagggaggagcgatgcgaacagtgatcccaactcccgggtacgagtctgtgggtcatcgcaagacttctccagacccatgcgcacagcagttgctccagctacattgcccccacacccgcatcagggcaagcctaccagcctgcataccccacacttccctcaggtttgtgatcaagacgtcagatgagtcgggcaataaggtcttcctgaatgtgtgcgcggacgcggcagtcccccttccagatggctggtctcctggtgagccgctgccccctgcggtgaagggatacctggaggctggaccggaagggtcagcccccagcagcggggacgctttgatgtcgctcctggcctttcctatgtggctcagcgacctccggcgagactcggaccacacgggtgcagcctgcggaggtgagggcggggtagttatcagggacaaagccgggtcgagcctccgcatcccttgcttgcagtggactgagtcagctcagctgaagcttgcagtcttgtttgactgcgccggagggtggctgcccgccttcctggactgcgtgcttcacgctgacatcctgcgccacgccgctgaggtccggcccctgaagctctacgccatccagctggtcctgagcgaggtggcgcacaagtgcgcgctgcgcctcaacccgctgtacaagctgccgcgcatgcggtcagggcgcagagcgtccaggcctggtgagggaggtgctggccggccgggacaagggcctggccctccgcaccacgcccgccccgcggcccgcggcgcgggaacgaagcgaggcgtgcgaggaaagcgcggatcccagcaccccgctgcgggcaatactgcggtaccatggctgccccgtggaggccgtcagcgtcgaggtggcgctgacgcccgccctggtggcgacggcgcagcgtgctgtgcacgccgtgcgcgtgacagtgacggggcagcgggtgagcatnnnnnnnnnnggcgtgcagtgcacgctgtgcacgtgacagtgacggggcagcgggtgagcatcgccctccctgcctgcccggccctggaggtgggcctccccttcttcgttcgcccggatcagggcaccgccagggtcacggcgcaggggctccacgtgacgctgccctaccgcccgctggaggaagtgcaccctcgaactgcgtga

SEQ ID NO: 7511 - DNA, 930 bp, Chlorella protothecoides
  modified_base (852)..(861): a, c, t, g, unknown or other
ccccccgccccctcccgctggccgctgctccatgcgccagagtgcctgcgcgtcgtcgcggccctgccgggggcaaggccaagcacagccgcgcccgtgaccgcgctggcgctgggtcctgacggcacgctgcacgcagtgcacgctgcgccgcgcctggccgcataccgctggctcgcgcaccgcacggaggccgggcccttcacctttggacagaccgccgccgagccggccggcgccggccagggcctgctggaaccgtgcggggcagggctcaccctgcttgaccccggcccaggtcctggcatcaccccaacccaggccccgcccgtcgccttcctgccgggcacacggcacgtggcgctgggcggcgccgatgccacgctgcgctgcgcctgggtggaaagtggcgcgcccagcgccgcggcgtcctaccaccaggacgccatcacctgcctggccgccgacgagggagtggtggtgaccggctctcgcgacgccacgctcctggtctgggagatgggcgcgcgcggggtggaaagggcgccacgccgcccgcgcgccacgctgcatggccacccctcgcccgtggtggccgtggcggtcagcaccccgctagacctggtgctcagcgcctcggccggcgggaccctgttgctgcacggcctgcgggatgccagggccatgggttgcgtggattcgagagtcctgtggaggacactctctctgggtgatgactggagtgcagatcatcatgtctatctgctctgcgcttggtcatctgcaccctatgttctggaatgcaacgacggctccatcgattgcaagcacagcaaaatttacatgtacctnnnnnnnnnnctgcaccctcagggccatgggttgcgtggagtcgagggtcctgtggagggcaccctctctggatgctga

SEQ ID NO: 7512 - DNA, 273 bp, Chlorella protothecoides
atgaaatggaccctctgctccaaattcgagccggttcgctttggacctggggaggacatcctgtcggagggagacaaggccgagaaatgctgggtcatgctggaaggtgaggtggtgtcgctgcaccactacgtggaggccggctccatgcagggccctgcgctccttggcagtaccgtggtactgcaggacctggtggagacgttcaagagctcgccctgcaccctgcgcaccctcagctcctgcatctgctggcaggcaaggctcgattaa

SEQ ID NO: 7513 - DNA, 606 bp, Chlorella protothecoides
atgtcagcggcttcatgcgccccggcgagatggtgcgtgtgtcgtcaaagggcattctggcaggagcaaagctttcgccagggaaccggcagtatttcacccagggtttcctcatacatctgcatgctcctaccgtgctcccccatgcctgtgcaggtcgctctgatgggcccctctgggtcggggaagaccacgctcatggacatcctgtctgggcgcaagaacgtggggaagatctcgggggaggtgctgatgggcggcaacaagcccagcatccccttcctgcggcggtacacgggctacgtcgagcagtttggtgcgtgggatgttgagttctgccatgcttgctccgcgatctggcggcggtgcctggacttggtgggcgtgttaggggttgcgctaagggctgccatcgaccaaggcaggaacaggcgcatgagtggggtctccaggcagcatggcatggccgatgaatggctacccctctccctgcctgggccatgtgcagcggatccacacaccttaaaggacaccaagcataaccactgccacaccccacatggaaagactccctcaaactcccaaaccccgcatttctgcccctga

SEQ ID NO: 7514 - DNA, 1512 bp, Chlorella protothecoides
atgacgacggtgaagacgcttgcccggcgcggcctgacggtgtgcaccaccatccactcccccaccccctactgcttccacctcttcgaccgcctgctgctcctcctgcgcggccaagtggtctactttggccccggcggtgagtggggcgcgggggattgggcgtgcatgggagcagtccacgaaggcgtcgcaggggtggatcaggggcagcactcctccgagtgccagggtgtgtgccctgggcccagggcgctgaggatgagagtgactgcatcaaatttcctccatggccgctggcttgtcaaaagaggggaagggctgaccgcccctcaaaatggccaggaggcggtggagtactttgtgcagaacacgcccgtcatgaagggcctgatggagggcgagaacgaggcggagtggatcgtggacctcactgtccaggcagaccggcagggcaaggcgggggagtttgccggtgcctttgccgcgtcgcggcacaagaccgtgtctgacgaggcgctgcagtccctgctgcgcgacaccccctccatgctcggtgggtgggcgggtgtttggagaagcaggaggaaggctggggaggatgtagtagggaggacagaggatgggatgcagcgcctagtagctccacgccggctgtcgcatgtcgctgccaggcccttggctgaggggctgcacaaggagcatcccgatccaggctgtggtgggggccttgtaggaggtgacttggaacgcgaagcgcaccagggcaggcatgtggcgttcatgcgtgcccatcgagcgccgccgccctgccccctgcctcgcagacgaggacagcaagaaggagctggcagtgcagcgcgagaccaccacgcccttctggtgggccctcctggtcatgatcaagccagtgccctctgcccgcctcggcctgtacccctccccctcactggtgatgcttctctttcctcgcagcgacgggcgttgaagcagtacaagaaccccgagtttgtcatgccgcgcattgccggctccgtcctgttcaggtggggtggcgtttggcaccggtgctggttgagcgcgagggatggaatggtgtggaggttctggttggacaaagggatggactcctggctgcacccgtccgctccacctcaatcacaacgccgatccgagatccatgggtgttgcatctcagcactcacacacacacacacaccctatccgcctcctccactccacagcctggtgatcttcaccctgtactggaagaagggggataacctgtccaccggcaacctgtacaacatccaggcggtgctcttcatgtgggtcgtcctgcccgcctacaactcggcctccaccatgcccaccctggtcatggagcgccagctgttcaccaggtgctgtttgcatcgtgcgggagtttggggttgtgctggagggtgcgttggggacatggctgtcgtggggaagcaagcaggcacagctctggatatgctgctgagctga

SEQ ID NO: 7515 - DNA, 375 bp, Chlorella protothecoides
atgctgatctgtgcgcgcctgcgggtggactggtcccgactgggacgcggcatcaccggtgccgctgcgctggatgcatcccaagtgctgggcacctgcggtctagacccctactcggatgcatatgctgcaagtgcggggcgcatggacggcttgctgtcccggttgcgggcggacgtggcacacgctgtggagggtggggggcccaaggcggttcagaggcaccactccagggggaaactgctgcccagagaacgaatacaggcgctgatcgatccagggtctcccttcctggaattctcccagctggcgggcaagggcctgtatggtgaggggtggaggattgtggctgggtgtctgcgatgccgttcataa

SEQ ID NO: 7516 - DNA, 624 bp, Chlorella protothecoides
atgcagagctatgagctcaagcctcgacccgaggacctgctggcgccggaggctgcacacagcgtgggccactatgtggagcgcgtgggccaggccctcaccgtggccgggctacagacctccctgcgcgggaccagcctggcctttgacagctacatggacgagcgcatggaggcacggtggcagcaggagcgggaggccctgtttgagtggacagcgccctacagcctccctgccctgcccctcgtcgggcctggggcgcgcggctctgccgcggagcggaccccgctggggtcggtggccagtggcggtgcggcccgcctgcgtggcagggccgcacagtacgctgaggtggcgcggcgcctgaaccgggcgcgcgccgcaggggaggagttccccctcgcggccgagctgggggcagcgtgccaggccgaacctggcggtgagattgtgtggagggagtctcccgaggggtgtttcctgcccaaagtaggccgaacgcttcagaacaggcagttgatcgtgcactccaccacctcaacgcacgcaggcacggagcgacgcaccagcatggcacgcgtctggaaggtcctgggcagcctcctcccggcggcgcaggtttag

SEQ ID NO: 7517 - DNA, 426 bp, Chlorella protothecoides
atgcagctcacaatccggaatcacaggagcaaggtgggcgcggtcggttcgtggttgtgcgttgggggggcagagaggcagctggccgggcagcagagaggcagctggccgggcagcagagaggccggccccatgccgcaccttgccgccgccgggcgccatgttactggccgacccgctgccctgggcgcctcgccctccaaactggcgctgatcaacgcctacctgcgagtcagcctgggcagtcgggagcagctggattttgatgagcctgggggcatggacaccacgtggcaccgcatctacacggccttacgtgccggcctgacggccgaggcgcagcaggcaagggctaggcataggggccgccggtgttggcgggtggtgaaccctgattccagggtcagcatgtttcatgtcacttag

SEQ ID NO: 7518 - DNA, 1086 bp, Chlorella protothecoides
  modified_base (601)..(610): a, c, t, g, unknown or other
  modified_base (912)..(921): a, c, t, g, unknown or other
atggctgcaacattcgacggcggagtgatcctgggcgccgattctcggacgtcaacaggtgactatattgccaacagggtaacagacaagatcaccccgctgtccgattctgtctacatctgccggtcgggctccgcggccgacacgcaaaacatgtcgcgctacatctcctggttcctggagcagcacgagatggacctcggggaggggccgcgggtggagacggccgccaagctggcccagagcatggcctaccagaacaagaaccacttgcaggcggggctcatcgtggcggggtgggaccgagtggccgggggcagcgtctttgccatacccctgggtggtgcgcagggcgcggggcttgcgtttaccggagagagggtctggcgagggacggcatgcagggcattcaccgcatggatgggtgacgtcacgagatcctggaaagaccacgtcgaggctggcaggcatcccctggtgtgggtgggtagccagggccacgcggacgacgtcctgcagtcgaggggctcgctgtacccatcaccccctggtcagcgcgccatgcaccaacccctgctccaggcaaacatgacggaggagnnnnnnnnnnatcacgagatcctggaagaccacttcgagacgggcaggcaccccttggtgtgggtagccagggtcacgcggacgacttcgtgcagtcgaggggctcaatgtacccatcactccctgctcagcgcgccatccaccaaccccctgctccaggcaaacatgacggaggaggagtgcaaggcgtttgtgatcaaggcggtgtcgcacgccatggctcgggacgggtcctcgggcgggtgcatacgcaccgtgatcatcaccaaggagggggtgaggagggacttcctgccgcacaaccgcatcccnnnnnnnnnnttgcatacgcaccgtgatcatcaccaaggacggcgtgaagagggacttcctgccgcacaaccgcatccccataacgcatggcgagctacctcatcccgagccacaatcggtggctgctgcatgaccgtgcggctgcatgtgctgtcaaagctggaggcaccgtga

SEQ ID NO: 7519 - DNA, 273 bp, Chlorella protothecoides
atgccggggtacggcgagcagatgcgggccgtgtccctgcgccacgtccccaccgccgtgctctccaggcagaccgccggcctgcggggcaaggccctgatcctgaacctgcccggcaagcccaaggccatccgcgagaccatcgacgaggtgtttgcctccatccccgcctgcatccgcttgctggggggcccagacatcaggacggacgactccgtcgtgaaggccttccgcatgcccgacgccagcctgccacccagggaagggcgctga

SEQ ID NO: 7520 - DNA, 2289 bp, Chlorella protothecoides
  modified_base (315)..(324): a, c, t, g, unknown or other
  modified_base (1954)..(1963): a, c, t, g, unknown or other
atgctacccgccggggtgccaatacacaaatctagaatctccctctccacacacacacacactccccgcaaccatcccagaacacgccgacactcccgccccaagcccatacctggtggccagcaggcagagcatgttccagaagggcgcgccgtcgcgcgagatgtcggcgccccgcgcgtccgagtgcaccacctccgcgcaaagccgggcaaaggtcaggcgggcaaaggggtcggcgagcccccgcctcgccaccgctgtcctgcgcatacgccgcggctgcctcggccaccatgccgcccatctccaagnnnnnnnnnncggcattcccgcgccgcccccggggctggcctgctgagcggcgggggagccctggcccggcacgagattcccgctgccatcccgggccccagcccccgcctcgccgccgctgtcctgcgcatacgccgcggccgcctcggccaccatgccgcccatctccaaggcaacggcgctgggctcgcgggcggcgaccagcgccgccaggcccagcgcgtgccgcgcgcccacggcgtcgggcgagcccaggcccacgaaacaggcgcgggagacggggtccagccccgtggccgcgccaccggcgcgtaccgccgcaaacacgctgtgctggagggcccagtcggaggccgcgccgccctcgccgctgtcgggggggccgcgcggcgtggggcgctcatccgcggcggcgatggccgcctggacgcgggccagcaggagcttgcgggcgggggcgctggcgcgcgccgccgaggcgaagaggaagagcagcgcccgctgcaggccggggtcgaggtcggggcgggccagcagggcggaggcgtggtccagcaccaccgtcagcaccttgtcgtccacttttttagacgctgcgcatgtgtggagggcgagggggccggaggggggttgagtgggtgggtggcttgggtgggttggggggtccgaaaccatgtcgccccccagtcctcactccctcacccgtcgcggggtcgaagagcgtgggcgtcccggcgctgttgcctgacaggtagaggcccgccaggtgggacagcggcttcacaagccgcacgtcctccccctgggcggggagcaggcgggccagggaggcccccgcctcgggggacaggtgctcaaagaggaacagcaggcgcagggcactggccagcgacgccttggaggccttgtcgtccgcctgggaggccacctcctgctgggcaacgatctgcacacctgatcggtccccactgcagtggtgcagacgtagcgagacaagagggggtcccggccggcgcccctaccctcgggcctggactcagatcgttggacaggctggggcccgggtctacctcccacacccagggccttgaggcgggagcccacagcacttgtggcgtcccgatacaccgcggcagccatactgtgatgcaagcacacacggagctcagtatgtcactggggtcatcgcgcgtgacgtcaccagaaagaccccagtgcactccgcgcgtcgcggctatccgacgagagaaaataccgactgttcgcaatgcgagtcgtgataacaatgtagggatgcggagggatgcttcccctcctgctcagatcggtttgctaagaaatctggttccgtgtttaccgggccagaacctcagcacgagatcaactgcgggagggagctcgactgctccttcttgcatgcttgagctcgtagcgccgatgggaaagcggaaaagcgccaagcccccaccggcgaagagcaaagcaaagctggatgtaacgttcgcctgtccgttttgcaatgcaggtatgcacacagagttctatccccttgcactgatgtgggagcagggaatgtccgctccaccagtattatgcttgcaccgccaaaacctacacaaccacccatgcagacaagagnnnnnnnnnnatggtggctgggaacctccgctccaccattattatgcttgcaccgccataacctacacaaccacccatgcagacaagagcgtgacatgcacgatggaccgggaacggggcgtgggatcggtttcctgtactcagtgcagtgcaagctttgcggtgaagatccacactctgtcagagcccatcgatgtgtacaggtgggaccagggtgtccactggctgcctgtatcgatggggcggctgagcataggctcaggcaccccctgcagcccttgctcacaccccacgcataacaacgcagtgactggatcgatgagtgcgagcgcgtga

SEQ ID NO: 7521 - DNA, 1311 bp, Chlorella protothecoides
  modified_base (873)..(882): a, c, t, g, unknown or other
tccgccgccgccggcccccccgccgccgctcccgccgccgcctcccccgcgaccagcccgccccccgacccctttgccctagtgcgtgaggagctgggggtggtgtctgagcgcatgcgccgctccatcgtcaccgacatccccgccctgggctccgcggccgactacttcttccgcctgggcgccgacggcaagcgcctgcgcagcacggtgctcctgctcctggcgacgcggctggcccccgcgccgccagaccccgcgcgactggaggtggacgagtcccccgcgcgcgccccgcccggcgagccgcgccggcgccagcagcgcctggcggagatcacggagctcatccacatcgcctcgctcctgcacgacgacgtgatcgacgaggcggggacgcggcgcggcgtgtcggccgccaacgccgtgttcgggaacaaggtggccatcctggcgggagacttcctgctggcgcgggcttcggtgtcgctggcctcgctgcgcgacacgcgcgtgatcgagctgatgagcgcctgcctggagagcctggtggcgggcgagatcctgcagctgaccgccgacccggagcaggcgctgtgcctggaccactacctgcgcaagacctactgcaagaccgcctcgctcatggccaactccgcgcgctccgtcgcactgctggggccggagcccggccccgatgccgcacaggcggcctgggactacggccgcgcgctgggcctggccttccagctcgtggacgacgtgctggacttcaccgcctccgccgacgagctgggcaagcccgcgctgaacgacctgcgctcaggcctggccaccgcgcccgtgctctacgcggcgcaggccagcgagccnnnnnnnnnngctggcacgccggcgctttgccgcgccgggcgacgtcgacgccgcgctggccatcgtggccgcaggggacggcctggcgcgcgcgcggcgcctggccgcagaccacgccgacctggcggtgcaggcgctgggcaggctgccgccgccggcctgcgaggaggcaggggctgctcacgctgccctgctggagctcaccgcccgcgtgctcagccggcggagctgatgcgcgtgggaggggcaggtgcagggagggaatgccatgtgccaaggctgtatggccgagtgctctggaaatgtgtgcgcgcgaatcgctggacaggcacccgccaccccggtcgtcccgtctcgagcctgaaccacacgctgccgtgtgcagggggaggcacccaccgcagtctcctcgctggcggcgctcccgcatgccactga

SEQ ID NO: 7522 - DNA, 1164 bp, Chlorella protothecoides
  modified_base (206)..(215): a, c, t, g, unknown or other
  modified_base (293)..(302): a, c, t, g, unknown or other
  modified_base (1085)..(1094): a, c, t, g, unknown or other
atgcctctgaaggtcaggagcatggcgtcccaggagctgctggcagggcggtggcggcaggactgcctggctctggtgatgccgggtggagccgacaccccttactgccaggtcctgaatgggcacggcaaccagctgatcacaggtggggcatttagctgggatgagtatttctctgctgtcgcagaaagtttatggggctgttnnnnnnnnnnacggcaaccagctgatcacagagaagccatacactctctctggggaacatggagccaccatgcctccgagtccaagannnnnnnnnntgctccagagaagccatacactctctctggagaacatggagccaccctgcctctgagtccaaggcctgctctcatacacccgtgctgcatgctgctttccgcccgtccattcaccctttccaccccattgcgtaggcttcgtggccgagcagggcggcgcctacctcggcctgtgcgcgggcgcctactacgcctcggcccgcatcgagttcgaacccggctcgcccctggaggtggcaggggagcgcgagctggctttcttccccggcacggcgcgcggcagcgtggtgcccggcttcgactaccgctccgaggccggggctgccgcggtccccctctctgtggccggcgaggtcgccaccgagtgccgcgactactccaacggcggcccggccttccaccccgacgcgggcgccctcccgccgggctgccgcgcactggcgcgctacgccgacctggcggggacccccctggcggcgctggcctgcgctgtgggcgccggtcgcgccgtgctgtgcgggacgcacccggagctggcgccgcactggctgggcccgcccgagagcgcggccgtgccggcgcaggcgggggtccccccgctgaccggcggcggcgaccaggcgcgagcgctccagctccagcgcgacctcgggcggcatggcgcggcgcgctgggacctctggctgctgctgctagaagctgccggcctgggcgcctggctggccgtccagcagggcgggccaccacccgagggctgggcggaaggcggtcacatatgacgtnnnnnnnnnngggcgcctggctggccgtccagcagggcggcccaccacctgagggctgggcggaaggcggtcacacatga

SEQ ID NO: 7523 - DNA, 1860 bp, Chlorella protothecoides
  modified_base (821)..(895): a, c, t, g, unknown or other
atgggctcccagcaaatcgcacagttcccacgcggacctggaagagtggcaaggtctccatcctgtcagctgtcactcggccgagtctcggatgaagacggcctcttcaacgcaaaactatccgattactgcgcatgcattcacgaccattcaattctggatttggctaaacccaaggcagggcgcgggatccgagacccccatcctcccacaatgatgtcggtgtctgcgacgtcctgccgtgctgtgagccacatgctccggcagggaggacccagaatcgcagcgcccttcaaggcggcccatcgtccatgcagatgccttcacaccagttgcatggcccgcaagggcctcgctgagctcctgcgcctgtcagaacggtgcgtgcagagaaccctgcagcctgaagggcaacgcacgactcgaccccacaattcaaaccgcccctccccaccccacccgcctcctgccagcagggatgacggggcaggcctgaagggccgggcgcccctggtcccaggcaccgtcagccccccacgccccgttcccccccacatcgtgcggccgccgtatgtcagtcggtccgggactccggactgggacagccggccccagatccaggatgcagagggcctggtgcggatgagggcggcctgcaacctggcggcaagggtgctgcgcctggcgggctcgctggtggcccccggggtcacaacagatgagattgatgccgcagtgcacgaggccaccattgccgcaggggcgtacccctctccgctcagctacggtgaggaggggcctggaggatgtcattttgggannnnnnnnnnnnnnnnnnnnnnnnnnnnnnnnnnnnnnnnnnnnnnnnnnnnnnnnnnnnnnnnnnnnnnnnnnnactgggcccagggacccccatccatctggctgggccccctcatccacccatcgcgaactcccgccctctgcaccgcaggaacattccccaagagtgtgtgcacatccgtgaacgagtgcatctgccacggcatccccgactcccgacctctgcaagaaggggacatccttaacatcgacgtcaccgtgtacttggatgtgaggatggctgggagggcgtgggagtgtacgaggtggtgtctgaattgtggttctgccctgccgagccagcaagcatcctggcctgcgcctcgcgcccatagttgcggatgtggtgtgatgctctcagccgagcaccgcccacagtctcctcctcgtccccgaccacatccacgacgctcaacccctttccacatccacgacgctcaacccctttccacatccctcctcacctcccagggctaccacggcgacacctccgccatgttcacggtgggagaggttgcgccggaggcccgggcgctgtgcgaggcgacgcacgaggcgctgcacgccgccatcgctttgtgcggtccgggcgtccccttcaaggccttgggtggcgccatccaggcggtggccgacgcgcatgggtttggcgtggtccgcggcttctgcgggcacggcgtgggcaagggggaggctgtcctctggtcctgcacgggaaagggtccctgttggggtggtgcatgccctccccagggcaccactgagcatccatccacgacgctctaccacaaccccaaccatcgcaggaaccgggagggcggcaggatggtcccggggatgacattcaccatcgagcccatgctcacccagggcagcgccaaggagcggtactggaaggacggctggacggccgtgaccacggatggcgggctgtcggcgcagtacgagcactcattgcacataacgcacgagggcgtggagatcctgacacagctctga

SEQ ID NO: 7524 - DNA, 2274 bp, Chlorella protothecoides
  modified_base (18)..(27): a, c, t, g, unknown or other
  modified_base (760)..(769): a, c, t, g, unknown or other
  modified_base (1240)..(1249): a, c, t, g, unknown or other
  modified_base (2184)..(2193): a, c, t, g, unknown or other
atgatgcagcgaacgacnnnnnnnnnnggcctcatcccttggagctgtgccagtcctcaacttttaaacgcgaatgatgcagcgaacgacccttcacagcctcagacttccagctggttgagcttgaggaacttacaagaagtatgtcggaaatggtccagggtttcagttctgctccaaggtcctcttgctcgggaccagcactaccgccgaagctggcagctggggttccaaatccctgccctgctgcaaacccacttcggaaacgggttggggcagggccgccacggaggggacgacgtctgccgcgaccgacgcaagcacgctcggcctggaaacacagtccggggcgggtgcggagcggggcaggtggtttcggtcgtagagcagagagttggccacgtactcgtccgtctcgtcgttcttgcggtcagcatactccgcccaccatctgcgcgggcccgggggaggggggtcgtgcaagtccgtgagggtcgacactggccctcgcacacatcagagcacccttacctcctcagcgactcctcgtttgcttccttcttgttgtgccgtagattgcttgcattacatggggtgggcacccactctgtgacacgggtacccctgtggggctcgtctcggtcgccattcacggtgggcagacgtgtcaattgggggtgcgagctaacttggaagccagcagcgcgcccggaagctatccgccctcccctctcgcgccagatcacttcctcgctccctnnnnnnnnnntcgccattcacggtgggcagacgtgtcaatggggagtgcgagactggctatcgcagagtccctgccatattccccctgcagcctccatgcattcgccctccctctacgatgcacttggcgtgcccgccaccgccagcctcagcgagatccgggccgcctacaaggctctggccttcaagtgtcacccggacatcaacccctccgcggggaaggccgggcaccgcgaatttgtggcggccacggaggccttccagatcctgagggacggggccaagcgcgcggagtacgatcgcgtgctcgccttccaacgggccacggaggcgctgcaggcagggaagccctggcacgcgtcccacggagctggccccaccccctggggctgggaggggccgccccggcctgcgggtcgggccgctcagcgcgaacccctggacgacgtgtttgaggacatcctgcgcaggatggggcagnnnnnnnnnngggctgggaggggccgccccggcctgcgggacgggccgctcagcgcgaacctctggacgacgtgtttgaggaaatcctgcgcaggatggggcaacccgggtgcgcaatcggttgttcttatgcacctgagggtagggaggcggggtgcggtccgcaatttgaccgtgcaaggggaggctggtggggcctgggcagccgagcatcacagggcgatgcttggtgccggggcccagcttggtgccgccgtgatccatccaccaccagagttgcatccaatgcaacgattttgctcttctatcgatgccaccgaccccagtgtgccctcccctccctccccctcccaggtaccgcgccagcgccgaggcctccgcgcggcggggccgcagcgacgcccagcgggccgcggcggcggcggcggcctggcaggaggagaaggcggcggcggcgggggagaaggcgcggactgcacgcctgcgcgggcgcatggaggcggcgagggccgtgcggcacgcccgcacgctgcgcacgctgtggcagacgcacggcggcgtggcgcgccaggacgtggcggtcgcggtggccttcctggcggggagcgtcgcgctggcggtgcagtggaaggcgtacctggccgcgccaggggagcgcaccccctgacgctgcgtgagggtggtgacgtggcgccgggcggtgcgctggaccgatgggcgctgctcggatggcgtggaccaggggttgacacaccactgggcccttcattgtacatagtctacactgccgtgttctttacgcggccatcgccctggcactcgcccatgccatgcatccgcaccaccattcagtcaggccctcgtccgatgggagagcgccgtcgcgaacagagtcgcggccatggggcagtgacgaaagcgaggagcgcgccggcctcagggcannnnnnnnnngcatccgcaccaccattcagtcaggccctcatccgattggagagcgccgtcgcgaacagagttgcagccatggggcagtga

SEQ ID NO: 7525 - DNA, 453 bp, Chlorella protothecoides
atgcccccgcccgtcgcaggcgacctggcacagaggtttggcctcgcctcagacctcctcctgacccagcttcgtccgcacctgggtcgcgatgtccgtgcccgcctggaggggggctacctttacacacaagcgctcacagtccgccttaaggtgcgaggctgcgtgaccggggtccgatcatgcgaggcgctcgctggcacgaccatcgcttgcggagaaggcgtcctggcagcgccagagctgccaggggttgcgcaggtcgcctggaagcaggcacagctgcgaggcgcgctgcgggggtccacggtcccgatcggcgtgcccgccctgctttcctctctggacctgggcgggacgccgttcctccagtccctcgtcccgggtctggtggagcagctcgtcgccgagggtgggtgcgacgggggccagtgttggcgaggggccgggtga

SEQ ID NO: 7526 - DNA, 267 bp, Chlorella protothecoides
atgaccgggtccatcccggcccactcacaggtcgacctgcctgccgctctgggggtggatctgctgcactgccaggaggccgccaggcaggcggctgcgtgcgcaggcgcccaggacattctgctcgcccaggatgagctctttgctcgggagtactttgacgacctcgccgccgaggtggatgaagtcctggaagagcagggcatggcgcccgtcggtgcgtcaagtggtttacccaagggggaggggagggtcaagctggggtga

SEQ ID NO: 7527 - DNA, 465 bp, Chlorella protothecoides
atgggccgccttgaagggcgctgcgattctgggtcctccctgccggagcatgtggctcacagcacggcaggacgtcgcagacaccgacatcctgagcgccagggggtggatgccttcacggataccgctttcaagggcaactctgctgcggtggtcttgctcccggagcaggacgtgccctccgatgccgccctgcaaagcatcgcaatggagaataatctgtctgagacagcctacatcagacccatccctcccagcagtgatgtgaccactggggacaactttgacctcaggtggttcacccccaccaccgaagtcaagctgtgcgggcacgccactctcgcctctgctgctgctctctggaaatgtgagttgcagcttcgaccctctggcccctgggagacctggctcatctttgacggaactgaggaatgtagcgttgtctgcgcctgcgctgccgcttaa

SEQ ID NO: 7528 - DNA, 495 bp, Chlorella protothecoides
atggactttcccctgaatcgtgccgtggcggacgtccccctgggcactgccgctggctcacggctggtgagggctgtggccggaaccatcccggtgagggaggtgctgcacaaccctgacatcaacaacttgctgatcgtgctggaggggggtcgggaggagcttctgagcatcagacccaggcctggcgagctgctggacgcccatccggagaagctcctcgtgatcgtcacggcaaagggggagggggagcacgacttcttctaccgcttctttgcgccttgggccggcatcgatgaggatccggtgaccgggtcggcctgcacggtggccgcgccctattgggctgctcggctgggcaagacggagctcagggcccgccagctgtcccagcgcacaggcgagctgtacgtggacgtgcgggaggatgcgggccgcgtcattgtggcgggtgatgctgtggtggtcatctccggacagctgcacctgcaatga

SEQ ID NO: 7529 - DNA, 2409 bp, Chlorella protothecoides
  modified_base (158)..(167): a, c, t, g, unknown or other
  modified_base (245)..(286): a, c, t, g, unknown or other
  modified_base (1162)..(1171): a, c, t, g, unknown or other
atgttagcgcggatcttccttccaccaacccatgtcgaggttctgcgtcactctcccgcagtcgtgcatgcgttgctgctgtggcaacggagaggagtgactccccaaaagttcccgacaccctgcggagaccacggctggggcacaaaaatacaacnnnnnnnnnnactctcccgcagtcgtgcatgcgttgctgcaatggcaacggagaggagtgactccccaaaaattcccgacacctgcgnnnnnnnnnnnnnnnnnnnnnnnnnnnnnnnnnnnnnnnnnntattcttcctgccatctgccaaccgtcgttacaccattggccgagggtcaccgcgcaatcaggcgccccttttgcgctgctgcctgttcaaaactgtattcttcctgccatctgccaaccgtcgtttacaccattggccgagggtcaccgggcaatcaagcggtctcctcgtccttgttgtagacataggtgaggtggcacttgccgcagtacacgcggttgaagtgggtggccatgaagatgcctgggccgcaggtggggcacaccttgcgcagacgctccaccttgccggaatcagagaccttgtagaacttgagcaccctcagcttgatcttcttgtgcttgtgcttctgcttcttgggcttggtgtaggtcttcttcttcctcttcttggcaccacccagcaggcgcagggagacgtacatctgggagtcgtcgctgacgccagcctcggacaggacggtcccatcctccagctggtgcccgccgaacagcacgcgctgctccgcagcgcacactcctgagccccagcctcgcggcgcgtaacctgcactcgctccatacgtaccctggcgcgcctcgatggcggccttcacgtcggcgaccgtcgcgccggagccaagctccagcacatgagtgcgccgtcctcacgtcgaaaaggagatgatcaggcagcaccaggggctaaagccacccaagctggggggtggaggctgcagagttcgtccccggaaaactctgctgtgctgagatggcatcgcgagcaggccccaggcatgatgggtgcctaaagcgactcctcccctgtgctgggtcgtggaggcaccctaccgagaggcaccatgtccacggactgggtacacgagctgaccgtgnnnnnnnnnncctcccctgtgctgggtcgtggaggcaccccaccgagaggcaccatgtcaactgactgggtacacgagctgaccgttgccaagctgaaggacgagctgaaaaagcgagatctacatgtgactggaaagaaagctgagctgatcgagcgcttggaggaattcctcaaagaagccgagggtgctgatgccgcctctgacgggaagagcgcagacgaaggggccgagccacaggacgaggatatgaaggatgcagcagctgacgaggcctcccaggacgataacgccgacagaaaggatggcggcagtgagtctcgcttcaccagtagcgacgacgaggctgtgcccgtggagagctccggccatggcagcccggccaagggcgatggcagcatgcacagcgaagacaggtcgggcgctgcggtggcaggacaggatggaggggcgggcgcggaggaggccgtggccgcagacgaggagagtgggccggtggccaacagagacggggcagaggcgccggctgcgcctggatcgggtgagagggagtcgaaagaggaccctgtgcccgaggcagcaagcccggctgggaagcctgaggcccctaccgccgcatcgctcgtggaggaggtggtggacctcgactacggcgaggaggaggccgaggccgctgctgccgcggcggcggcgaccagcgtccgcacaaagggcgctgccgcggccggcgccagccccggcaccgtcccaacaagcgggaagcggccgcgtggcgacgatgacgcgcccgccgccgccgctgcccccctgcaaaaggcgcctcgcgccgaacgaccggctgccgagggcgtggtcactgccagcacgacgcgcgcgctgcgcatcgatggcttcgtgcgccccttcacggagcgtgcggtgcgcgagctgctggaccccaccggcgcggagctcaaggcgctgtggatgcccagcatcaagacgcactgctactcggtgtttgcgagcaaggcggcggccgccgccgcgctggcggccaccgccgggctgacctggcccgccaccagccccaagaccctggcgccgcgccacgtcggtctgcgtgaggcggagcgcgccatcggccagggcgcggggaaccccgactttcgggtggagcggctgccggaagacggcgaggaggaggcggaggaggccgaggcggaggccgaggcggcggcctcgcccgcagccgctgcggcgggggcc

SEQ ID NO: 7530 - DNA, 2235 bp, Chlorella protothecoides
  modified_base (404)..(413): a, c, t, g, unknown or other
  modified_base (504)..(513): a, c, t, g, unknown or other
  modified_base (716)..(725): a, c, t, g, unknown or other
atggggatccctgcggccctggggagcatgatccagtcgctcagcacatatcaattggcatggggaatgatcgccatggcagggttggccgcggcgttgcttttgggaggaatcgtggccccgtacggcaggtacagcagctctgcatggggtcctctcattcctcctcggctggcatggctggtggcttcagatcagccttacgtcccccatgcagacgcaggagatcttgagcctggccatcccggtggtctggctggcggcatttgccacccaggagcagcgggcgagggtatccgaccccgtgaacgcggccctcatggccatgttcctcgtgcactacatacacagggacctcatctatcccttccgcattgtgccggccatgatgatgaggatgagcnnnnnnnnnnatggggtcccattggctcgccctgcgaagtgctcattctctaccctgtcgcgtccctggccccagcaggaccacactctcctcccacgcgnnnnnnnnnngcatgccgccataccccaacccctggcccccacttgcaggcaaaggcaccccactggctgtctggtccatggccgcaggcttctgaccacactctcctcccacgcgcaaccccaattctccacccagacccgctacctcctagaggaggcagcgatggggcgcgccatcagccccaccttcctgctgggcgccgcgctttggnnnnnnnnnnggcgatggggcgcgccatcgggcccaccttcctgctgggcgccgcgctttgggcgctgggctggggcattaatctccactccgacacggtgctcatccgacagcgtggggggcgcaggaagggctattccatcccgcagggcggcctgtttgccctcgtgtccgccgccaactactttggtgaggtggtggagtggctggggtgggccctggcctgccgctccctgcccgccacagcgttcgccctgttcaccaccgccaacctagtcccaaggtgtgggggggcgaggaatggaagggggaaaggagagtggcagtcgtcaacatcaggcatgcacaggacggggggtgggggggttgggggccagagaatcctttgtctgtccggggctgtgctttacgggcctcaccatgagctcttaaactgcccgaggagcccatcgactcggtccactccttctccttctgcgcagggcactgcatcaccacgcctggtaccacaagaccttcaagacgtacccaaagcagcggcgcgccatcatccccttcctgttgtgatgtcgtgtttagtcggtcccggccgtagtacttttgtcgacatgtgcatgtctgggacgccacagggtgtcaggagagctttccaagcccagcaggggctccgattccttctcagcctcgcacaccatgcgcacacacgactgctactacaggggcccacactcagatgcgcggtgtgggtgcggacgacggtcctcaggagggggacctgggtgggaagggtggccggcctcgcaagcggcgggcgacaggcagcaatgcaatgggctcaaaggcggggcgagcaacatgggcttatgacgggggaaaggagggagactaagaatgatcatgccacagacgggggagtcgtggaacctgcgggccatcgtgggcgccgagaggtggggcagcgtcgtgctgctggcgcgagggatcgtcgctggtggggcggggggacgggcgccgatgccggccggccaggcgcagacgcgcgcgaggctggcgcagcgcgcaggacggcacagcgccatcagttgtcgctgcgctcagccctcccgctgggccttcagaggccgcccgcgcggagcgggctgtgcgctcccaggagctccaggcccagcccgtccagcccggcaccgacgccgtcgttccagcccccagggacgaacatggcggtcctgcggcccgacatcaggcgcggcggggtgatgcccagggccgaggccgccgcggcccacaggtcggcgtcgcagtcatcgccgcggggcaagggcccctgcgggccgggggacagcgccagcgccatgcccgggtacagcggcacgtgggccggctcgccgccgccggccgggccagcgtccgggtggcaggcaaggccctcgtccacggatggcactgagcccagcaggctgcgtggcgtgcccggcgtgtcggcgccgccggcccgctgcgccgcggcgatctcgtctccg

SEQ ID NO: 7531 - DNA, 558 bp, Chlorella protothecoides
atgcagatcttcgtgaacaccgaccgcactcatgtgctggagcttggctccggcgcgacggtcgccgacgtgaaggccgccatcgaggcgcgccagggtacgttacgcgccgcgaggctggggctcctgttcgccagcagcttcaaggagatgtctacagtgtgcgaaaacgtccgtccctcctccctcacaggagtgtgcgctgcggagcagcgcgtgctgttcggcgggcaccagctggaggatgggaccgtcctgtccgaggctggcgtcagcgacgactcccagatgtacgtctccctgcgcctgctgggtggtgccaagaagaggaagaagaagacctacaccaagcccaagaagcagaagcacaagcacaagaagatcaagctgagggtgctcaagttctacaaggtctctgattccggcaaggtggagcgtctgcgcaaggtgtgccccacctgcggcccaggcatcttcatggccacccacttcaaccgcgtgtactgcggcaagtgccacctcacctatgtctacaacaaggacgaggagaccgcttga

SEQ ID NO: 7532 - DNA, 183 bp, Chlorella protothecoides
gccgcggtaagacagaggatgcaagcgttatccggaatgattgggcgtaaagcgtctatatcgggaggaacaccaaaggcgaaggcactctgctgggccaatactaacactgagagacgaaagcgaggggagcaaatgggattagataccccagtagtcctcgccgtaaacaatggaaactag

SEQ ID NO: 7533 - DNA, 1005 bp, Chlorella protothecoides
atggacgagttcaagcagggggtggtgggtgccaagagcaacaaccttgcggggctgagggggcgactgcccgagagcattcagctccccgcctctgtgacggcgctggagagccgggagaacagggagctggccaagcagatccgcgccgcagtgtcctcggtagctccccacagccctggcccggccctggcgcggtgccgcgacctggtgaaccaggtcgcggtgccctccgccctgcgcaaggagctggaggcgggcatgcgcgccgcgggcatccccgtgccgcaggacgaggagcggtggcaggccgccctgtgcgcgctcaaggtggagtattggttggatggaggggagtgtggacctggggaaagaaggagtcacccctcccaaacccaccgcctcctcccaaactggcaaacccaacaggcggtgtgggcgtccaagtacaacgaccgcgccttctactcctgccgcaaggtgggcctccgcttcgacgacgtgcgcatggcggtgctgtgccagcgcgtcgtccccgtgcgctacgcctttgtcatccacaccgccaaccccgtctccggcgacgccgacgagatctacgccgagctggtcatcggcctgggggaggccatcgtctccggcgccgtccccggcagcgcgctcgccttctccgcgcggaaggatgcgctggacgcgccgcgcgtcctgctctaccccagcaagtcgcgggcgctggtggtggacgactcgctcatcctgcgctccgactccaatggcgaggacctggagggctacgccggcgcagggctgtacgaatcggtcaccgtggacgcgacgcgcagcgtggtggcagactacagcgcagatgacctgctgatggaccccgggttccggcgccgcctcatgaccgacgtgtgccgcgtgggcctggagatcgagcaggtaatggagtgtggaggggttgaggggaggagggagggaattggagtggtgtgtgtgaggtga

SEQ ID NO: 7534 - DNA, 513 bp, Chlorella protothecoides
gcgacggcggtgctggaccgcgcccgccgcgccgtggcagcgctgtccgaccgcgtccctggcctgcgcgccgccgcggagctgggcgcctggcagctggtgtcccccggcgcggcgcgcggcgagctggtcgccgtgccctcgctgcgcgaggtgcaggaccgcgctttcccccgccccaccgtgctcctggcctgggaggtgacgggggaggaggaggtccccgccggggtcgtggccctgctgtcccccgacgccccggacgtgctgtcccacctggccgtgcgcgctcgcaacctggccgtgctcttcgccgcctgccacgacgccgcgccgctgcgcgagctggaggccctggagggccgggtgctggagctggacagcacggccgcgggggcggtgacctggcaggaggccgacgaggaggaggtggaggggggcggggggagggccacaccggcgggtgtggccgcggggaccaagaagctcacccgccccaccacgcccaagtga

SEQ ID NO: 7535 - DNA, 1209 bp, Chlorella protothecoides
  modified_base (773)..(782): a, c, t, g, unknown or other
atggacgcactggatgaacgaggagccttcccacttgtaaattctccgtccctcacactcgatcacgccatacgatgtgccattcactggtcctgccgccctgcacccaggcaccaccgcaccacctcccccctgcaggccaccgaacagacggtgataatcatctcctccaagaaggaccaccagtcgcacgccaacgcgaccgcagaggagacaggcgcccagggcaatgccaccgccgctgacgccagcaaggccggcgccggcgtcagcgccgacgaggcggcgcggttggccgcggcggccaaggcccgggaggcggccgccgccgcggccaccgggggcgagggcgacgtcgaccgcatcatcgacagcaaagacaacgagtatgtcctctccaaggccggggaggagggcggcatgggcatcaccctcgacccgcgtctggtcaaggacctgaccgtgctcatcgccgcttgcgcgatgatgggcatggccatggaggcggtggggcagcccaccatcaacggctacttcatcgcagggtcggtgggtggaggtcgggggcgctgctcgggtgaagaggcaggagctcgtgctgcatgggatatgcatgaccctgtgagctggcggagaggtcggcgtcccagcgctgcctcctgtgcggcgttcatccttccttcagccccaaattgtgggctcttccccccgccccctgctactgcccaaagtcacccagccccgccccctgctactgcctgcagccgcccagnnnnnnnnnnggtcggcgtcccagcgctgcctcctgtgcgacgtccagtccctggcccagctgggggtccagctcctgctcttcagcctgggcctggagttctcgctggccaagctgcgcgctgtgcgcgacgtggcgctgctgggcggcgcgctgcaggtggccctcctctccggcctgtcggccggcgtggctgccgccatcggcacctccccctccctgggcgcctttgtcggcgcgctggcgggcatgagcagcaccagcatcgtggtcaagtgcctatcggaccggcgctgccagcacagcgccagcgggcagatcgtggtgggcaccctggtcatccaggactgcatggtcggcctgctctttgcgctcatgccgctcctggtcctggccgcgcgcgcggcgggcgccgacgcgggcgccgcggcgcgcgc

SEQ ID NO: 7536 - DNA, 972 bp, Chlorella protothecoides
  modified_base (179)..(188): a, c, t, g, unknown or other
  modified_base (267)..(276): a, c, t, g, unknown or other
atggactgctggcggagcaggggtgagggacgggcaacggtggtccccgaatggacacgggaaccacccgggattgctgggcgcatggctccctgtgcagaaacagtgggacgcagatactcaattcatttcattcaaacgtataaaagaaatgccggcggcagtggtgaacgccgagnnnnnnnnnngcatggctcccttcgtggtggtggcggtgattcattcagagacttgccctctttacttcgagtagcctccttctcctcnnnnnnnnnncattcagagacttgccctctttacttcgagcagtctgtgtcactgcaccccgccttctccttctttgacacgggacctctgcgcctctcaataccgagtgcacccgttctccatgcaggtcttcagcaggacccgccggagggagtgaacgcctcgcctaggtcagacaacatcatgaactggcgagcagtcatctttggaccggagggaacggtctgggatggaggtgagggccaaacctggagagtgggtgctgcttccagacccctcccgggtggggcctcaattttagcctccaccgtgtcatcccaggactatcccaacaaggcccccatcgtgaagttcaagacgccaatgtatcacccgaacagtgagtggcatcgaggcaagcagtaaccagtggagtcccatttacgatgtctcggccatcttgacctccattcagagatcagcagcaaattgaatcttccggcccccgctaacccgccctgcagtcactgctgtcagaccccaatccaaactcgcccgccaactctgaagctgccaaactttatgtggaggataggtgagaattctattgtcagtatgtatggcatgagtcctttccccccttctgatattgcacctgccaagaacaagatactaagggatgccacggcactcacctgcacaggaaggagtataaccgaagggtga

SEQ ID NO: 7537 - DNA, 885 bp, Chlorella protothecoides
  modified_base (873)..(882): a, c, t, g, unknown or other
atggaccctgacagtaggagggcattcaaaccactccaccacataaacccagcagcttctactccatctcaacggtcgcatgctcagtctcatgcacatacacaattgcagctcggcatctcctacgatgtctttgtgaggaccacccagccggcgcatgcggaggtggtggcccaagtactggagcgggtgtgggacaaagacgtctacaaggcggcctacagcgggtggtactgcgttggctgcgaggagtacaaggacgagctggagctgggtccaagtgaggcaggggggttgctggtgggtgttgcaactcgcgcacaagctggacaaggagtaacgaaagctgaaagtgggagcctctgcatgtttgagatgtttcaatgccgtgcatcgacacattcatgcatacccaaagagcaagccgcccacgccctgcccaaaagttcactcttcgaatcccgcagatcacacttgcacgacccaccagacactgtgccagcacagggaggaggacaactacttctttgcactgacttcctggagacacaccctgactttgtgcagcccgcctcggccaggaacgaggtcctggcctgggtgaaatctggcctgcgcgacttctccatctcccggtctgcggtgtcctggggaatccctgtgcccctagacccgagccacacggtgtacgtctggtttgacgcgctggtgggctacctcaccgccctgctccagacgccacccgggggtgtgtcgctcggtgcgactggcggggcaccgcctgacacggcgcgtcccaagggcgagacgccgggctccccccgcctggacgacctgccccggcacggctggccggctgccgcccacatcatnnnnnnnnnntga

SEQ ID NO: 7538 - DNA, 1911 bp, Chlorella protothecoides
atggcccaacatcctgtgcgtcgccgatcgccccacccatcaagaacccccccacccctcgctccttcgaaaggtcacctggacctgctgaccgacgaggccttcctggaggccatccagtccttcttcgcctccatccccaccgccgacgtgtggcaggaccaggcgtggcaggagcagcagcgccggctgctggccgcgcagttcgggccacgtgaggtggagagcctggccgtcaacgccgtggtgccggcgctggaggaggagaatggcgcggacgccgctctggactgggtcatcgccaaggagacgcaggacctggcggtgctgcacggccagtccgacctctcttcctggtactttgtggagcatggtgagcgagccctctccctccccaatccccacatcatccacaccgaatcatcatccactcccctccaaccaccaccccgtgccgcagccgagatcgggggcgtgctgatcaacgtgacggtgtcgctgacctcgcggctgctgacgggggagcgcgccctggcgacgcgcagcgtgcagagcgccgacgccttccaccgcagcctctccgcctcgggcttccagctggtcaacgtgggcaacgtgcccatcgggctggggcgctgggtggtgggctccgaccccagcctgcgcggcggccgcttcagcaacggcttcctgagccagcgcgcactgcagagcaacctgctgcgccactaccgccgcgaggcgctcaaggaggcgcataaggtgctgtccggcgcggggccggccatcgcgtcggtgccgctgaccgtcatctgggcctcgggctccgccttctccctgctgcgcgccatctcccgcggcgccaccgggcccggcgccgcggcgcagcagttcgtctacgtccccctcatgggcatcagcatgatcgtgtcggggttctcgcgcatgctggcggcggtgctggcggcgctgccccccgcccgtgccgacggcgacgcggccaccgtccagcgcatcatccagcgcccggggtcctccctggaagccctcttccgcgtgggccaggagctgggcctgggcgtggcggcgggcctgtccggcatcatcctggaccccgtggccggctggcgcgcggggggctgggccggcttgtccctgggcctggccaagggcctcgtgctgggcctgctgggccggcccctggtgggcgtgctggaggcgggcagccagctcagcggcgcctttgcccgcgcggctctgggtcgcgagggcatcctgggcaagctgcagcgccgcgtgcgcgccccgggcgcgcacggcgacgaccccggcgactcgctggacgagcggacggggggcgaggcacgcgtcgcgctgcgcgcgctggtggacgcctggcagcgcgtgctgccgcagttcttccccgtcctggcgcgcgaccgcgtgctggacgtggtcaacctgcgccccagccgcgtgctgctggtcaccgaccgccacctggcctacctgcgcgcgcgccacctgcgcgcccactccgtctaccgcgccaagtggctggtcccgctgtccgaggtccagaacctgacggggtccgcggagagcatgaagctggcgctcacccacgtccaccgctacgacctctggctcctgggcgtctggcccgtggccgcgcgcaagaagatgcgctgcggatcgcgctccgtctacgagcacacggtggccaagctgtcgcgcctgctccaggccgccaaggccggcggcgggcgcctgggctggggagaccgcgaggacgcgctgcgcggcggggccgcacagctcaccatcctctccgcgccctaccacccgccggaggcgggggctgtggcggcgggagcccagaggcctgctccacccgccgacgccaagtga

SEQ ID NO: 7539 - DNA, 498 bp, Chlorella protothecoides
atgggcaaatccctgggcaacgtgctggacccacgggctctggtggatgcctacggcgctgacgctgtacgcttcttcttcatgcgcgagatcgcgtttggcgccgacggcgacttcagcgaggcgcggttccaggccacggtgaacgcaggcctggccaacgacctgggcaacctgctgaagcgcacgctgggcatgctgcacgccaacgttggggacagactgccgtgcggcgcaggcgaggcaggggcaggggtgcgggacgccacgcgcctgccgggcgttgccgaggccgcggcgccgcgtgccgcggcggcctatgcggccctgcagccccacgccgcctgcgaggcggcgctggccgtcagcggcgacgccaacctcctcctgtcagagctgcagccctggaccaccctcaaaaaggcagggctttggctttgtggattgtgtgtgcggaaggggggaaagggggccggcggcggcccatggtggatttga

SEQ ID NO: 7540 - DNA, 408 bp, Chlorella protothecoides
atggtggagcacatctttatcaaagggtggcctgtggcaagaacaggtgttctgctcgaattcccaccccgccataccacacgggggacggaggaggaaaaggctgccgccatcacggtgctggtggctgtgctggaggcggtacgcatcgtggccgtactgctgagccccgtcacgcccagcctctcacatgccatcctgcgccagctggggcaggaggcggctgctgcggggcagccagcctggagcgacgccgcctggggaaagttgcaggccggcacgagccttccgccgccggagctggtcttcgcgcgcatcgcccgggagtttgtcacagagccggcggcgggcgcggccgcggcgccgaccaagggcgccaagcgcaaggcccagaaggtggcgtcctga

SEQ ID NO: 7541 - DNA, 1203 bp, Chlorella protothecoides
  modified_base (910)..(919): a, c, t, g, unknown or other
atgcgccggcaacaccgccctcttttccctcccactcccctctccaagcccaggcacgcacccatcccccccgctgcgcaggtacaaagcaaggagagggaggcgacgacgcgcctcggcgcggcgctgggcctggagggcacctacatcccgcactcctacatcgagctggtgcagatcgagaacctgacaacctccttccagaccgtgaccgaggacctgaagcgccggttcaaggtttccggggagcccctggacggcccgggcctgctgggcagcagcttctcccacggcagcagcccgctggcctccggctccttccgccgcaccctggggttcgagctgtcggggtgcgggggcggcagcggcaccacgcccttcagcacctcgggtgcgccgaggggtggtgtgctggggaggggcatgcaggaggactggcgggggcctggggccatgtgggaggtcgtcaggccgtgggcgggagggtgcgctgcatgcagtgcccgcccaccgtctccggcacgcccgacggtgccccctccacgcccgtcccgcagcccccgtggccgccagccgcctgcacatgtcgcccggcagcgtgggccaggagcgggtggggtcccggcccgagggcctgctgagtcagcacatgggcgcggctgggtcggcgcacggctccaagcgcggcgggcgggaggtggaggacaccgcctcctccagcagcggggtcgggagccagagcgagggcgagggcggacggggcgggggcatcgcgatccgggcacgcccggcgccggccgccaacgggcgccaccgggccgcaggcgaggagggggcgccgcggcgcggcggcgaggaggccgccggccaggggacggccgggccgccgggggcatccgcccccagcagnnnnnnnnnngccgcggcgcggcggcgaggaggccgccgggcaggggacagccgggtcgcagggggcgcccgcacccagcaaggccgggggcgaggggccgagctcgtcgcacctggaggcgcggctggcttcgctgctggacagccaactgctgctgggcaggcagctggaggaagtcgccttgcagctgcgcctcctgcgcgaggccggcggccggagggagctcgggggcatggcgggggctgggctcgacggcgctgccggcgcctcacatcccctccccgcgcccctga

SEQ ID NO: 7542 - DNA, 612 bp, Chlorella protothecoides
atggcgaccacggcgcgccccttccaccttgtcctctggggcgccactggtttcacaggtcgattggtggcagagcaccttgcacagtcctaccagggcaaagtcaagtgggcgatcgctggccgaagcagggaccgcctcgagagcctgcggctttccttgagcacccagtatggcttcgacaaggaggacgtccccatcctgcttggagacctggaggatccccagtcgctgcatgccgccttctcgcaggccaaggtcgtcatctccaccgccggaccctacctgaggctcggcacccccgttgttgacgctgccgtgcacgctgggacgcattatgttgacatcacaggtagaagatgggatgatgcagacatgttctggtttcttgctgcggggaatacaaagttgtgcggctgggaccttgagttgtgtacgccctgcttgtcatgcgagcatcgtgtggtggggaccccgcgtctgtcccaggtcagtcaccctctttgtattcaaattttggcaggggagattccttgggttacaaccctggtggacaagtaccacgaatccgccagggagaagggcatccgcctcattccatgctgcgcgtga

SEQ ID NO: 7543 - DNA, 1326 bp, Chlorella protothecoides
atggtggtgcgggccatccagctgctctgctcccagaaccgagacaccatcctggtgggccttgcgggcccctccgggtccggcaagaccgccttctcagccaagatccagtccttcataccggacagcgtggtgctgagcatggacatgtacaacgacgggagcaaggtcatcgacggcaactttgacgacccccgcatcaccgacttcgacaccctgatccagaacatcaccgacctgcgtgccggccgcgcagcggaggtccccatctacgacttcaaggagagccggcgcgtgggaacgcggcgcgtggaggtcacctcctcccgcgtggtcatcctggagggcatctacgcgctgagccagcgcctgcgccccatgctggacctccgcgtctccatcaccggcggcgtgcacttcgacctggtcaagcgcgtcctgcgcgacatcaaccgctcggggcaggcggcggaggacatcatccagcaggtctccgagacggtgtaccccatgtacaaggccttcatagagcccgacctgcaagccgcccacctgcgcatccacaaccgcttcaaccccttctccgggttcatgagtcctacctacatcctcaagtcggccagcgcagtgaccgaggagcaggtgctggccgtgctggccgaggtgagcagcagcccgcggtgtcaccagggttggatgggcgggtgttgcggctttgtgtgtgtgtttggcgtgtgggtgcatggggaatgtgacctgcgtgcgctttggcgggcacctgaccgtgggcatgagtgcttgggacccctccctgtgctccaatccccgctccctgcatcccccggccgccccctcccaacccggtccaccctcccacaccgaccggctgcacagggcggcgacggcgcggctgcggggaagcaggacacgacggagagctacgacatctacctcctcccgcccaacgaggacgcggagtcgtgcgccagctggctgcgcatgcggtaccgcgacgggcgctactccctcatgtttgaggagtgggtggtggacggcagcgtcatcatctctcccagggtcacgttcgaggtgcccgtccgcatcctgggcggcctcatggcgttggggtacgatgtcggcactatcatgcgccgaaccagccgcaccttctccaacgacagggggggtggaaggctggaaggggctttgggggcaccgggaggacttgggcacaagcggtacctgggcctgtgggtgggccctgggctgccatccctgaatagtgaaacctccaggcaggccccccgtgggacgctctcgacatga

SEQ ID NO: 7544 - DNA, 2760 bp, Chlorella protothecoides
  modified_base (296)..(305): a, c, t, g, unknown or other
  modified_base (359)..(397): a, c, t, g, unknown or other
  modified_base (1054)..(1063): a, c, t, g, unknown or other
  modified_base (2528)..(2537): a, c, t, g, unknown or other
atggagcgtgcgattcctcccgcccacccatgtgtgggggggatggatacggaccccaacagcgtcacaccgactacgcgattcgattcgcggagggctccgtgcgctccctggctggtgcatgagccatctaatgttatttttgttgaagaattgaacccagcacccaattggggacatgggagccttcagggggctagtccggcccacgtgggtatgctaaactgtatcatgggaggcatcgaggtagcgcattatcgacagactcgaccaatatatctccgagacccccagannnnnnnnnngattcttgttgaagaattgagcacagcacccaattggggacatgggagccttcnnnnnnnnnnnnnnnnnnnnnnnnnnnnnnnnnnnnnnntggattcgggacctgtgtccgcgagaatacggatgatgatggtgcgactggtcgtgctgggcctccttgccctagcattggcgccaccggtctacagtgcagacttcgtcaaggtcgacggtctgcgcttcacgtccggtaattgcacggactttaagccggttggatggaacggagtgcagtggaatacacgcgcctcactgttcttcccttgcgcccctgcctcccgtggcaggtggtccaccctatcgtacgcggccaacaagaagtccatgccgggattcaatgatgggcgggccttcctgaccaacatgttcaaggaggcccaggcgctgaacttcaacgtctaccgcttcttcatccagggcgattactccttcctcaccaccagcgctggtgaggatgcctgggcggtttctgacccctcgcttgcagtgggcggagaacgggcggttggggatgggtgggcatcctggaataagggagtgacactgcgcgttctgattttccagggctttgactttgtgctggacgaggctgccaagtataacatcaagctcacccccatcctgctcaacctctggatcgacgacggcgtgccactgtttgagaagttctgcggcagtgacagctccaactaccgccccaccccctccnnnnnnnnnncctgttcatggcctgatccccatccatcctccaataccgccgccccccgccccccgcccccacagtttgagaagttctgcggcagcgacagctccaactaccgccccaccccctccatcgacctgcgcaccgagacgacgctgaacgcctcggagcgcctgcagaccccctacaagtggtacaccgaccccgactgccggcagtatgtcaaggacttcatcaccaaggtggtcacgcgcgtcaacaccatcaacggcatcgcatacaaggacgaccccaccatcttcagttggaacatgttgaacgaggtgaggcacggcgaggggggaaacaatgctcagctcggaaggcaacaggggaccctaccccagcctgcttccattccaggctgccttggactggcccctgcatatcgcaaagcctatacaccaaatgtcgagacatgcccaagcctctcggagggcaacaggggaccctaccccagcctcgcctccattccaggctgccctggactggcccctgcatatcgcaaagcctatacaccgaatgtcaagacatgcccaagcctgtgtatccgccccacttcaaacccagccttctttgccctccctccacagcctcgctgcaagtattgcggacccgaggccgtcacggagtggtaccacgacattgccgcccacctgaagtctgtggaccccaaccatctggtcaccaccggggaggaaggtgcggaacctgcctgcctgtggctgtctggaaagggcgcagtgcatgcgcccctggtggactctggcttgcgcctgcctgcggtcatgatgtcaccgctcactggaccccctccatctggctgccctgccttgccagcccccagagcccctgccccatcagtccatgccaccaacacatgcgcaggcttcttcgacgagtcctccagcttcgtcgccgcggaccccacggacggcaacaagtggggcccccgctccggccaggactttgtcgccaaccacgattcccccaacatcgactacaccgtcatccacatgtggcctgacaactggggtgtgcagcccaacgacatcgcctttggcaagacctggatcgacttccacactcaggccagcacggcactgggcaagcctctgctcatggaaggtgcggcatggccgtgggtgggaccaggcggttatgtttttgctgggatgcatgcccggggatggtgtccacagccgcggcagagcatgacgtcaagcgccgcggcagagcattacgtcaagcggtggcatgttcgaggcccccagtgccccattaccaaccccctcatgcccaccctgccctctgaccacccctcagagtttggcaagggcgtgacagactcgagccagatcacctcttttagggatccctggtactccctcacctacgacgccgccacccagagcattgctgcgggcggcgccctgcgtgnnnnnnnnnnctcagagtttggcaagggcgtgacggactcgagccagatcacctccgtcagggatccctggtactccctcacttacgacgccgccaccgagagcattgctgcgggcggcgccctgcgtggagccctgttctggctgtgggacgggtccacccagaatggcggcgacggcgttgtggtgggaaccgccgactccacgatttcggtgagggctttcggcgcatga

SEQ ID NO: 7545 - DNA, 1068 bp, Chlorella protothecoides
  modified_base (382)..(391): a, c, t, g, unknown or other
  modified_base (811)..(820): a, c, t, g, unknown or other
atggatcccaagaacatccccaaggccagtcctcagagcgtcgctcggcagaacaggatcatcggcctggcagctgttgcaggggctacagccatctactttatgatcaaaaagtctgacgagacgaaccctgatgtggccaaggaaaaggtggaatcagctggcagcaaggtcaaggaagcagctggagatgcaaaggatgcagctcaggaggcagcaaatgatgccaaagccaaggcctccaatgctgtggacgatgccaaggccaaggcctccaatgccgtggatgatgccaagaagaacatcagcaagaaggtggacgaagcgaaacagaaggccggagacaaggttgaggatgcggggaagagcatcaagaaattgnnnnnnnnnnaacagaaggccggagacaaggttgaggatgtggatttctgccacacatggaatagggtaatatgccctttaaggagaagcccggcttgggtaccggcagtatataccgggagccttcacaacacccccgacgcctcctacggcaccccttgccagtttggcgctccaaatccgctgtgtccaccgtgctatgacaattgtgcggggaatgagggaggagtgcgagcttgccctgctggaacgcgcacggacagttggcaccggggtcaaactccgtgcaccaacggatgccaccccgtcccaaccgctgttcaaaatcacgttgcggggctcaatgaccattgttttctgtactctcgccaattgccgatcctgcagaaaatagtttggtatcataaaacccttacagaccagcgcattnnnnnnnnnntgtactctcgccaattgccgatcctgcagagaacagtttggtatcctaaaacccttccagatcagcgcatctcctcacaaacgcttacaatggctcgtgccgccgtactcttcgtcacgctgctgtcgtgcctggccgcgacgcagggaaccctcaccctgaagcagatccttaacgactctcgcttcacagcctacgtgaaccaggtatgcgctccaggcgagcgcgatcactctgcaagtgcttga

SEQ ID NO: 7546 - DNA, 1023 bp, Chlorella protothecoides
atggccgtgatcctccacccacggcgcgcgaaaaccgaggacagggcgttgagcaaaaatgggtcccagtctcggaagggtaaagcaccctccataccagccgagtggaaggtggagctgcctgaggaagggaatcgcggcgactctatcttcggtggctgccgcagtatagaggctggctaccaaagggagtttgtactggggcaaggaacctatggagaggtgtatcgggccgtcgaccgggctactggagacattgttgctgccaagaagataaaaatggacaatgaaaaagaggggtttccgatcactgccatacgagctcacaatgccccttactcatcccacagaaatcaagatcctgtctgcgcttgcccagtcaaaggcagagatcaacggcaagatcctccgaaaccatgtcatcactttgcgggaaatcgtccgatcaggaaggaagtgtcaccctgtatggtgacaattgttgcaagccaccaatgttccagtctccctccgtgcatctccctcgcaggccacaagtgcaacaacttcaggggttccatctacatgatctttgactacatggaccatgacatgacgggtctgctggcccggtcgcagcgggagggtcctccattctctgtgcctcagatcaagtgctacatgcagcagctgcttctgggtcttgcactcctggaaacaaacaagaggcgcaagccccggccgctctctccatggcatgtggttgttgctatttggatggatcttgtgagagggtcgaggtgaggcgcaagcccctgccgctctctccatggcatgtggttgttgctgtgcttggatggatcttgtgagagggtcgaggtgttaaggagggcaagctgcgcccgaggtgctacatcgggacttgaagaacagcaacctcctcatcaacgatggagggatactgaggatcggggactttgggctggccaggtaccgcccccaaggcgaggaggacgggcagggaaatggcgcgaggatgactaa

SEQ ID NO: 7547 - DNA, 1545 bp, Chlorella protothecoides
  modified_base (70)..(79): a, c, t, g, unknown or other
  modified_base (534)..(543): a, c, t, g, unknown or other
  modified_base (1372)..(1381): a, c, t, g, unknown or other
atgaccgactgtgtgtctctccaggataattgccaaacctccggcctcattgcctgctcccacctggctnnnnnnnnnnatgtggacaagggaagagtgtgctgggtggctgtgagaaaggcatgcagctcgaaaatgaccccctgtgtgtctccccaggataatgccaaacttccggcctcattgcctgctcccacctggctcgaggtctttgatcccccctcccttcctgctcgtcacctccatgtccgcagctaccagcacatcgacttcaacaacgccaagtaccccaacaacagccggctgcgccaccatcttcagaacagcagcattatggatgctcaagtgcgtggcgagcatgcctggctgtcagagtgggattggtacgatgatgtggtgcagactcctttctgtatcctttggatgtgcagctcagtggcagccccacacctttcgcaactcaggccaaggatctcatggagcaaatgctcttgctggatcctaagaaacgcatctctgccaaggaggctgccnnnnnnnnnntgtgatgagcatgtccggctgtcagagtgggattggtacgataatgtggtgcagactccttcttgtatcctttggatgtgcagctcagcggcagccccacaccttttgcaactcaggccaaggatcttatggagcaaatgctcttgctggatcccaagaaacgcatctctgccaaggaggctgcctcgccacccactgctgctggagctgaggcatgatgatttcttcactctctgtgcgattcaccctgccttctccatctccccaaccttcgcacagcacccctggttctacacgcatccgctgccgatggagccgcacaagattcccaaataccaatccagccacgagatgagcatgaaacgctccaggcaggagggagggggcgcagggaggggtcggcaccccccccaccccgggcccccgtccggcaagcaggccaggctctccggccccggccaggccccgcaccccgggcagcgtgccggaccccagggccggggacccggcggggctggccccgcctcagcgggcacgtggcaggcctacccccctcagcagcaggtgccgctgggcgggcagcacccggggcaaccgcccctcaggccgctggtgcatgccgcctcgggcgcgccgattccgtaccccgccgcggccttcgtccagcaaggcgcgctgccgggtcagcagcccgggcgcggccagcacccggcgcgagctccgctgagtgtgggcggcgtgcctcctcccccgccagcagctcccatgcgcggcccgccaccgggagctgcgcccccgccgcctgccgcctggcagtcgcagcgccgannnnnnnnnnctgcgcggcccaccaccgggggctgccccccccccgcctgccgcctggcagtcgcagcgccgatgatggcgccgagggcgtggatgcgggcccaattttccttccttggcgcagacatggtggcgcgaggcatgcgccatcatggtgcccagtggtccatgtga

SEQ ID NO: 7548 - DNA, 681 bp, Chlorella protothecoides
atgcaccctgtggacaagtcacgcctccatgcttctcaccctgcaaagcgccttccggctcctgcatgcccagccagcagcccccctcattgccatccaccgtggacgagtgtttgccgaggccagtggtctctctctggggccgggcccgtttgtcactgctctggaggtggccgcaggcaggaccgcccaggtggtggggaagccggcgcccgccttcttcgcggcagcgctggaccacctcggcgtggcctcggagcacgctgtcatgatcggtgggtgcgctgttcccttcacaggcctttcattccactggtcccgagtgcggggtggcagatcacgtgcaggcactggcccgcctgcctgcctgcccagcctaacaactctggaaaatgctcgcatcaagcgatgcactgcgagggcagacctcatgccaggtcagcagcgcagggcaatcctccatccagcgctgctgtcaagccccccaccctgccctgctccgcaggggatgacgtgcgggatgacgtgcagggcgctcaggcagcgggcctagcgggggtcctggtgcagacaggcaagtaccagctgggggacgagggattcggtgcgccggcggcctccgccccagacgccacggtgccagactttgctgccgcagtggactggctgctcagccagtga

SEQ ID NO: 7549 - DNA, 540 bp, Chlorella protothecoides
atgcgattcaaggccgccctcatcgatctgagcggcaccctccacatcgatgggcaagcgatcccaggggctgtggcagctcttgagcgcctgcgcgccgcgcagctgccgtgcagatttgtcaccaacacgaccaaggacaccgtggacagagtatcagcagcatttcacatgcaacccctgcttgactggcatctccctgtccatgagggtccctggtcgcctccacaggtgttctcgtccctgtctgcaacccgccagctcctgaaacagcgtgacctgcgccccttgctgctcctggaccgacgtgccctgcccgagtttgacgacgtcccccagcatgatcctaacgctgtggtggtgggtctggcccgagaggccttcaactacgacagcctgaatcggtgcgtggcagaatgtggatgttattctctgggtcacgaggagtttggagcctctcctgggaggggtgatcatttaataggacttgggcatgatctgtggcggcttctttgcacgccatgttgggcaccattttag

SEQ ID NO: 7550 - DNA, 1005 bp, Chlorella protothecoides
atggagaagcccgtcagtctacacccggatgacattcgcgaccagaagcctcctcattgccatgcagagagatgctccgccagccacgccaccctccccctctcccattggccccaggtgcaagtcctgcggtgcatcaagcccccctccctggacaatgtggtgctggggcagtacactgccgccaatggcgaggacgggtacctagaggaccccaccgtgccccagggctccaggacccccacctttgcctccattgtgctgtacatcgacaacgacaggtgggcgggcgtgcccttcatcatcaaggctggcaaggccctggacgagcgcaaggcggagattcgcatccaactgcacgagaccccccacttcatttttgcgggcgagtccagctcctcccgaaacgaactggtggtccggctgcagcctgacgaggccatctacatgaagttcatcgtgaagaagccaggtctgcggcgtgggagagctcagcctgggggggtggggtggcacgagacgctttgtgtcgaggggaaacaagagcgccgaggattcatggcaccaagggtgtcgactggcaaattgcttggcactgtggaggggtctcgaccctatgcactgagacgcaacccccccgccccatccggcaacctccctccctcctccacacacacaggactggacacggagcccgtgatctccgagctggaccttgattaccacagccgatatccagacgtcatcatccccgatgcctaccccaagctcattctggacgccatccgcggcgaccagcagcactttgtgcgccgcgacgagctgcgcgctgcctgggccattttcacgcccctgctacacgccgtggacgcgggggaggtgcccatccacccatacccctactcctcccgtggacccgaggaggcggacgcgctgcgctcgcgggtgggctgggtcaagaacagcaagtatgactggaaggccaaggtcgatgtgccggcgtga

SEQ ID NO: 7551 - DNA, 300 bp, Chlorella protothecoides
atggcgatgggcctttgttgtacggctgtgtctgttgttcgtgaggcgggtctggattgggtggcacggaatgcgcagcgtccggcagtggtcaacctctctctgcgctccaccaccggctcctccgccctcgccgacgccgctacccggctggtgaacgaattccagctacctgttgtcgtggcggccggcaacgagggctctcaggcatgtggaagctcacctgggaacgcgaccggcgtcctgacagttggggcctccaccatgcagaatgctgcctggaacctcactaactggtag

SEQ ID NO: 7552 - DNA, 456 bp, Chlorella protothecoides
atgctggaccaggaagatcaggaaagcctgcgctcttcgcatggcagtgacatccagtccatggaggacaacacccagcttcacacggcagagcttgtgagcaagtccagtgaaatgaccctactgtcctactccccaccacggctgtccacacgtggctccctgtggactcaggatggtcccgcctggcccctgcagcgcatcaatcgccgcaggtggtcgccagggatgagcccacccgcagactatgccttctcggccctgggctctggagtgaatgcatacatcgtcgacaccggcatcagactgtctcacagggagtttgcgtccttcccagacggaactggcgcgtcccgtgccctgcccgccatgtctggtgcgtcggtggcgggcccaagccggctggcttgggtggcgacaggcctgctgtctgggctttgcccggtcgtagggtga

SEQ ID NO: 7553 - DNA, 1047 bp, Chlorella protothecoides
atgggcctcataagagcgtacctaggcattagccctgttgcttgcatgcatctgggtccgtatatctggcatgttgcgttgaaggcacgtctccctctgattatctcaggttcgcgagacaatgcgctcctagtagcggagagacgcaaggtgtcccagcaagtctcgactccttctccacctgtctggaagtcgcgaggccgtgctcgatcagattacgctagatcgacgttctgcgttgaagaggagatcacgttactatgggctctcctcatcgtggtcattgtggtgacctacctcatacagcgtcacaagctcaactggatacccccagccagctgtgcgatggtcatcggcatatttgctggaatactcagcaaagtgatcggtgaggagcaggcttgcatgctgcagatgaggtctggccaagccgctgcgattctcgccagaggtgttcttctacgccctgctcccccccatcgtgtttgcagcgggcttcacattgaagaagaagcagtttttccacaaccttgggccgatcctcatgtttgctttcctaatcgtgcccgaggcgagctccatgcagtcgataggcttactgccctgcaatcacatcttgatctggcagcacctttgtttcacccaaaccccaccgttgcttgcggtacaggtggtgggcaccttcatttccgccctcgtgtttgggtttgcaacctacctgctggtgctcctgaaggtggtcaacatcacgagcatggcaggagcgcccctcgtggagtgcctgatgtatggcaagttcattggcatgtggcgtcggcttcttgcaccagttctgcgcagttatctttagttctatgtgacgatgcgtcttcattgtggatcattgcaagcgcctctgcgcgacacgtccacttggctctttctgcttgcgggcctgtttgcttgactccggcccgctcaggaactcaatacccacgatcagttggtgaagggtcgagcgagactccaccccgcccacccaccctcacacacaaatcccgacccacc

SEQ ID NO: 7554 - DNA, 606 bp, Chlorella protothecoides
atgatcagggaggcggagaaggcgggcaagatcacgccggggaagaccacgctggtggagcccacgtctggaaacaccggtattgcactggccttcatcgccgccgcccgcgggtacaagctcatcctgaccatgcccgcctccatgtccctggagcggcgcatcttgctgcgcgcctttggtgccgagctgaagctgaccgacccggccaagggcatgaagggcgcggtggccctggctgaggagatcgccgcagccacccccaacgcgtttgtgctgcagcagtttgagaaccccgccaaccccaagatccactacgagaccacggggcccgaggtctggagggacacggctgggaagatcgacttcttcgtggctggcgtgggcaccggcggtaccattacggggaccggccgctacctcaaggagcagaaccccaacatcaagttgatcgcagtggagcctaaggagtcgcctgtgatctctggcggctcccctgcccctcacaagatccagggcattggggcagggttcgtacccaagaatctggacacctccatcctggacgagatcatccaggtgggtttcatggctgatatccgttga

SEQ ID NO: 7555 - DNA, 558 bp, Chlorella protothecoides
atgagccagcaagcctggcctgtcatggactccacgccgtgcacagtgcacatcctcgtgggtgcgtgtaagggtcttggaccatgtaccatccctccagcttgccaccagctgacctcctacacctctgtcacctgcagcactctgaatgacccggccttcaagggcacggcttttgttccaacaaacgccgcatggtcgaacctgctgactgcccttggatggagccaggatcagctgctggatgcaggttctcgggacgctctcaacgagaccctccagtacaccattgtgcctggggcagcacagacccagcgggccttggcaggcctgacctacctggccccgctccctacggtacagggccagccactgctggtgagtggtgcaggagcacatggcagacatcgggcgatggctttgctgggacctgggtgtgacatccctgctttccacgaatgcagccacacggccgatctccctgtgtatgcaggcttgcaggaaacatggatgagacattacactgcacttgccgacatggctttggtatctgtgtaa

SEQ ID NO: 7556 - DNA, 783 bp, Chlorella protothecoides
atgagagcatctgcggctgccttgagagtttggacgcggtgcccacgctctctggcaagaccagtgcataatatttaccgccatgcagtccgttgtatggtttcactggcggagccgcccacgatttttgctttgagcactggggcaggcagatcggcagtggcagtggtaagattgacaggcagcaagtcgggtgagacacattgcgaggtggggggactgtgtatttacagtgatggtcaaggagtctgtcgatactgtggcatcattcagggtcacactgagggctgtgcaaggatgtgctgttccccaggaccccagccgcctgaccaactgtctgcctgcccccccaccccccttcgtacctcatcgtcctgccttgcaggggaggcgttgacagcgatggctccggcgcttgttcggctcccagcccctcgcctcctccacctcgtcgaggtggtggacccggccagtggccagcttctggacaaggcgctggtcactcgcttctctgggccccggagctacaccggggaggactgcgtggagttccatctgcatggcggcccatcggtcgtgcgatccgtgctggcagcgcttgggagcctgccagggctacgacctgctgagccgggggagttcacacggcgggcctttgaggtagggaagggggggtggttctgtggaggtaccataccaacagggaccgactgctgcttggttttatacatgtgttgggctgagaaaggagcacactcacgcggggaaatgttctggagatga

SEQ ID NO: 7557 - DNA, 1269 bp, Chlorella protothecoides
  modified_base (480)..(489): a, c, t, g, unknown or other
ccaatcccccccccccacctacacctccctctacagtgcctttgccaacgcccggagtctggggaagggcgccctcccggtactggtgcgcaccctctccctgcgcgagggtgtgcccacgagtcccagcacgctagtggctttgtgctcggccatcaagcaggtggtgtgcgcgatagtgcatggaaaggagagggagtgacaataatacaatgcacagtggatgcaacaatctcatccgctcccgcacaccctgacagctatcggccaacgaggagttgtgtgccgtggcggcagagcatggcgctctcggcatcctgctgcgccacttcagcgcagccagcaaaggttgttggcggagggaggggagggaacgctggcagagtggtggtcgttgcttggttgggcgccattgctgcggtgtcaaatgttgttgacaccacaggccatcttcctcaccctcaccgccccacctgcacnnnnnnnnnngaacgctggcagagtggtggccttcttcctcaccctcaccgccccacctgcatctccattccacggcccgctgcagccggggaggagagcgtcatgcgggctgcctgcgccgccctgcgccagctctgctcctccgactcgtgcaaagccgccttcctggaccaggatgacgtgatcccgcgactcgcttccgcgctcaagcggtgcgacgggtatccttctcctgagtatgccgaggtgtgtaagcaggctctcacaagctgcagcaagggcgtgcccctcctgcatgcaggtgtcgaccacccctactcacatgcgctgcaggtgctggggctgatgactaaccttgccttacgcaatccggccgcctccctggctcttgtgggggagcgtgggtgcctggacgcggtcctcagggcgctcactgctgcagccatggagcggaccgctgacccacgggccgcctcggcgatgcggcagggatgcatggccatccgcaacatggctgtcagactgagcgcgacggaatgcgagggacagcgtgaggtcaggaggtcgttgagatgcgactgtgtctgtttctgcctggcatgcacccacgagatgccatcctccaagcacgacaggtgtgaagaggctaagacagaactccttgcgctgcatgctcaagacgtgctgtactccatcagggactcctcggccccaggagccctccaggacgctgcatcagcggcgctgcgagacctgggcatgctggattatctgcccaaagcgcgatag

SEQ ID NO: 7558 - DNA, 297 bp, Chlorella protothecoides
atgcggagcacagcagcagctcaggacgtgatgcacctgcacgacggcagcccccccgtgcccatcacctttgggtgcgagacacgggagacgggcgagatctactggcagacggcggacgggctgctgggtatggggcgttcccctgccagcgtgctaaaccagttggtggctgccgaccaggtggccaacaccttttcgctgtgcctggggtctgtcaggggggatggcgccctcatactgggggacgcgggcatccctgcgggggtcgacatgcaggtgggcaggaggcggtga

SEQ ID NO: 7559 - DNA, 1062 bp, Chlorella protothecoides
atgcattgcctccccaagcctcgctgtcttccccccataccctctttcttccccagcacacgcacgcacacacacacaccccaagcccaggcggttatcgatttcggggaggacgagggcatcgccgacgaggtggcggccggggtgctgccggacatgcgcgccctgcgcgccgagctggcgggcttcctgggcggcgggcagcgcggccagctggtgcgggacggggtgcgggtggccttggtggggccccccaacgcgggcaagagctcgctcctgaacgcgctggcgggcagggacgcggccatcgtgtcccccttccccggaacgacgcgcgacgtcatggagctggagctggagctcgggggccagcgggcggtgtgggccggtgacgacgccgccgccgcccaggcagggggcctgggcggcgactcggcgcccggcgaattggagaccgaggaccctgtggaggccgagggcgtgcgccgggcgagggccaccctggccaccgcacacatcgtggtccagctccgggatgcgcaggcggtctgggccggtgacgatgccgccgccacccaggctggggactggggcggcgactcgacgctcggcgaattgtcagaggcccagctgaccctgtcggtctggaacaaggcagaccttctggcggagggccagggtccccggggccagggcctcggcatgccagcagagcttgcgccacgggacagagggcccccctcgaccgcgccgctgctcatctcctgcgagacgggggagggcctggacgacctgacccggctgctgggccgggcagtggaggacatcctggcccagggcggcgatcccgaggccgccgccctggtcacccgcgcgaggcacgccgccgcgctttcccggtgcgtcgccgcgctggagcggtacgagggcgtgtgggcagcgctggagctggcggccgaggagctgcggggggccacccgcggcctgggggccatcagcggggtggtggacaccgaggaggtgctggactctgtgttctcagagttctgcatcggcaaatga

SEQ ID NO: 7560 - DNA, 687 bp, Chlorella protothecoides
  modified_base (448)..(457): a, c, t, g, unknown or other
atggctgcctccaacgtgccaaaggggttccaggtcgacgtccagagcggtgggtttgccgtcgtcaccgtgcgctctgagcccgtcaacacgctttccctcgacctctggaggggcctgaccagcatcctagatgcgtgcgaacaagatccggccgtgcggggcatcatcttccggtcgggcttgaagaaggacattttctcggcaggcaacgacatccgggagctctacgcccctctgacctctgcccagcgatacagggagttttgggtgacgtccaacaagttcctggcccgcctgtacagcacacgactggccaccgtggcggcaatccgtggcgcttgcccggctggaggttgcgccatttccctggcgtgcgattaccgagtcatgaccgagcatgggcacatcggttgcacgcatgtctccctccccgcaggcctgaatnnnnnnnnnntgcagcattctttgtggcagcgaccttcagtttgcgcgcatgtctcccaagccacaggcctgaacgaggtggcactcggcatctccgtgcccaagttctgggcggggctgatgggacgtgtcatcggggcaaggaccgccgagaggctttgcctggtgcgtgcgagggtgcatcgccgggagtttgatatgggatcagaagccaggaccgggtttggtcgcattgcttag

SEQ ID NO: 7561 - DNA, 885 bp, Chlorella protothecoides
  modified_base (578)..(587): a, c, t, g, unknown or other
atgtgcgactcccaggcggaggcggtgtgcgcaggggccccagccccgcctctggccaaaccccgtgtgatccccgcgcgggacccacccacgctccaactcgccagatggtacgccgccaccattcccaccagccatggtggcatcctcaccagggcgctggccggcccgtgtcccctgacagccctacaccatgtgaaacgcattcggcggcatccccaggatgcagctgccctgcagattctggtgtgccccgtccccgacggcgaggacttaccggagggggtgagtgccattgtacaggagcactccctgtctctgagtgaggtgggggtgcccgagctggcgccggcgacgcgcgccgactgggcggggtggggcgcacactggccgctgacctggcgcgcgccggacccgcagctgcagcctgagcacgtcgccctggaccccgcggaggagaccgccatgaggcagcacctggcggcggtggtggtgcgggccgacgcttgcggcgccaatgtctgcgccgtggtcgacccctccacaggcatgtttgtgggtcggtgcattccagggtnnnnnnnnnngcgccaatgtctgcgccgtggtcgaccccttcacaggcgcgtttgtgggtcggtgcattccagggggcgatcctgcatttctcctcgtcatcgcctggctctgaggcacagttcgtggagcgagtacacaaagtctgcaacctcgcgaaatgtctggactgctgatccagtcgatgcctcatacccaatcacccgccaagcagacaagtggaggccgtggcagcggggcagagggcctgcctgcagcgggaggagggcggctcagcacaggatgggtgccccaagcgcccgcgtctag

SEQ ID NO: 7562 - DNA, 741 bp, Chlorella protothecoides
atgtcacgccgaccgtacctggcggggatgagctggcatagctcgttgcacgagctggcgtcggtcgctggacccattgatttcgcactccccaggtccatcccgccggtcatggagaccgcacagctgcccctgccccacccctccgagtgtggatccgacgaatgggcgcgccagatgcgtcttcgcttcagtcccgttggcatgtgcagcgagactggcgacatcgtgcaggacttcttccggcccagcggccttgcactgtgcggcgaggaggggtcacgctggggcgctgcccagcaagcggccctttacatggcaagtagtgagatggagggcacatacgcaggccactccatttgtcagatggactggctgttgaggcgagggacaatggcatcatgtgtacgcctcactcctcatgatggagtggctgttgaggcaagggacaatggcatcatgtgtactcctcactcctcatggtacatatcagaggcgcacagcatgatcccatgcctggcacccgccctcgagcagggtttggaaaagtatggggtcggtaagtggcgggacatggccacggagcatccggcgctggaagcctttgatgatgcagccatccggaccaaggcggcccgccttttgggcacgcaatcgctggcccgccatgcggggtggaaaggtgcgagttttctagggggctcgaaccctgaatgccgcggcacggctggcatgccatag

SEQ ID NO: 7563 - DNA, 1092 bp, Chlorella protothecoides
  modified_base (525)..(534): a, c, t, g, unknown or other
  modified_base (847)..(856): a, c, t, g, unknown or other
atgaaggtgtggccgcgctcccttgttcctgtggtgcttgagggggcggcgtcgcaagcgaacaacgcctcggtatgctcctcttcttgccctgcacttccccctgctcattcccctcttctttcccccaacaacctcaaacagggcatcgaccgggagtatgctgagctggacaccgtgtggttcatggcgggcagcctgttcaaccagtacccctacgacatccccaccgagcagttcacgcccgaggtcttccggcaggcctttgcggccgtgcagtcttgtgtggtgcacctccagggtgttgcctgggggttctgccaaggttggtggaaagggcgctccggcgcgtgcaggccagggaatgcgtgctcattgtcagtgtgcaaccctcgtcaccgaccccttagtcaccccaggccttcctggctcctccctcccgcatcaatcacacatccctctcatccccgcccccgcgcaagggagtgccgctgtctcagcgatttgcgttggtgcccctgggcnnnnnnnnnnctggctcctccctcccgcatcaatcacacacccctctcatccccgcccccgcgccagggagtgccgctgtcccagcgatttgcgttggtgcccctggggccgcccttgctcacctacagcagtaccgccagcgccatgctgcggtacgaccccacgtcccgcgaggtgcagctcgccgcggatcgggcgtaccgcccgggcgagccggtgctggcgtggtgcgggccgcagcccaactcgcgcctcctgctcaactacggcatcgtggacgaggccaacccctacgaccgcctccccctggaaggtgggtgtnnnnnnnnnncggcatcgtggacgaggccaacccctacgatcgcctaccccttgaaggtgggtgggtgtcaagggggccaagggcgaggcgtgggatggaagggtgggggttgcgggtttgaaggggatgctgttcctgggcgagcggtgtcaatcgaggcatccgaaagcaacgaggagatcagtgcatgggtgttggttcgcaaatggatggctgtgcctgggctgaacaacagggcgctctga

SEQ ID NO: 7564 - DNA, 426 bp, Chlorella protothecoides
gcggcgctgcgcgccacggcgcccgccgccgcgctggacgcggcgctggacccgagcgctgccgacggcgacgccgacgacgaggagccgccggagggcgcggtgcgcttccggctgagcggcgaggagattgcggcggcgctggcggaggcggggggcgccgacgtcgcgccgctgccggaggtggacgtgccggagcacctggtgccggaggacgtgctggcggcgctgctggaggagcgtcaacccgcctgggtggaggtccccggggccgggtctgcgcgcccagccccgcacccggcctcaggcgtggtccagcgccgcctgtccaacggcgtcgcgctgaactaccgcgtgacgcccaacgagccgcgcgccgcggcgctgcgcgtgacggcggcgggcggacgcgcgcgcgagcgcggc

SEQ ID NO: 7565 - DNA, 702 bp, Chlorella protothecoides
  modified_base (605)..(614): a, c, t, g, unknown or other
atgagggtgtggggcagggcgagaggggagcaggggagggccccgggccgtcgtggtggcatgctggcaggtggtcgggaggctgtggctggcaggtggtgggcgaccgcccctcaaccccgttcccaccccctgctcatatcccccccaaccccacacacagacctgcaggttgttggccctgactgccttcaagcgaaaaatctccaccagggcagcacagaccatggagaggatggcgatgccgaagccgacgcccatgcgcgtgaggcgggagatggggcggccgatgcgcctgaagtagggttcgatgcccaggtcaaagatggggacccagatgaggacggaggtggagtccagcacgttgaccatggtggcggggacgacccaggagcccaggtggcggtccatggcggagccttgcaggacgaagagcgtggacatctgggcgtagatggcaaagtagacggcgaggatcgccatggagggcagcaggcgcaccacgcacttcagctcctccacctcggtgacggtcaccagccagcggtcgtgcaagccgggggcgttgaccggtgtggccgccttgtccagccagcggaactcannnnnnnnnncgcacgccggcggcctcgaccggcgtggccgccttgtccagccagcggaactcaggggtgtggatcatcctggtctggccggggatga

SEQ ID NO: 7566 - DNA, 1302 bp, Chlorella protothecoides
  modified_base (17)..(95): a, c, t, g, unknown or other
  modified_base (251)..(260): a, c, t, g, unknown or other
  modified_base (416)..(425): a, c, t, g, unknown or other
atgggttggagggcgtnnnnnnnnnnnnnnnnnnnnnnnnnnnnnnnnnnnnnnnnnnnnnnnnnnnnnnnnnnnnnnnnnnnnnnnnnnnnnnngcgtggcccaaccggccttgtgtgccaggcacacagccgcgtggagggcatagtcccctggccacgtgccatgttcattggccgtaccacccaggccaccccctttccccaccggcccagatcaccggtgcacctcagccctgccacgcagagccnnnnnnnnnnacgtggcccgaccggccttgggtgccgggcacacacccgcgtggagggcatagtccccgggccacgtgccatgttcattggccgtactacccaggccaccccctttccccacccacccagatcagcggtgcacctcagccctgccacgcagagccnnnnnnnnnntgggttggtggggttggatgggttggggacgagatgggttgggggggttgggggtgagatgggttggagggcgtggggcgagcagtccggggctgcgccgggccaggaccttgccatggcagggcgcgagccacagcactgccctcccgcccggccccaccccactcacgagccgagcgtcctctggtaccgcggcccgccagtgggcaaacgcgccggcaatgacgcggaaccagcgcgtcagggcgctgccgcctggaggcttgcggcggtaccatttggagccggcgaggaagatggcgatggcaatggcaaaggagacggtggggatcaggaagccaatcatccagctgcatggcggtcagggggaggactgggattgctctggcgaatcaaagggagccgagcaggaacccccttctcccagaaggaccgccccgggtgcagcccacctgacgtccgtctggacccagacgatgagcgtgcaggccaggaaggcgccgatgttgatgaatgcatagaaccagttgtagaagcgtgggatcatggccagctccgcagggtcatcctcgtcaaactggtcagcgccaaaggtggacacgcagggcttgatgccgccggtgccgattgccaccaggtactgcaggcagacgagggaagggagtgggaacaaggggagggagcacgaccccaccagtacccttccagggctcttagcgggctgcctggacccatttcccccagggaagggggaaaggggggctggttcagttccatcatgcctgctccagatttggctgcatcggcgcacaacagcagagtcccggggcctgcaacccgcagaagccctcatgccaggctttgcagctcaccatga

SEQ ID NO: 7567 - DNA, 864 bp, Chlorella protothecoides
atgcctggagtggacgagaatgatattcacaagatcttaaataaggtgtcgagtgggagcgctaacttggatgccgacaaacgtcagccaccaccacaccagaagctcagcaccggaagcacccctgtcgaggatgcctctccatcgacgacgaccgagtcaccggtctcaatgggtcgagcttttctaagagctgttcctattctcggtgagctttgggtggggtccagtaaacatagccgtggcaggagtgcggtttaccggtgcaagaacatgttatcattgcgcctatccttcagaggaatgccgatcgtcgagagaccactaggcgccggcacgcccatcagcgcgccgaaaggtcacacagcccccgccccccaaatgcaccgccgcacagatcaacatcgtggtttgcctgatgtttaccggtgcaataacatgttatcattgcgcctatccttcagaggaatcccgatcgtcgagagaccactaggctccgacacgcccatcaacgcgccgaaaggtcacacagcccctgccccccaaatgcaccaccgcacagatcaacatcgtggtttacctgacgtcgtctggcccacaccccctccaacacactcgcaggtgaatgcctggtcgggcacatgctatttaactcctctcctgggtgcatgggtcgccgataccttcctggggcgtttctgggccatcttttctggttccatcatctacatgctggtgagactgatggttttgcaagcctttacctggagacctgacctgcctctgctcgatgttcaggggaagtgggcaggggcttggtgcggatgtcaaggcaagaagcaggcatcagctttatccctctga

SEQ ID NO: 7568 - DNA, 2259 bp, Chlorella protothecoides
  modified_base (1099)..(1108): a, c, t, g, unknown or other
gccgccgcggccgccgccgcggccgccccagcccccgaacgaggcggctgccacctcgcgctccaccacctcgggaagggtggagggctgcgagacaaaggcgccgttcttggcggcacccacatccccgtcctccggctcgggcagcgcctgcttgaaggcctggaccagggcggcggggacgtcaaacaccgcccccttcccgtcgctggtcagggtcatgctcttcacctcctccaccgaggcctcgggcagggccttgcgcagcacgccaaacacctgccccggcttgtccacggggaaggcggccgccaggcgcagcgtggtgtagtcctcgtgcgctgtgatgagcgagcgcgggcgcagcgcggtgtagcccgtgatgcgcgccagcgcggcggccagcgcggcctccgcgctctccgacgccgccagcagcgtgcgtgccgcgggccggaaggcgtccaccacgcccgcgtccacctcggccagcgcgtccacggcgcgctcgcccgccacgcgcgccatgtcggcgggttggggcgcaccgatgcgctcaaacttcatgcccgcgcggcgctcgatgacggggatgagcccttccttgcgccggtccaccagcgtgatgcaggtgccggtggagttggcgcgccccgtgcgcccgctgcggtggatgtacgtctccggctccttgggcggctccgactggaccaccagctccacgcacttgatgtccagaccgcgcgccgcgacgtcggtggccaccagcaccgcaaacttgccggagcggaagccggccagcgtcacctcgcgctggctctgcgcgatgtcgccatgcagcgggcgcgcgcccaccgtctccgacagctgcgccgccagctcgtccgcgtcgcgcttggtctcggtgaagatgatggtgcgccccagcgcgccgtagcacttgaccaggtcttgggtcacctccgcgcgctggctccagtggcagggcagcagcaggtgacgcaccgaggtgctagcctgttgagggattcgtgggtgagggagggaggcttgggcgtcatgactggtgcgggatgcgggatgcgggccttgccgtcannnnnnnnnnagcaggtgacgcaccgaggtgctagcctgtcgagggattcgtgggtgagggagggcgggttgggcgtcatgactggtaagggatgcgggatgcgggcattgccgtcggtccgcattcaccgcccacactccccatcccgcccctaccttcatcttctcggtgccgaccaggtccacggtggcgtggttgggcttcaggaagcgggtggtgatctgcttgacccagggcggcagcgtggcggagaagagcagggtctggatgtcggtggtgtccacgcccgtgttcaggatgcgctccacgtcgtccacgaagcccatgttgagcatctcgtcgcactcgtccagcacgcggaaggcgaggttggcgcaggacaggctgccgcgctcgatgtggtccttgacgcggccgggggtgccgatgaccacgtccacgccgcggcgcagcgcgccctcctgcgggctcatgggcgtgccgccgtacaggcagacgcaggtcaggccggcggagcggccgtacgtctcgaagtctgcgcccacctgcttggccagctcgcgggtgggggccagcacgatgacggagggcgcgcgaccgtgcgcgccgcgcgggcgctggctcagccgctccacgatgggcagcacgaaggcaagggtcttgccgcagccggtgcgcgcgcggcccaccaggtcccgcccctccagcagggggttcaggcaggccgcctggatgtcaaacagggactcgatgcccttgctgcgcagcatggacttcaggggggcggacagcgcgaagttatccagggcgtgggggtggggggcgggggtctcagccgtagacggggcgggagagtcgggcccggcactggtgcttccgagggcgagaggcactgtaatgcctgtcccacggagccgccgcaacgccacgcaccgcaccgcgcacctagcacggggtcggccaccttccgcttcttcgagctcttctccttcttctcgaccccattggatgcctcggccttcttcgtcttcttcacctttgcgacgacgggactggcgtcccgggtggaagccatggtgggtagggccgccgaagggggggaggagcggagagaagcggggccgatttcaggcacgaaaatgcgcctgtatatcgtatga

SEQ ID NO: 7569 - DNA, 1155 bp, Chlorella protothecoides
atggcgatcctcgccgtctactttgccatctacgcccagatgtccacgctcttcgtcctgcaaggctccgccatggaccgccacctgggctcctgggtcgtccccgccaccatggtcaacgtgctggactccacctccgtcctcatctgggtccccatctttgacctgggcatcgaaccctacttcaggcgcatcggccgccccatctcccgcctcacgcgcatgggcgtcggcttcggcatcgccatcctctccatggtctgtgctgccctggtggagatttttcgcttgaaggcagtcagggccaacaacctgcaggggcggtcgcccaccacctgccagccacagcctcccgaccacctgccagcatgccaccacgacggcccggggccctcccctgctcccctctcgccctgccccacaccctcatgccctccctccccgcgccaaaatgtggaccccaccgacaactccgtccccgtctcagtctggtggcagatcccgcagtacttcctggtgggcatgtcggaggtgtttgcctccgtcgggtccctggagttcttctactcccagtccccggaggccatgcgctccatcgcctccgcgctgagcctcgtggccgccgccgccggcagctacctggccgtgagcctcgtggccgccatcaccagcgtcctcgtggccggcgccgccggcagctacctggccgtgggcctcgtggccgccgtcaccagcgtgtccacgcgcggcggcgccgccggctgggtggccgacaacctgaaccagggccacatcgacgacttcttctggctgctggcggtgctcatgggcgtcgcactcctggcctacatccccatctgctacacgtaccgctatcgccaggacccggccgtgggcttcgccctcgccgcagcagcagacagggagcgggacctgggcatcgcagcggcgggggtcgatgacctgcgaagctcaggcgcctcccaccccctccacacccaaacactgacgcaggccaaggtgtcttctcgcgtcgtggtcgaccgtgccctgaagcggtcctccttcgtgccgccggtgcacgccttcgagatcgcgcccgtgtctctgggcgtgaagggagggtccttatccaccaagccatccgaaaactga

SEQ ID NO: 7570 - DNA, 723 bp, Chlorella protothecoides
atggagtttcagtactgcctggcaatgacacctccacagggcctcactggcgtcaccatctccgccggcctcccctccctgaggccggcgccgggggagcagcccaccgctcaccagctctccttcttctgggggttcatggtgagctgcaaagcctggcatgagggcttctgcgggccccgggactctgctgttgtgcgccgatgcagccaaatctggagcaggcatgatggaactgaaccagcccccctttcccccttccctgggggaaatgggtccaggcagcccgctaagagccctggaagggtactggtggggtcgtgctccctccccttgttcccactcccttccctcgtctgcctgcagtacctggtggcaatcggcaccggcggcatcaagccctgcgtgtccacctttggcgctgaccagtttgacgaggatgaccctgcggagctggccatgatcccacgcttctacaactggttctatgcattcatcaacatcggcgccttcctggcctgcacgctcatcgtctgggtccagacggacgtcaggtgggctgcacccggggcggtccttctgggagaagggggttcctgctcggctccctttgattcgccagagcaatctgcttggtgcccatcgcacgccggcccagcacacacccaggcacaccgtcccccggctcccagcgcgcgcgcgtcaccccagtcctccccctga

SEQ ID NO: 7571 - DNA, 813 bp, Chlorella protothecoides
atgcgggacgtggaagaactcgcagagcttgggcaggtcggcgcaggcgtccaccaggcgctggctgaagtagcgcgggtggctggtggcgaagcggatgcgcgcgatgccgggcacgtcgtgcacggcgcgcagcaggtcggccagcgtgtgcgcgcgccggccggagccgtccggcgcggacccgggcagatcccggccgtaggcgtccacgttctgtcccagcagcgtgacctcgcggtacccggcctcgcccagggccgccatctcggcgcggatcgcggcgggggtccggctctgctcccgcccgcgcgtggtgggcacgatgcagtaggtgcagcgctcgttgcagccgtggatcaggttgacccaggcggagagggtggagtcgcggcgcggcacgctcacgtcctccgcccagtccagctcctcggtggccaccacctgggagccggagctcacctgctccagcagggcgggcaggcggtggacgtggtgcggccccatcaccaggtcgatctcggggacgcggcgcagcagcgccgcgccctcctgcgccgcgacacaccccgccacgacgatggtcaggtcggcgcccaggcgccgcttgcgcgccgcgtgcacgcccagcgcgccgtacagcttgtcctccgccttctggcggatggagcacgtgttgtacaccagcacgtcggccgcgcccgcgtcgggcgaccgcgcgtaccctgcggcgtccagcgcgccggccagccgctccgaggtgtgcgctttggtggggacccacctcaatgcaagaatgcccgcagaaactga

SEQ ID NO: 7572 - DNA, 2007 bp, Chlorella protothecoides
atggcttccacccgggacgccagtcccgtcgtcgcaaaggtgaagaagacgaagaaggccgaggcatccaatggggtcgagaagaaggagaagagctcgaagaagcggaaggtggccgaccccgtgctagatgccccggtcgccagccccgagatcgtggagaagaagaagaagaagaaggaggcggcctcccccgccccctcaatcaccgactctcccgccccgtctacggctgagacccccgccccccacccccacgccctggataacttcgcgctgtccgcccccctgaagtccatgctgcgcagcaagggcatcgagtccctgtttgacatccaggcggcctgcctgaaccccctgctggaggggcgggacctggtgggccgcgcgcgcaccggctgcggcaagacccttgccttcgtgctgcccatcgtggagcggctgagccagcgcccgcgcggcgcgcacggtcgcgcgccctccgtcatcgtgctggcccccacccgcgagctggccaagcaggtgggcgcagacttcgagacgtacggccgctccgccggcctgacctgcgtctgcctgtacggcggcacgcccatgagcccgcaggagggcgcgctgcgccgcggcgtggacgtggtcatcggcacccccggccgcgtcaaggaccacatcgagcgcggcagcctgtcctgcgccaacctcgccttccgcgtgctggacgagtgcgacgagatgctcaacatgggcttcgtggacgacgtggagcgcatcctgaacacgggcgtggacaccaccgacatccagaccctgctcttctccgccacgctgccgccctgggtcaagcagatcaccacccgcttcctgaagcccaaccacgccaccgtggacctggtcggcaccgagaagatgaaggtaggggcgggatggggagtgtgggcggtgaatgcggaccgacggcaatgcccgcatcccgcatcccttaccagtcatgacgcccaacccgccctccctcacccacgaatccctcgacaggctagcacctcggctagcacctcggtgcgtcacctgctgctgccctgccactggagccagcgcgcggaggtgacccaagacctggtcaagtgctacggcgcgctggggcgcaccatcatcttcaccgagaccaagcgcgacgcggacgagctggcggcgcagctgtcggagacggtgggcgcgcgcccgctgcatggcgacatcgcgcagagccagcgcgaggtgacgctggccggcttccgctccggcaagtttgcggtgctggtggccaccgacgtcgcggcgcgcggtctggacatcaagtgcgtggagctggtggtccagtcggagccgcccaaggagccggagacgtacatccaccgcagcgggcgcacggggcgcgccaactccaccggcacctgcatcacgctggtggaccggcgcaaggaagggctcatccccgtcatcgagcgccgcgcgggcatgaagtttgagcgcatcggtgcgccccaacccgccgacatggcgcgcgtggcgggcgagcgcgccgtggacgcgctggccgaggtggacgcgggcgtggtggacgccttccggcccgcggcacgcacgctgctggcggcgtcggagagcgcggaggccgcgctggccgccgcgctggcgcgcatcacgggctacaccgcgctgcgcccgcgctcgctcatcacagcgcacgaggactacaccacgctgcgcctggcggccgccttccccgtggacaagccggggcaggtgtttggcgtgctgcgcaaggccctgcccgaggcctcggtggaggaggtgaagagcatgaccctgaccagcgacgggaagggggcggtgtttgacgtccccgccgccctggtccaggccttcaagcaggcgctgcccgagccggaggacggggatgtgggtgccgccaagaacggcgcctttgtctcgcagccctccacccttcccgaggtggtggagcgcgag

SEQ ID NO: 7573 - DNA, 1656 bp, Chlorella protothecoides
  modified_base (797)..(806): a, c, t, g, unknown or other
  modified_base (1618)..(1627): a, c, t, g, unknown or other
atgtgggcagcatgcgtggtgcgcgacctgcacagacccgcctgcctgtttcgtgcagcgctgggcagtcaaaaatatgtcaagatctgttggatcaggaggcattggaatgttccggcttcctccgcttgtgatgcgtctgggaggggcagattgagcccctggcgccacaagccatcttgcacccttccgcattcccttgcctctgagcctccccactgccacgccacaggccccttcttcacctggccggccgtcttcctcaagggcagcaccggggcagcagcgtttgcactgatcaactctgtggggtccatgggtgggtttgccgggccctacctcatcggcaccctgtcccagcgcctggagggagagcctcagccccatagccggcgtgcacggggtcgaggaggccgttcacacccggctactccagcggataccctcctcggatgtcgccgcgagccgcggccggcggcccggcagctccaacagcgcgcggcagtttcaagattgaccggctcaagctgctggacgaccacttccgttgccgagtcacgcccgtgtagcactgccaataaaacctgctgtcgtgatacccacttgccccgcgtcttaccacacactcccgacccttttgccccgttggcagactttgttgttgcacagtttgggggaggaggtattacaacgggcgtggacaagggatccgacacggattgctggtatctgtgtattgaatgggccaagggcggctggtcccatcgcgggcctcctcgcgggtcactccgcgttcnnnnnnnnnnccccgcgtcttaccacacactcccgaccctgttgccccgttggcagactgggttgctgcacagtcagggggaggaggcattacaaggggcgtggacaagggatacgacacgggttgctggtatctgtgtattgaatgggccaagagtggctggtcccagtgcgggcctcctcgcgggtcactccgcgtttggggtggtcagcagggcgcagaagcccctgctcgccgtcgccgccagacgctcgatggccgggtctgccgccgccgcggcacgctgcgcggtcagccccgcgccctggcagtccttgcgggcccgcagcgagtcgccgtacagcgtcctggacgagggtggtgtaggtttggggaggagcatgagaggaaggccagcgccagggccccaggaagatcccaggcctttgctgggcatctttgtccacccacacgaggcccgtcgctcgcctgcaccccggccagtgagaccccgagcccgcgtcgcactctcgcagccgccggtgcgcagcagcccctctccggaaagaggagttccgcacctgcacaggactgtgttccccgccccactcaggagcaggcagagggtttgcggggggagggcccgcaccaccgccgccacgcggcgcgccgtctcctggaccagcggctccacgccccccgccgcggcggcagcacaggccgtggcgcagccctccctgtccgagaagtccagggcgcgcgcctcgcgcccctgccgctcggccacgtcgctgagtgaggcgaagacaaagtgctggggtggaggacctcgcgctctcggannnnnnnnnngcgctcctgccgctcggccacgtcgctga

SEQ ID NO: 7574 - DNA, 852 bp, Chlorella protothecoides
atggccgccggtatgtttcaacgtggtgctcccggatgcggctcgtgtgccatgcatcagcctggcagcagaggccatagacacctgccccgtgtcctgcatccactgggtgtcggaggggcagctggcgctgctggaggtgaccatgtcgcgcatggagcgggtggctgcctggctcatcctgacaggcgggggcaagggcaccaacatcgacgtgttcaacgaggccagcggcgcctgggagaagcggcaggccgagctgcgcggcgccgcgcagcgcagcgtcctctcccgcttctggaagtcgacggaggggagcggggaggaggaggaggaggaggtcacctccaaccccacggggcgaccctcacgccgggggcagaaggccagcccggccagcctggcgcgggcggcgcggcgatggagggactaccagcgcaagaagaggaaccgggcctccctcatgctgccgggccagtaggtggcggggtagagggggggcggagtgcacagatactggcaccatgccccatccccctcctggccgcccacgccagttgccgaattctttgtcgccgccgccgcaccgccggcgatgctgacgctgctagtagcagcgagggagcctgccgcgcgtcggcccctgatattgtagccgagggttcccggttcctgctcgtcccctgtaccacctcccacctccaaagagctacgctgtttggtgtccaagtagaaacctgtgggatgtgctgtcccgctgtaccgttttcccccctccttttcccagtagatgtattttcccctgaatctcatgagaagataatatgcacctcttcgcctcaagaaacatga

SEQ ID NO: 7575 - DNA, 324 bp, Chlorella protothecoides
atgtttgtgatcatgtgtgctgggccatgccaccccttccctcccaccacacacaaaccatatggcggtgcagagacgctgatggacccggagaagagggcagagtacgatgcgatctcggggttccagctgggcggcaccaaccccttccgcgacgtgcatgctgagcgcgaccaggtgttcgtggatgagttctcgtgcatcggctgccgcaactgcaacaacgtctgcccccggacctttgagatggaggacgagtacggccgcgcccgagtggtcgaccagggcctggacaccggtgagcagatcgctctcttgatttga

SEQ ID NO: 7576 - DNA, 405 bp, Chlorella protothecoides
atggccccgctctccggtgttccttgccaacgacaccagccgagcaggggagtccatggcgtagattctagctgtgcagccccacttcagctgcaccagatcgcacacaggggggtccctgggtgcagccagcacaggtccggtgcgcgagggcccaagttgcatcctgtctcgcactggcgcacgcatgccgttcgcatggcggacagcgacaccgagactcaggatgactactactcggttctcgggatctccagcgcggcctctgtcaaggacatcaagcgtgccttccgcgtcatcgtcaaggatcaccacccagacatctccatggacgaggaggccaccgactttcagatcttcctcaatgatgtttacggtgggaggggatgctctggggctggatga

SEQ ID NO: 7577 - DNA, 501 bp, Chlorella protothecoides
atgtgtaaccagtgcacctcctcgcaggtgttcatttcggagggcgcccgcatccccctgcgaccggcacgtaagaagctttgggcggtgaacgtcccggccgcaggtgggaccctcctgcgccaccaggcgggggcgacacacatcctgctgggggatgagcccttcaacaggatctgcaagaagctggagtcccaggcaggcgtggcccctgccctggtgcactacaactggctgtcgcagacgctgaggctggggggccgccagaacgaggacgactacgcgccccctgctttactggcacacagggagtctgccggctccactccggtgcccagcctgagcgttcacgaggttcccagaggcaccacactgccagatgtgcagagtctcatcctccacttgtgtttgggatctccggcgccaaagaactttgccatcgtggtgaggcggggaatgggcctggtggtggctttcgaggaaagatgcattgggggttga

SEQ ID NO: 7578 - DNA, 621 bp, Chlorella protothecoides
atgcccggccccgggcccctcagtgctgagcagtccgatgacgggctgagcgaggcggggaccgactggagcgacggcgtggccacggcccacaaggcccgcctcgccgcgctgccctccggcttcgcggccctcctgcgccagcgcgaggtctgggccatctgcgtcgcccagttcgcgggtgcgctgaggggtggaaagggggggagccgcgacggagacgagcgtcaggagctgaggatcgcgatcgtgtctgacttggttggtactgcggggcgaggagcgccctgcgccgcccgccaggcccgcttgctcccctcagcaccaaggttgcactccttctggcctagactcccagccgcactctgtgtcccctgcggtggcgcctccacatcctccttcaatccccccccctacccccacacacacaacaactacaggttcctggggcgcgtatggcctgctgagctggctgccctccttcttccgcgacgcctacggcgtggagctggcgcgcctgggccgcttcgcggtgctgccctacgcggtgcagggctgcgtcggcctggccgccggcgcggcggccgaccgcctgctggcgcgcggctgggccacggccag

SEQ ID NO: 7579 - DNA, 1077 bp, Chlorella protothecoides
atgggctggcgggagggcactgggctgggcaggaaccggaaagaaggcgcggagccggcgcagcccaaggacctgaagcgccgccccgcgcggctggggctcggcgccagcgccgcgcccgtgccgacccacaagcgccacatcaagcccggggagacgcgggcggcggcggcggaggggccggtggacaacaagggcgcggcgcacatcccgctcgcggagcggaacccggcagagctgggcgccggggaggtgaggggtcggggtggaaagggaggagcacaaagaatgaggagaggcccaccagccgccttgtggagggtggcacccaaggcactcgagctcagtgtgcgccatggttgcctcgttcaggccctggcatccgcatgcacaccccctgaccaccagccatgccagcacacaggctgcgtgggtggtcgttgggacccactctggtctggcctgcacctttgtcgggctggaggccaagcgcgaggggcgctcagggctatgcaccccaacctggcaccccggccgatgcgcagagcgagccagggtgcgcctgcagcccagcaacgaggtggtggtggtgcgggtctccgacctcagcctggcggccccctccaggcagcgcagcaggggcaagtgcgatggccgtggccaggaggcgggggaggagaggagccggcgggcgccagatggaccgcagctcggcgatggctcactgagaaagcaatcagacagcagggccggggagggccgggccgacgcctcatccccatggctcctgccaaacatacgcggtggcgtgtgctggactcccctgcattcgttcaggggcaggtcatgtgcgtgcccggatcaagcatgccccccaggacccagatcctcgccgggcgctgccgcagggtcaaggtggtcgacaaacgggcggaggggggccgcgtttacctgaagaagggcaccgtcgtggatgtggccatgccccgcgtctgcgacgtgcacctggacgaccttgcgaggacggtgcaggtaggggggggtggaggggggcggaggactctggcagtcgcgtga

SEQ ID NO: 7580 - DNA, 813 bp, Chlorella protothecoides
atgtcggggggagggcttagcctcgccttcacgggccctgctcggaaggctcgacggctggaggtccacgagacgatcgaggcggtagttcgggaggagatcaccggcgtgggagctggcggggtacaaacagcaggcactgggaacccactggctgacctgaaggtgatcgaagcccagcccaacagcttcaagtacgcagggcttgtggacttccagggccctccctcttctcccctctgcttcaggattgccagcggcaagtttgtacctagctacatcccagaagcggccgacagggcggaccaggagggcggtatcgacaagtttgaggcggcagcccaggacgctgtcgatgcccagggcgacgtcacctacggcctcatccgccgcgaccgcaccgacgaggcctccacctcgcgccgagcgcagggcgccggaagtggcgccgttctcggccccggcgaccaggagaccctggccctgcgccgcgacctgaccgccctgcccgaggtggcgtccctggacgcctacgaggccatgccggtggagatgtttggcgaggccctgctcaggtgcggtgggtggggtgggggtccagggggttgccagtgggcgtgggtttggacatcaggacatgctttttcaaatcagaactcaggagagctcgttaccgctgtggcatggatctgtgcacgggccctgccctacgtcgctgggtgttctttgggctccccacagtatgggcattctctgtgcaagtatgtgctcctttcccccggctgccgcctgccatgcctgagcagtcgttga

SEQ ID NO: 7581 - DNA, 837 bp, Chlorella protothecoides
atgcgacgtcgacattccaccgagccctgcaccctcccgcccctcccctctcaccctggccaggctccactcccccccctccctttcatccccgacaccgctcccctcccctcacggtcccacccccccgcccctccaggcgcgtctgatgccggcgcacccctggcccccggcctctccgggggcaaccagtccatcgggcagcgctcggccaccgagagcgaggcgctagtgctggcccgcgcgacgggcctcgtcagcgagtgtcgcgccgagctgcgcgagctgcgcgcccgcgccaaggccgcgcgctccaaccgcgagcgctgcatggccgcgctggctgccggcagcgaagcggtgggcgcgctggaggaggtctgctccgacgcgggcgcgctggactcgcgcggcgagcgcgcgctctgcgcgctggccggccgcgtgcagggcctgatggaccaggccgaggcgctggtggacgtgtatgggcgccagggcggcctgggcaagtttgcctcccgcatgttcaacccgggggtgggcgccaagttcgaggccatcaccgccgagctgcaggcccacgctaagcaggtgcgcctgctggcagagggcgacgcctactcccgtggccgcggcagcagcggcaccgcctccggcagcctgtcagcgcgcggcgcggcgcgtggcgggccgcaggcctgccgcgctgggtcggaggcctcggccatgggcatctcccgcctgggccgcacctctggctccctgccctcccagcacagcgtggtgggcgtcggcacggccggcgccgcggcggtagccgcggcgagcgcggcc

SEQ ID NO: 7582 - DNA, 2022 bp, Chlorella protothecoides
atgccttccataggttgccgtgccgcttcccggacctgtccacaggatctcagcccagtccagccccaccctcatccccgcccccccatccttccgcagcaagtggatgcgctgcgggagctggtgcccgaggaggcggtgccctttgtgggcgaggcgctgcgcacgctgcgcgccgaggtgggcagtgcctccgccgtgctgggcttcgtgggcgcgcccttcaccctggcaacctacatcgtggaaggtaggggatgcgtggtggccggcggaggggggatgggggttgatgggtcgacccatgggttgcgctgggatgccaagcctgagctgcaccccacaccctccccttccccccttaaaacaggtggcatgtccaagaactacacgcacatcaagaagctgatgttttccgagccggcggtgctgcacggcctcttgcagcgcctggccgacgccgtcgtcagcgctgcttcctggttctgcctggcaagcaatacgggacaccctcagagtcagcgcacattggccggtgctctccagatgaggaggcctgcaaggaaatcagagcccaagttcagccctgcaaccttccacttaaccctccaccaccaatcaacccctttccaggccgacaatggggctcagacggttcagatctttgactcgtgggctgccaacctgagcccacgtgacttcgatgtgtttgctggtccatacttgcactacatcatcaagaaggccaaggaggcaagctcaagggttgtggttgttgaattcatggccccgcaaaccggaggaggcaggaccccgtgccagctgtgtggagtgctgcagccttcttgcatccgcttgccgcatcaaacagactcagtatcattagagcagtttcctgggaccttccgctctaacttccctcactccacctcttggcctcaccctcagcccccaccctggtcctctcccgccaatcaaaccttcacaggcccacccggacctgcccatcatcctctacatctccggcagcggcgcgctggtggagcgcatggccgcctgcggccccgacatcctttctctctgccactcggtggatctggaggagggcgtgcgccgcgcgggcaccaacttcgcataccagggcaacatcgactccggcgtgctgtttggcagccgcgaggccatcaccagtcgcgtacgcgagacggcgcagcaggcacagcgcgcaggggtccgccacatcctgaacctggggcatggcatcatgcagccagaatggggaaagtgcattcagagtccgatggatgtcctgatgtcaaggtggtggaataccaatccataagcaccttggttaaccgaccattgctgtgcagggcacgccagaggatgctgtggcgcacctgttccatgaggccaagaacctgcaactttgacttgatcggtaggctgccagtgcagcccgggggaccagacagattccttgcggacaaattgcgtccgcgccagggactgccactgccctctctagcttggcaaaggggcgcacgccacccttgcccttgtcttgggctgttgccgtcgccggcggctgaagctgtgggcgaggagaaagccgaggggataggtgaatgttggtggttgaataaagatgcaggcgatcttgctccccatgaagcccatcccaacggaaatcaggtggcccccgcccttggcagccatggccgcgaaatggctctcattctcggcgttgatggctttggtgagcttctggttatcgccgtgactccgcttggtcgcggcgcgtttgggagcgactgtcagtttgcctgtgagaaggggccaggtatggtgaacgctgtgtgcgtgtgccattcgtcaggcgaaggtgggtataccacaaccccatcggagtcccaggcgcaacgccctcagattcacctcgcttcgtcgtcatctgggacttcccatgcttattggcagcagaagactgcttcgcctgcacggacttgccctgtttcttaa

SEQ ID NO: 7583 - DNA, 1017 bp, Chlorella protothecoides
atgcaacgcgggagactcctctggaatacaagatcggattcgtcgaggtatccggggaaagagtatctgggcagatgcctatcgcaactgagcagcagaatgcgtttgccgacgtggcacatgatccaaaaagataaatgtatcgtgcatgcatttcggccccccagggaggaatttgcagcccatcccacgaattgttggctgattaaagtatatctgaatcctgtatctaccagatcatcgaaggtaactgcatacctcggggaagcaccctcgctgctgccacgccatggcgagccttgcgtacgggtccttcgtgcgggcgtcgccccacagggtgagtttggatgcattggtgagtattgctacatgcagcacccacagctctcatctggctgcgctgtttccctccacagcacggtcatagtcgaaggcaatgtgcgactcctcgggctgcgagtgccgtcgaggccccggcctccgtcggacagaaggtgggccccaggcatcgagccccgtagtgcaatgtcaatcttcctgtctcacagcaaagccgatgtgtcaccaccagcatgcgatgtggatcatgctcccgtgcgccccctcgacccgccaccctccccatttccatcccaggctcatggggaggaccccctcctgctgcgcgccctacgcggggagtcggtctctcgcccccccgtctggctcatgcgccaggcagggcggtacatgaaggtgtaccaggacctgtgcaagcagcacaccacgttccgggagcggtccgagaacgccgacctggcggtggagatcagcctgcagccgtggcgcgctttccagcccgacggcgtcatcctcttctccgatatcctcacccccatctctggcatgggcatcccctttgacatcacggcggggaaggggccgatcatccccgaccccatccggacgcagcaggtgggtcgaccatggcataacggaggggagggggggttgctgtaccctggtcgtcctctgtga

SEQ ID NO: 7584 - DNA, 2154 bp, Chlorella protothecoides
atgaatccacgccagcagctcctgtgcagctcacctgtggcaccaggtcacgatgatgatgcgcccccccggcagcgccacgcgcgccagctccctcacaaaggtctccttctcgggcatgtgctccccgctctccagcgaccacaccaggtcaaaggagccatccgggaagggctggctcagggcgtccgccacctggaattcggcgcggtcccccaggcccgcctcgcgcgtcatcacattggcccggtcagcctggacgggactgagcgtgatgcctcgcgcctcagacccggggtaccggtccaggatgtggcgggagctgccgcccaggccgcaccctacatccaccacctgccaggggttgcggaggggggacaagctccaggaggctgcatgcattacaactcaaaccctcgaacacacagacagggaggtcctgctggcagcctctactgccagtccacgacaagtgcaacagcaacagcaccccctgagcaccttcttgacactctgcacgcctgcccagtccaggacgttgtccaccatgtcgatctgagcctgggcgttggacttggtcccctcctcggcgccatagtagccgtggtggaggtgctcgccccacatggactcccacaggccggaggactcgtcatagagcttggcgatgccgtccttgaggggcagcgcctgcgggcggagaccggcatgccacctcttgattcagctcatagaagtgcaaaagatgcagcagatgcaaacgtatcgtgccttccaatcgcgacgcagcgccacacctttcctccactggttattggcttcagcaccgtttccagcagccctgccgccggtcgcaggggcttgcatcggccgacccggcgtactgaaggtgcaaatggtctcgcagatggagcgtacagcgatgcatggcatgcgacaagcgcctgctgcatggtagctggctggtgggaggttggtcctctctccaaacaaagtacggtcgatcacatgcctggattcgcgctgcgcgcaccaccatgtgcggcttatgttgtgtggtacaggtttgtggtgaagaactcgcaaagcccctctcgggaacgcgcagattcgcatcaccgaggaacctgtccctcagggcctacccctcccgatccagccccgccgcccccactcgccgagacccattcaaaggtaggtcaatcgttgcgcgaggtcattacagggatctggactggaggcgcatgtgattgcgctgtgggaagacacctcttcatcatgatccgtgatgttccagccagtcgaaggcccccagaatccacgagcaggtccacggacaccgttccattcaccgctgtaggtccctccatggccccagcctcaacctcgccgactcgtatgaacgcaagtcccaccaaggaggcccccggccggtccgctgcgaagacccccctggcctccgtgggcagggtggtggtgctgggggctgggggcggtgtgggctccgcggtggtgacccagctggcagagcagggcgtccccgtcaccgccgtcgtccgtgacgtcagcagggccaaggacaagctccccagccgggagggagtccaggtctccctgggagacgtgaccgactctgccagcctgaccagcctcctgcagaactggagggctgtctgtccgcgagccctcctggcatgtaccaccgtacggagcttccatgactcatccgcctggcagggcgctggggcggtcatcgtggccaccggcccgagcagcctgaagaacccctttggaccctacaacgtggactacaatgggaacgtgaacgttgccaaggccgccgcgaacgcagggctgaagaagatcgtcatggtctcctccattggcgcggaagactggttcttcttcctcaaccgtgcgtgggatgtgatgtgctcatcgccggggagtggccggggggtgggcaggggcatggtgggctgcagcggggcaccgtcatggtcgccgacctgttcctacatgccgggcgagaaggccatccagagctctggcgtggactacaccatcatccgtcctggtatgtcgggaggattcatctcggaacagctttgcaaaaatgtgcacgggactggagcttgccattccggtggataa

SEQ ID NO: 7585 - DNA, 684 bp, Chlorella protothecoides
atggcgctgcactctcccacttgcccgccacgccttcctgctcctgcaccaccacgaactctccctcccctcctcgaccacctgtccaggaacctggcacctggagaaactgcactgaccccggaggagcagacgctgttggacagactgtgcgaggcctactacctcccggcctggtgctctctggccgactacgagcgcctctttgctgcacacggaatcaggggtgggtggtgctgcgaaactggcctgcatgagggaggagcggctgcgacgacgagggagggcagcgaaccctgcagggcttggaggcaggatctcttctgtccgcccctcgtcgcccaccccacccaccctcgtgcagatgtgaagacggcggactggtccgtggaggtgcagcccttctggggccaggtgatcaagagcgcgctgaccacgcaaggcgtcaccggcctgttgaaagcggggtggaccacgatcaaggtgagggactggagtcgggggctgaggcttgcggttgccggggcagcagggcatattgtgcatcacaacaccagaagaacccccctcatgtcacctctcgcccatgaccagggggcactggtcatgccgctcatggcgaggggcctgtccatgggcctcatcaaattcgtgctgatcactggcgtcaaggccgagacctga

SEQ ID NO: 7586 - DNA, 489 bp, Chlorella protothecoides
atgacgttgggcttcctgcgcagcccgccccgcctcgacgcagcggtggggctggccggcgcagccacaaccccgctgcccgacctggaggacaggggaggccgccccgcatccaaccacggcagcgtgcagctgtgggacgggacgggcatgtcgaccttcagcgcggcgcgcggcgactgggagggcagcggctacggctcactgctctacacgccccaggtcctgcccggttccgtcctttccagcatgccctggctgggccaggctgacttcaaaaagtacatggcccgcctcccggacgcctctctgttcctcaccatcgtccgcgaccgggaggagggtgaggccggtgcaggacgggcagtttttggggcgggtaaggtccgtatgctgttttgcatcgagcggggccgatgtggcatggtcattgtctggaccaagagccttgcttgcatcgggcctggcccgctgcttcctctcggctag

SEQ ID NO: 7587 - DNA, 813 bp, Chlorella protothecoides
atgtgccggtcgctggcccagggctgtagggagctgggcgagccggtgagcgaggtgaaacggaactgccaggtggacgactgcagctcctactggtgggtgctagtgtgggcgggctttgggagagcagggcagcacctgccaggggcatctgctccctttgttgcagcccgatgggaggcgtcgcaggctgtcgtagacaaagcctgtgtccatgccacgcggcgccgtctgccccgctccccccctgactcgcccctcctccccgctgtgcacccctccacccgactcggtgcgcgcgtggctgacggaggccgtggacgcgggcgcacgcatcctcacaggtgccgtcgggtggcatgcccaggggccaggcctggcacggagggggtttggcgcctgcaccccctcatgtgcatggtctgcggggaggatgccacctcccccggagaccacagactgtcaatcaggcaggcaggcagaacatccgggggcacaaggttgcccaagtgccgccatgcaaacttggcaggtgcctgggccgagcgcatcgtgaccgagacgcagggatctgccggccggccggcgcgagtggtcggggtctcgctccgtggcggctcgccggggacatcgggccacggcctgcgcatcgctgtcgcggcgcggctggtggtggccgcgggcggcagcctgcacacgcccgccctgctcctccgctccgggatacaggggcggggcaatgtgggtgagcctggggcgaggtgggcattgggtgcggaggttactggcagcgagggattgctttggcggtag

SEQ ID NO: 7588 - DNA, 618 bp, Chlorella protothecoides
atgcaagcccctgcgaccggcggcagggctgctggaaacggtgctgaagccaataaccagtggaggaaaggtgtggcgctgcgtcgcgattggaaggcacgatacgcgctgcccctcaaggacggcatcgccaagctctatgacgagtcctccggcctgtgggagtccatgtggggcgagcacctccaccacggctactatggcgccgaggaggggaccaagtccaacgcccaggctcagatcgacatggtggacaacgtcctggactgggcaggcgtgcagagtgtcaagaaggtggtggatgtagggtgcggcctgggcggcagctcccgccacatcctggaccggtaccccgggtctgaggcgcgaggcatcacgctcagtcccgtccaggctgaccgggccaatgtgatgacgcgcgaggcgggcctgggggaccgcgccgaattccaggtggcggacgccctgagccagcccttcccggatggctcctttgacctggtgtggtcgctggagagcggggagcacatgcccgagaaggagacctttgtgagggagctggcgcgcgtggcgctgccgggggggcgcatcatcatcgtgacctggtgccacaggtga

SEQ ID NO: 7589 - DNA, 540 bp, Chlorella protothecoides
atggcctcagggtcggcctttgcggcgcgtgtggccgcggccgcgggggccgacacggtgatgaccctggacgccgacccgcgctgccgcttcctgtttgtggacgagggggcagggtcgggcgtgagcgtcatgaatggggaggtcgtggcggggacgggtggcacgccctccctgccggcgcggctggcgccggaggggcccgcgtcgctgctgaccccggcggacgaggcggcgctggcgctgggcaacgccgcgccggcctccgactccggcgcggcgcaggcgcggcaccccgccttccggcgctggctggcggagcgggaggcgggggggatcgccacgcggcgcaccccgctcttctccgcacaccagatgggctctgcccggatgggcaccgaccctgccgtctcggtggtggatgccgagggccagagctgggacgtggcaggactgtatgtgatggacgcctctaccttccccacggccacaggtggtgggggggaagaggggtctgtgctcggggctggaatggagtag

SEQ ID NO: 7590 - DNA, 720 bp, Chlorella protothecoides
  modified_base (444)..(453): a, c, t, g, unknown or other
atgctgggctccgagcacaacgacgccttctacatggcccccgacggctccgttcgcacgcgcaccaaccgctccggcggcgtgcagggcggcatcagcaacggcgaggacgtggtcctgcgcctggccttcaagcccacggccaccatcaccgcgcgccaggacaccgtgaaccgcagcggggaggacatccagctggcggcgcggggccggcacgacccctgcgtcgtcccccgcgccgtgcccatggtggaggccatggtggccctggtcctggccgacgccctgctgcagcactacggccagtcagagaacttcccgggtgtgtacaatctggacagtcccgcacagccgagtgtctccccccagcggcatctcaggcgtgcaggctcgcgccccgcacaaacgtcccgccgcccaccggcgccagcctgcgcatgtggnnnnnnnnnntcaggcgtgcaggctcgcgccccgcacaaagttcttgccgcccaccagcgccagcctgcgcatgtgaaagaaggcgtggcgtgggcccgcggccttgcgtttggcgcctgcccgccagcccagcgtctgctggccctcggcgccgtcgtccgcctcgcactcccaggccacgggcaccgccgcggcctccagcaggggcgtacaggtggcccagctgaagcggacaaggctggggaagccgaagacgcggtgaagattgctctctag

SEQ ID NO: 7591 - DNA, 576 bp, Chlorella protothecoides
atgcagggctacacgctgaagcggttggtaaagggtctggcctcgggcaatgcgggcgcccgccagggctttgcccttgccctgaccctcctgctgaagaggctgccgggcatgactgcagatgatgctgtgctcctcctggcctcctatctggaggcgccctctgcctccaaggtgagcggagtggatgatggccgacaaacatgccatgcagtggaatttatagttggtcaggttggaggttttacaagcggtcatgcttctttccatctacttcgccagggcgccgagacgcgggactaccttctggggcgcacctttggcattggagccattgttcaggctcgcgttcccgccagcacagcgtgcaaagcggagatgatcgaccagctgctggatgcgggggtgctcaaatccttcctccgcgaggccgcagccaccgtcatcctcgacctcgttgcgtcggagacggaggagagcgtgtcggcactgctctcggcctgcgccccgctgtctgccgccctgagtgcgtccatcgaccaatccaccccagaggtgatggcttgtggtgaatag

SEQ ID NO: 7592 - DNA, 969 bp, Chlorella protothecoides
atgacacacctctcaggcgccgctgacggggatggaaacatctgctgcgcaagtccgcccacctcaccgagtctcacactccccaccctatcccaggccaaggccgctgcgaagcccggcatggaggaccccaccatgcagaccctgagggcggccggcgccaggggtgcagccctgcggcccctggccgccgcccgcctgatcgcgctggccgacttcctggccaagcgccccgtcgcgccggggtccgcggcgcccagcccccctctcgccgacctggtggcctgggtggagggggcgctgagctccggccacgcgcgcctggcgcgcgtgggtgcgggcgcgctttcctccacgcagcccctgcgcgaggcgctctccggccgtgcgcgcctggcgtcggtgggtgcgggcgcgctttcctccacgcggcccctgcgcgaggcgttgtccagggccgcggcgtcggccgacgcgggcgggcggggtcgcgtggcggcgctgacgcacctggcattgctcctgcagttgtacgagtgggcggaccccagcgtggtcgaccccggggttgggccggacctggccgacgtggtggacagggcgctgtgccaggccggcgccgaggttgacgggccccgagccggggtcaacggcgacgcagcccccgcctggcacgacacgctggtggacgtggtgctgagcctgctggcccgaccgtgctcgccgctgccctccgcgccgctgcgcaacgccgccgagtccgtcttccgcgtctttgccacagacctgacgaccacaggtgggttgggggatggtgcagggagggaagggggcagagtccctgtcgtggtcggccacctcctgtgcgaggcggctgctcaagctcgtaccccccttcttcccaggcctgcaagacctgttgcgtgtgctggccagcttggcgggcggcccggaggaggtgctgggtga

SEQ ID NO: 7593 - DNA, 516 bp, Chlorella protothecoides
atggcttgcgcgcaaggcatcaccgcccagttggcagccccttcccctcaccaacaacttcctccatcacaagcaggcgctgcctctcccagcggacagggcaacgacagtgacgacgggctgggcgcgactgacgccgagatgttccgcatggacgccaagctggcagcctactttgccacgataaagaacggcaagggggggaacgccaaggcagctgcagagcagctggaccagttcaagcttcgggtcgtcacgctgttggagtacttcctgaagagggctcccagggacgtggctcctgtgtcgccacatcctgacctcggttctcctcctggcacccctgcgcagtcacctgcgtcgccgctggtgcccactgccgcggtgcccatgctgaacgccctggctgtggcggccaagcccagtgggtcccaagtcctgtcccagagactggccggcctcatcaactccaagctggtgaagaccaagcctggggcagccggtaaggagttgtga

SEQ ID NO: 7594 - DNA, 336 bp, Chlorella protothecoides
atgcacagggcggacaacgtggccaccgtgctgtcaccacccttcctgcgcttcctttccaccaacgtctcgcagcgcaaggcctacctgcacgcctccgcgcacaggtgcgagctcgcgctcgtcgccgcgctctccggcgacgacgcggatctcgcgctggccgtctccctggcgctccagcgggcgggcgggtcgctctgggacagggtgagggccggcgccaagagcgccggcgccgccgcgccgggcggcaaggccaatgccatcactggggtgcaggtggggcgagtgtgggggggaaggtttggtgttcggggcttgagtgcaggttga

SEQ ID NO: 7595 - DNA, 277 bp, Chlorella protothecoides
atggacagccacctatactccgactacctggtgccctccaactacgactcgctgctgggcaagctggtagtgtggggcgaggaccggaccgccgccatcaaccgcatgaagcgcgcgctgacggagatggtgatcgcgggcgtgcccaccaccgcgccctaccacctgctcatcctcgacaatgagtacttcaaggcgggcgatgtcgacacagggttcatcgccaagcatggcgacgagctggtcctccccgccgagccggccaggaaggtgagat

SEQ ID NO: 7596 - DNA, 1260 bp, Chlorella protothecoides
atgggcaccagcccactcagcagcacaagtgcatctctatcgacttgcctcccggatctggtccacagtcctggcgcggaagagctcctccacctgctgctccaccgactctgccatcgtgcgagtgcagagtgctcacctggccaggccccgacaccgcatcagtccatcgagtacaattctcttatacagagcagatccggtgcgggtgatcggggaggcccaagcgccccagacccctgccttccagatgtccctcccgtccgcagagaccacatcagaggaggaaagccaagggacatggtgagtcttcctaggggactggacggccgtcgcacttcttctcccatcccaattcatcggtccgcatcgcccctccaggagtccacggtggtgtgcgtggacaacagcgagttcacgcggaatggggactacgcacctacccggttccaggcccaggcggatgccgtgaacctgctggccggggccaagacccagcaccaccccgagaacacggtgggagtgatgagcatggcggggcgcagcccccgggtgctcgtcacccccaccaccgagctgggaaaggtgctgaacgccatgatgaagatggacattgagggggatgtgcacctggccacggccgtgcagatagcccagctggccctgaagcaccgcgagaacaagaaccagaggcagcgcattgtcatctttatcggcagccccatccaagaggacaaggtgtgctgtggtgtgttgggtgggggacgtgggcaaagggggcggggctggcacctgttgcagagggctggcttgactgcaccctcactgccagacacggcacagctcacgttccgcatgcaaactccctcccaggactccatggtgaagatcgcacggaagctgaagaagaacaacattgcagtggacatcgtcagcttcggctctgaggaggccaatgtggagaagctggaggctttccaggcggcggtgaacagcaacggcaacagccacctggtgacggtgccgccaggcaccatcctgtcagaccagctcttcgccaccccgatattcatggaggagggggcgtccagcgacggcggcggccccgcgcctccaaggagtgagtggtctagggttggagaggttgtcaaggcctgtgtaaacgagaggtgggaggggatgagagggctgaggaccccacccaaggcttcgatggcttcagcctgccattccgccttgatacttttcacaccccgttga

SEQ ID NO: 7597 - DNA, 483 bp, Chlorella protothecoides
gatgcgctccaccgcgccgcgccgggcggcgagaaggacgcgcagcagctcttgcccgtccacgggcttgagcagggccagcgccgccagcgtggcggcgacggtgcgcagcagctcctgcccgtccacgggcttgagcagagccagcgccgccagcgtggcggcgacgtcgcgcgccggtgcgtcccccgcgccggcgccgtcccgcagccactcccccgcccggccctgcacctcgccccggaacttgcgcaccagcggccactggtgctggagcagggggaactgggccgcgacgccgtgcttcccgcgccccgtcagcgcgcggtgcgcgtcggacgcggccaggaagcggcacgccgcgccgaggaagtcgcaggcgtccaggcagccccagacgtgctcgggggtgtccagcaggaatttgacgcggatgccgacgtctggtgggggggggtgggaggatgtgggaggtccttatag

SEQ ID NO: 7598 - DNA, 792 bp, Chlorella protothecoides
  modified_base (311)..(388): a, c, t, g, unknown or other
cgccggctgcgcaccgcaggcgctgagtttgcggcctgggtcttccgccacgcagccctggccgacctggcccccgccgcggaccctgccctggccgcctgcctggcgctggtcctggacggggctggggagacggccggcgccgccgacgcgggcacgcgcggcgcggccctgcgcgcggtgggcacgcttgcgcagcgtgtgccggcctgcctggcggggcgcgtggacgtcgcagctgcgctgttcgaggcgctggcccgcgagcctgcgggcacgcgcgcgctgctgcaggagacgctggcgggggnnnnnnnnnnnnnnnnnnnnnnnnnnnnnnnnnnnnnnnnnnnnnnnnnnnnnnnnnnnnnnnnnnnnnnnnnnnnnngcgcaagcggacgccggggcgcgggcgcaggtgttggccgtgctggcggcgcacatccgctcgccgcaggaggcggcgcgcgccaccgcgctgcagtgggcggccaaggtgttcccgggggaggacgtggaggcgcgctacctggccgtcgtcgcagcgggggatgtgcggggcaccgtggcggcggccgcggtggactcgctgacccccgtgccggggacgcgggaggagcgcgggctgccgcgcttcctggacatgctgggctgcctgctgcgccaccaccccgccctggggcgggtcggcgctgtcggcgccgactcgggcctctccctcaaggtgtgtctcggtggggatgggggcctgggggtcctagaaggatgccgcaatgggccgccacagaatga

SEQ ID NO: 7599 - DNA, 849 bp, Chlorella protothecoides
  modified_base (306)..(315): a, c, t, g, unknown or other
atgggcaggctgctccccccacgcctggcggcgcatctggaggcccactccgtcctccccgtcctctacgcctccagctggttcctcacctgcttcgcctccgacttcccgctcccctttgctgccaggatcatggacctggtggtcaccgactgctatgcggcgcccatcatgaaggtgcacggtctttgtctgcttgtttttattttgggggaggagggggcggatggtcctccgtgggagcgtggtcagcgagggtctgagctgacccggtcctccttggagacacccacccaccaccctccnnnnnnnnnntcctccgtgggagcgtggtcagcgagggtcagagctgacttggtcctccttggaggtgtttctgtgacgcgcacaccttgccacacccgacttcatccccgcgccatgtccccgacgctcaccaccaaagcccccctccaagctgaggcgacgtggcgccctcacttgctcgatacccttgggaaacccttgtcaaggcacccacccaccaccctttctcctaccatccccacctcaccaggtggcgctggccgtcatgcgcgccgccgcgccgctgctgctggaggtggaggacatcgaggcggcggtggactacctgaagaaggacgtcccgcgctggccgctggaggaactgcaggagatgctgacgctgggcctgacgcggccctggaccccccgccagctggccgtcctggcagagctcaacggcagcgagaccgtggcccaggcagtgcggcgcgtgggtgggaagggcggtgccgagtcgccgcgcggcgtggcggagcggggtggtgccacgccctcggcccctag

SEQ ID NO: 7600 - DNA, 2163 bp, Chlorella protothecoides
atgcatctgcgagagccagagctcagcccgcatccgggctgggacgctgttgaagaccgtgcgcccacactggagatcgacgagctcatcgcagccatttatattctcggatgtgttgtctgcccccaggacgtactggaatgcgtcttggccgagcttctgcacaaatgccagagccatggctcgggcctcctacaggaccccgtccagaaggtcgagtcggcaccttgcacgcatggtgggacccaaatggtctcgatagccttcgatttttattcactcgcaaagcctctctcgaacaccgtgcacaggcttcatgacaccagttttctcgtggggtgcatatgctcgaccggtagaagggaggaataccatgccccgtctgtccctgggtccccctccctcaccgtcaaagtccaggcgccgggccccaagcggcacagctccccggttcttcagccagctctccccgccccccctcctcaccagattggtgactttcaggcccgtggcccgtttgtctccgtctttgatccgccagaatgcgtgaggtcatcagtatccacatcggccaggcccgggccgtggcgtccggtccatgactcggcagtccggcgcaacacggcccgtgatccagccccgtgcttccccttccgcaggccggcatccaggtcggtaacgcctgctgggagctctactgcctcgagcacgggtgaggagaagtgttccgggccgacgatcgccgaccgacactgccgtccggtgggcggccctgctcgcacccctacccgcccagctgagcccacccgagtcccactttcaacccccacccgccatgcgcagcatccagcccgacggccaggtcccctccgaccgcaccttcggcgccacggacgatgccttcaatacctttttctccgagacgggtgccggcaagcacgtgccgcgctgcgtcttcgtggacctggagcccacggtgatcgacgaggtgcgcaccggcacctaccgccagctgttccaccccgagcagctgatcagcggcaaggaggacgccgccaacaactttgcgcgcggccactacactatcggcaaggagatcgtggacatctgcctggaccgcatccgcaagctggccgacaactgcacgggcctgcagggcttcctggtgttcaacgccgtgggcggcggcaccggctccggtctgggctccctcctgctggagcgcctgtcggtggactacggcaagaagtccaagctgggcttcaccgtctacccctcgccccaggtggggtgggtgcaagggagaggggaggtggagatggtggacggaggacgcgccttgcctcgacgcttgtccactcacagtctacttcactcgccagaacatctgattcccctttgcaccccacaggtgtccaccgcggtggtggagccgtacaacagcgtgctgtccacccacagcctgctggagcacaccgacgtggcggtgatgctggacaacgaggcggtgtcatctcctcgctcaccgcctcgctgcgcttcgacggcgcgctgaacgtggacatcaccgagttccagaccaacctggtgccctacccgcgcatccacttcatgctctcctcctacgcccccgtcatctctgcggagaaggcctaccatgagcagctgtcggtggcggagatcaccaactccgcctttgagcccgcctccatgatggccaagtgcgacccgcgccacggcaagtacatggcctgctgcctcatgtaccgcggcgacgtggtgcccaaggacgtgaacgcggcggtggccacggtgaagaccaagcgcaccatccagttcgtcgactggtgccccaccgggttcaagtgcggcatcaactaccagccgcccaccgtcgtccccggcggcgacctggccaaggtccagcgcgcggtgtgcatgatctccaactccaccgccatcgcagaggtgttctcgcgcctggaccacaagttcgacctcatgtacgccaagcgcgcctttgtgcactggtacgtgggcgagggcatggaggagggcgagttcagcgaggcgcgcgaggacctggccgcgctggagaaggactacgaggaggtcggggccgagtcggctgacgccgacgacgacgagggcgacgagtactag

SEQ ID NO: 7601 - DNA, 1503 bp, Chlorella protothecoides
  modified_base (691)..(700): a, c, t, g, unknown or other
  modified_base (1111)..(1120): a, c, t, g, unknown or other
  modified_base (1247)..(1256): a, c, t, g, unknown or other
atgcagcacagagccatcctgtctcaagccgtatgcaccgggcttgatgggcttcttgggtgtggccaggctctcaagttggttgctcgacttgcgtttggccttggccggcatggcgaggcctggccagcgagagctggtccgctcaaaggttccaaaatttacatctctggttctcatataaaacgcagtactcttggtctcaagggctcctctacaagctacggtggaaagggctcgcatgatataatacgaactcgcgcccacaccggaacacggaccacagcaggttgcaggcccttgtcgttcccaacctctcccatcaccagccaagtgcacgcatgcaaatatggagatactcagcatggttctagagtaagaatgaaatccactggggcagcgctgtgtgcaggtacccgactttctcctgccgaccgtccctttacctccaaggtcccagtgcgatgtcaagcgcggcctcgatgcagccacatcacggctagtggaacccagttcagaccatgcattgacatccacgatgtgagcgggggggtgcgactgggcatcctatgcagcattgtgattctgagcactggtttgctagccaaccctccgtgtatacggctgcagggttccgtcaagcagatcgtgggctcctccctcaaggacggtgaaggatctcacacaggtnnnnnnnnnngagagtctgaactccgtcttttggattctacgtattcgttctataatggacaagcgatgctgtacgagtacatgcagatctcacacaggcatcttcccaagactttgcagacctccactagaccccccctttctccatcaatgccaccctgcagcgccgcttccgagctgaagaccaacttcgtggccacccagccgtcgtcctggtttgctgagctctttgcgcgtgacaacctcacaggcggccatgtcatcatgctgggcgccagcgaagccaatgagcgagcagccatcgaggcgctgcaggcctacccaggtggcctccaagtgggcggtggggtcaccgcggagaacgctgcacgctacttgaaggctggggccagccacgtgatcgtgacctcttacgtctttnnnnnnnnnntcaccgcggagaacgctgcacgctacttgatggctggggccagccacgtgattgtgacctcttatgtcttccaggagggcaggctgaatgagcgacgcctggccggcctggtgggtggttgcgtttnnnnnnnnnnggggggggggggggggggggggcgcgcgcgtgtcatcagggtctgccttcctggtggcagactgcgcggacgatggctagcgcagacggcagcaccaaatgggatgttcgtcgacggaggcgcaatgcacccctcacctcctccgcacgccctctctgcttcaggtcgaggctgttggcagcgaccgcctggtgctagacctgagctgcaggaaaaaggacgacggccagtactacgttgtcactga

SEQ ID NO: 7602 - DNA, 600 bp, Chlorella protothecoides
atgacatcatcaaatattcctactcttcccacctccacgacagtccctcatgttcctcggggaggctgtgctccatgtcatgcgaggcagggcgctcttcaatgggtgagggggtcaagaatgtgcatgtgcgggtgcctaatgtactcttctgacccccgggcgaccctcggctcaggcagcgtctgctcgatcgctgcggatgcagtgaacagcggcccgctcctcatcagccaggcggccgagggcaatcactttccctttgcgcccacggagtccgtcctctacctgcagctgcgacccctgcccgcagagcagcggctgagcgggggcttggggtcgaccactgctgcgcgcatggcggacgatgtcggctaccaagcctggctgcacaacgacccctccgcgcccggctgccttgccacccccgacatctggtcgcaggcggtggaggagatggcgggcctggcctaccctggggccgtgtacgccgtggtgggctccaagaaggtggggaaatccacgctgggcaggctgctggtcaatgagctgctgagcacgcacagcagcgtggcctacctggaaacaggcgagttgtga

SEQ ID NO: 7603 - DNA, 507 bp, Chlorella protothecoides
atggaggaccctcgagtacagttcccctgcatgtttggcggagtgctccacgaccccccgctccccaccccaagtcgctctccattcctcctttcctccagcgaggccacgctgcgccagctgggcgcgcgctgcgcggagttcctggtgcacggcgtggatgtggagggcaagcagctgggcatcgacgaggagctggtgggcctgctgggcgcgctgtcgcccatcccctgcacctacgccggcggcgcccgcaccctggtgggtgggctgcatggctgcgaccacggggctctgccgcatggccccgtcgacatagggccggcttccccccccccccccccccgccctccctcaaacacccatggccaggccgaccttgatcgcgtggcggcggctggaaagggccgcgtgcacatcacggtgggcagcgcgctggacgtcttcggcggcgccctgccctacgccgacgtcgtggcgtggcacgcccgccagcgaggaacgtga

SEQ ID NO: 7604 - DNA, 399 bp, Chlorella protothecoides
atggctctggcatttgtgcagaagctcggccaagacgcattccagtacgtcctgggggcagacaacacatccgagaatataaatggctgcgatgagctcgtcgatctccagtgtgggcgcacggtcttcaacagcgtcccagcccggatgcgggctgagctctggctctcgcagatgcatcgggatcgggaggcggtgcaggcctgtgaggagtttgcgcacctggtgtcacgggtacgcgggggccgggcctggcagggtacccgattttgtattgttccaccaaaccctaacgccccatccgtgaccatgctggccctcgcacagagcctgccttcctccgtccagtcggagatcgagaaggacctccaccgcacctacccaggccattggaggtag

SEQ ID NO: 7605 - DNA, 1065 bp, Chlorella protothecoides
  modified_base (435)..(444): a, c, t, g, unknown or other
  modified_base (955)..(964): a, c, t, g, unknown or other
atggggcaggcgtggcgtggtaaggtccggagtcaccaagacgatgcatattgcgcgcgatatgcgcatggctttacaaggcactgtcgctgccaacaagacgcgccgcgtcagcccccaccttcgtctcgcctcggcgagcctgagccgatgaaaggggacacaaacctggaggtgtccttcacggaccttcggttcaaggttcaactcaaggatggaagcacgctagaggtcctgaaggggatcagcggccaatgcagaccgggaagggtgctggccatcatttatagtatcctctgtgcctccatcaggggctcctccggcgcagggaagaccacactggtgggtgccggagtgggggaggggtccggtggttctaacaatcgcagtacgggcacccatcccagaaaccaccccatcatacccaccccttannnnnnnnnngctggtgggtgccggagtgggggagagggtcggtggttctatcaatcgcagtacgggcacccatctcagaaaccaccccatcatacccaccccttacaccgtggacccactttaatagctcgacatgctggccaacaacgtctacgggggcacccagacggggtcggtgtacgtgaatggagctccacgccagcgcgccgccttccagaggcagtcatgctatgtactgcaggtccggggtgtctcggccgacatgcgagggatgggacctttctgtgctccttgtgcccacggtttcttcgtggacttgccattgtggccttgtactccgacctgcgagggaacccccatccctcgcccccgctggtacagagggatgtcctgctttccagcagcacggttcgggaggccatcacgttgagcgcgctgctcaagctgccccaaaccatgacccgggaggagaagcaggcgcgcgtggatgagaccctggcagagctggtgagtgtgtggnnnnnnnnnnctgagcgcgctgctcaagctgccccaaactatgactcgggaggagaagcaagcgcgcgtggacgagaccctggcagagctggtgagtgtgtgggctgctga

SEQ ID NO: 7606 - DNA, 1746 bp, Chlorella protothecoides
  modified_base (901)..(910): a, c, t, g, unknown or other
  modified_base (1133)..(1142): a, c, t, g, unknown or other
  modified_base (1452)..(1461): a, c, t, g, unknown or other
atgctcctcgccgatggccgcaccgtcttctccggcgcctggtcggacgccctgccattcttcggcgcggcggggtacccctgccccgcctacaccaacccctccgaccacttcctgagtgtgctgaaggaggagggggcgcgggataagctggtggcacagcacgaggccctggccgccaaggacctcgagacgggggatggcaatctcaccacgctgcccgaggcgctggcggtggaggggcgcagccgcagcatgctggagcaggaaggggcggcgcaggagtcccgccccgacgcccccttcatgaggcaggtggcgctgctgagtcagcgcatggcgcgcatgtgggtccgcaaccccgtcatgctcatgtccgagctggcgcagtacggcttccttgccgtgttcatggctgagacacctccccctcccttcaaaggcctcatgtacctgaggctgaaccactccacaactacgggcctgtccgaccggctggcctccctctggttcggcctggccatcctttccttcacaccctcctacaccgccgtcaccatctgggacaaggaccgcttgctgctccgccgcgagtcccagcagggcatgtactcggtgaggcagatgggcgcgggtgggagcggagggctgccgggcaaggcgggaccttggcacgggaggccagtccgtgcagaagcatgtgccagcccaagactcggaacctgtgccgccgacgacgcagatcccggcgtggttcctggcgaggacgctgaccgtgacccccatgcagattgcccaggtgtgggtcagggggttgtgaacgaggggtgctgcatcctgcaggtccttcaaatctggatgtctgatgtggaggaacctgcagctggaatgtttggggacnnnnnnnnnntcccatgcagattgcccaggtgcgggtcaggggggtgtgaacgagggggtgctgcatcctgcagggccttcaaatctggatgagcgtcggccaattatttggaagccattgtcaaacctctccaccacccacgtcctcacacgcctacagaccacgctcttctgctgcatctcttactggatggtgagttgcagggtcgtggcctgggcaaacttgctgtcgnnnnnnnnnngcgtcctcacacgcccacagaccacgctcttctgctgcatctcctactggatggtgagttggagggtcgtggcctgggcaaacttgctgtcgcagggtgcaaatctggccagggtttccgtgtggccgactggggggttgacacacctgcaaaacagcttgagacattctccccaagcatccagttcctgctcccaggacttccctccccaccccgtgctgtttcaaagcgcccaacctgtgccgctccaaacatgccagcccactacccgccccgtcacattcccctgcgccagattgggtacattggnnnnnnnnnntctgcaaaacagcttgagacagtctccccaagcattcagtccctgctcccgggacgtccctccccaccccgtgctgtttcaaagcgcccaacatgtgccgctccaaacacgccagcccccactacccgccccatcccattcccctgcgccagattgggtacattggccgcccagggtccttcttcgtctacgtcctggtgtacaatctgttccagctggtcagcgagaccatcggcatgctgtgcgccatgctcacaaagaacagcacctacgccatcctggtga

SEQ ID NO: 7607 - DNA, 279 bp, Chlorella protothecoides
atgggtaatggggcgagcctcagccactcaacaccactgttttatcatgcccatgttgatgtacctgtccataggtgcggtcactgcaagcgtctggcccccatctgggaggaactggctgacgcggctgctgcagacccccgcctcagaggacgggtcgtggttgccaaggtcgatgcggatgcacatcggtcacttggcgaccgctacggcatcaagggcttccccaccatcaagttctttggtagggggaaacccacagccgctcctgcagagtaa

SEQ ID NO: 7608 - DNA, 531 bp, Chlorella protothecoides
atgctatcctgtgaccggcctccatgtgcccaggatcgaccaccacccctctcctgccctgtctctccctgcagctactctggtggacgcaccctggaggcgttttctaccttcctgactgagaaggtgcagtcggatgcccatgcccgtgtcgagttgctggacacctttgcctccaagttcttggggagtgccgatcaggccggactcctggcccagacagaggaggcggtgctgactctgacaggtgaggctcaggccaacggtgccctgtacgtgcgctacatgaagaaggccatggagaagggcgcggcctgggtggacacggagctggctcgcctggagaaactgacctcgggagcaagcgcatccggtgccaaggtgcaagagcgctctgtgtggggaagggtgaggggattcgcctgtgatgcatggcggcgctcttgctgtgaagacggcgttcacatgctcgagacgcctcaaagtgaggatgagagggaagggctccgcctttgctcgagtctggattga

SEQ ID NO: 7609 - DNA, 2379 bp, Chlorella protothecoides
  modified_base (471)..(480): a, c, t, g, unknown or other
  modified_base (2058)..(2067): a, c, t, g, unknown or other
atggcagcctccatctcgcgggtcgatcacgtctgtgccgatcgctgctccgggagagtcaaacactgttcggtgggaggtactgcagtcgatgtggataaaagatcagcacgcgatgtctgccggcgttcacgcccggctgggctccttgttacgggacctgcagggcgcggaggtgcagagcgagtcgacattcctccaactcgccgatgcaagtctggtggtgaatatcaggtcccaagagcatccgccaggaggtgcaagaatgcctccaagtcgcccagcgcaaggagatggcagctctctgcgatgcactctataaaaaggcacgtagcgtgctcgaaacttagctgcacaggccagcgatatggtcgatgctggacgtcagtccagggtgtcccggtgcgttggtatgttaccatcaagcctgcccccttaaacaccctcccctggcacagacggaggccgcannnnnnnnnnagtccagggtgtcccggtgcgttggtatgtgaccatcaagcctgccccctcaaccaccctcccctggcacagacggaggccgcctgtgcagccgtcctggagatccagacagccgaggtcactgcctcggaggctgagccggggtcaccgggccttcccccttccgcgctgtctgtcctgggcgccagtgctgtcctggcccgcctgatgctgggggagaccaaggcatccccgccccctggcttgcacgccacggccgcgctgctgcacgacaactgcctcctgtacctctgcgactcccccgtcatccaggaggccgtggcccggctgtgcctggagtggtggcaggcgggcgcgcccggcaggaacgcgctcgtcccatccaccatcgcctacctcgtcgctgaagccgtgggggccgggcataccactgtgctgtggggaatcgctcatgcctgccaccatgtattgtttcccccctctttcagtgtcaagccaccctgtgcatgcccttcaccaacccttccacccctgccaggcaccactgcggccgtgaagcggtgccacgccatccggcacggcctggacctgctggactacgaggacgaggagtccatcgtccaccttaagcgcctcctgctcaaggccaccttctgccccgccttcctgcgctgcagcgagggccgccgcttcctggctcacctcttccgcctgcaacccgcttttgtcgcggagctgacggccatcatcaagaaccaggtcccggcggggcgcgcctcaggcaagtcagagggaggttgggctggtgagggccagtggggggtgggatgcctgtacagtgatggctgccactgctcgggtgccaggatcggtgtgactctggaaagcgcacattccaaaatgctcagggaccggttcaggagccctccgcatggctgccctgctcccctgagaaccccctctccacccccactcaccccccgacacaccaccaacccaaccctgaatgcagtcctggacgcgtacggcgagatcctgttccgcgcggtgtccggcgcggagggcgagcagttgggcgcggtggtggcgcactgcctgcagccgctggccgaggccgcgctgctggcttcgtccccgggtttgggggccaacctgcgccgagtgctgcgtggcctgcactcccgcaagcacgagccgggggtggacgccgcgctgctggaggcctacggcccgctgctgctgcgccgcctggcggcgcccaacccgcgcgtccgcgtggccgccctccgcctcctggccgacgcgttcccactgcgtgaccccgcagaggacggtgccgcggccgacgaacgtctgggcgaccagtttcggcgcctgcgtgacgcgctgggcgacgacgcgcccgccgtgcgcgccgctgctgcgcgcgcgaccgcccaggtcctgggcgcctactgggagctggtccctgccgccctaactgcctccctcctctcccgcgtctccactcgaatttgtcccacctcaccaccaagggcatcaccgccggtttccctcaccccccgccatcccttcccnnnnnnnnnntgcatcttgtcatctctgaggggaggaactagttgccccagccactcgaacttgtcccacctcaccactaagggcatcaccgccggtttccctcacccttcgccatcccttcctttcctccttctcctcttgaccccaatctcaccagctcattgctcaaaccgccgcgtgtgcaggcgacctggggctggacacggccagcatcgaggcgcggtgtgcggccgcagaggcgctggcgggcctggcagagctgccgttggcggcgccgctgctcaagaagctgctgccccggctgaggccccagctctttga

SEQ ID NO: 7610 - DNA, 1383 bp, Chlorella protothecoides
  modified_base (173)..(182): a, c, t, g, unknown or other
  modified_base (799)..(808): a, c, t, g, unknown or other
  modified_base (1156)..(1165): a, c, t, g, unknown or other
atgcgccggtggaaagtggttcacgagtctgacggctttgggcaaaagtactggaccccctccgaacagcgatggaggtatgaagaaggaggaggtgccactaaagttaatagtttcagcaagtcttggatccattcaactcttcctccttacaccacagatctcccaccagnnnnnnnnnnaccctccgaacagcgatggaggtacgaagaaggaggaggtgccactgaaatctcccaccagtacattaagcagaggaaggatttcggccggcacccctccttccggaacggccccattcagaggtgggctcccctcccgactacaggtatttgtggaccagcgaccagacgaggagctggccgccctctgggttcccgtgtcccacgtgacgaggggcacccagtcgggccccagcatgtcggaacacgagaagatgttcctgcgccaggcagcaagttcatgctggtctcgacgcagcacggcagacaaggctttgtccatgcccatgcacgtgtgcaggtgaacaccgtggtcctccagacagtcagccaagcagtggatgcgaccctggggcgctggcccaaggacgtggaccccacagacgcccagcaggtcgccaggttccgcaagaaggtgactgggtttgaaaccagatcctacgcaccgtgtgggaatgagtgggtacatgacgaggagaacaaccgcgcacggcatgtgtgtatgtcctgtgcccgaaggtgggacgcagagcgccctgcaattctcttggaatgtctgcgcaccttcatcccatggnnnnnnnnnnagcgcacggcctgtgtgtatgtcctgcgcccgagggtgggacgcagagcaccctgcaattattttggaatgtctgcgcaccttcatcccatggtgttggtatccgctgctatgtcagggcagggtcgaggggtcaagggtatccccaaagccagtatccacattcatatctttactcagatggagaaagatgaggactacatacggtgcacggtacgcctgggagcggtggtggaggagctgatcaaggagaacaacgccctcgacatctacgaggagtactttgcaggtggtagacgggtgttcagctgcagatggggtgacaaggcctgggatactgggtctgacnnnnnnnnnnggacgggtgttcagctgcagatgagacgtcccccccctcgccgagctggacccgccctccatcgccagcctggcgacgctgctgccggagggcgccggggagccggtggtgcgcctgagttggcgccccgacgccgcggcctgcctggcggtggccggcgcctcccgcgtcagcctctgggacctggacgccggcccgccacgcgtggccgccgcgct

SEQ ID NO: 7611 - DNA, 339 bp, Chlorella protothecoides
atggcgacgcatgctcctgcgcgcgcacgtatcacccatccacgccgtcccccacaacaccccccgttcagtgggctgtccggcctgagctggctggacgtggtggcgccccaggacctcatcggcgtgctgggctgcgacacccccgccctgtcccagcgcgtgcaccagctcctgctgccctccttcctccccgacgaggagtcggcgccgggcttgctggtctccctcctgcgcagccagccggaggccgggcgtcgcctgtgcctgtacctggccggcggcgtggagtccaaggcgcaggacgggaccgtcctggccctgccctcgggtgcgtga

SEQ ID NO: 7612 - DNA, 480 bp, Chlorella protothecoides
cacgaggcggcgcccacgccgcgggacgcgcccggagcacaccaagcgccgggcccgcaggcggacaaggggcgcgccccgccggcccctgccctggccgccgcgacgtcgagcgacccgggggtcgctccccacccggcgccgcgcgacccgaccagcactgccccagcagccgacgcggcgctggacgcggagctgtcggcgctgatggctgcggaggatgagctggtcgccgcgcatcggcagcatatcgaggactccatggcccacgtgcgggaggagatggcgctgctgggcgagctggacggcggcggcgcggcgggggacgtggaggcctacgcggccgagctgacgggcctgctggccgagaaggcggcggcggtggcggcgctgcagctgcgtgtcacccagttccggcgcctggtgcagaccaccctggagcggcacgccagggctgggagtggcgccgggcagcagtga

SEQ ID NO: 7613 - DNA, 750 bp, Chlorella protothecoides
  modified_base (364)..(373): a, c, t, g, unknown or other
  modified_base (530)..(539): a, c, t, g, unknown or other
  modified_base (637)..(646): a, c, t, g, unknown or other
  modified_base (699)..(708): a, c, t, g, unknown or other
atgcattcaggtacgagggagaaggaattactacggtcaagcgacgagcaggaggagagctccgcagaccttgcaaatctcatcctgtgccgcctccgaacctgcaggaaaacacagagggccaaagaaattgcacggaacaagaaggagaggtcactgcagcgagatgcctactccaagcgggatgatcctgagagtctgaaggagcagctgaaggaggtcattgcagcggagcaggccggcaagtccaatccgacgttgcggctgaagaagaaagcgctgcaatcagcatatgaacaggccatcaagaggcagatggtgagcattgaacccaaaaacttgggactggggcactcaagtgtannnnnnnnnngccatcaagaggcagatgaggccatggatagcgcactggagtcgaagacttctaccattcctcatgactgcctttcaccctacctctcattgcaggaggaaaaggcctgcatcaaactggcgcccggagaggcatccctggctgcgtcagagaccgnnnnnnnnnncctcatgactgcctttcaccctacctctcactgcaggaggagaaggcctgcatcaaactggcccccggagaggcatccctggctgcatcagagaccannnnnnnnnnttgacggattggcctcgcaccatggaagcgcatgtgcaagactgcagggttcnnnnnnnnnntgcaccgacctgaggattctgtgtattaccacccgaccttga

SEQ ID NO: 7614 - DNA, 429 bp, Chlorella protothecoides
atgcctgatgtgaatgcgcgcatggatgctgaagcctccataagtgggcaggatgatggagaatcggtgtatgatgggctgcccttttaccaggtgagcacccagcagcagcagcaacagccgcacgcaggcagctcccgggcttgctgcctgatcagcctcaacattacactccgcccacagcacatgatggcaggagcactggctggcatcggggagcatgtcgtgatgtttccagtggacacgatcaagacacgcatgcaggccttggcccacccggggcagcaggtgaggctcaaccctggtgctcatggccccatttttgtctacgcagatctccattttgtcactgtctgcctcctgatcaggactgatgatttatcagggacgcgaacggctcgacgcacgatgcacctgaggctgtgttga

SEQ ID NO: 7615 - DNA, 396 bp, Chlorella protothecoides
  modified_base (330)..(339): a, c, t, g, unknown or other
atgcctctgcatcccccgcctgcgcagctgcacctgtctgtcaggcacgcgatgcgggcggtgctgaggcgggaaggcgtggcggggctgtatcgtggagtcacagcaatggcccttggcgccggacccggccacgcgctctactttgccacatatgaaaaggccaagcatctgtatggcggcaaccggaagggccaccagctcgttgccacggcgggtgcaggtgggctttcggtggcgatggatgggacgagaggcgaggagagggagggtgaggactgctgccggggcgatggcagtgggtttgggtcattggagcagttgtttccnnnnnnnnnnggcaggtgggcttttggtggcgatggatgtgacgagaggcgaggagagggagggtga

SEQ ID NO: 7616 - DNA, 801 bp, Chlorella protothecoides
atgggctggcccacccctgagttctgttgctttcccacgggggctgcgccgccccttgccaaccccaggctacccctggctgtcttccctcgtgttgggcacctgcccctcttcctgccgtccgtatggttgcctcggagcctcgtcgccctccctcccaaactccctccaggcgccaccgccacgatcgtgaacgacgcgtgcatgacaccgtgggacgtggtgaagcagcggatgcaggtgtcccacagcccttatcgcaacatctttcactgcgccaagtccacctaccgacacgagggcctgtcggccttttacagatcctactggaccacggtgggtgggtggttcagcagctgggacgcgttgccatggagccctgggctcggcgctgtggtggagattcagatcgcaacaccctgcatgggagccggtgcagcctggcaggggagtgatgatcgaccgaggatgtttggctcaggcagtgtgctgcaccctgccgtaagttcgtgcccagtgaggctatcaattccttcccatcccgctctttcctgggtgcagctggtcatgaatgtgccctacacggcccttcagttcatgctatatgaatccagtaagaagctgctggtgggcgagggcacggccgacgaggaggaagaaggcctgaaagtccaggggcgcgcatggacgaggtctgcccggcactcgcctgccatcctccccggcctcaatgcccgcagctgcaatcccccccggcctcaatgcgcgcagctgcaacccccccggcctcaatgcccgtag

SEQ ID NO: 7617 - DNA, 576 bp, Chlorella protothecoides
  modified_base (312)..(321): a, c, t, g, unknown or other
atgctgtcggatcccggcgccgccagggaggttgcgctagggtcgcagggagcgctggagggtttgtcccggggcaagggctacatagacgcctccaccgtcgacggcggcacctcctgcacgattggcgaggccgtccgcggcgccggcgcctccttcctggaggcgccggtgtcgggctccaagggtccggctgagcagggcacgctcatcttcatgacggcaggtgtgttgggcgatttagaggtgtcgcaaggggtttggttgacgcagtccttgcctgcatcagcgctgctgggaagcttctcctgnnnnnnnnnncatcttcatgacggcaggtgtgttgggcgacttagaggtgtcgcaagggggttggttgacgcagtccttgcctgcatcaacgctgctgggaagcttctccaacttgctctggtggagagcatgagacacgacccaccaatgtccacacaaactgcgcaggggacaagaagctgcatgatgcagctctgccgctgtttgaggccatgggcaagacctccgtgtacctcggggagacagggtcggcggccaagatga

SEQ ID NO: 7618 - DNA, 1356 bp, Chlorella protothecoides
  modified_base (1300)..(1309): a, c, t, g, unknown or other
atggctgcagatgtgaacactgatgtaaaccctattggcattttggacgccgattcactcctccgacacaaagattggcgtgtgctagggaggctcgggaacttggctgagctgcaagaagtacttgatacatctagacgtctgactgcgctaccttcaggccccacccatcgagctgggatgtcgtgttcaaaagctgtcgtgaaggtggcctctgccctcaggaggcggtgcgagcttgcacacccctccgtcgccctcagcggcttgaccatgagcgatatgagggctggattgtcgcagaggcagcacagcagcagcctggcaaacattccggatgcccgagtaaaccccgacggtgtcagggccattgctcgcaacctgctgctggacacgcttcagatggtgagtacctggacccccatggcgctagcttggagtaagagccgaagcaatgattacagtccccagcttgaatgcacaaggggtgagggtggcagctggggtgctccctgtcctagtgccaaccgctcgatatctgtgccaaacattgaccgagacccttggtcacccacaaaacatatgcagatgaggaagttcgaggcctctggcatgagtcgggagcaggcagagggcttgactcagcacctcacccagatgctgtgtcaggatcgtgataagctggctgacctttatgtgaccaaggaagtgctgaagcgggtgcgcagcgggggtgtgaatgggactctgatcaccagtttaacgcttgctgcctgtgctgggtgccgcctcaagccgcctccttcacacgagacactgagcggttgcaggacggcctggagaagatccggtctgagatcaggtgagtgcctgcacctgtgcgaggctggcgggagaggaatctgcaagagccctgatcaaaggagttggatgcacctcctaaggacccatcgcatgtatctgtgcttcgcgagcgatccccttgctcaaaggaaagatccagttggtgagcattacctcttacatcccaatctccaccttgctgcctttgaaagaaattgctccatgtccaattccttcaggtatgaggttgacaagctgacggcaagtcaacgactggatcttaatcttgaaaagggcaggatccgggatgagctccagtccctccgagatatggccacagaaatggaaatcaaggtctgctgggcggttggctgtggttgcagtggatgggcaaggagaagaaaaggcttcaagggtttgtggctagggagaccagtgatctcccttcccccacggnnnnnnnnnngaggagaagaaaaggcttcaaggttttgtcgatggggagaccagtga

SEQ ID NO: 7619 - DNA, 2013 bp, Chlorella protothecoides
atgcagagtcgagaggctctgaatgctgggaccagtggctcacccgaaggggcccagccccccctccgttatgccttccctagtgcccggggccccacgtcccacaaccgatcgagcgctttgataaaggatatggatgccctgaagcaacgtatggcaaccgccaaagctggaacgggggaggtggcagcggtgctctcctcggtcacctttcagccccgggcggcagccttcaccagtctgatccaggcaaccagcaaggccaaagccacggagaaggcgctagagcttttccagtgcatgcaggacatcttcggcatcccccctaacaccttctcttcctctgcgctgatctccgccctggccaagtccgggcagtgggagctggcggagttttacttccacgacctgggggcgtcccgatcctccgcagctgccctggatgcccctggggaggggcgcctgccgcctgcctcgtcaggcttccctgccgtcgaggggttgcggctggtcgacgtgctgccttctgctcgctgggtctcaactcctcaatcgattgtcgatcacgagcggcggcgtgctgctcgatgccacggctgcccagtctccgattcccatcctgtgcagcatacgagaaagggggccagttcgagaaggcgctcaaagtcttccagcagcagctcgatgccaaggtcgacccagacctcatcacctttggcagcctggtctcggcctgcgaacgcgcaggtgcagcctcccggcggagcctggctggggatggggagggtgagcgccgcgcgtcgcctgcccccacgggcttgtcagccgtgcagtgctccaactccaaccccacccgacaccgccgccccgcacaggccagctggagacggcgatcgccatgctggacgtcatgcacaactttggcctgtccggcacgcagcagatgtacaacgcggtcatcgcggcggcgccggactggaactcggcgctcgaggtcttcctcggcatgcagtgcgccatggtgagcggcgtctgcggccacggcgtgagggacgtcgccccctgccggctgcatggtgttctccgaaggggcgcgtgcctcccctgctcctcacctgggaggcacagggcccccattgcagtggagccgaccgtccagaccctgaactccaccctgacccaggccgcggggtcgggaagcatgcagcccatcctggacgtgctgctggccgccgggcagtgccacgcctcgctgacggccagcacgctggcggcggtgcgccgcgcgacgaccgcgctgggcggcgaccgccagctggcgcatgtcctctcctcgctgccctcaggccttttcaagtgacgcccccgcagaccacccctcctccagccccctgctctctctctccctttcgctccgagatgcgcaaccctcaagaccctttttcaacgccagcacacagcttgatcccccccccccctcaaggccatgcatatgaccttctttcattcgctaccccacccagtggggatttgccaaacaccaggcggcgagtgcccctttcccctgggctcatgccgtgcgttttccagaccctcttcaattctactgatcacgaacaagtcccttgtagacagctgcgcttggcagctggatactcaagctcttcattcattggttgcatttgttttttcccaatccctacccacactccgatttgctctctcccttccgtggcccatgcgccacctccagtaagccacgtctttgtccggtggagagggttaaaggcattggatgggaggatgggacggcgggagggggtggctgggtcgtcaaccggaggacggtgcgcaggagtgtctacagaggggtgggggggagtagcatcatcttccatcagcgaaggatcgcatcgctgcgcgaccccgggggtttgccacttgggctccccggcgcagccacggtgttcaaagggaaatgaccagggcgcatgggcattccgcactgattaa

SEQ ID NO: 7620 - DNA, 1308 bp, Chlorella protothecoides
atggcctcctgtgtcgaacatgcgctccagcgcctccatgttggccagggtctgcgacaccgcgcccgggtctgcgccgtcgcagcgcagcgcggtcatgggcccgtgcagcagcttgttcacgatggacttggtcaggtcctccaccgccttcttctgcttgttggtcatgccctcccccagccgcgccagcgtcttctccagctccagcgcgcggatggcttccgccttgctgcgcagcgccttgatggtgggcaccgtctccaggctgtcgcgccaggcctcgaacgcggcctgctcccccgtcagcagctcctccgcctccgccgcagcacgcgcgcgccccgcgctgttggccgccaccacctcgcgcaggtggtccacgttgaacacctccgccgcgtcgcgggcgggggtcaggtcgcccgccacgttgcgcggcaccgagatgtccacgaaccggcgcacgccgtccagcggcgccggaggcaggccctccaggagttcgcgccccaccagcacctcctccgacccggaggcggtgaacaccaggtcggcggcggccaccgcgtcgcgcagcgtgggcatgagtcccagctggaactccacatccgggaactcggcggccagggcctcggcgcgcgccagcgagcggttgagcagcgtcacgcggccgcagcccttggaggccaggtgcttgaccagcaggcgcgacatcttgcccgcgcccacgatgcacacacgcgcggcggggaggcccggggcgggcagcttgagcgccgccagctccgcggccgcgctggacaccgacaccgcgccggcggagatggaggtctcggtgcgcacgcgcttgcccgccgtcaccgcctgcttgaacaggccgttcaggtggcggccgaagccggggcaggcctggcccaccttgtacacctgcttcacctgggacaggatctggccctcccccagcaccaggctgtccagtccagcagagacgcggaggaggtgccccgtcgcgtcgcggtcgcgcaggaggaagaggtgcgggcgcaggtcggcaagggggacgccgctggcgcgggacagccagtcctccacctcgcgcacgccgcggtggaaggacaggcccaccaggtagatctccagccggttgcaggtggacagcactgctgcctcctcgatgagcacagctccgcaatcgcgcgcggccactccgcctcgggcaccgcaagcttctcgcgcagctccacgggggcggagtggatggtcaggccgatggcgatgatgctggacttcttctccatggcatag

SEQ ID NO: 7621 - DNA, 342 bp, Chlorella protothecoides
atgcccatagctgcaacccccccgcaacccatcattcgaccccccttcacacagttcgtcgccggggggatcgccgggggcaccgccgccgccgccactacgcctctggacgtggtcaagacccggctgcagctggaggggctgggcagcgccacacggtaccagaccatgtccgtgatcccggtcatgcggcgcatcgccgccgaggagggcgccgctgcgctgtggagtggctggcggccccgcgtgctcttcaacgcgccggccgcggccatctgctggggcgtgtacgagacatgcaagactttcctggcgggggatgacgtggcggaccaggcttga

SEQ ID NO: 7622 - DNA, 1353 bp, Chlorella protothecoides
atggagaagaagtccagcatcatcgccatcggcctgaccatccactccgcccccgtggagctgcgcgagaagcttgcggtgcccgaggcggagtggccgcgcgcgattgcggagctgtgctcctacccccacatcgaggaggcagcagtgctgtccacctgcaaccggctggagatctacctggtgggcctgtccttccaccgcggcgtgcgcgaggtggaggactggctgtcccgcgccagcggcgtcccccttgccgacctgcgcccgcacctcttcctcctgcgcgaccgcgacgcgacggggcacctcctccgcgtctctgctggactggacagcctggtgctgggggagggccagatcctgtcccaggtgaagcaggtgtacaaggtgggccaggcctgccccggcttcggccgccacctgaacggcctgttcaagcaggcggtgacggcgggcaagcgcgtgcgcaccgagacctccatctccgccggcgcggtgtcggtgtccagcgcggccgcggagctggcggcgctcaagctgcccgccccgggcctccccgccgcgcgtgtgtgcatcgtgggcgcgggcaagatgtcgcgcctgctggtcaagcacctggcctccaagggctgcggccgcgtgacgctgctcaaccgctcgctggcgcgcgccgaggccctggccgccgagttcccggatgtggagttccagctgggactcatgcccacgctgcgcgacgcggtggccgccgccgacctggtgttcaccgcctccgggtcggaggaggtgctggtggggcgcgaactcctggagggcctgcctccggcgccgctggacggcgtgcgccggttcgtggacatctcggtgccgcgcaacgtggcgggcgacctgacccccgcccgcgacgcggcggaggtgttcaacgtggaccacctgcgcgaggtggtggcggccaacagcgcggggcgcgcgcgtgctgcggcggaggcggaggagctgctgacgggggagcaggccgcgttcgaggcctggcgcgacagcctggagacggtgcccaccatcaaggcgctgcgcagcaaggcggaagccatccgcgcgctggagctggagaagacgctggcgcggctgggggagggcatgaccaacaagcagaagaaggcggtggaggacctgaccaagtccatcgtgaacaagctgctgcacgggcccatgaccgcgctgcgctgcgacggcgcagacccgggcgcggtgtcgcagaccctggccaacatggaggcgctggagcgcatgttcgacctggcggccagcacacaggaggccatcctggccgccgccgccgcgcgcaagtag

SEQ ID NO: 7623 - DNA, 267 bp, Chlorella protothecoides
atgtgccatgtggagtccgggggaggggcacgccgcgtcgccctgcaataccacagctggaacaaccggctgacggggacggtgccgtcgagctggcagtttgcggggctgcaggagctgtacctgcaggacaacgacctggaagggggcctgccctccgcctggggctccaatggtacctttgccagcctccagatcctcatgctggacgacaatgacctgggaggtgaggccacggcaggtgcatggcgttgctgggctgagtag

SEQ ID NO: 7624 - DNA, 204 bp, Chlorella protothecoides
atggtggcagagcgcttcgaccccgccttcccgctcaagcaccagcagaaggatctcaggctggcgctggaactgggatcggacgccgggcagtacctgccggtggccgcggccgccaacgacttgtatctgaccgcacggaatcacggggcgggtgacctggacttctcggccgtgctgcgggcgatccagcgcaagcaatag

SEQ ID NO: 7625 - DNA, 2889 bp, Chlorella protothecoides
  modified_base (2468)..(2477): a, c, t, g, unknown or other
  modified_base (2553)..(2562): a, c, t, g, unknown or other
  modified_base (2721)..(2730): a, c, t, g, unknown or other
atgttagcgcggtatcgaagtgtcgattcaagcaggatcggatctgagctgaggcttagtagatcgcgggccgtgagccaccgtgcggcggaccgcgctcacaatatgactggttcactgcaccccgccggctggcaggccgcatggtcctcggcgctgggtgtttcaggcagccaggaccggcaccacgtctcaccccgacctgatctggacgtccgccaccctcgtggagaacaagatggccgcgatggctcccctcctcacggccaccccgtccgcatactcaccttacccctacgcattcccccccctcttcgaccgcgtggccagggaggcgtccctggacgggggcctgcgcctgctgcgtctctcggtggaggaccgggtgcagtacctggacgggaggaaagtgcggcaggtgcagcgccgccctcgctggcgcgacgacttccgcttcccgggccagtcggtggccctgcgcttctgccccggccccggcgccgccgatgtggacggctgcgccgccgacggctcggccacggtgcgcttcgcccttgcctcctcccccaccagcgcccgaaacgagtcggcggggctggacgccacgctggtggagctgctgctggacacgcgcgcgcgggacagcgccgccagcctggccgcgcaggagccgggcacaccgctggaggtcagccaggtgctgggacgggggtgagtcgcggagggtgggggctccgccgtgcgttcttcttcttcatatgttccctggggcaagcgggggtgagcagggccaggccctgtggtggctttgcggtacatccggctcctgggcggtcgtgtaagcccactgcaccgaatcggctctatctgagaatcacatgcgagattagggcgatgtggaatcgcctgggtggggaaggcgtcatcggagtgtcaccctcacccccacccccaacctatgcacacctccacccttttcccaccccaccatgccgcagcttctcctcggtgctctccctgggggctgacctggcgacggcgctggaggagcagcggccgctcctcctgctgggggccagccctggcggcgtggcggcgctccgttccgcactttcctggacccccctgctggcccacgccgcacagcaccctgtggtggcggtcgtactcgcgccctcgcccaccgccgcgccctttgtggtggagtgggaggagtggcggcaggcgggggtgaagctgcacagcccgcctcgcgccggagctgggggcgctgctggggtcggggccggcgggactgcgcgcgctgctggggcccagggctcgcgaggcctgcgtcctgctgtccggcatcgcaccggagcagggcgccgagctggcaaagaggctggcagaggccggggtgcatgggcgttcgatcctggtggcagacgccggggcggtaggcctggactgaacgagggcggcgctctccggaggctggaggggctgaggtcgcagcgcccgtatcgccctcaagtgctcttctgtgctgcggtctgctccccttcgatgcacggcctggagcactcggacgtgatgatgcagcgcgacggctccccagcagtcctagtccttgcggttctgtgcgccctctcgctctccgtcgctggtcaaaactcttcgggtaagaatgacggcttgactgctgccttacattatgtgccgttcccggaagtagcaatgcgcaggaccccatgcatggagccgggcaccgccgtcttggacctgatcacccccgcatcagaaatcgaggatttgcctggagcctgcaactgtacgctcacggggatcagcgggtgcgcggaggcaaatgctgtcccgatttgggggctcggaagctgccctctgccaacgcggagatcgctggttccatgtttgtccccatggctcggacttaccatgccacccaccaagcagctcctaatccagtccgcccttccaacaccctaccctacacacccaaaccatcacagtgtggcctctgtagacgatttcctgggctgcgacaacttcctgagcagccagggggacgacacctactactgctatgtggtcagccccgaggcctgccccgccgtccaagccagtccccgcttctccggcgcgggctaccgaggctgcaaccctgaagtggacgccgtggtcgcaggagcccccgactccttcacgctctgggagctggtggccgagtcacccagcctcagcttcctggccactgccctggaggtcgccaacctcaccgacaccctggcatccgccgggcctgacggtcaggggtacaccctctttgcccccaggtggagtcccccgtgtcaaccgccatgcaccaatgcacgccggacctgcttccctcccgcagcaactatgccatcgccacgttcctggagtccacgaacacgaccatcggacagttcctggcctcacccaannnnnnnnnnatgctggcggcttgcaatcgtcgtttgtgttgggatgcggaggtggggtcccccgtgtcaactgccatacaccatnnnnnnnnnngctgttggccatcctgctcaaccacgtgacctcaggtggtgcggggtttatgttgactggggagagagcaccggcatgtctcatgtggtcgggagggaagggaggggtctgcgcaagcgtggatggctgccacaggtggcacagcccctcctcccaggnnnnnnnnnngctgttggccatcctgctcaaccacgtgacatcaggtggtgcgggggtgtgttgactggggagagagcaccggcatgcctcacgtggtcgggagggaaggcaggggtctgcgcaagcgtgggtggctgccgcaggtggcacagcccctcatcccagtag

SEQ ID NO: 7626 - DNA, 2295 bp, Chlorella protothecoides
  modified_base (667)..(676): a, c, t, g, unknown or other
  modified_base (838)..(847): a, c, t, g, unknown or other
  modified_base (1928)..(1937): a, c, t, g, unknown or other
atgaaactttgccgggcaggcacaccactcttgcctctcttgcgctcaagtagatattgcgccctcggcttcccacgcatctttgcaccttcctatcatcccttcaccttatccaccccccaatccccttccaatgcagccctcagatggtcggaaggcgatgtgtggaccctggacctggatttgccagctggaaagcacgagtacaagctggtgatccacaacgagagtgcagatgtggcgtactgggagcaggggaacaaccgcaccttcacggtgtccgagcagtctgatgcgcccctcgtccttgagtttaattccgtggaagtcatcacggagaccgccgatgagctgagtgagtcaaggccgcggccagggtgtcctggcatgacccttccttccgctgcgcgtccgtgcaatgcttcagccatggggctgcatggatgtgtgaagcgactgctccagatcgagtccaaggggtgtcttgagctctcgagccttgagccaatcaagctccagttgacccatcaaacccccaccaagccccctccattcatctcccctctctccccttcagacgccgtctctgactcgcagctcaccgctgacaaggccaaccccccgactgctgctgctgaggagcccacagcggccaaggcagggtctnnnnnnnnnngcgctgacgaggccaaccccccgacggctgctgccgaggagcccacagcggccaaggcagggtctgctgcccccccagctgcagaggaagccagcgaggcagccatcgatgcccctgtctcgtctcctgctctggagaaggaggccgaggcgccgtcggcannnnnnnnnnaacgccccggtctcgtctcctgccctggagaaggaggccgaggcgccgtcggcagctgccgctgcggtttcttcttcgacgaagaaggaggaggccgcaaggccgagcccgctgccgcgcaaaaggaggccgccaagcatgcggccgtggaccccgccgcggacgccttcaaccccgcgcccaccccgaccaccgccgcaagtgagaaggaggaggccgccgccaccgacgcagctgcgaagaagctggagtccccggccgcgaagccagagaatctgggccagcggtctctgtggcgcctctctggccctcgggaaggctgtgctgctccgcccaccatcaagcacccacaccttttccaagccaaggatggttgcgccgccgcaggccctccacgcccagaggaaggcccagcacacgactcttcaccaacctaccctctctgccgccttgcgcagactgctggagtgaagaagaagggggcaaagaaggcgacccgcgcccagaagggcaactttaagatctctgcctgccatatggagtgtaatgtacgcgacggagcatgttgtccgggcggcgcataccaccaacatggtgtcacccaagcggaatccatgatcatgaagcatctctgcgataacgggcagtctccgacacccggaccatggcgtccagtcggccagtgtaacagcttcggcacggaccgatcaatcttagggtacctgtcatgtccggttcgaatctgggcaggtgaatctgccgctgcaagtactggcaatcaaggggcaccttcggagcaagagcgaggcagctggcgcgtgacgatcccgccacgattttggttggacgccatgatgcaatctatcgccatccagaagcccttcgtggcctccacgaccgccacgcgggtgacctctcgcagctctgctcgcactgcctccaccaccgtgtgcgccgtgcgtcgcgataaccagcatgccattgccaaggtcggcatgggcctcgctggcctcctggccgctgcgcagctcgccaccacacctggccccaccccaccctgtcgttcctccctcccacagcnnnnnnnnnnccatgttgattcctgtgccaaccgccgaggccccaccctgtcgttcctccctcccacagcccaagccttcgatctgggacaggccatcaactccgtggggggcaccgacctggtagagaaggctaaggacgccgtgggtggatcaggaggagtccaggatctggtgcagcagggcaaggatgctgcccagaacatcaacgcccccgacctgaaggacgcggccggcaaggtcggcgaggtggcagacaaggcctctgacaaggcctctggtctggccgacaagatccccggcgtgtctgagagcaacctgcagaacgtcggtgagtggccatgggacgtggattcctcttcagagtga

SEQ ID NO: 7627 - DNA, 1248 bp, Chlorella protothecoides
  modified_base (1154)..(1163): a, c, t, g, unknown or other
atgctggcacaccgagattattatgccccgctcctcgaggatgaggaagaggctgcgcggctcgcacaggatgcggaggctcagcaagaagcagacaagcagcaggcagcagcagcagtaggcttggtggatgctgaggctgtcgctcagccaggctttgcatggagcgtcagagcgaaaggagaaggacccgcactaacgatctgggcgcgaattcgaactgaagttccggatgaactggcgatcagttctgttgtgcatcggtcggctaccggacaccgctctcacggcgaacacatttcgagcctacgcttctatgaaggcagaccgctcttggacccgcttggtttcgagaggcccctgatcttcacggccaggccttgctccgatgaagctgaaggccaccttgtcggacagaggcctgcgagtgttggagaagggtttcctacccacattcgaaaagtttgggaagagcctgcagctcctcctggatccccaggggtggttggggaaacagtcgtctgcagctgcaagtttttgagcctttcttctttgcccatcatagcggtcctgtttgagcccggcagcttccacatagagtcgcgctgcgacaacaagatagcctttgcactggacaccgccctgctactcagggtgttgcatgctgccgccgccaacgatgcctccagcctcgaaatgcggctcaccatgagggcctgctcaagcagcatgtcaggacagcatgctcctcttcagcatcaacagtgccccggtccctgcacaacaggagccgtgtcatccggcagcgagcagacatcgcagcgtcccgtcctttcctttgcatggcaggggtatgacatgagcatggtgcaggtgaggcggtggggcctagatcttgcagagttgggcatgcttgatgcgtgtttcagagggcatcctctgcccccacgccgatccctcttgatgcttgctgcaggacctccccatcaccaggccataccctgcgagccaggtctcttgggcggagctctccgggcccggcccttctgcacaatcacatgtcgtgctacatgctgcgtacctgcggcgcaggctctccaggctttcatatccatgacacgcatctctacataccctgcgcaccccacaggttnnnnnnnnnncgggcccggcccttctgcacaatcacatgttgtgctggatgctgcatacctgcggcgcaggctctccaggctttcacatccatga

SEQ ID NO: 7628 - DNA, 546 bp, Chlorella protothecoides
agcgtcgtgtcgtcgcccgtacccctgcaccagctgcacgaccttcatctgggtcaattcccccgtgccccgggcgccgggacccgggcaggcgcgggggtgagcaaactgtaccgccccacctacccctggggccagctgtcgggctggtacaagcaaacggtggcggaccccaccgccagcctgtcggcggagcggcgcggcagcatcagcctgcccgacgtggagagctgcttcagcaaggggggcacgggccggacgccctacagcgccaaggagcggcgggacctgctggaggcgctggcgcgccgccccgacgcgcagtggcggtcgggcaccatcttctccttccggaacgaggcgcgggtgtatggcagccccatgctggacgatgcctgggacagggtggagggcagggcgggggggctggaggccgtgctgcaggagctgcgggacgcggatgtaccgcccacctttggcggctcggcggggagtaaggcgggcgcacggtcgagatgcgtacggactggtcctccagagtcttga

SEQ ID NO: 7629 - DNA, 279 bp, Chlorella protothecoides
atgcatcacgaggagcttcatggtcccaatccggagggcagcagtgcccccgctagcaccagcgggacgggagttccaaagcttgcttccgacggcaggtctgaggccaagacgaatgctggctcggacccccctgcgacagctgctcatccagaggaacagcagggttcagctggcgaggatgaggacgatgaagatgatgaaaatgatacctgtgggttttgcatcttcatgaagggtggaggctgcaagaaggctttcaatgtgagtcggggttga

SEQ ID NO: 7630 - DNA, 390 bp, Chlorella protothecoides
atgccagatcgccgcatccggctgctactggccgacccgctgtcctgcaatccgcggaatgcacgctatggccagctgcatgccgcggggcccaggggtgaggtctcggcgctgcacccggccatctccgcgcggggagaggatgtgtcggaggcagccctgctgcagctgctcagcggcgtgcatcccccggggacgcctgcctcccagcgcctgctcagcacggggaaatcgaatgtggtggtgttcctgacgggtcatgggggcgaccagttcctgaagatgcacgatcgctccgagttccttgaggcagacctggccgccgccatcgccgccatgcacgccttgggcaggtgggcccctgctgggaggactggggcagccctatga

SEQ ID NO: 7631 - DNA, 2160 bp, Chlorella protothecoides
  modified_base (100)..(109): a, c, t, g, unknown or other
atgaatggtgtcgttccgtgcctgggtgaggacccgtgggacaaagtccaagctgctgctgcactgtccctcaccctctccgtgaacacgaggtcccatnnnnnnnnnnggtgtcgttccgtgcctgggtggtcctctccccccccacgcgctgatgcgatcgttttcctctccttgcttgtcattggtgtgcatggcatgcgtcgatcccagccccagccatggacaaagggtgaagggtcgtgggatgaggcccccccaggaaatctgggcggaacagagatactttgcaaagcagcgttgccctgtgttgtcgcgccttgggctgggtcaagcggcacgatgaagcgacggggcagtgagcgggcaatcaggggggtgcccctgttccgggtatctacaatggtaagtggtgatccaggggacatatctagatacagtgccgcgtcgggatacccgtcgctcccgcgcgcccccttcaccccccccttccaccagctgtgtgtgcctcccaccaggccccaaaatccttcgtcctccccaggagtcgctggactctcccatcgaccgacgggccgactactaccgtctcactgcactggagggtctgcgcaagaggtccacagggacggtcagccccttcctgaacctgccaaacctgctcaccatcagccgggtgttcatggtgcccatgtttgtggtcacatggttctggaccagcaccgcagcacccgccaccaccgcagccctcttcaccattgctgcgctgacaggtgtgtgtgtgtgcgcagagaggggggaggggggggaccacgggacaccctcccgcccatgccgccgctccatacccgagtgttgccccccaacaagaaagccaccccaagctctctgctgcctccttctacagactggttggacgggtacctggctcgacggctgcagctcaccagcgcttttggcgcattcctggacccagtggcggacaagatcatgtggtggtcatcactggcacgagctgcagcaacgtccccgttcccccgtcgatccccctccttgcccgcgctgcgagtccagggtatccacggcgctcatcctcctggccagcgacccgcccccgcccatctcgctgcccgccatggtcgtgccggtggtcatcatgacggcacgcgagctcaccatgtcggcgctgcgggagtgggcggcggcgtggagcaacgaggcgcacaaggtgggctggtgtcgggggtggtggacatggagcctgggggagacatgctctcccatccctgtgagcttggcacacgaggtgaggggcgcagtcggccctggcagccgccctttttaactcaggccctttgccagtcaggccatggcccccatccacccaccaccttgcaggcagtcaaggtcaactcccttggtaaatggaagaccgcgctgcaaatggtcgccatgacggccctgctcgttctgcgacatgcagacctgatcctaggacctggctacgaatccggtgagagggggccgcgggggtgtggccgggaatcatgggaccgtgctgcgcagggaaaccctcgcccggagacgagcacctctcgaagctgggctgcacgcactggtcctaggggctctcgcggtcctgtggctggccgcattcctggcggtctggagcctcgtgaactatatgtcatgcgtatggaagtttcttgcgagcacgtgagcctcggacgacgcgaggatgtgtgcgagtatgagcttgcgtggcatatccgagcattgtatttgccgataggcccacttcggaaagcgggttacccgccgcggaaggtccggatgggggtccctcctctgtgcgcactatttctggggaccacattccttcgagccacccatggcggtcgcgtccttcggcggatggcccttgtcttttgcatccctccacttcggggataccccggaaatcgccggggtcgaagggttggtagatccgccaaatctccggacttttacagtgagcacctcgaagccatcggcgaagttgccaggtgcggaaccgtgacctccacttatgtcaccttggatttaagacgcatattgagctcggtgaggacgtcgccggtcaccttctcggcgcttgatcctacgcgcgacgactggtag

SEQ ID NO: 7632 - DNA, 1149 bp, Chlorella protothecoides
  modified_base (542)..(551): a, c, t, g, unknown or other
atgccactcatgcgctacatgtggacattcttagccggtgaaatactccgattcctccttccacctcctgtcgttgctctgtgcgcgcgaaatcgctcctcagaccgtgagagctggcacctactttcccgatttactggtccgcgatgtgttaacacattgcgtttgatccctcccgcgccccattatcaagatctacgtattgcatgtgcacctgaagcaatgtcgacggctgtcagcatgcactccgttgcctctgcgagggtgtcgccatgcaggtcgtgcctccgtgccaggcctgcagtgggacaagcactgaccctgcccagcccacgcatgtacccgtcccgatcacaaccccatcgtgtctcgccgcgccgggtgcagcaggagagggtcgagcagacatccagtaatgacacgtctcctcatcccgataccctggtcgacaccctcttgcaggacatccaaagcacaggtcggggggtagcaatgatttgcctggctgttgtcggggtttttattcgactcaggaagggggnnnnnnnnnncctggtcgacaccctcttgcaggacatccagagcacaggtcggggggagggaggttctgaaatcttcatggagcaagccccctgtccctcctccacccttcgctccacagacgccggggacagcgtgtccccgccccagcgcgcccgcatcgacgacaccatccgccacctggctcgcatcggggacggccaggacccccgccccctgcggaaccccgacctgtttggaaacttttcggtggcgtacgtgtcccccggcacggcccagcccggtgcggcggccgggggcaggttcaggtcgaccctggggaaggccctcttccccacgcggggcctcttccagagcgtgctctcccctgacatcgtggttaacaagagggccaggctcgccatctggcccccattgcaggtgtgctttgcgctgctgggcctcatccccggatccgtggtgctgcgcggcaagctccagcccatccccaactttgccaccggcagcgaggagaccctggacaccgtcaaggtgcctggggggggtgttgggacggtggcagggtgctcctgccgcacggaatggtgccgtggacgcgtccttctgtag

SEQ ID NO: 7633 - DNA, 477 bp, Chlorella protothecoides
atgtcgggcgcatggtcactctcccaagccctgccccccgtgcagatccgcatctacaacctggccaagcaagccatggtgaagaagctgttcacgggggcgggggtgatcaccagcatcgcgctgcactccacaggttggtgggatggggtgcatcgtgcgatgagtgacctcggcttggccggtgcgtgctgcactcctctggccgctggcggcccgcctgctccatgccaaggtcgcccacctgccccgcccccaaccccaggcgatcacctgatcgtgggctcggaggacaaccgactggcctggtacgatctggacctctccacgcggccatacagggcgctgcgattccacagcaaggcgttgcggggcgtcgccttccacaggtgggcgtgcaggggcctcggtttcgcggcgggcctggggggtcaggggccggcgcgggttttccgcacaggcatggccagggcctga

SEQ ID NO: 7634 - DNA, 342 bp, Chlorella protothecoides
ggacccgagggcgcggtgctgctcccgcacgccgcgcgcgtgacggcgctgacctggcacgcgcgcggggactacctggcggcggtctccgcggcctcgcccagccaggcggtgctggtgcaccagctgagcaagggcgcgacgcaggcccccttccgcaagacgcgcggcaggcccgtgcaggtgctcttccacccgaccaagcccctcttcttcctggccacgcagcagcaggaagtggggaacggggggacagaggggtgcggggtctcgtggcatgggggggccgcggggcggggggagtgggtcgacaacccaacagctgagctgcgcgagtggcac

SEQ ID NO: 7635 - DNA, 909 bp, Chlorella protothecoides
atgggccggagtgggtgcggcgatgctcgtgattggttcattgtagccttcgataaagtggagcgaggtcgcagagggcgacaacgcccagactgggacgcttcggccttcgatggagtggagcgaggtcgcagggggcgacaacgcccagactgggacgctccgggtggtccagggtgcccagcccaaccctggccccacccacaccacctccacaggttcagcaaggacgatcagcagtctgcgcccaccagccgcgtgggcacccccgcctacctggcgccggaggtgatcgtgagcaagcccggcacgcactacgacggcaagaaggcggacctctggtcctgtggcgtgctcctctacatcctggtgacggggacctaccccttccagcgcgtcaaggactccaccatgaaggggccccagaagctgaacgccatcctgaaccgcatcctggcagtggactacatcttcccggagcgcaagcgcctgtcgccggagtgcaaggacctcatctcctccctcctcgtgctcggtgagctggatgatggagcgtcaccgtgtgccatctggagggtgcttggggagatcgttccgccgacccgcccgcggctgcccatccagcctcacactctcgcccctgcatcgtcacacccctcccttccccgccccccagatcccaacgcacgcccggacattccggccatccaggcacacccctggtaccgcgtggacctcaaccccgccgccctctccttcaacgacaccctggtggccgacagcctggccaacgccacgcccgactcggtgtacgaagacattcggtccatcgtcagggatgcacagcaggttgtgcgcggcaagccccagcacgcaggcaaggaggggcggagggggccttatatttga

SEQ ID NO: 7636 - DNA, 444 bp, Chlorella protothecoides
atgctgtatgtcatgctggtgggcgcctacccctttgagcggcccgaggacaagcacgacgcgcagaagctgcagaagatgatccagcgcatcctgcgggtggagtacgattggccgccgcacatcaagctgtcgccggagtgtcgggacatcatggcccgcatcctcgtggcagacccacagaagcggatctccatccaggagctccaagaccacccctggtacatgaaggacctgccgcccggggtcaaggagatgaacgacaacatgcggatgccgcccgcggggtcccagtcggaggaagagatccgggagacagtcgcggaggctcagaaggcgccggggcgcggcggcggcatcgccggctgggaggacgactacatcgacgacaccatggatgcggagaactacgagtcgtcgttcgacgagtggggggggacctga

SEQ ID NO: 7637 - DNA, 960 bp, Chlorella protothecoides
atgagcgcatgttccggcgagagtgcttccgtgagctcgtcagcaggaaacagtgctgacagcccacgtccaagcgacagcgccgaacaaaccgagtgtggcgatacaggagctaaggaggaaacagaacatcagagccccgagagacctgaacaggcggaggccaccccccttccaggccaggcagagggcgtcccagtggaagcctcttggcaatgcgcatttgacaggaactcccagagacactactggtattgtcaggagacgggagtgtctgtctggcacgcacccccaggatgggaagggcagccttgcagggaggcaggcggggcgcagcagcccgaatcaggtgtgggttacaacccctccccagacggatacttctacgtggatgcggaggggacgacacagggcccctttgatagggagcagctgcgggcgtggcgcgggcatctgcccatggacctccccatgtggcgccctggtgatgaggcgcagcagtaccttgctaccgtgctgggcgacgatggcctgctgaggcagtggcacgatgccaaccctgaggaagcagagcgggtgtgtctgctgtgggtgcgatggatgcaggggtggggggctgcgtggccgtcttggctggaccatctggtgggacaggctcgtcgacagacgcaccagactgtacatgtttgcggccctcattgttgttcccctgccacgctcgtttgccaaggagtgcaccgtcggcagccaacatcagcgctattctcagcggttgtgaccccgctctgcccctcccatgcccagggcccaagccgagcccctccagctgcgatctacgaggcggaggagagagggggcagtgcagcgggctacgcagctgctgccctggcagggcttcctcccgacgacgatgccgtgcgggtgaggcgcggccgcggggggtgggtggggagattgtga

SEQ ID NO: 7638 - DNA, 915 bp, Chlorella protothecoides
atgcatgcatacgtcgagtgcaggccgcccccccaccagccatgcccctatcccccccacacacgtacaaacagcacctacctccccgagccggagacctggctgcaccgcgccggcgcgggggccaagcagctctggtgcatgggcctgctctccctcctcatccgcggcgggtctgggtgcaaggcggctgtggtcctgtacctcgtgctcgtcaccaccctgtctctgccgcggcacgtctgggggccgcagctgcggcgcctgggcaccctctgcgccctcctcctcctcctcaccgcgctgggctccgacttggccgcggcggaggggctggagcggggcccggcgccgggcggcgcgggcctctccgccctccccgcctccatgcaggacctgccgggctcaccaaggtacagcagcgtgctcctgaagctggggttcctgcgcgtcacgcggcgcagcttccgcctggcggtgagtgccgcggggcgggcggcgaggctcggctcggcttggctcggctcgccgagcattctttccagatgcatggatcccagggatgcgctcggcccctgggctcggtcctccacacccatggcggtcctgctgctcgatgtccctttggttcaaagagatcattccttcctccctccccttcactccccggccaccacaggtgagcactgcggcgctgacctttgcagcactgcagtcggcctccctctgcctggcctgcacccccccagagcgcatggccgcggcgatgagctctgccctgagcccgctgagggtggtgggattccctgccgacgagctggtgctcacgctcttgctcgcgctgcgcttcatctcaatggtgggctctgggtccaatggacacatgtcgcagggggtgatggggcggaaccctag

SEQ ID NO: 7639 - DNA, 1227 bp, Chlorella protothecoides
atgtgcccccgggtcccccctcgctgcccgcaggtccaggtgttggtggacagcgtggtaggctgcctgccggtgtacagggatgcccagcatctggcccttcccacggtgcgcccctccgccctgtgggtggaagccgtgcttgccgaccggtacgacaccctgggcatccccgtgcgtacctcctacgccgaggccaccttctccggctgcacctgggacaccaccctgacctttgccacccgggtgagctgggatggcctcacgctggctggcatggggagggcctggcctggatatctgcgatacacttgttggggccagcatgggatctgtgaatgtagccccccgtgccgtgtttgcaccctgcggaggtgggccggggacctcgtcaatcgccgacggctgaccatgcacacaccctgtcccccccacatggcctccctccatgcccccggtttcttcacagtaccgcgacctggaccacacggcccagctggcgctgacggtgtgggaggtgcgggaaggcgtgccgcagcgcgccctggcgggcgccacgctgcgcttcttcagcaagaaagggcggctgaagaccggggcgcacacgctgcggctgttgaccccgggccccgcagatgggggctggccgtcgaaaaccccgggcaaggtccccctgaaggagcggggggagcgcgggtgaggggcgaggcatcgtggggatgggatgggggtccccgcacctgggcccctcggcaaaacgcatggcgccttgctgcactgtgccacgccgtctgtgctgctgcggctgggcagagccgggatgaacctggactccaacccaaacacggcatgcccagaccaacgatcgcagtggttgtctggctgctgtcacacacacagacacatcctccttcctccttgcccaccgccgcacgcaccctccggtcactgcgactccctcaacccccccaggcgggtggagcaggtgctcaagcgcttcgagcggggcgagctggaaagtgtgccctggctggacggcctgaccctgcgcgccatcgacgagctggcggccgagggcgcgcgcggcgcggcgccggccgcaggcgagcccctggccctgctggtcggcctgccctccttcccccaggcggtggtgtaccaggcggcggcgctgccggggggcgccggggtcgcggacgccgcgcccgacgcgctgcgctccaccga

SEQ ID NO: 7640 - DNA, 1743 bp, Chlorella protothecoides
atgcagggcctttgcagccaagcaccgaatccactgcgccgtcccagcccagcctcgccaccaccggtgcagggtcagtactataagaggagcaaggagggcgatgccatcatcggctttctggctcctctgctcgccgagagcgctgggcaggtggcagcctatgcaccccaaggtcccgctgtgagcgccgtttcaagggtcgatgaccccacagcgtccaggcttgttgaggggggagcttcgcttcccaacagcgcggtccctccgccaccggaagcccccgtggcgcgccccacagatccatcagcccccccgggacctgcctcggaggaggaggaggaggaggacgcggggcgcccgcctcatcacgactcggcgcagggcccacgcagggtgctgggccccgccgcgccgccgcccgagttcctggcagctgccgcgctgctccccctcccgccctccccggagccgggtgtgccgggtgctgacgatgacgacgaggatgccttcttggtgggccccgtgcctcctgacctggcgggcgagctggacctggccagcagcgacgaccgcagcgccgaggtggcccgcatcctgggcctggcccgggagcgggaggcgcggctggcgggcgtggcggccgccgacgccgcgcgcgacccgctcgacccctacgaggtgctgggcctggggccggaggccactccggcggaggttaagcggcggtacatgcgcacctccctgctcatccacccggacaaatgcgaccacccgggcgcggcggacgccttccaggccgtggcccgggcggccaaggagttgcaggttgggccgcggtgccgagggggatggcgggggtgggggtgtttggatcgccatgagttctggcggctgctgtttgttgtgcagccttggacgggcagggcggtggagatggaaggggggtcaacccgaccaaacggaccttgcatgtgctggcgaagaggaatccaacctggaacatgccctgacctgggcctgagggccgcggtggacgcccggcgggaagaggccgcgctgcgtcgcgagtttgaagccgagcaggccgtggcggagcggcagcgtgcctggcgcatcgcccggggcgaagccacaccggccgacctggccggcccggcgccgggcgcggctggtccggcgcgcgaggcctggatgacggagctgccacccgagcggtcggccagcgcgacagtagccgcggtggcgcctggctccacccaccgcggcttctcgcagtccgggatcaagccccggggggacacctccggctggaccctgacgccgcagcagcgggctctgcagctggagggcggcggcgcggccggcggcggcacgctgctgggccctgcctcagggggcggggcggcggccgtcaccgcctcggcggtcgacgcctacaatgccgcgaccaggaagcgcagcctggtggagcagcacgccgagcggctggccgccgcgaccaagaagaaagggaagaagaagacgagggacggagccccagccccggcccaggcgcccgcggactgggaccctgccacccagccctggcggccctttgaccgcgaaaaagacctcgtgggtgggcgcggggacgtgcagtctgcccagcagcgcatcgcggccctgcccgccctttcctcccgcttcggcggcgccggggggggcaggggtgcgggcagcggcgcccgcaccttcctctga

SEQ ID NO: 7641 - DNA, 903 bp, Chlorella protothecoides
atgcctcaaaatcatcgacaggagaagaagacgaaggagaagaaagagaagaagcgcaagtatctgggggactcgagctgcccctcatgccgccatattgcaactgcgcagcaggttgaggaggctcagtcagtggtgccagaggtagcctcgccagtggtagagccgcccaagaagaagaagcggaaggcgagcgaagccgagacgtctgctgctccggtacctgcagaatctgcaccagctgtcaagaagaagagcaaggccaaagctgcggaagcggctgcctctccggtaccagtgaccaagcctgcagcaccagcagccgtctctcaggagaaggaggagaagaagaagaagaagaagaagaaggcggaggcggaggcgtctgcggccatggagaaggctgcgcctgtggaaaccgttggagcccctgtgaccgaggagaagaggaagaagaagaagaagggtgcaagtgtggaggacagccctgccgggactgccttgccggcagctggtatggcggaggagcctgagcccctcgctccggggtctagcacccgccaaggcattgaggagatgcaggcggtggaggaggctgcgccacgccaaggcaccgctgccaaggccttccagagggtgaaggcggaggagtggattgacaagcgaggatcgtgggacaactcctacgtcggcacttttggcgaacaaggctggggcttcaaggcgcagcaaatcctcggacaggtgggaagaagggatggcgtgcggcagtgggctcaggggaaagtacgtggcaaggacttccgtcatgagaagacgaagaagaagcggggctcatacaagggagggctcattgactcccacaccgtgagcagctacaagtttgacagcgatggcgagtaa

SEQ ID NO: 7642 - DNA, 645 bp, Chlorella protothecoides
atggcagggcacaggcacggcggccaccgcacaccacgcatcttcccccctccccttggccccaagtctgcaggtgtctcaccctggccccctcccttccccacccctcaatcgaaggcccgcgagtcgctggatcgggcgctggacttccgcggcaacgtgctgctggcgggcgtgaccacctgctgcgtgggctgcgcggcctggcagaagaactgccacctccgcccccgcctggccctgggcatgacctcggtgtccgtcacctttgtcatcctaccctgggccttctcaggcttctccgacaccatcggcgtcgcaggtgtggggccctggccacgtgtcgccgttcccatgccggtgcgatcatccatcggtggccgtgcaggcccctccggatcaaacccacccaccaacatgccccatcgcccaggcacggcgctgcaggtggccaccgaggcgctggcggtgagctactccaccctggccctgctggtgcagatccaggcggtgctgagggccaatgccttcctggtggagtatgccgccgccgtgccggagctgctccccctgttccggccgcccaccgccggggtgctggcccacctgcatgccctgtttcttcgcacgccgtgggaggggtga

SEQ ID NO: 7643 - DNA, 507 bp, Chlorella protothecoides
atgatcttcctcacgctcctggctcccttcttcgctccttacatcctgggatggcctgccctcgccactctcgtcacgctggcagccgatctcggcatcaccttgggtctaggggtggcggcgggtaacccgggcctcccggattacctgtccctgtccctgaccatcaccctggtgggagcgtggctgggcctgaccctggccaccgccctgtggcgcaacctggagtcctccttcgacaggatgccctggctgcgccacacccaggagctgcagtcccgcaaggggggcaggacataccagaccaagtgccccttcaccggtgcgcccagggatggttggcgtggtgtgtggtgcatagaggactcaccggggcagcatgcagtcgtggcaaggccacgggcggggacgggagaggcccgcacaaccaggctgagcaccatgcctcgctttccacctacacacctcctcccgccaaccccttcccccaatctctcacacgcgtga

SEQ ID NO: 7644 - DNA, 723 bp, Chlorella protothecoides
atgacgacttcttctccaccagcaaaacgtcagctcacactgcgcaaggcctgcgctgggcctcgcacatctggcgagaccgaacgccagacccaatatgctattttcaatgagcacaagatccaggagctccatggccttgccgatggctacgtccaggcctggacggcgcggtgcagtgccctctcgatgacgggggacagggcgccggtgcgaccaggcaccaccatgaaacccgatccagaggcgcatgagcaacatttggacaccgctgagatgctggataccgctggtgtgtattgtcgcgcccccactggcttctcgcgcacacatgagaggctcttggcttgggcatctggcatgatgttcttcgtccgagaatgtggcctgaaatggacgccagcggtacagagtgatgtgctcacccgccatcccctcaatgcaggtttcaggtacgtcgaggcttgtcagcgctgtctggaccaagccattcccaagaaccaggtcctggacaggcactcgattgagcacctggtcctcgtgctacggtgtgacggcctgcacggctctcgcgccgtgtcagcgggtgctgccagggtcctggcctcggccgccctcgcctttcccccagccaacctgtgttggcacacccagggcccccattcggggcagccctttgtagccgtctcagatgctggggtctggtcccccgtgggattgtga

SEQ ID NO: 7645 - DNA, 1059 bp, Chlorella protothecoides
ggcgtggcccggggccgggcccccccccgcgccgcccacgcccctgccgcccccgctcgccgccaggctggaggggctggaggtgacgctggggccggacctgcgggcggtggtgccggtggtgatgaatgtgggcgtggaggggcgtctggtgctggacgctggcgccggcggcgacccgcgcctgcgcgcgcgcggccgcctgagcctgcccggcggcgacctcaacctggtggccacccagctgagcctggatcgggagcacgccaacgcgctgggtctgtggtttggaggagggcagcgaggggactgcgccggggagtcggcgggggccgggcagggaagaccgctcggaccaggcgccggttacctcgccgcctggggacggtgggggtcacccgcggacgcccggcgagcgcggagtggggagggagtgcaggaggcgggccgtgcgacggcctgcgcctgctgaaaccccggaacctcccgcgcgacgcccgtccccgtgaacccacaccacctcacgatgcaccgcaccgccgcgtgctctctcgctcgcagggcccggcgcgcgagtggcaggagcacatgacgctgcagcacgtgagcggcgagggcgcgggcgccctggacgtggccgacgcggcgcgcatcttcgaggaccggctcaagtcggcgctgctggcggacgacgggcgcctggcgctgagccggctggcaggcagcacggtggcagggctcatgccccgtatcgagagctccggccaggtggggggggccacctggcgcctcgtgtcggcgccctccatcccaggcaggcggggaattagggacggcaaggggggggttggggagcgggacaagcgctggcatgctggggtggcggcatgctggggtggcggatcacctgggcaggcggacgtgctgggggcgggtcgagcagagaagaagccgtgcgcggcgtgtacggcaggggccgggggtggagagggtcgtgacatccaggagagggtggcgggcggcgctgcccacccggggcccgtcgctcccgggggctga

SEQ ID NO: 7646 - DNA, 558 bp, Chlorella protothecoides
atgtcaggttgcggtgcctatctccgtcggctgaccactggcctggccgggtgtgcgttacgccggggcgagccaatcgtcgctgcagtgcccagttggagcgcctccccttccccgctgtgtgttgcacctcagccacggtggcgcgcctgctatgcgactgccgcgcccacgctgaatcctctggatcaggtggcgatcccagagccggagaccacgccacaaggctcgcagcagtacaagaagaagaagaaggacccgcgcttcaagttccaggagaagggtgtcttcggggagaacctgtacaccaagggcttcagcgagaacctgcacatatccccccacaagctcaacgacatggtcaaggtgctgcgcggccagagcatccacgatgccatcatccagtgccaggtgcgggctgcctggatgccagaggcccatgcctgggtgcaggcgtggagggtgctagggctgtgcgtgcagcgcccagctggtgaagggggggagatgctttgggctcaaagggatgcacagggcctccaaggtcaggcaatgtaa

SEQ ID NO: 7647 - DNA, 360 bp, Chlorella protothecoides
atgttcaagaagctgcgatcctccttcaccggtggatctaaatccagctccaaagtacgcctggatgtgaccgtcgtgtccgcggccggactgccgggccccacgtcctgtcgggtggtgtgggctcggcagagcaaggtgcaggtcacgcgacaggctagtgtcggggagacaggcaccgcgagctggaatgaggagctcagccagatcgcgaccatggagcgggacgccaagggcgcttacctccccaaggtattgcccgggcgggcagcgaggctgcacttggggcgggagcgtggggtgggtacgagtgtgggagacgcagccgacgcagtgccaagagactgggttgcttggtag

SEQ ID NO: 7648 - DNA, 645 bp, Chlorella protothecoides
atggcgccagccgtggacgtcctgctgtgcgagaccatgtcctccgccgacgaggccgcggcggcggcctcggccgcggcggccacggggaagccggtgtggataagctggactctgcaggacgccagcgatggggagccacgcctgcgctcgggggagagcctgcaggtgcggcgctggctggggagtttggctgcctcatcgcctggccagggcggagggcaaggcttccccgccgcctgggacagggtgaaggacatcccttgcctccaggccatcctgattaactgcagcagcccgggcacggtgggcgcagcggtgccctgcctgcgacggctggccccggccggcgtgcgggttggcggctacgccaacggcttccgccagaccaccggcgagtggctggagggtcgggggaaggccgacatcaatgatgtcggggactatgacgaggtgggcgacctgctgccaggcgcatatgctgcgcatgctgcgtcctgggtccgggcgggagcaggcgtcgtgggcgggtgctgtggcgtggggccggcccacatcgaatctgtgtcggcgctgctgcaaagagagggaggagcgctcgagtatgacagctgcagtgctgagcggcgagtgccaccgccgtag

SEQ ID NO: 7649 - DNA, 378 bp, Chlorella protothecoides
atggcctccggcaccgctgactcggtgctcctcctggatggcggcatggggcatctgctcaagtctcaggacatagcccgcttcgcccccgatctaccggttgagcggcagtttgctgcagccgcgctggccaacgctgccgctcccgacctgatcgttggcctgcatgaggtatacatcgcagccgggtgccacgtcatcaccagcaacaccttcggggctggtgcggcggagaggaccgctgagctggcagcggccggcgccatgctggcgaggagagccgccgacgcagcgccgcggccggtcgtggtcgcaggtgcgaggcgcagacgggcgaggtggcgcagtgtgcgtgggagctggcctttgagcgggtga

SEQ ID NO: 7650 - DNA, 2280 bp, Chlorella protothecoides
  modified_base (2124)..(2133): a, c, t, g, unknown or other
atgagaacctcgtctccgtgctggtgggcgtttcgaggtgaggagcaagaccgtgagtcgtgtcggggtcaggtgttaacactgaacatcaccattcggggctcagccgaaccacggcacgtccctgctctcaccatgcagagaggagctccagcagcccgtttttgcagccatcggaaacctcgagcatcaaagatttctcgctcagggtgggtaaacaatgggtctgtgcacccccatagatcacacatggccggtgaagggcactttaagtgtcagagggcaggcatgctgaggccggtggagtggcgggcaggtgctgtgacggacctccataagcccgatggacagcggctgcggcggaacttgtcggccatcatcaactttgccaaattccgtgaggagaagctcatcgcctatgcggagctgcaggtcagttgcgggggcgtggtcaaggcgatgtggggacgtggagactgcggcatgtgtccatgttgccattgggggggactgctccttggctgcctgccaaatctcatgcctacctggacgaggcagagggcaccaatgccgacctgcatgccgcactggacgagctcaggaggacggccgcgcatgagcagccggtgcgttgattggggtcaccgccgagcgcctgctgccagaggctcgccgctcattgccgcccagtcatatccgtgcaatgaccgggatgtggagcgcctgacggccgcggccgaggcggtgtactccgagaatgcggcgctgaaccggcagcaggcggcgttgagctctgaggtgaaggcgctgaagcagggcgccaacgcgctgacggacgaggcagcggggctgcgcctgcgcctcgcctcggcgcggggcgaggaggagctgctgcgcggccaggtggtgcagagcccgcagaaggcggcggccgcgctggaggccctggccgccgcgctggagcgagagcgggatgccgtgtcggaggcggagcggcggcagcgcgacaccgccgcccgcaccgacgccgtgcaccgcgtggagaaggaggtgagcaaggcgctggcgctgatggagggtgcggagctggagatcgggcgcaagaaggaggtgtcgcgcgaggtcaagcgcctgcgcgccgagctggcggccggcgagcacgaggcggcgcagctgagcgccacgctggacctgctcaagcgccagacggcggtggtggaggagaggggggggattgactggcgccagcttcgcggcagcttccacgggtcggggtgcaccgctctgggtgccggcacccggtgctggcgatggggacgccgcccgttccactcacacacgcacaaaagcaactgtcgccccacacctctcccccgcagtgcgcggtgcggaaggaggcagcagaggggaacatcgaggagcagctgcgcgacaaggaggcctacgaggccgagaacgccgccaacgcggccaagctcgccgagaacgaggccacgatccacggcctggactgtcatcatgggtggaggggggtgcaatcgaggcctgcaccccagtaggcagggagcgcgcggattgccaagggcttctctcgcccttttagcacgcacgccgacatgtcgtggtgccgcttgtcgccctggggcagggagcgagcggattgccgagggcttctctcgcccttttggcacgcccgccgacatgtcgtggtgcagcttgtcgccctggggtgcagcgccaggcgcggcgtgccgcaccaccccaatcccacactcacctctttttttcttgctccgcacagatccggacgctgcgggagcggctgcgggaggtgaggcaggcccacgaggctcagcgtgcccaggtcctcacccagtatgcaggccttctggaggaggtgggacatgctggcgggggggagggtcggcagtggcaggctcttgggtgggaggcacttttcgtacggacctaccatggggagctcacctccgccatggagggcagaggacctggcaggagggaggtgacggagcacaccgccctcctgattcgatgatggacatgaccaaagttggccagggggttgtgtgccgacgcccaggtatctatgagcgcttgaacacnnnnnnnnnnggagcacaccgccctcctgattcgatgatgtgcatgaccaaagttggccagggggttgtaggccgacgcccagggcgcacgcttactcctgtgagggatagaacctcatggtgctttccatctgacacgctgctgccagcggcttga

SEQ ID NO: 7651 - DNA, 2124 bp, Chlorella protothecoides
  modified_base (368)..(377): a, c, t, g, unknown or other
  modified_base (659)..(668): a, c, t, g, unknown or other
  modified_base (851)..(860): a, c, t, g, unknown or other
  modified_base (931)..(940): a, c, t, g, unknown or other
  modified_base (1190)..(1217): a, c, t, g, unknown or other
atggcatatctcccgctccgaaagcaggggaaaggagaactgcgacatacgggagtgagccacccggcaagcgactcgagactgtacaggatatgctcaggacttgagtcgtatagttttgcgctccctcgcatatcgtgggctgctcccgcgacttgtcctgcccaaggagcacaggcggatattggagcagctggcgcgcccttcaaatctcctcgcgccctttcctcagcctcctcgggcctgagccgaggcgcacagcgtgcgacaaagtggactcagcgacgacaagacaaggttgaagggttgcaacaaaggctagtagtgcatatgattgccattgggcgcaagcggatccgacagggccnnnnnnnnnncatgattgccattgggcgcaagcggatccgacagggcctacccccgccctccagcggcagcaacgcaataccccaggcccggacgggcgtcctgaagggatatgatttggaacctgcccctaaattggaggctcccgcacaagacaggggccgtgcgctccatggacacgccgtccctcgccacccagaaagagggtcgcatgcgcagactgtgcgcagcaacaagcccgaaggcaggcacgaacgcctcaggacgtcagctcgatcagtccgggaacctcnnnnnnnnnngtatgatttggaacctgcccctgaatcggaggctcccgcacaagacaggggacgtgcactccatggacacgccgtccctcgccaaccagaaagagggtcgcatgcgcagactgtgcgcagcgccaagcccgaaggcaggcgcgaacgcctcgggacgtcagctcgatcagtccgggaacctcnnnnnnnnnntggtggtgtggtgcggggagttgcagagggagaccgacctgcaggcctgcgactgtcctcatgcatggtgnnnnnnnnnnaggatgaggcccccggggctgggtctcccggtccccgagacgcctcacccgagctccgtgccaggccaagcaagcaggatgtttgggagcgccctgcgccggcaggccagatgcgagccgcctccaagaaggccggcgagcgagaggcgacgccagctggaccccagagcatccaggccatgacacggtgtttggcgacacagtcaagtgggcctgctttcccgccccgctccactagcacgctcacccnnnnnnnnnnnnnnnnnnnnnnnnnnnntgtgatggtggcccccgtagactctgaggactctgacgccgaggcccaggccggcccggggtcaatcctcgatgccctggtctccaacctcgccgcgcgcgacgcggcgctggaggaggagctgggcgccgccgccgccgccgccgccacagcgccgggcgcagccgggtggtcggaggatgagggggccacgtcgtccgacgacgagctgtacaccaacctgcgagccgcggctggggtcggcgcccccgggcagagcaagcggcccaagcggccgaaagtgaagcaggcctcccgcgaggaaagcgcgggggcaggcctacgccccggggagctggccagggcggcggtggcgaggaccaggcctgggaggccctgcgtgggcgtggggcaggcagatgccgagccggcagatggctttgcagggctgggcctggccccggagctggcgcagcacctggggagcctgggcttcgcggtgcccacgccggtgcaggcggcctgcatcccagcgctgctgcgaggtgactgcaccctgggtctgcagggagcagggagccatgtgccctgcccagcccaaggagtgcccgacgggctggcacacgcagtggaccggcccattcctgcggttctagagctttccctcccagactctgtcctcgggccacaccaaaccgtgcaggacggccaggatgtcctcgccaacgctcccacggggtcggggaagaccctggcctacctggcgcccatcgtgtctgagctggcacgtcgcgcgcagcgcgtgaccagggagcagggcaccctggccctggtggtctgccccacgagggaattggccctgcaggtgctggagagggggattagggagcagcggaccctggggtggattgccggggatgagctatga

SEQ ID NO: 7652 - DNA, 399 bp, Chlorella protothecoides
  modified_base (65)..(74): a, c, t, g, unknown or other
atgggtttgggaggggtggggagggtgtggcagcaagggtacgggaggcatggtggagaggtaannnnnnnnnngcgggtgggtgttggagggcatgggtttggaagggggtgggagggtgtggcagccaggttacgggagggatggtggagaggtagggggggtgggggtgggggggggcctggcactgtagattcgcaagagcatgcgcacgtggcaggtaggtgctcggcacctaccctctccaacctggtgtcggcccttgcgcacctggcgagcagcgtcttccctgtgccggggggtccgcacagcagcacgccgcgcggcaccttggccccggaggccttgaatcgcgcgggcctcgtgaagaagtccaccacctcctgcagctcaaactga

SEQ ID NO: 7653 - DNA, 525 bp, Chlorella protothecoides
atgcagggcgagtcgcagctggcggacgaggaggcgtatcgccagaagctggccgccgacgtgaagagcgaggaccccaatgctcaggctgaggagatgctgaagatgaagacagtgcgcatcaagcgtgccatgtcagtgggtgggggaaggggaggatggttgagtgaagcagcagcacggatggtgaggttccattcctcgttcagcaggatcttgggtgtggagggcctgggcatcattgccgcatccctcggaacacgtgtgcgggtgccgctctatgagccacccccaaacctgcagcggggtcgtcgatgtttgatcgatcatgcctggacctgcagggaccccgagcgccagcgccgcatccgggaggcgcagcgccagcttcgtggcgtgaagctgcagtactctgacgaggagaccatcttcttcgacgatgtggcagggatcggggatgccaaggtttacaggtcctgcaccttcaatccgacgagcagccacatcatcccagccgccacctga

SEQ ID NO: 7654 - DNA, 300 bp, Chlorella protothecoides
atgtggcccttcaagggcgagaagcccctgacagaggaacagcaggctcgattgcgacccgtagttgcggttcgacgacgacatggaagcgtcagccccgtcgcccctccaacccccacccaggtcgtacactgttacgcggaggtactggaccccgccctggccgctgcgcacgaggattgtttcaccaaagcggtgaatagccggcgcgacccgccctacaccgcctgccagggccaggcccaggccatgcgcagcgcgctggccaagcgcaagctctacccctttgccgaccgatga

SEQ ID NO: 7655 - DNA, 459 bp, Chlorella protothecoides
atgcgctcaccgcgcggcgtgctgctctgcacagacgtcgcggcccgcgggctggacttccccggcgtcaccgccacgctgcaggtggaccccccgggcgacgcaggcgagtatccgggcgaggctgggtacgttggccgcctggcggagcgcggcgtgcgcctggcggcgctggacgccacgcgcctgctggacggcgcgctgggcctcgaccggcgcgcggggaagctggcgcgggacgagcggggcctgcccctggagcggcaccagggcgcctacgcgctgcagcggcggctgatgggcgtggtggcggccgacgcggcgctcaccgcgctggccgccgcggccttcaggtcctgggtgcgcgcctatgccgcgcatcccgccgccgtcaaggacatcttccacgtcaagcggctgcacctggggcatgtcgcccacagcttcgcgcttacgtga

SEQ ID NO: 7656 - DNA, 819 bp, Chlorella protothecoides
atggctgcagccctcatcaggcgcaccatatcccttcaaacctcgctccggcatgtctcatcacttaatgtaggctgtgcgccccagccggttcggctggcggccttctcagcagtagccgaggctgccgctcctggaagggtattcggggcctgcgtcttcgagaggctcccgttggtggtacccccgcaccccgattgggaagtggagcacagcaggtggcgctttgagtggaacctgccctatttcaagaagtaccctgccgacttcatcgacgagccccgcacggaggagaccgactcggcggtggcggccagcaaccggtgggggcccgcccccctggagtccgaggcggaccgcagcggcgacgtgcgcagcctgaagcgacggctggaccagcgggtgttcatgctggtgcgaagaaaaggtggcagcggcgcatgggagttccccgcggtgcaacacgaggagcattgcttgtgcagcccctggcgccgtcccgcatggacactcctcaggccaggctcgccatccccaccctctcgacagggcgagaccattcgcgggagtgcggaacgggcgctgggcctgacgctcgtgcgggaaggcctccagcccttcttcgtgggcaacgcccccgcgggacatgtcgagacaggtgagggcaccacctttttccaccgctgccagatgatcgcgggcacggtgcggctcgtccctggcggtccctactccgacctgcgctgggctgccaaggatgagctgccggagttcgtgcaggaccaggccctcctggacctgttccagaagatgctatag

SEQ ID NO: 7657 - DNA, 477 bp, Chlorella protothecoides
atgggccaactctggggcaaggggtggtgcaagcgggggcggcatgcatttccccaagggtgcagagtgagcgcatgtgaccggaacgatgtggtgtgtggcagagttggtgatggcaatgcacaatgtgctacatcattcgctggcatcaagaacgtgccacggcgcctgcgcatcgtcgtgcagcgaaagcgcaacgaggacgatgatgacaaggtgggtgaccgtgtggggcgggaggcaaaggtgcggcatggacggcgcttcgcctttctgctgaccgcaggcctcaaggcacgctctcctccctccctcatggacactgcaggagcagctgtactcttttgtcaccctggccgacgaccagaacaccaagggcaagggcaccgtcctcctggatgcctgatcttgccgccttcgccgtgctttccttctgggtgcccggcctgtaattcgttcgcacaagggtgcacctga

SEQ ID NO: 7658 - DNA, 1080 bp, Chlorella protothecoides
  modified_base (432)..(441): a, c, t, g, unknown or other
atggatgtgactagtcctcgtggtcacctgcatgtttgcactgcgaaggggcatgggcagagctacagcagccatggtgaagttcttgaaggtgcgtgggaggcggttaagggcgcggacggccctggagcacctggcgactgggcccccggcgccggagggtgcaggtccccgtgtcggggaggatgcaggatgcgccgttccgggaaggtggtgatccttctgaccgggcggcacgccgggaagaaggctgtcatcgtcaagaacttcgatgacggtgcgtccagccgcccctacggccacgccctcgtgctgggcctcagcaaggagccgcgcaaggtgcgtaatcggggaagcagggcgggggggcctggggaggaggagggcttctcagatgtctggcctcctgcactgagctgtttgtgcatctcnnnnnnnnnncccctacggccacgccctcgtgctgggcctgagcaaagagccgcgcaaggtgcgcaatcggggaagcagggcgggacgggctggggaggaggagggcttctcggatggctggccccttgcaatgagctggttcctgggctggccacccacccatgggctccaatggttgtgcgctgtaatgcaaggagagccgggaaacttgtggtttgtgaatcttcaggacctgcaaatgcctggcccgaatcccccccgctttctctgctcctcgcaggtgaccaagaagagctccctcaaggtccaggcccggcgctccagcctgaagaccttcatcaaggccgtgaactacacccacctcatgcccacccgctacacgctggacctggagctcaagggcgtggtcagcaacgaggcgctggagaactccaccaagcgcaaggaggccaacaaggccgccaaggccctgctggaggagaagttcaagaccgggaagaacaggtggttcttcaccaagctgcgcttctgagcccccggacccgcgctggtcgcccctgtaacgcactcagtccaggaaaggggggggtggtcgagggggtagaccgcacacctcgtcgcatcggggtgcggggagtggcagcgtga

SEQ ID NO: 7659 - DNA, 1131 bp, Chlorella protothecoides
atgctgccctcttgcggggtggggcagaggcacgctgtccttctcccgcagggccctccccatgccagcatcaccctctgtcgaggagtacatcccagaccgcacctcccgtcctgcgctggagtagggtacgatgggaacagacacagcttccggcctggacccccacctcggcccaaccgtgccagcgtggcacggccagctggtgacccggatgtcgtgtccaccgctcccgcccccccctcgaaggggggcctggcccagcgggtcatctccggatccctgctggcttcactggccctcgtcatgatcggtgccgggggctggcccttcgcgagcctcgcctgcctggctgcctggcagtgctccagggagtacgtgggcctgctgcaggcctccggcatggcttccggtatggaaccccccagcaagctgacgtccagcacagtgaccctcttctgcgtcgccctgaacgtctggaccgcggcgtcccgagggagaggcagcacgcccctcgccgttgctgccttctgcctcatgttcatgcagctcgtggatgctcacaagccgcgcttcgcccagctggcgtccaccgtgtttggtctgatatactgtggtgaggagggaggaccatgtttgtcggtgcggagggagaggcgaggggcggtgacagggcaggcgtgccatggcacccgccagctcctgaccgccgtccgccccggcgcatggctgcgcgtgccgcgcaccgcgcgcctggatcggtctgatccccctggatccaactgtgcgcctgacgcatgcgtgtggtcctcagcctgtcaaggctgtcaccgaccaagaggtcttcctgatcctcggccctgcagggtacctgcccagcttctggctgaggctccggatgctggacgtgccggcaatcaactcgcagcttctgcacggctggccggtgggtcacatgtggatggaggtcgtgactgggtggggaggacctcgcatcgctctggggtgtctgatctcagcgagagggctaccctgagccatggttgctggctgcccgtgccacagtccctcccacccgtgcctgctcggtatggtgatcccccacagggcaaccccgtatctcctgcctga

SEQ ID NO: 7660 - DNA, 705 bp, Chlorella protothecoides
atggtccggcacacaaccaaggaaacgccgctccactcctgctgcgcatgctggggtcgccccttccagcaggaaacccaaacccacggcccggctgctcccaccagttttgatggagggattgtacggcagccaaaccatacgattcgaccttggatattctgcccggggccagtacgcctgacctcacagctccgcgacacagagagactccgacgggccatgtcggccgctgccttcttcaggtcggcaccctgccagcggaccgggggcgagccctcctgcagctatgctccctctcctcagcgagcatcgcatcgccgctccgctgcacgtccccgccctgccctgcgcgcccgggcttccgcgggcggcctgtcttacaaggacgccggggtggacatcgatgcagggaacgagctagtccgccgcatccagaagctcaaccccaacatcgggggcttcagcggcatggtgcccttcggtgactccttcctcgtggcgggaaccgacggggtggggaccaagctcaagctggcctttgacgtgggcaagcatgacactgtgggcatcgacctggttgccatgagcgtgaatgacatcatcacctcgggtgccaagcccatgttcttcctggactactttgcgacggggaagctggatgtggacaccgctgagcaggtggatggaggggtgaatctgtga

SEQ ID NO: 7661 - DNA, 2706 bp, Chlorella protothecoides
  modified_base (1073)..(1144): a, c, t, g, unknown or other
atggccagccagcgccatgtgtcatcgcacgactcggtggaagctttgcaccccttgggccatgatctggtgcgcaacgtgcaatggagcatgcaggtctcaagagcacgattcctgcatcaccaaggctgcaccgccgcaccctccgaaatcagcatgagcttacagatactgcacggcgactgcacccacctaacaaccccatctccggccttcattacgtcctcacctccacgccataggtcccaggattctgcaggggaagatcctgcgccttgcagccctccacaccatcctcgacccagactcgggatccgatggtgtgaacccccgcctggggcgcaatactgctattttttgtcatgccggagtcagggcatgtgggagccaggcgacgaggtcccctcgcaaccgaacacggctggtcgggggaaatctggcaggtgtcaacggggccttgcagggatgcttgcccctgagatttttgctgttgtgtcacgcaaggtcgggggtgtgggtagaaggcgccactcgggcccagctggtgtgcaggcgaaggtggttcggcacccgcgtctcgggctcgtgctgtgcgatctgttcaaatcccctcgatccagtgacaacagccaggggcgggcggagggtacggacgtcctcaggcagtcgacgagagtttggaatcggcattttgaccttaaagagggcacttgccaagtacatggcccggcggtaggggcgacggttgtcgggatgcaggccgaggagcgcttcgcacacttgctgcagcccatccgggacctggctgccaactggaatgtgaagatcgccaccgagctagacgaatacctggatgccttggagaacatcgccttcaccttcgaaggaggttcatctctgaactttgctgaagtagtgggccacctggagtccacagattctcctacaatagcagcctcctctcctgcctttcccttgatcagctgcgctggtcattcagggttcagcatgtgtgtacagcaaaaaggtcgagtatctccacaccctggtgttccaggcattagagtacctgnnnnnnnnnnnnnnnnnnnnnnnnnnnnnnnnnnnnnnnnnnnnnnnnnnnnnnnnnnnnnnnnnnnnnnnnggctgtcttctgtagctgctgctgtggagggcaagaatggcgccaagaaaagggcaggcacggccaagaatgacgacgatgacgatagtgacatagaggaggatgaagccttcctgtccctggatgatctggaggagggcaagaacctcgatctggatgaaggcgctggggacaaaggcactgtagcccccttgcgacccccagccacgctgctggcgctaacgggaatcccccagaaggagggggatgccgctgggtttagggtccacagctgcgcggtgcatgtgtctggagctctgctgctggaaagcgcggacggcatgcacctggacgccggcctgcagccgactgacgcgacacggggtgttcccggggacgagtttggccgaccacgggaggatgcgagtgggtatgggcagcccgatgctggaggggtcccgacagcagacaacccactggaggacgactggggagggcaggagtatggcggcgactacatggatgacgatgatgaccgcggcgatctggacggcgggtacggcggatccccaggagagccggatgctcggctgggggtggccagtgctgcaatggcggcgtcaggaaagcggagcggcgagctgagctgcaacccagcagcctgtgactcagaggaggagagcgaggacgtctacgacccatatacacccctggatcccaacgattcgggaccagtggcgcccaagcccctgcgcaaagcgctgcgggtgaggtgctggtcgtgggcggcagctggtggcaggcctgtggccagctctgctcagcggcctggtacccaacaagccacggaatcagcggccggcacagccgttccagacactgcaggaggcaattcacagggccgttccgcccgatgggctgttcttccgggagtttgcctatggactcccaaaacaggccaggacgatagaccgggtagggctgatggacagggtggggagtgtgtgattactggggtggtggtatccaaaatttgcactacgaggaaccacagaattcaggagccaatgtccagctttgagcttggaagtggtgtggagaccctttgagagccaccgttgcatcctcgcggccccaccatggtttgcaggctgccttcgaccaagaggatgacggtgctgacttggcgggggtacaggatgccgacgaatttgacgatgccaaggacgactgtgcgtgcggttggcagaggggagggaaagggtctcacgctgcagcaagacagacgtccccaccagcccatcaggcgatgcgatgtgcaggatgaaagggtagagtttcgggaactaccctgctccattgcctccgcacagacaccctggctcaccctactcccctaccaccctgcagacgatggcgggtacgatggcgggtttgaggccgacgactatgaaaatgtgccgatccctttggcggatggactggacggcgatgacctcctggtttcggcggcagctgccgaggggtggagggaccccaccctcacaagcacagcctttcagactggcatcgacggtgagtga

SEQ ID NO: 7662 - DNA, 672 bp, Chlorella protothecoides
atgcgcacctcctgcagccactggaagagcgcgggcacctcccaggagccgcggctgacccgggcccttgggcaccacccgtgggatgttttccgggaacccgcccccggtcatgtgtaccaggccctgcgcatgggttttcgggggcatgcaagtattggtcacctggtccggatgactggaggcagtgccgcccagcacgcccttgctcacattgcggctgaccttgacgtcgacggcctccgtcagcctgagcacgtcgcggacgtagatggtggtgggggtgagcagcgagcgccccacgctgtcgtcggaccagggcgcggcgtcgcccaggccggtgccgctgacctccagcacctttcgcaccaggctgaagccgttggagtggacgccggaggagggcaaggccagcacggcgtcgccggcggcgatgcgcttgccgtcgatcacccgcgactgcagcacggagcccaccgcgaagccggcgaggtcgtactcgccggggctgtagaagcccggcatctccgccgtctgtgggaggcgggaagattggtgaggccgagggaagggggagggagcagggagcagggcgctgcgcagagcagggaggcagctgatggcaggtgcacgctgagctcatgcatgtccagctaccgtgcgccccagtag

SEQ ID NO: 7663 - DNA, 648 bp, Chlorella protothecoides
atggggggttaccgcgcagagtcagcgcccaccaacggcagcacccgcagcgtggagcagcaggtgctggagtccaacccgctgctggaggcgtttggcaacgccaagacctcacgcaacgacaactcctcccgcttcggaaagttcaccgagatccagttcggccgcgacggccgcatcacaggcgccgcgatccggacctacctgctggagcggtcgcgtgtggtggcggtggcgtcccccgagcgcaactaccacgtcttctaccagctgtgcgggggcgcggacgaggcggaggccgcgcgcctgcgcctgggccccgcgcgcgggttccgctacctgaaccagagcgactgccacgagctggcgggggtgagcgacgcggaggagtaccgccgcacgcgccgcgccatgacgctggtgggcatcgacgccgcctcccaggacgccgtcttcgcggtggtggcggccgtgctgcacctgggcaacgtcgcgttcgtccccggcgacggcggcgacggcagcgccgtggccgagccggcctgggcccacctggaggctgccgcggcgctgctgggcgtggatgccgcgggcctggcccgtgcactcaccacccgcacccgccagacccccgacggtgtgtggtag

SEQ ID NO: 7664 - DNA, 402 bp, Chlorella protothecoides
atgactttcgacgatctcctgaaggctcacatcagccgcatgatcgccgcggcggccgccgcccaggtccagactgagctggccagcagggttggcgggtggcgctcacgcatcgggccggtgctggaggaggaggatgcccgccccgcctttgacatccacgtgtacggccagagggttctggatgccatgcaggggctcagcctgagggagccaggtgcggcgggagggcggctgtgggcccagagttcacgaatgcgcgcctcacctgtccccgcggctggggatgggacgggcgtggtgcacgtgtcctgtgtaggtggaaagcgtggcgcggggtatcatgtgcgagtgaaggacaacagacatgtccagcatggtcgtgagtggggttccgcatga

SEQ ID NO: 7665 - DNA, 762 bp, Chlorella protothecoides
atgacaaaaaatagcagtattgcgccccaggcgggggttcacaccatcggatcccgagtctgggtcgaggatggtgtggagggctgggtcaaggccaaggtggttgccctggggcccacggatatcaccgtggctctggaggacggcacctccaggacctgcaaggcgcaggatcttcccctgcagaatcctgggacctatggcgtggaggtgaggacgaatcgtgctcttgagacctgcatgctccattgcacgttgcgcaccagatcatggcccaaggggtgcaaagcttccaccgagtcgtgcgatgacacatggcgctggctggccatcagcgctctccagcaactcgccttttccctttcacacccccctcccccctcgacacccctccacttccaggacatgaccaccctgtcgtacctgaacgagccgggggtgctgtggaacctgcgcgtgcgctacgaccagaacgacatctacacctacacgggctccatcctgatcgcggtcaacccctttgcggccatgccccatctgtacggtgcccacatgatggaccagtaccgcggcgtcggcctgggcgagctgtccccgcacgtctacgccgtggccgactccgcctaccgccagatgcggcgggagggtcgaagtcagagcatcctggtgagagatgtagagtgtggggccggagggggaccggggcctgcgcttgacgggcgacggcggcgggatctgtgtcggacccccgcgcgcatgtga

SEQ ID NO: 7666 - DNA, 396 bp, Chlorella protothecoides
atggacggcggcatcgcctccgtggtggctggcctcgtggacgttcccgtggtgagtcttgatgtggcaatgtctcgctgctcgtgcattcgcgagaggaggagggatgctagccggcgatgggcggttcgtgttggcaacaccgccaacctcacacctcgtctcgcttctcatcatacatcgcaggtggcactccccaccagtgccgggtacggcaccgcctttggcggcgtgaccccgctgctggccgccctcaactccgcggccccgggcgtcaccgtggttaacatagactctgggtttggcgcggccatggccgcctggcgcatcctggtgaacgctgcgcgagtgcgcaacgccgtcatccaggcgcacgccgccgccggccccggatga

SEQ ID NO: 7667 - DNA, 894 bp, Chlorella protothecoides
  modified_base (778)..(787): a, c, t, g, unknown or other
atggagctgctgcagagcgtggccaccggggtcatgtccgccagcgacgccgccgtccagctcaacgcggtgacccgcccggcggcggccgctgcctccgagcacggcgacggtggtggcgaggcggggcccccccgcccgccgcccgccctggccctctccgcctgccccgaggtggtgtggggcgagggtaagacgcccaaccagctgctggccagcctgcagcgcatagcaggaaagcagggcatcgccgccgcgacgcgcgtcggccccgaggccgccgccgcggtgacgggcatggacgaccgcgtgctacacagcccggcggcgcacatgctgacgctgaagacggggcccgccaagaagctgccggggacggtagccctgatctgcgcggggacggcctcgccgcaggtggtggaggagtgccgcctggtgctccaggccatgggctgctatgctttcaagctgccggagtcgggcgtgatgggcatgcacagggggattggaaccatcagttggaagggggtcggacagtgggagaggaagatgcgtctcccatcatggagacggcgtttccaggccagagtagcgcagaacgggtggacaggggacggggggcgagcagtgataacggagcaggggtgggctacatctcggcctacttcacaccttccgctgtctgaagctgggatgcatgccttcagcactcagcaccatttaagtgcacacactctccaacaatccctatcctgcaggatcgtgcggaatctggatnnnnnnnnnnctgggatgcatgccttcagcactcagcaccctttaaagtgcacacactctccaacaagccctatcctgcaggatcgtgcggaacctggacgccgtgcaggctgctga

SEQ ID NO: 7668 - DNA, 543 bp, Chlorella protothecoides
  modified_base (455)..(464): a, c, t, g, unknown or other
atgcacatcgtacagactggccgatcaacactccaagctccacaagctcatcaatcctccctgtccctcccccaggccgccctggtggtgggctctgccctccagagcacgctcaccaaggccgacagctggctggaggggcggggcgtgctgggcaaggtggagcaggacactgcccgcgcctccctgaccccgaaagagcgcaaggtgctggagaagctgcaggcgctgcgcctggatgatcgccgggtcatcgcccgggagcacaagcgggagaaggaggggcgaggcgtgaaggcgccctggctcatcaagggctcctacgttttcctgtgctgggtgctggacatcctgtacgccaaccgccccatccaggtgtgtgttggggatggtgggaaggaggggatcagagggagggtccttcgtttggggcaaggaggggctggagggctggnnnnnnnnnnggggaggaagggatcagagggaggggtcttttgtttggggcaaggaggggctggagggctgggctcacgcctggcctaa

SEQ ID NO: 7669 - DNA, 1617 bp, Chlorella protothecoides
  modified_base (55)..(64): a, c, t, g, unknown or other
  modified_base (892)..(901): a, c, t, g, unknown or other
  modified_base (1112)..(1121): a, c, t, g, unknown or other
atgtccgcagaggtccacccccaactgcatccacacacactcgagcagccagacnnnnnnnnnngagtgggactgagggctagagcgtcttgcatatccgcagaggcccacccctatctgcatccacacacactcgagcagccagaccccactcccctgattccagcgcttctgggtgctggaaacggtggcgcgcatgccatactttgcctacatctccatgctccacctctacgagtccctggggtggtggagggcgggggcggagctgcgcagggtgaggctcggttgatggtgtttggaggttgtggcagggtttggaaggtgtggattggtgcagcaatccactttgcagaggagtggaacgagctgcaccacctgcaaatcatggaaaccctgggtggcgaccacttgtggatcgatcggtgtgtatgggtgacatcggaaagggtgggacctcgggcattcaatgcccatgcagcgtgtagcaaatatgatgctagaatttgcctggagcgatgtgaccctgaatgcatcccccatcccccgaccacctctgcagtttcttcgccgagcacgccgctgttttctattactgggtcattatcctcatatttgagcatgaagtggttgggccctgtctgcaagaaaggtatccatgcaaggggccctcattctctgaactggccactggagttcctttcccttgcacacattccagaatcatgcggtggacacttactccgagttcctcgaggagaacaaggaggtcctgcagggcattcctccacccctagtggcagtcacgtactacaagtcggcttcattctccctcgtcgccatgccccatttccaggtgatctgtacctctttgacgccctgcacacggagnnnnnnnnnnattgccatgccccattcccaggtgacctgtacctctttgacgccctgcacacggagtgggagtcgggatccattcgacgcccagagtgcaatcaaggaggatttgatcatgttgggcccatcggatctatgatcaaggtgaggttccaacaccccgtaacacgctttccactccccctcctctgtagcaacctgtatgatgtgtttgtcannnnnnnnnnctgccgtcctgcaaatgtcacgacgcacggtcaggggggatttggtcatgttgggcccatcgtatctatgatcaaggtgaggttccaacaacccgtaacacgctttccactccccctcttctgtagcaacctgtatgatgtgtttgtcaacattcgggatgatgagttggagcacgtcgcgacgatgaaggcctgtgccgagaacaccatcaagcccaagatggatgtgagcggggaggcggagggggggggatggggaacaacaccaaagtggtgctgtcgatggggggaagatcgggcagggtcccaagggtctggaggaggccaaagaccaggtaacgaagctcggcaccagcaacgtgaacaacaaggaggcacaggaagtgatttaaaggaggaatgcagcgaaccagcgaacgcgctgatgagcagcacaggggtgattgatgcatgtattcgctcgacctccttatgccttgagcgtctgggcgcttga

SEQ ID NO: 7670 - DNA, 480 bp, Chlorella protothecoides
atggacaaggaagccgcgacagagctcctcctggacggcgcacgctatggggacgaagatgacgtcgcacacgctctggacgagggtgcagatgttgacgctcctggtcccacaggcagcacagccctccacatggcggctgcaaatgggcataccaacatcatcaagctccttgttaaagatggcgcgaatgtggcggcagcaaacagtgaagggaacactgccctgcactgggcggcgatgaatcatcaggtggatgcggttcggctcctcctcgaggccggcgcgtcgcccagcgccatcaacgggcgcgacgaaacccccgtggacgaggcactgcgaagagactacaacgacatcatggcgctgataaactcgttttctgcgccagggaccgatgtcacagacaccaagggggtggatgagtttgacgaggaagaggaagccaacgagccttcggcccctgccgcccaggaataa

SEQ ID NO: 7671 - DNA, 1572 bp, Chlorella protothecoides
  modified_base (413)..(422): a, c, t, g, unknown or other
  modified_base (903)..(912): a, c, t, g, unknown or other
  modified_base (1098)..(1107): a, c, t, g, unknown or other
atgaaagtgagaggtctgcagggtggcatccaaaacttgtcatgcccctcactgcgggcttcaccttgtctgcagagcactgcaatgctgagtgtatatcttgaagatcttgcgtggccgtgccccagagatcaaggctgtgtagtggttattgagcatgcactccaagtccttcctgttgtctgcccaacgggtgggggcgcgagatctgggcagggggatcctcaccttgtgctggattctgaatgtcgacggcaagactctcctgcgcgagctcggcgcagaggcccttccgtggaccgccagctccgtgccagggcggcatgcagcggcatgcttggcctatgcagcggcccatgggcgcctggtatcgagatggaacacctcgagcattacagggacttcccttcacnnnnnnnnnnggtcggcatggcaggcgtgccgtcggttcccgactcatgcgcgcctggcctgacactacagcattacagggatttcccttcatgcaggctgcggacgaaagctgatgatggcagctgcctactccagcgcacagacggaggcgctgaaggccagcatcgcggcggcctgctcccgcgcccaggaggaggcgcttgcctctgcgcagcgcgcatctcacgccagccagggcatcgacgaccggccccagttgcgcccgcagctcctgaccgccatcgaggcgctgcagcggggcctggtggagagggacacggaggtgcggctgctgctgctggccgcgctggcccaggagcacatcttgttcataggcccgccgggcacggccaagtcggagcttgggcgcaggctggcacagctgtaccgcggtgctttcttcgagcgcctgctcaccagcgagagggctcctgtgggttgggccgtcgnnnnnnnnnngcgcctgctcaccagggctcctgtgggttgggccatcaagggtttggcaactgcaccctggtgcctaggtgcatgccagggtggcatggctgggcggaggaggctgtgacatctccagcagttcctgcatccgggcatcggatttgcatgaatacccactctgtctgtgtccacgaccttctcaannnnnnnnnntggcatggctgggcggaggaggctgtgacacctccagcatttcctgcatccgggcatcggctctgcatgacatacccaccctgtctgagtccacgaccttctcaggacatcctcccgctaccatatccacctccagtgccggaggagctgtttgggccactctccatgaaggcgctggagcatgacgagtacaagcgcaagaccacggggtacctgccgagcgccagcgtggcgtttgtggatgagatcttcaaggcaaactccgccatcctgaactcgctgctcaccatcatcaacgagcgcctgtttgacaacggcagcgtgcgggagaaggtccccctacgatgcctgcgtgcgggagaaggttcccctacgatgcctggtgggttgacgagtctgaaaggggggaacgggctcctgattgtgtgccatgctgcaccggcagcatgctgggtttctttctag

SEQ ID NO: 7672 - DNA, 657 bp, Chlorella protothecoides
  modified_base (477)..(486): a, c, t, g, unknown or other
atgccctggtcttgcctggacgtggtgccggggagtgagacccctgctgcgccgccgctggccgccgctgctgtgcaggcctggctctggagggtacaagcaatgctcccccctcatgctcctccctcacacccctcatccccagacctgaagcccgagaactggctgctcaagcgctcggagagcagtgtgcatcctgagaacctgagggccgtggactttgggctgtccaccttccaccaccccaccgcgccgtgcacggagcgcgtgggcagctcctactacgtggccccggaggtgctgcaggtgcgcacatgggtgggtgtcaggaaggggcgggtgcagatcgcttgtgggcgcccctgccccgctgtcctcgttctgcaccaggcctgtctgcgatcgttggcgtggggtagccgcttgccgaggtcggcagtggtacgcccgctgcgacccgccagccccagccccgcnnnnnnnnnngccgctgtcctcgttctgctccaggcctgtctgcgatcgcgggcgtggggtggccacttgccaaggtcggcagtggtacccccgctgcgacccgccagccccagccccgctgcacagctgcagccttgtgcgttctggcgcacgcccttctgtcctgcagctgccgcttga

SEQ ID NO: 7673 - DNA, 2382 bp, Chlorella protothecoides
atggcctacgtcctgctctccggcttcccccccttctggggctcctccgaccccgtcatctaccaccgcatcctgcacgacgacctggactttggctacgagccctggcaggcggtcagtgccacggccaaggactttgtggcctccctgctccgccgcgacccggcgcggcgcgcgacgctggccgacgcgcgagcccacccctggatcgctgacgcccctgccctgccctccgccccgctcctgccggaggtgctggaccgcatcagcgccttcacgcgtcagacccgcctgcacaagctgctgctgacggtggcggcgcggcacctgggcggcgccgcgctgggcgcgctgcgtgacgtcttcaagactttggacaccgacggcgacggcctgatcgggctgggcgacctgacggccgcgctgcgcgccgcgggcgtggacctggccgcggcggaggtcgcgggcctggtggactcgctggacggcgcgttcgacggccgcatcgcggtggacgagttcctggccgccgcgctggaccagcgcaaggtgctgtcggccaaggcggtgaacgcggtgtttgcggcgctggaccgcgacggcgacggcctggtgggggtggaggagctggcattcgtattagaagagtgccgcgtggaggtggaccccgaggcgctgcggcgcatgatgcgcggcgagggcgcgctggaccgctccggcatggtctccgccgcctccttccagaacctgctgctgggcggggaggcgggggaggccgccgcgccgctggccatcgaggcctacctccgcgacgtgcgccgcttcgccgccgcctcggccttcaagaagctggccatgctggtcatcgcgcgccagctggacgcggcggaggtgggcgccctgcgcgatctcttcgcctccctggacccgtgcggctcgggggtgctcacgctgcgccagctccgcgccgcgctgggtggtcgcgtggccgaccccgacctcgccgccgcgctggaggtgctggacctgaagcgacgcggcacccacgtcgactttgacgagttcctggccgcggcgctggaggagcagcagctggtgacggagaccaagatgcgcgccgccttcgactactttgacaaggacgcgctcggcgtcatcaccccggaccagctggggtcggtgctgcgtgacgtgggcatgcagcacggcgacgtgcagggcctgctggccagcgcgggcggcgggaaggcgcggcagccctccacgctgacctaccaggacttccgacgtgtggtcctggaccaggcccccaacatcctcaccgtgagctgcggggggtgttttgggggggtggagcttcgaaacagtggcgtggtaaagtgtggggacagggtgaggaggaggagctctgagggggaggtttctgaggcaaggcgacggggcggggggcgtggagctgcacggtcatgccgcacggcgtgcacctctgtcgaggcgccaggctgggcacctgtgtccagacatggccctgtccacacgccatgccctgcataccgacacctcccctccctcccccctccaatccaaaccattgcaagcagtgctgcagtccgcggtcgtcgctggacgaggggcggcccgagggccaggccagctccggccgcggctggacacgcccctggacctgccgtgcagccccctgcacggccgccgcggcgaggccgcgctgggctccgtggccggcagcgccagcttctcggagtgggtggccaccggcagcgccgccttccgccaccgcgacaccgcccccgccccagcgccgggtgcggccaggaaggacacgctgctgtctggcacgccgcacggcgcacaggcctcgcccccgcccaggggccgcgccgcgggggcgcggtcgccggaggcgcggggcgccaagcccaccgtgctccagtccatgctgcagaagctggtgaggggatcatcgcgcacgccgcggcgcggcggcgtggaccgcacctccaccatcagctctgccagcgacggcagcacggccgcctacttggcgggcgactgagagaggaggggcctggtcccaggagctggactagcaaacacgtgaggtgggggaatggccacgcacgtggagagatgccgaatctcggatttttgctggggcccgtaccttcgccgctgcgctcatgggggcaactgcgtccccatgcggatctgtgccctggaatcgtctcattgatgatgcttcattgggggtttaccgcatgcaacaagtcatctgggtccatctcggccgccatggcgaggcgtaccagccggaaccacctgggagggcatgcgtacgacatgcgcatggttgatatcgtctga

SEQ ID NO: 7674 - DNA, 1347 bp, Chlorella protothecoides
  modified_base (617)..(626): a, c, t, g, unknown or other
atgatgtctcgtacgatcaccctcgccctctttgccctggcactctcgtccctcagcgcaccatgcgatgcgcgcgtgccctcccgcgacctgcttgccttccatggccggagcctcctggagttcgagaacatcaccctgccggagctgccctacgagtacagcgccctggagcctgtcatcagcgcggagatcatggagctgcaccatgacaagcaccaccgtgccttcctcgccggtttcaacaccgcggtcgccggactgatcgccgcccaggattcgaacaacgtcgccagcatcgtcacgctcacctccgcccttaacttcaacggaggaggtgcgaaaggtcttgggctggcatatcatggtgacgagtgcgtcgtaaggcggcgatgtcgggccactcaccggtgtgtgctcgtccgaggtttgtggtttgtgcgtgcgactttagggttttgcgcgcatccccctctcgcaggttggatcaaccacaacctcttctggccatccctcacccccgtctcgcttgcggtactcgtggtttccacaactaagatgcacaccaccagcacatgtccttctaaatggtctcatcaccaccctcatccattctnnnnnnnnnnccttccgatactcgtgctttccacaactacgatgcacaccaccagcacacgtccttcgcaatggtctcatcaccaccctcatccattctcacagaactacaccgagctgtctgggcctcttggagaggcaatcgatgagacctggggatcctttgacgcctttaagaccgctttcaacactgccaccattggcatccaggtccgtgacatgattgtggtgcggctgatcaagagtttccagggatctggctggggctggctcgccgtcaaccccgccaccggcgtgctttccatcaccaccaccgccaaccaggatgcgctccagcccaggaccggcctggtgcccctctttggagtggatgtctgggagcatgcctacgtaagtttggcttctgtgcgaagtgttgttgtctgcataaggcttctggttgtggcttcagccagtctgggtttgggacagccgcctgcttttgtttctaggtatggggctgtacacatttggcaacaatttgggtcaactcatgacactgtccccttccatccccgcctttgcagtacctccagtactacaatgtgcgtgctgattacgtcaatgccatctggcagatcatcaactggcccgaggtggagcagcggtatgcgactgccactgcctaagtcggtgatcatgcagagggaagtgcatgacatttttgatgtggatgcagcattggtactgtga

SEQ ID NO: 7675 - DNA, 348 bp, Chlorella protothecoides
atgctgtcctgcgcggcgtcagccgtccgatctgggcgcagcaccctcgtccgcgatgtcggtctgaggggcatggccaccggccaggacctgaagctgcccgcactgccatatgactatgatgcgcttgcgcccgtaatcatccccgagatcatggagattcatcacacgaagcatcatcaggcttacgtcaccgggttcaacaatgctctggcccagctaaaggatgccgaggcgaagaccgacccaagcgcaatcgtgggactgcagtctgccctgaagttcaacgggggaggtacgtggcgtgcactgcctggcgttcccgcaaacccaaggctgccttcgtag

SEQ ID NO: 7676 - DNA, 426 bp, Chlorella protothecoides
atgcaggacgacgtcaccggcatctccacccacctgtggtttggccatgccgatgcccggcgctttgtcacggccctgaagccgcggctgaaggccgccgccaccgacacccagcgcctgctggcggaggtcatcgggctgcaggtggggagcgctttaggagagcctgggctggcagtgctgctggccgaaggtgcagaccaggccacgcccccgcgcctttcagcatgtagatatcagcatgtactcccatccccgatccacccccagcacgccattgaggctgggctggattccgcacacctggccgacctcctgcccggcgtgtgggccgacttcatccgcaacgccgacatgtcggacgtgaggccgctcggaacgcgcagcatagaggtggtgcggtccaagtacagcatgcagccctga

SEQ ID NO: 7677 - DNA, 372 bp, Chlorella protothecoides
atggcagagcttgtgggagatcatgggctgcaggcacaggcccctctgctctatcctacacccggccgccgagcctggttaggcctgcggagggaggacatgcgggcacggctggggcgattcggcctgtcgggccatcaccacctccagcccatctgcaagctgtcgggcgggcagaaggctcgcgtcgtctttgcagccatctcgctatcggcgccacacatcctcctgctggacgagcccaccaaccatcttgacatgcaggcacgtggaagtgggggggggaggaagggggatgggggttatgtgtgtgtgtgtaggttcaagggtcgccgagcgcatggctcgggggatgtttttagggaggcttga

SEQ ID NO: 7678 - DNA, 333 bp, Chlorella protothecoides
atgccgatcccacattgcccgcagtccatcgatgcgctggcagaggcgctagaggcgttccagggcggtgttgtaatcattagtcatgacgctcggctgctgcagagcatctgcgacgacacagaacgcgctgaggtgggtggggagaggggcggcaggggtcgcgctgtggtgggtgggccaggcgcatttgaggcctgcgactgcgtcatctccgtctggattgtggaggatggcaccgtcgagcggtacgacggcgactttgaggagtacaaagaggagctcatcaaggagatcgcggcggacatggacgaggacgagaaggcaaaatag

SEQ ID NO: 7679 - DNA, 546 bp, Chlorella protothecoides
atgggagcgattggttctgtggctggttgccatgctttgcgaactcgacccccttccccacccatcccgtttggcatcacaaacagatggaagaagacgcttatcgtggtatcgcacgaccgcgacttcctcaacacggtgaccactgacatcatccacctgcacgacgagcgcctgcactactatcgcgggaactttgcgcagttcgaggagatgtacgagcagcggcggcgggaggtgaacaaggagtttgacaagtaccagaagcagatgaaggccgccaagcgctctggtagggccaacgcggacaaggtggccaaggaggccaagagcaaggcccagcgcacgcagcgcggtaagtacgaggacgacagctccaaggcggccgacgcgccgcggcagtggaacgactacaccgtgcactttgagttcccggagcccacagagctgaccccgccgctgctgcagctcattgatgccaggtgggagtggttaccggtgctgtggggtagcctgattggtgagggtggacctccttgctgctga

SEQ ID NO: 7680 - DNA, 504 bp, Chlorella protothecoides
atgacgtccatacgacgcctgagaatctccccccgtccgctccgccaggccgtggacctgatgccaaccacctcccaccccaccccccaggacccccaccagcggtaccgcttcctgcgagtgctgggcacgggccacttcgcggccgtgtacctgtgcagccacctgggcacgggggagctggtggctatcaaggcgctggacaagcaccacccggagtttgagcggcacacggcgctggaggaggtccgcgtgctggcggcggtccaggaccaccacaacgtggtcaccctgtacgaggtgtgggaggacgcgtcctacatcttcctggtccaggaggcctgcctggggggcgagctcttcgacctggtggtccagaacaaggccttcagcgagcaggacgcggccaagaccatcgccgcggtcttgagcatggtcagccactgccatgcgcgcggcatcctgtgcagagagcgggggtacaaggacttgctcggcgcgtag

SEQ ID NO: 7681 - DNA, 411 bp, Chlorella protothecoides
atgcaggagttccagccacccagcggacctcttgaggagcagatcaaggctacctggggatccttggacaccttcactgccaagttcaacgctgcggccgccggagtgcagggctccggctggggatggctggcgtacaacccggagaccaagggtctgcagatcgccaccaccgccaaccaggaccccctgcagcccaccaccaagctcatcccccttctgggagtggacgtctgggagcatgcctaccgctctcctatcatgtccctcatgctttcctccgcatcgccaccttccaccctgcagtacctccagtacaagaacgtgcgccccgactacctcaaggagatctggaaggtcatcaactggaaggaggccggcgaccgcttcgcggccgcctccaaggtctga

SEQ ID NO: 7682 - DNA, 1083 bp, Chlorella protothecoides
atgtcgcgtgagggaggaggcatcgcccactctggcattccatttctaccaggatacacggttcgagagccggtgagtgtgtcgctcctggcgagaggttttgaagtgctgacctctgacctgacatgtgcacatggccctcatcggacaggttcccttggacgcgcggttcccttggacgcccggtatcctcgcacccagaccttgtcattcaagaacggatacgctgtggctgacgttcccgtggcatcgctcaagccggcatgtgggcccgccgaccatgtcgctttccctcctgcaccctcacggatcgagctcagccaggcgacccggccttttgtcccggcgttcgttcagtacgagcactgcgtgctgcgcttcttggcatggtttaaggaggtcctgcccggcatcctggatgagggggagtacatacgcaaggcagtcgtcagcttctggccggaggattgcagtctggccattgccgagcctcgcctccccaactcgggactcatgcaggtttggcggtgtggtgtggtgggtggtacatcattgcgaggtggcaaagatggcccctgcgctgctctcaagggtgcagatgtggtcttggcctggaggacttcagcattgggagcacgatctgtgttcggaaaacacagtaccacctgtgttctgcggatacctacacccgcactttcttctccgatcgaggcctgcacttgggcgaggaccttgccctgcccgaggcgccaaccgacggtggggcagtgtcgcgccccggctcgacaggtgtgtgtggtgctgatgggaccgtcctgtgctggggccaggccaccttgccaagacgtgtgctggacggaggccggcccacgcctctgcctgccaccctgtgcagaccggcgtgaggccccggcagagtcgcccacccgactggatgaggctgacttttcagctccccaggagctggtgcccttggccccagcatgcggctgggcccctggactgacacctttgcatgccttctccatcctctgcacccccatgcccagcccaggtcctccgcttcttcgcggtgtggaatga

SEQ ID NO: 7683 - DNA, 507 bp, Chlorella protothecoides
atgccgagagccacgagtacgccaagatcgagggcgatgttgccactctgggcatcaccgacttcgcccaggtacggacatgtggacccttttcagtctctgatgatgaggtctgcacctgacatgaagcatcccgtggatcgggatggggatgatcacctctgcctctcagtgccaggaggtaccggggcaccgaaggccccccctccaccaatatcaattcagagcgagctgggagatgttgtttacgtcgaggtccccgaggtgggcgccagcctgtccaagggagccaacctgggtgtcgtggaatccgtcaaggcggccagcgacatctactctcccctcagcggcgaggtgatcgaggtcaattctgccctggtggatgaccccgccaaggtggggcgcatggccaggggaaggggggctgatttgcctgttacctcctcaatgaaacaatggatgagtaaaataatgcgcaatggagaccgtctttatccttgtctttga

SEQ ID NO: 7684 - DNA, 1503 bp, Chlorella protothecoides
  modified_base (196)..(205): a, c, t, g, unknown or other
atgcatggaagcttctggggcatgcccctgcctgtcaacctggagtatctgccacgcaactcaaatcactcatggggcaaagtcaaacattgggccacatcccagtcctccacaggatgcctggcactcgggtgcgtgcatctgaagcatgtggccccttcctgcaccttggaacacattgacttgctaatgaatnnnnnnnnnnaagcatgtggccccttcctgcaccttggaatacatcgacttgctgctgaaggtcctcgttatgcatgttgcaatgcagtggaggacagtccagtagtctcgccggagggagggtggacttgtgtagaagttctgttgcaggagaatccgccccccccccactgtacatgtgatccattgcaaccagcgactttgcatttctgcatcatggctgacaccctgggacaggttgtggtggcgctgtcctccagcggcaccctgcccacccccgtcggccagcccgctggcaccgatcggagcccctccaagctccggaaagcaagcagcacctcggtcacctcccggcaaccagatgagcccaccgtgccataccaggccaggcctgtgacctccgccgtcatcacgcacaacctcaccgctgccctgccggtcatggagggcacacggtgtgacgtccgtcccgagcggctccccgcaggagctggaggcccgggtgcgacaggtcatcgaggactaccgacagaagctggaggaccgcacggatcaccacatgggtttcatgaaaggaatcacaaggagctggggtgggtcctccccagggcagcaccgctcaccgtgcctcagcacctgaccctgtatccgtacaacctggactttgactacggcccgctggagggcctgcagaagttctgcatcaacaacctgggcgaccccttcatcgagtcaaactatggcgtgcacagccgcgagttcgagatcggcgtgctccagtggtttgcgcggctgtgggagatcgaggaggatgagttctggggatacgtgaccaactgcgggacggagggcaacctgcacggcatcctggtgggccgcgagacgctgcccgacggcgtgctgtacagctccgcggagtcgcactactccgtcttcaaggccgcgcgcatgtaccgcatggaggcggtcaaggtgggcgtgctgggcacgggggagatcgactacgaccatctccgcgcatgcctggccgccaacgcggacaagcccgccatcctgaacctgaacatcggcaccaccgtgcgcggcgcggtggacgacgtcgaccgtgtgctggccatcctggccgacctgggcttcggcgaggacaggttttacatccactgcgacggcgcgctcttcggcatgatggtgaggttttttgggggggggttgggggtgacgttgagggggataagggagaggttggggggcgaattgagaaggggcctaaaccccagggagggatgggcagattgcaggggtgtgtaa

SEQ ID NO: 7685 - DNA, 1518 bp, Chlorella protothecoides
  modified_base (204)..(213): a, c, t, g, unknown or other
  modified_base (421)..(430): a, c, t, g, unknown or other
  modified_base (1243)..(1252): a, c, t, g, unknown or other
atggttgctgagcagggctgtccacccctgtcacatgagacgcatccacccaggagctcgatcgagcgcagggcgagggccccggacagcgatgccacgctgcggggtgaggaatgcaactgcagtcccaatgagtcgcccgaaacgagctggagctcacagggcagccctgagcagagccaaggcaagagcaggctcctggcnnnnnnnnnntccccgtacagcgatgccacgctgcgggatgaggaatgcatctgcagttccaatgagtcgcccggaacgagctggagctcacagggcagccctgtgcagagccaaggcaagagcaggctcctggctgtcacgttgcaaggcacggtccgggagaacaatgaggtgaggccgcccaatgcgcacctgggcccgaacccggcagtagagnnnnnnnnnnatggccttgatgatgcagagaacgatgaggtgaggccgcccaaggcgcacctgggcccgaacccggcagtagagccggatggcacgggtgatgcacgctccagcgcggcgtgccaagtatgcggcgccccgctggagcacatgcacttcctggagcaggtttcgcacgtcaagcgctgcatggggggccgcagggctgcgaggaggtccgcggcagcggggccccgtcgccacgcgagtgcacctgctcctccccgcagcctgccagacgtgctcaaggtacgcggcgcgggggctgaggccggcaggagcattgcattggtcgaggaccccctccccctgctcatgatggcacagccctctcagcccagatcggagcattgcattgatcaaggaccccctccccttgctcatgatggcacagacctctcgacccagatcggtacagagtctcatgcacatgtgggccccaactcaccgcaggcggccggcctgtcggagcacgcgcccgcgttccagcgggcagaggtcacggtcgacatcctgcacaccctctccgacgctgagctggcagagttggggatcacgcaggccggcgccaggcagcgcctcctcggctcgctgacgtgccggccggcgccggctccggtgcccgggtccaaggccctgcgccccctgcgccaggtcctgctccccattcagctcccctggaactcccccgcccccagcgcagcctggctgccgtgtgctgaccctgttcgcgactgcagccctgcgccggcagaggcctcgggccgcgcctgggaggcggcgnnnnnnnnnnttgctgaccctgttcgcgaccacagccctgcgccgccggaggcctcgggccgcgcctgggaggcggcggccctctcgcccctgcgccgccgggctccccgtgccagaccaatcgccggccccgtgtccccgccccgccgtcgggcgcgtctggcttgcctgggtccagagacacagctccccccggggtcgcgcctggtgtccccgccccgcacgctgtggcacgctgcggggacgtgcagcgcgcgcggcgcgggcccctcagcc

SEQ ID NO: 7686 - DNA, 291 bp, Chlorella protothecoides
atggtgaccttcaagaagcccatcgggagcgtgtcggtgtcggggcacaagttcgtgggcgcgcctgtgccttgtggcgtggtcatgacccgcctgaagcacatccaggcactgtccacaggtgcggcgcgtaggccaggggatggcgggttggattgggggaactttcagagggggagcctgttgaccccggggcgtctggcctccagggctcagcccaaggggattcccgtgcatggggagggatgcgcagtacataagccggcatgccaagccgagccggggcggtga

SEQ ID NO: 7687 - DNA, 474 bp, Chlorella protothecoides
atggggccagaccctctccctaacccgtactcatcgctccacaggccccgcaggttcgtgatctccttctttgccgcggacgacaccctctccgtgtttgagccgcccgcggcggctgctgggggggcgggcagcaagttcctggagcggaccagggcatattgggtccccggccaaactgcggtgagaaagggcggccggggaacggttagctccaggacgccggcgtgcggggcgccccgcccgctccatgcccggctgtccagctaccacctcttgccctcgcagacactcatctccgagaaggacatctgggtgggcgcagtcatcccgctggcggggcggcgcttcgagctcctggccgccgataacttcacgctgcagcacatggagctggcggcgcaccccatggctcgcctgggcgacgcgcttacgaccctggggcaggccctctcaggtgggagatggctgtga

SEQ ID NO: 7688 - DNA, 1170 bp, Chlorella protothecoides
  modified_base (479)..(488): a, c, t, g, unknown or other
  modified_base (758)..(767): a, c, t, g, unknown or other
  modified_base (1084)..(1093): a, c, t, g, unknown or other
atgatgtcggtgtatgagcgcgcggggcgcgcgggcgaggcggtgggcatgctgcgccgcgcgcgcgcgctgggcgtgcgccccaacaccgtcatgctgaacaccgcgctgtcggcgctgggcaaggcggggcgcgtggacgaagcgcgcgcactgtttgcccgcatcccggaccccgacgccgccagctacgagacgctggtggcggcgctgggcgcgcgcgggctggcggccgaggctgaggccacggtggcggccatgcgcgccgcagggcatgcaccgcgccactatgcctactgcggcctcgtcgccgcgcacggcgtggcgggggactggcgcgccgcgctggccgtgcggcggcgcatggcgcaggaggggctgcagcccaatgttcacgtctacaatgcgctgctgggtgagcgagtttggtgttgggttcttgtttctttttgttccttaggaggggggaaggggatttnnnnnnnnnncaatgcgctgctgggtgagcgagtttggtggtgtgtgcaaccaggcggggcagtgggacgcctccctggcgcttgtgcgggagatgcggggggcagacattcagggcaacctcaccacggcccaggcaagaccacatggggtcgtgcagggcctggcgcgaggccctggggtggcaatcaggggggagggaggtgtgcgaggcccgcacaagcattgcttcaggtcggtgtgatgcccagcaactctacattctcgctccacatcccccnnnnnnnnnntgcttcaggtcggtgtgatgcccagcaacttcacattcacgctccacatcccacccacagctgctcgaggcgacggggcgtggtggcgcggggtctgtcgaccgccaggctgccctggccgccgccctgtcggccaccgtgggagcagcgggagtggcgctcatgcagaccggcttcatctgatcagtcgactgtggaagaggatgaatggaaaaggaggagaccttggctcccccccgccgcctctccaagcacctcacctgatgcccgctcccaagctgcaactggggctcgatgcacgatgacccacaagccgnnnnnnnnnngtcgactgtggaagaggatgaatggaaaagaggagaccttgacttccccccgccgcctctccgagcacctcacctga

SEQ ID NO: 7689 - DNA, 321 bp, Chlorella protothecoides
atggtccaggaggcggacgcacgccccctgctttccgctcgcctggtcccccccgccggtggtctgcaggccggcgaggttttgactgccgtcctggagatcctggcaccctatcccttggccctcatagaggttgacatctccttggtgggcgtggagagggtggacaccgcctatgtgtcccgagactggcgagcaggggtcccccccctcaacactgacccccgccgcatccagcggcacttactccagtcgggcctgtgtgccgcctgccagacggacctcgcaaaccccgagctccgccgcttcgtcatccagtga

SEQ ID NO: 7690 - DNA, 354 bp, Chlorella protothecoides
atgcaggtagaggcggcgctggaggcggaggaggcgctggcccccggctggcgcgccggcggccgggcgtggcctgcacccctgatcgtggccgaggcgcgcgaggcggtgccccacgccgccagcgtgggcctgcagctggcgctgccgcgcggggcgacgcccagcttctgcacgccgctgtgcacgctgggctgggcgctgcgattcgtgttcaccgccgtggggcagagccccgcgcgggacccaggcagcacgccgtggcggggagccaccgagaagctgacctggcgcctgcccatcttggttgtcgcccccgggggaatcccgggggaggagcccaacgagtactga

SEQ ID NO: 7691 - DNA, 354 bp, Chlorella protothecoides
cacttctttgacaccccccaccgggaccgcgccgccgaccgcgacgtgggcccctggctggcggcggctctcaaggagcggcacccgggcgcctatgtcaagtacatcgacccctcctacctcgtgcgcagcgtgcccaccgtctccagcgaccgcacctactgcaaggtgctggcgcacaacgcggtgcacgccgcctttgccggcttcacggggaccacggtgggcctggtgaacacacactacgtcctgctgcccatcccctttgtcacccaggcgccgcggcgagtggacccgcagggcaaccagtggaaccggctgcgtgccgccaacgggcagcccaacttcacttga

SEQ ID NO: 7692 - DNA, 1011 bp, Chlorella protothecoides
  modified_base (789)..(798): a, c, t, g, unknown or other
atggtgctcgtaaggtctgcacttgatgctgaaagccagccctgtgcctggtggcccatgccctttactcctcgtgccacccatccctgcatgcagcacacccatggcaacgtcctggtccgcgcgacgtatgacaagacgtatgagctggtggtgacacccacccaggcgaccatccttgccctgttcaatgacggtgagtggagtgtgcattgtctggggggatcacattctgaatgggataggcgctggatgttgtttgagcaggatggaaatttggcatggcgagctgctgagcgcttgcttctgggaggggtccaagactccctgatccaggcggggcgggaattcgccccaatggccctgtctcgccagcacgacactaggtatcctgcacactcctcttttcccgcactgcctgtagcgacgtcgctcaagtacattgagatccaggaggccaccaacatagattctgacgaccttgagcggacgctggcctcgcttgtctttgccaagcacaagctgctgagcaaggagccgatgggccggacgatcaacagtacagacacctttgcctacaacgcgggtttcaaggatcggatgcggcgaatcagggtgagtcggtgggttacccggggaggcgctgggcgtgttgtgatttgtagggggaccctagtgctcagcgccgagggttcgggaatgggacgtgtcccatccctcatgcatgtgcaatctaccctgggccgcgcctcgtcctggtcccgacgcctcaattgcacgcatccttgnnnnnnnnnngcggcgaatcagggtggccctgccgccactggaggaccggcgcaaggtgaaggaggacgtgggcaaggaccgggtgcacatcatccaagccaccattgtgcgcatcatgaagagccggagggtgatgaagcaccaggagctgctggtcgaggtggtgggccagacccagaagatgtttgcagcagatgtcaagctggtaaagaagcagattga

SEQ ID NO: 7693 - DNA, 1164 bp, Chlorella protothecoides
  modified_base (22)..(31): a, c, t, g, unknown or other
  modified_base (260)..(269): a, c, t, g, unknown or other
atgcagattgggagggccacannnnnnnnnncatcaggcagcaggcactccacattgctgaagcctcgggtggagcagcatcaaccagcccctcacataccatggagcatgccgcgtgcagattgggagggccacggtcgccgaagccatggcatccttctgcgattccctgctccgcaaggtgggcgccatgcgtggctgcagcgtgggtgcacttctgtagagccatgttgctctgctgtatccgtttcattgccatnnnnnnnnnncgcaaggtgggcgccatgcgtggctgcagcctgggggtccacctccgagaagctgactgatgacgaggtggagagtctgctggacagagaccaagctcagcaagcggtgcgcgcggagccaggggttctgcggaggaggcgttgcatggaagccaggcttcgatgccggctcaataatagggtggcccagcctgcatgttcatcccatttcgcaatgctgcactgggagactggtggcagcaaggggctactgggaacccacatggcgtccgaggagctcgaaaagggggtgctgatccgcctgaagcagcagtgtgggacccagttcacttccagggtgcgaagaggctttgtgggggaaggacgggacgcagacaagcgaggatgcagcgcgggcgtcacggcctgtcggcgcgttattgggtgcacgcttcctgaacttgctgcatgtcccagcatgggaggctgccgtcctgtgtctctcctctttccgcacacatctcaaggtgctgcccctccgcatcttccatgcgctcagatggagggcatggtgcacgacctcgcgcacgccaaggacaagatggaggagtttgtgaggtggcagaagaagaggggcgtcactctgcccgtcgaactgaacgccaccgtcctgactgttggcttctggccgaccttcaaggtgtggggtcgagggggacgggtcctggtggggtggaacagcaagctgcagggctcgtggacgcgacaagggactgatccctccatggttggaacaattgaggtatcacctcgctctgcattctcaaatgcaaccgaggggcaagagtcgcttggtgctcacggcccggactccctctcaaaccccttctcagaaaatcgagcccaccctgcctga

SEQ ID NO: 7694 - DNA, 1080 bp, Chlorella protothecoides
  modified_base (242)..(251): a, c, t, g, unknown or other
  modified_base (593)..(602): a, c, t, g, unknown or other
atgtgctgggaggcgttttgccaagagcagcgccctgttgatcgcagccaaccaggagtatggcccatgtccccagcgtatgatctcaccccaggtcccaaaaatcaccactccctgaacttcccacactgtcctccacagaaagaggacctggctcgcatgttccggctctttggtcgcatccccaaaggtctggagcccatggctgcaattttcaaagatttcgtggaatctgaaggtannnnnnnnnncatgttggcgcggggctgttctactgaagcggccaaccataccagcaggattgatggaggacaaggcgctgccggccggacagctcctgcagggtgtctgacatggctagggcgagccctgagcctcacacccatcacacccccccttcccaggcatgtcgcatgtgcgagcggcaacagaggcagctgggtccaagcaggccaaggaaaaggatgcaggtgggtgggggtgaactcaaggtacctcgcagtgctgggaccaagtgcggtgtgtgggcgtcagcatcctggacaggatacgttctccccccgtcccacaagcgctgctcatgaagatctcannnnnnnnnnaaaaggatgcaggtgggtgggggtgaactcgaggtacctcgcagtcctgggaccaagtgcggtgcgtgggcgtcagcagcctggacacgagacgttcttcccctgtcctacaagcgttgctcacgaagatctcgaaaaccatgcacgtgtacgcagccatgccagacccctgcgccccccgcttcctgtcccctgcccaggcaaagctggcaaggacggcgccgccgcgccagagcaccagttcatccgcgtcgcgatagaccttcatgacacctactctgactacgtggtatcatactttggcagtgcctcgctcttccacaaggccttgaaggaggcgtttgagacgttttgcaacaagcaggtgcgttatcgtggagtggggcatggctggctgggcacagattcctgggaccggctggtgccagggctggtgccagggatggctcatcaggcagcaggcactccacattgctga

SEQ ID NO: 7695 - DNA, 504 bp, Chlorella protothecoides
atgccgtccctggcatgtgaatgcgtgagaggccaccctctgcacccctgtgcagacgagattggccctggacaagtcaggattcaaatcaaggccgtgggcatatgcgggagcgatgtccactactggaagcatgtgagggatatggaggaggcgtgcgtcgctgtcagaaaattgttgcttgcaggcagggcggccatgctgcgagccctcgtccagcctcggcgctgccccagccatgccaaagtacaccccttgaatctcgactcgcagggcaggatcgctcactttgtggtagaggcgcccatggtgatcgggcacgagtcagcagggcaggtcgtgggcgtggggcctggagtcactgccctgcacgtcggggacagagtggctctcgagcccggcatcccctgctgggagcatcgactgtccaggcaggctggcttcttgcagtgcatggtccaggcgcactgggggctcattcgtcagccggcaaccctttcatga

SEQ ID NO: 7696 - DNA, 1779 bp, Chlorella protothecoides
  modified_base (883)..(892): a, c, t, g, unknown or other
atgggtgcagcgttgcctgtaccccggagtggctgtgcagatcgcggagtgcccacggcagcgctatcctcgtctccatctgtccagaatcactcgacgctgtcctgccatcgtcacctggcagtgtatacctccagcagggtgccttttgagaccacaagttcaggtaggcatccctcctgtgctggtgccgtcagccagatcgcagcgcaatgctggacggcagtgggggggtgcacctgcgcagggagggcacgtaggtccttgactttgcacacgaggagctgcaagccatccagcttctcatccaggctaggggagccgacgcgtgcggtgccaggcgacagcaccccaggtaagactggagtcagaatggggtcgtgggcgccacacagtggccacctcctcgtacaatcccctccgacaatttccaacgctgacctacgttgcacagacaaaatgacatcgttcgccatgatgcgtatgtcgggagccgtgcgcatggcgcgtgctggctgggttcggcagcagattgtgcgaacgccgtccaccctgcaccgcccactggtcatgagccccttgcgggccgccagcagcgccagcagcagcgagtctgagctcattgccggcatgaggtcaaagatccagtcggcgctggaagcccaggaggtggacatcgtggatgcaggcggcgatggcaggcatgtggagatccatgttgtctccgcggcgtttgccggcaagaatgcggtggcccgacaacgccttgtgtacaaggtactgcggcggggcctggcgcaaactcatcagcatgggcggtggcaggggccaggaaggcatgcgcatgctgacttgacgatcaggccgtttcccctctccctannnnnnnnnncggcaagaatgcggtggcccgacaacgcctggtgtacaaggtactgcggcggagcctggcgcaaactcgtcagcatgggcggtggccatctgggaggagatgcagcagacggtacatgccgtcgatgccatgaccacacagacgcccgaggaggctggcctgtgaagcaggcacggctgctgctggatgagcagacccacagttcactctcccatgcacccggcagcccgtgtaccctgtcgccatgtcctcgtagcgagagccgagcgtcacttcttacagaccatgaatccagatcaggccttgacggcgtacttccgccgggggaaagcaaggtccttcttcgcctgcttctcggtcttggcagcagcctgtgcacgaaaagaggttgtgtccagatcagggtgggcctcaggcactgttttggaccacccagcagacagtttcaccatcggcgtggacgccaggcgctcggcggcgactctgccaacctcactgctccggcaagcacgtgtcgagcatcgcagtcgtacgttttatctcaaccctgggagccccacctggtgcttggtgaggcggcggcggatggcgcgggtcttcctgacacgcaggtccaggggcatgtgcttcttcttggcaaaggcctccttcagggcattacgctggttctggttgatcacagtcagcacgcgggccaccgacttcctgaccaccttgctgcaaggatggaaggggcgcagtgggaatggtcagcacccatccctcaccaactcccagcaaacatggccacaagtgcaggctgggaacctctgaggcacgaacagtctgccagtcaggattgccctctggaatccatcgaggtagccacaccccaaccaacgaattag

SEQ ID NO: 7697 - DNA, 669 bp, Chlorella protothecoides
atgctgcgactggagcgcaccggcggcgccgtaacctccatcactgtgagctgcaggggaggaggaggggggggggatctgtacagtcccctgaaatgtgagctcagggcgtgccttggggcaactcatgtgatccccctgatccgcacggtatcatcttcacagatgacgctggccggcgcctctccgccagccacctgcctcgcctcggtcggcccctccctgctctttctcggctcagcactgggcgattccctcctagtgcgcgcagaggcagctgctgccgcagccgacgcccataatgtatcaatgggcggtcagggcggcgccccctccccgcacagcaacctggagctgagcgggggcgaggacgaggaggacattcttgagcgggatggcggcgaggggccgggtggcgccgcacagcccatggaggtggacggccagtacgcagcgccggcctccgccggcgcgcccgcctcggccgacgacgaggaggacgaggccatgcggctgtatgggatgtccctgggccaggaagatggggcaggggcgtccagggcggcggagcccctgcgctacgccctgtctgtgctggacgcgctgataaacgtaggccccatccatagcatcaccatggcaggtgcgggacgagggggccaagtatga

SEQ ID NO: 7698 - DNA, 435 bp, Chlorella protothecoides
atgcggggcggccgcgccgccttcacccgcgggcccctggccgccggggacccgctgggccgctgcggggcggtggtggtttacgacaacaagctggcggtgctccccgccatggtgcccgagctgctggagctggatgaggcggcgggcctggcaggcgcagggagggtgccggaggcgggcaccgtcggcaacagctatgtggacgatctgggcggcgccctggacatccaggagcgccctggacatccaggaggtgggggtggggggcctggctgtcctggcggctggtttcacgtggtggggttactggggcgctgcgctgtccagccgtggcgtcgtgtgctttatggggtccctgtactcccagtcatgcgctgcgccccagggcgtctgcgcctgggggcgcaatggccgtcgcggcgatgcgcctga

SEQ ID NO: 7699 - DNA, 486 bp, Chlorella protothecoides
atgaacgaagtgggtctcctcgtttggaaagaggtggtgcacgaagtgattaagagccgcgtgacggacgccatcctggagctggtggagcgggagcgagacggcgaggccgtggactgccccctgctgaagaacagcctggccacctaccaggaggtgggcatggggctgctggatgcctacgagaaagactttgaggcggcactgctgcagaccaccgccaagtactacaagagaaagagcgccgggtggctggaggcgggcgtggtgggggagcgcatcccttgcactgagggtgatgggtgggagacgcagcttttcctactgcctcgccggcacatcgcggcttgcctgggggctcagccgtccaccttggcagctgcatgctgttcctacacagcattggccattccgtgggttccagaatgtaacagctgcacggatagtgatagctggctctgctgcacatgcctgcatggggattag

SEQ ID NO: 7700 - DNA, 507 bp, Chlorella protothecoides
atgtgtgagccgctcagcgtgggcatccatgcatgcaggaggtctggcgtgtcccccggaaagcgggtcctaatcctgggagccggacccataggtgcgccgggggcggggcgagggggggcctggctggaccctggcctgccagcacagctcccgaggaagatggtcatgggagcgctagtccgggctggcctcgtggcgctgctgtctgcctcggcctttggagcagactgcgtggccatcactgacctccgtcaggaggcactggacctcgcccaggagctgggagcccgcgtgacccagcgcaccttgcatggcgagacgccggaggaggctgcgcggaaactgaaggagagcgcagccccagacggcttcgacatcgtcatcgactgcgcagggttcgagtctaccatgcaggtgcgtttgtcggcgtctgggcggctcgagtccgggaaggcacggcatggtatgcatgagcaggtccctgattcgcgggggggcgaataa

SEQ ID NO: 7701 - DNA, 567 bp, Chlorella protothecoides
atgggggcaccttgtggtagtcccgggtctgggtactacggccgctccctggcgagtttgggcaccacactcttacacagtccgcacgccgtgacaggagaggactggcgcgaggcggggaaggttcggcggcctggccagtccccgggcggtgtgttgccgatatgcgggtacgcgagcgcgccaggtatcttcaccgttcacgcgttcctccccctgattgcagccaaggtcagggcacatgagctgcggcccaagagcaaggccgagctgctcggccaggtaggaaggcgcatggagtgtcggctcaaggacctgaagcaggagctcgccgctctgcgcgtggccaaggtcaccggtggcgcccccaacaagctgtccaagatcaaggtggtcaggaagtcggtggcccgcgtgctgactgtgatcaaccagaaccagcgtaatgccctgaaggaggcctttgccaagaagaagcacatgcccctggacctgcgtgtcaggaagacccgcgccatccgccgccgcctcaccaagcaccaggtggggctcccagggttgagataa

SEQ ID NO: 7702 - DNA, 1002 bp, Chlorella protothecoides
atgggcgagggcacgtaccgcggcctgacgcaggcgctggcgcgccacgccagcgtgcgctgcgcctcgctggaccggctcaccgcgcgcgacgaggaaagtggggcggaggtcctggtcctcacgccgcgctggggcgcggcgctggccgactgcgccgcgcgcgtggaggccgggctgttcggtgcggcgcctgccggtgacggggcgtgggcgggcgggtaccatggccagagcctggaggcggcgccgcctgtgtcgacatcagccgaccccgcgccggcccgagacccgcgccatgctgcaagctctgcctctggagattccgatgattccaacggtcgagacattgcgccacccccggccctgcgccctttgcctgcgatcggcgcgtccagtcctgcgctgtggaacgcagggcagggagcgtcatcaccatcatccggtccccttccaacccaccctggacctcaagcgaccttgcagccgcctgctcagccccctcaacccaccaccgactcgcccgccacgctggcggccctggcggaggcccgggccgcgctgcaggacgccctggcagaggccgcgggcctgcgcacgtccctgcaggcctcccgcgacgaggccgacgcgctgcgcgcctcgctgggtcggctggagggggagatggagggcctgtcctcggcctactcatccctggacagccacgccgcagagctgcaggccgagctggcccgcctgcgcaagcgggagcaacacggcgcggcgtcggagggaggcggcccatctgaagggcccggcgcggctccacctccagaggacgacgagctcaccgacctcctggtgtgcctgggccaggaggaagccaaggtgcgcatgtggatgccgggaggggggtgggtttccgtggctccagtgactgcgctcttcgacgcggccgcagcactgggactcgcccagcgctgcatggcgagctggcccgcgggtgctctcgcgccttaa

SEQ ID NO: 7703 - DNA, 1641 bp, Chlorella protothecoides
  modified_base (1382)..(1391): a, c, t, g, unknown or other
  modified_base (1629)..(1638): a, c, t, g, unknown or other
gggcggccagccagccggccacgcgaggtgccgcgcgcgctggcggaccgcgacgcgctagacgcgctgcaccccgacggcgccgcctggggcgagctggcggcgcgggccgctgaggcgcaggtacggcccgagctgtactgcctggcagcgggcccgtacatggacgtggcctcgctggacgcctttgcgcgcggcgcggcgggcagcctgcgcctctaccccggcttccatgcgcccgccgacgcggctcggctgcaggacgacctgcgctgggcgctggcgcggccggcggggctggaggcggtgggccgcctgcgcgtgtccacgggcctcagcgtgggtcggtgttggggcgccttccaccgccgcacgcccaccgacctccacttcccggccatcgatgccgatcaggccctggcaggtgtgtttggatatgagtgtgaggagcgtcctttgtcacagatttccgttcctgcaccatactatccccttcccctccccctccccaaaaccatccacagcctccatcgaggtggacgagaagctggcggagcggggggaggcgtacgcccagttcgcgctgctctacacctcgcccgccggccggcggctcgtgcgcgtgcacaccttggccctgcccatcaccacggggcgcagcagcgccttccgcggtgccgacatggacgcggtgctggcgctgaccgcgcgccgagtggccgcgcaggcgcctggcaaggcgctgggcgcctgccgcgacgcggtcatggccgctgccgtggacctcctggtcgcctatcgccagcacgtacgtgggtgggttggtccttgtttcgactgcttgaggtgtgtctttgtgcgaggaaaacggggggcggggtggtcgtgctcgtctcggctttcaggtggggcgtcgagcccgggaggcgccccgaccgacggcctctctcccccgacccccactccccacccgacaaccccatcacgcgcgcaggcggcgcagcagtcggacacctcgcagctgctcctgcccgaggccctccagctcctccccctcttcagcctgggcctgagcaagaacgcgctgttcaggcgaggcgtggcgtcgtgggggtggtcagagggggggagggttccatgctgcgtcgcctgtgggctgctccccgcgaatcactggctcctcccagtcacccccctcgtccattacaacccgtctcgagcacacttccaccgggcaggaacgacgcgcggctggacgagcgggcgctgtggctgcaccgcctgctgacctgccccgtggaggccatggccagcatcgtgtacccgcgcctcctccccctgcacacgctgccgctggccggccccggcggcggcgcgccccnnnnnnnnnncctgtcggccgcctttgtcgaggcccacggcgtctacctcctggagaacgggtgcgccgtgctttcttgctgtggctcgttggggccctggtgtttggcgttgcgcgcctgcctggccccgctcgtcgcctgcctgccgcccacgactcgctcagacgccatccacccactcactcacgaccccctcgaccctcacaaaccacccacccccatgcgcccaggtacgaggccagcgtcnnnnnnnnnntga

SEQ ID NO: 7704 - DNA, 519 bp, Chlorella protothecoides
atgtcaagttttctccagcgacggtgctgtactgcatcaactggccgtgtcgagaggcagcagcccatgccggccatctggcatgctgtgtgcggagcgtatcagacggattcccgacaccggtcgaccgtgtcgaggccaagcacgcgttccatgcaccgtgtctgcctacttcacctcgtgcacgctcgacagggcaactcgtcattctctcttggatcaacaggcctgggagcacgtcctgccgattctccaactcctcatcaccaggcccaggtgcacccaacttccgtacgcgccccagagggatctcccgccccagtaccaactcatccaccacctgctaacatggctgggcaacaaggctggctgcgcggcgtggtcaaggaggtgctgagcggcgacaccctggtggtggctggggctgtgaagtccggtattcccccggagaagcgcctcaccctggcgtctctgatcgccccacgcctggtacgccggtgtaaagggctttcgtgttag

SEQ ID NO: 7705 - DNA, 1701 bp, Chlorella protothecoides
atgcgtcacttcaacgtcgttcctcactccattatataccactcgacgcctccggtgatttccagcttgcaggggagtcggaacaaatccacaatcaccccctgggtgatattactttgggggcacctccgaaaaccgatcgctccgactgaaatcgatgcttgggcgccacttttggcatcccggggcttgtacttggaagcgcttcgaccgatttgcgcttctcccacgacagctgccgtccccctggcaccggaacctcccggggctgtctgccaagagcttggaaatgtctcggtctcggattgcacttggtggataccgcacggattagggaggtctgaagctcaagacggccctcctgcggagaacgcagacgaggacggggcccccgtcgcaccgcgaacaggccggtcggcgatgggccctgctcctcctgctgtccgccgcagtcctcctactggtggcgggcgtcactcgcatgcggggtccagctggccaggcagagggggagttggtggtgacgcgcagggctggcactgctcctcccgctgcatgagccggtggaccaccaggcccatgtatctccctggagggcagggtggtctcctcccagcgattggtgccccacgtcaatgcgcccatgaccgccgattgtccaccctgagcaccgcgtcgggcagcgtagttccctctccatgccagaccgacggccgctgctccccacaagtccctgcagaaaccgggtcgcagcacgctggcgcccggtcccatggctccggggaccgaggggcgagcccccctacccgcaccccccgcatcccccccaccattcaccagatgctgggcctgtttgagccggactggcgccggccccggcatggccctatcgaccccctgcgcctcgacttccccggcctcagcgccgacgcgcgcgccgccatgcgcagctggcaggtgctgaacccgcgccatgcctaccgcctgtgggacgcggccgacgtcgaggccctggtggccttgcactacccggccctgctccctgcctggcgcgcgctgccccacgcagtggagcgcgccgacctggggcgctacctggtcgtgcaccgccacggcggcgtgtacgccgacgccgacgtggcggcgctgcagccgatggacgaggtcctgcgccccggtgacgcgctggtggcggcctgggagaacgtcatccccctcggcgaggtcacggagcgcgagttcgggcgccatgcgcagctgctgcagtggtggtttgcggccgaggcggggcaccccgcgctggccgcgctggcggcgcgcgtcgccgccgccgccaacgtcaccttctacgccaacccgcggcgcgacaccatcgagcgcagcgggcccgggcccttcaccgacgaggtcttgcgcgcggccgtggccgcgccgcgcggcggcgcggcggcgggggcgccgaccgtgaccgtcctgccgcaggcggcggccgggttccagtggacgaacggtgcacggtcgctgctgccgcggtccagcctgcacctctttgcggggtcgtggaaggagaacccggtgaaggacgggccggtgaaggaggggaaggagctctggaacgtgcagcggtcggagggggaggggcaggccggtggcagcgagcagcagcctggggagctgcctacacccgccaaacccctgtga

SEQ ID NO: 7706 - DNA, 462 bp, Chlorella protothecoides
atgctgctagaggagaaccctccgctgggattctcatggcgggcgaaacgggtccgcacgggcctgccggagcaccccagaacaggagagccgagcctcatccccagggccgccccagcccccgtcgtcgccctagccgcgagcgccaaatctcccaaccagggacttctagcgctttgcgaggccgccagtagcgccggaaatgacgatggtgagccaagcagcacctccacagtgagcgccccggggctgcaggggcccccgggtaatcccgggccgcctcccgtgctcataaagtctgtgaccgcctcgcccttcccgggcactcccacctctcggggacccgggccgggggttctgctcacgaagaagaagacagcagcctacatcggagtcaggaggagaccatggggcagctacgcagcggagatcaggaatcaaatcactggagctcgagagtga

SEQ ID NO: 7707 - DNA, 462 bp, Chlorella protothecoides
atgctccctccctccctgcatcccccacagactgacgcacagaacccggcgctctcgcagtggcggctgtccaccagcatgtttgggcaggagtggagcctgagctggctgtcggagtcgctgccgaacaagccccacacccagatgcagtggcgctccgtcccgggctacaagggtccaggggggtccctggaggtgccaaacaggtgtgggagtcatgttttgtcttgtgctgctggagacgtgcccttcaaagggtgtcatgaggggtccaaggtccctcaccactgccaactgatccctcctttccttgcaaccactcaccaggggccagctgctgttccggcgctttggccccgagtcatgcatcgtggagctgaccatcggttacgaggtccccggcctgttgcagccctttgccagcgtgctgacccccaccgtggagggcatcttgcgcactga

SEQ ID NO: 7708 - DNA, 1125 bp, Chlorella protothecoides
  modified_base (488)..(497): a, c, t, g, unknown or other
  modified_base (758)..(767): a, c, t, g, unknown or other
atgtctcttcgctacatcctgctcatgcaacgggatgtggcagcagccgcacgatactacaatgaagggctggggctccccctaaaagtgttgacggagcgatgggcggagctccagagcggggagacgaccatcgcgttgcagacggcgccgggagaggcctactgtacaactgggttcagtccagtgttgagcttcaatgttgagagtatccaggatacactgacccgcctcttgacgatgggaggacgcatggacggcaagatccaccactctgtgtatggcaagtttctgctcgcgacactcgatcttcctgtctcaggttgcctccatccgaggaccagatgggcacatgatcagcttggtcgaggaagactgacagacatggcgctgggatgtgactctggcccaagctcagtactcggccttcagtcctgcagttcccttgattgtgcccctgcaattgcaggcttcggtgtcttccttannnnnnnnnncatggcgctgggatgtgactctggcccaagttcagtactcggccttcagtcctgcctttcccatgattgtgcccttgcaattgcaggcttcggtttcttccttgaggagagtggccttctgtgcaattctgatcttgtggaattcgccctttccttgacccatttgcgcttgcctgccggaacaatccatacggaggcccgctccctgccacgtccaatactaggagtacagaagtgctaccttgtgggatattctccttnnnnnnnnnntgccggaacaatccatacggaggcccgctctctgccacgtccaatacttggagtacagaagtgctaccttgtagatattctcctagtggagagacgcgatcgtgagaccagtaaaccttggcgctcccccccacgagttgttactcgctcaaccccgcggtttgtggagcgcttcggagtgaccggggttgctccgtggcagggcggtggcactgccttgaaggtgggcctggcgtctcaccctgcggcgcctcgacaccacctttcttccacgagcacaggtggaaacagattgacagaaatgagtcctggcagacgggggcctacgacaccctggccgtctcctaccttgtcatag

SEQ ID NO: 7709 - DNA, 1515 bp, Chlorella protothecoides
  modified_base (277)..(286): a, c, t, g, unknown or other
  modified_base (1372)..(1381): a, c, t, g, unknown or other
atgaggacaggggggcatctggccagtccgcgaggaactgtcgatgtcattcaaaatcgcgcgcgaacagtggctgcttgcagggaagggcgagtgtctaacatctgctcaagacatgagcgatcagacctagtaggtattggggcatgtgaccataacctgtcctgtcgcaagctgggggtactcgggtatgtgaccataacctgtcctgtatcaagctgggggtcatggaagaactctaacctgtcgccaacatcaacggggctggtccacggtnnnnnnnnnngggtgagagttccctttactagtgacggggagagagaccctaggcatgtcccacttgcaggctggtccacggccacatgtacaccgcatggagagcaggaccgacctgttcaaactcggctgcgagctcgagacaggtgcggtcttcgtaggcgtactgaagctccggattgctgctcgattcctgcaccaccggacccttccaggccgcagcagaaggtgaggtctcacaatgccaccaccgtggcgaggtatgaggttccagagaccatgagcaccacagcgacctcgggctccatcgggggccagccgagtccgatcaaaacaggttcaacggagcctcttcagcggctcgacactgctgccgtggccaagaggctacagcaggagcttatgagcctcatgagcagtggcgagaagggcatctctgcatttccacagggcgactccctcttcacatgggttggcacaattgaggtgcgtcctgcacatcttgctaggagcagtcttattctagaggattctactggtccaggcgcaggagccctgcctgagtgccaatgctgctcgtgcatcgcacatggagcatctgggactgtttttgaggagcttacattccgcttgtccctgaactttggggcagactaccccttcaagccgccgacagtaaaatttgagaccccctgcttccaccccaatgtcgaccttcagggcaacatctgcctggacatcctgaaggagaaatggtcagccactggaagctcaccactgactaccactccacactgtagccgcatacagcgtccggactgtgctgcagtcgatccagtcgctgctggcggacccaaacaacgattcgccactaaatgtccaggcagccaagttgtgggaccaggaccaagccgtgtatcgccaggtgacgagagtggtggaggcttggatggtgatgaagacctacaatgctgccaagacgtcctgaggctcctgtctgacgcgattttatgtagtacggtgccggttgcaagcaaatacaccttgatcatccagcttggcagaacagattcgaaactcacgccaggagcaagannnnnnnnnnacgtcctgaggctcctgtctgacgcgatttcatgtagtacggtgccggttgcaagcagatacaccttgatcatccagcttggcagaatagattcgaaactcacgccaggagcaagtaggagatttgtcctttga

SEQ ID NO: 7710 - DNA, 597 bp, Chlorella protothecoides
ggcgccccaaaagctcgccttactagcagcgcgtcgatccaatctcacgcctcccggtttctccaccccttcgcccgacctctgctccctcctttctcccctcccctcccctctcaaccaacagagtccctggtgcacgcgctgcaccagatcacgcgggctctgcccgacctgctcccgcgtgtgcaggagctgctgctggacctgctgtcgctggtgctggcgcggcgcacgcacggcgcgctgacgccgcccgccaccgtggcggcgctgcaggccgcgctggcagtgggcgagctgcagggccaggcgctgacgcgcatggcgctgcagacctttgcccagttccggtttgcgccgcactcgctgctggagttcatccgcgaccatgtggtgccctgcctggacaacggcgaggcgtccatccgccgcgcggcggtgctggcggcctgccacggcgtggaggaccacgtggagtacgggcgccgcgacgggcgtcgcatccactcctcccagctccgcatcgtggacaaggtgggtgggtgtggggtgtggtggtgggccatcactggtggtaggttcgggggaggaggttga

SEQ ID NO: 7711 - DNA, 975 bp, Chlorella protothecoides
atggcaggtgggagtatgcctgcatgccactggacccgtccccagtcccaatctccgatcacaaccccaggtcaacccctctggtgcactcaaccccctgaccaaaataatcccgttcagatcgtgcagcggctgctgaccagcgcggtatccgacctggcggtcagcgtgcgcaaggcggtgctgcaggcctttgtcaaggcgcgcagcctggcctccagcctggcccagtccgaggcgctgggcatcctgttcatcgcgctgaatgacgagtccagcggcgtgcgctctctgacgctgcagctggcgggttcgctgggcgcggtgaacccggccttcgtcatgcccgcgctacgccgccacctgctccagctcctctccgatatggagtgtgcgccggacacgcggcagcgagaggacagtgccaagctgctgggcgtgctcatcggtgcggcgcccaagctggtgctgccctacacctcccccatcctggcctgcctggtgacgcagctgggcgcggaccggggcgcgcccgggcatgaccccggcgcggcagggcatgaggggcgcctggtcggctcctccccctccctccactcgctggcggggcggggcagcacgcacggcgccggcgcgcgcgcgctgcccccgcccaagggcggctccgccgcggccaagggcgcgcgccccgacgacggcttcgagctcttcgtgctgatgacgctgggcgagctggcgcgcgtcgccggctcacgcctgcaacccgaggtgggcaaggtgctgccgctcatcatcgccgccatccaggaggacggcagcgccgccaagcgcctcgtcgcggtcaacaccctgggccaggtggtggagaacacggggtgcgtgctggagccataccgcatgttcccacagctgctgggcatcctgctgcgcatgctcaatgagggcgggcccatcgtcaagcgcgaggtcatgaag

SEQ ID NO: 7712 - DNA, 363 bp, Chlorella protothecoides
cccgcccccgccgccacgcccaccccggccctggccgccacgctgctggacgacggcgcacgtatctttgaccgctaccgcgcgctgttcgcactgcgcgatcgtggcggggaggaggcgctggaggccctggcgggggccttcgcctcgagctccgccctgctcaagcacgaggtggcctacgtgctgggccagatgcaggacgcgcgggcggtggcctgcctcaaaagggtgctgggcgacgccggcgaggcggccatggtccggcacgaggccgccgaggccctgggcgccatcgccgaccgggcctgcctggccctgctgcagcaggtggagagttttaggagcggctcttgggggtaa

SEQ ID NO: 7713 - DNA, 1167 bp, Chlorella protothecoides
  modified_base (97)..(106): a, c, t, g, unknown or other
  modified_base (786)..(795): a, c, t, g, unknown or other
cgcggcgccggcgccactggcgccgggatcggccccgacgggccctctctgggccccggcgcgcgcaaggccggcgcggcgggggacaaggcggcgnnnnnnnnnngccccgacgggccccccctgggccccggcgcgcggaaggccggcgcggcgggggacaaggcggcgcgctcgtcccagttccggggcgtgaccaagcaccggcggagcggccgcttcgaggcccacatctgggtcaaggaccttgggcgccaggtgtacctggggggctacgagtgcgaggagcacgccgcggaggcgtacgacatcgcggcgctcaagtgcaagggccggcgcgggtgcaagaccaacttcgacctcaccaagtacgccgacctgctgggctgcatcaaccgcatgaccatggaggagctggtcatggcggtgcggcgccagagccagggcttcagccgcggcacctcctccttccgcggcgtgacccaccacccctcgggccggtgggaggcgcgcattggggtgccggggtcaaagcacatctatctgggcctgttcatcgaggagcgggaggcggcaaaggcctacgaccgcgccctggtccggctcaggggcaggggcgcggccaccaactttgcactgggaggtgagagggagagagagtgtgtgtggtttgttttggggggggccagattcgtggctgggagttggggcttggaatgtgggtgtgcacacccgcggacgagtgccggtccgagatcagagatcgtgtgtctgtctcaaccggcnnnnnnnnnntttgggggggggcagattcgtggctgggaggtggggcttggaatgtgtgtgtgcacattcgcggacgactgccggtccgaaatcagagatcgtgtgtctgtctcaaccggcgttgccgccctcattcccccagcaccaaccccaccctctttcaccctcccgcttcaaacagactacaaggtggagatggcagactaccacaagatgcaggcccgcatcctgggggcggacgcccactttgcggagatctccagcaacccgggcctgtttgagcgctgggtgaagggcggctgcgaggcgttcccggagctggggtccaacccatcctcgcacacgcacgtgcagaacattgaaggtgggggggggaagggg

SEQ ID NO: 7714 - DNA, 303 bp, Chlorella protothecoides
atggcggggggtcttttcttcttcggcgccgccgtgtggtgggccctgtttgccgcgctggcgacggtcgtggtggccgctcgccgccgcggcctggcctacacggtggcctggtggggcagcgtcttcccgctgggcctgctcggcctcactgccctacgcctgggcacgctgctggacgtggccgcgctggaggtcgtcggcaccgtgctgtccatctccacggccgtcatgtggctcacctgctccctcatgctggccgcccgcatctgggacgggtccaactttgcgcgggcactctga

SEQ ID NO: 7715 - DNA, 363 bp, Chlorella protothecoides
atggatggcggcgcccttccctttgtggatgggggtgatgctggtgcagtactccggcctcccagcaccatcactacaggctggggttgtttaaagtggcgggcttcagccctcctcccatcgcactcagaggctggggagaggcctgatccttctctagacaagagcgagtatggcgacctgtacaagctgacgctcgactacgagggcgagattgttcgggacatgcacgtcaagtactttgacaccatccccccggcctcctccatctgcgtcatgcgcaagggcttcctgtttgccgcctcggagctgggggaccatgcgctgtaccagttccaggcgaggaggggttggacatgctga

SEQ ID NO: 7716 - DNA, 291 bp, Chlorella protothecoides
atggagggttcggagcacgtccactctcagctgcgagggccctccacccccatcctcacccgaatcccccaggacccgacgggcgaggcggcctccgaggcccagaagcacctcaccctgtatgagctggacctggggctgaaccacgtggtgcgcaagcagagcgaccccatcgacaacggtgcaaacatgctggtccccattcccggcggcggcgacggcccaggttggaagggcagctggggggtgttttgtgggtgggcgggtgctctcatgggtgacgcgccgtag

SEQ ID NO: 7717 - DNA, 429 bp, Chlorella protothecoides
atgtggacagccgaacaaccatcctcagcaaggggctttcataaacatacacctggcccgccctccggaaaccccacccccaggcgcatcgtccccggcgagcacctggccgtggaccccaagggccgcgcctgcctcatcggcgccctggagaagcagaagttcgtgtacgtgctgaatcgcgacaatgaggcgcggctgaccatcagcagccccctggaggcgcaccggggtcaaaccctcgtctacagcgtcgtggggttggacatgggcttcgacaaccccatcttcgccgccatagagctggactacaccgacgtcgatcaggtgtgggggatgggtgcgaggggtagaaggggcccagggctggggtgtacggagtcggggggaagggtcctgctgtcatggcgcttgagcagggcggcgtag

SEQ ID NO: 7718 - DNA, 300 bp, Chlorella protothecoides
atgtatctctacaacctgaccctcagccgggcctcggccatcacgagtgccatctatgggaacttctctgcccccaagctccaagaaatcatcgtttcacggggcaaggtcctggagctgctgcgaccagacgagaatgggcgcatgcagaccatctgcagcactgaggactacgtgatctgcggctccgactcgggccgcatcatcatcctccagttctccaaggaaaagaatgcctttgtcaagatccaccaggaaacgttcgggaagagtggagccaggtgggcaggtggtgcctga

SEQ ID NO: 7719 - DNA, 429 bp, Chlorella protothecoides
atgacatctagaccctcctcctcttccgccctggtgcccaaacaggcttatcgctgcgtggcggtccaggtggccaccttccccggctacttcctgcctctggccagccacctgctgcacgtcaagctgcggcactgggaaaaggcgctgcgcgagctcgccagcctggccctggcagatctaactcgtgtggatgctgactggctggcgggcacggcgctgccgaccctgctcccactcacagagtcggcggacctggagagccgccacggggcggtggcgggggtcgctgagctggtggcagcgctgccgcgcgaggcgctgacgcccttccatgccgacctggcccagatcctgccgcgcatcgatgccgccaagctgaaccgaggaaaaggcggcgaggtgatgcgcaccgccctgtgcaggtag

SEQ ID NO: 7720 - DNA, 1275 bp, Chlorella protothecoides
atggacgccgctgcgggacgagtggggcgcatcgcctcccatctacagggggagagcccgtcccaggagggcgtggacaatgcccccaccagtgccgacgccttccattcccagtgttacaactacgagcccggtcgcctgttgatgaaccaggtaatcggggtacgggtgcggcatcgcgactgggaacacactaccaccatttccggaacgggagcagtgtcgcgatgcgggggtgtcggattttgcaatgtgtggggagagacttcgaggaggagcagccattggcccgtctccccatgtgccggaatggcgtcatttccctttccattcattccagccccatcccccgttcaggtggccatcatcaccggggcggggcagggccttggcaaggcggcggccatcctgttcgcccagcacggcgccaaggtggttgccgcagacctggagggcgacaaggcccaggccactgccgacttcatccgcaactccaacggcgtggccatcgcctacgcgggcgacgtgacccaccccgacttccccgccggcgtggtggccgcggcggtgggcgcctttggcggcctgcacatcctggtcaacaatgcggggttcacctgggacggcgtgatccaccgcatgggcgccaagcagtggcaggccatgctggacgtgcactgcaccgcgcccttccgcctcatccaggccgccgcgccacacatgcgcgatgccgccaagcgcgagatcgaggccagcggcaaggcgcgcccgcggtgcatcatcaacgtctcctccgtgtctggtgggagggagaatgcggcagtcagtggaccaggtgctcagccccacagggagcccaggactgcagaagaccagaacagtgggtcctccgcagggcggaaggagagcacgcatggcagtgcagggcaggccaactactccaccgccaaggccggcgtggtggggctgaccaagacggtggcgcgcgagtggggcaccttcaacatccgctgcaacgcgctggccttcggccacatcaacacacgcctggtgcaggccaaggagcgcggcgacagcatcctggtggacggcgagcgcgtgccgctgggcatccccggcgcggtgatgaagggcgccagggtggaggatatggtggccctggggcgcaagggcagccccgaggaggcggccgggtccatgctgctgctggccagcccctacgccagctacatcacgggccagagcctggaggtgaccggcggcggctggctgtag

SEQ ID NO: 7721 - DNA, 1569 bp, Chlorella protothecoides
atggcgacgctggacgacagtaatgtggctcggctggaggccaagcgcgactttgcagacttcctggacagcgattacggaagggatacgggcgagggcaagtacgtcaagaagatcgaggatatgatgaagaaataccccaccaccaagaccatacgcctggatgtcgatgtgcaaggtggggccttccgttggggagtggtatcagggcaagggtggcactgggcacggcctgtcggtacaagcgtacttccctggcaccgtcctgtttgcgaccctccactcgagaattcgccgctccagagatcttcctgccccgtgccacgccccagatctctccgagtacaatccagacctgcaccgccgtgtcttggagtccccgggcgactgcattcctccctttgccgaggccctggaggacatgatccgcaaccagagccccaaggtggggcgtggcgtgtgggtggggagacaatggagaagagtgtttgttcgataaaggaatgtctctctaattcagtgtgctctgcccaggagtcggtgttcagtgtcatagccctggacaccttcactcgtcctaggcaccctgaggaggacctcgtgctgctggaggaggggcagagggtccacgtcgggttcagcggcgaatttggccgccacgctgtctccccccgagacatgaactcccaggtacaaccacatgatccctccttatgcatgaccgtgaagacgccccttctcaccacattcgttcctctcttgcctccctccagttcctgtccaagctggtgtcgctgcagggcatcgtcacgcgctgcaccctggttcgccccaaggtggtcaagagcgtgcactggtgcgctgccaccaactccttcaccagccgcgagtatcgcgacgccagctccatcgagggcctgcccaccagcaccgtctaccccacgcgcgacgagcagggaaacctgctgtcgacccaggtggggggttggagggggtttgggggaggtggggatgggagatgggatgggaaggggagaacccgaggtcatacccggtggtggctgctcggtccgagatgtccggcacagccagttgatgccaggcactgctgccggcaacctacacacacgcaagacaccaccggtccctctccctcccgatgcatatccgttcactctgcagtacggcatgagcagcttcgtggaccaccagaccgtgaccatccaggagctgccggagacggcgccccccggccagctcccacgatcaggtgggtggatcgggcgccagggcgatgtgttgggccggcgcccgagcgcccttgcggcagggtgtcgagggcgaccgatcccacctcatgcacgtgcaatccctgcatacgctcttcttctgttgtttgacccctaccttcttttcccccttgcctccccaccgcagtcgaggtggtgctggaggacgacctgcgtgacgcctgcaagcccggcgaccgggtcaggatcgtgggtgtgtacaaacccatcgcgccctccactgccggcgccagctccgctgtgtttaggtgggttttga

SEQ ID NO: 7722 - DNA, 279 bp, Chlorella protothecoides
atgctgcctcggcgtgagcagcaccggctgcagttgcgggaggtgatcaaggagtttcagagattcccaggggatgttggctcctcagaagtgcagggtgagtgccagggctattattcatggtggtcaggaatgtacatgtttacttctacaatggtccaagcgagcaatctcacactcttcggcatcgtaatgctgcgctatgagatcaagtgtgcaaccctccgttcggtttccctcctctccatctcatctcagacaaaagccccagtaccatga

SEQ ID NO: 7723 - DNA, 1131 bp, Chlorella protothecoides
atgtatgcgcgccaggggtacgccaccacttcgcgcaccgactgcggggtctgcgcctgcctgcacgcccggcttctcaccagcttcctggggcacccagtgtgggcccacatgtcgcgccaggtgcccgtccccccggaggcgctggccgccctgccgccggcggccatggcgcgcggcggggcgtcggcgcgcgaggagctggtggaggtcagcctgcacagctccagcgccggcgccgggaagactgccgcgccgggccccctgctggcggcggccctcaagcgccgccagggctctggcggtcaggagatcgcgctgacggagcaacgcatcggggccctggccggcgtgaggcaggtgtcgggggcggtggggccctcaccctccccctcccgcgcctggaccagcggcagcgaggacctccccgccgcaccactggtgctgtacgggggggagggccgcggcggtggccagtcggagggtggaggcggcaccgcagcgcccgtcacgggctggtccgaggggttgggtgtgccactcgaagacaccccggagcctggtgcgttcccagaccctgtgctggccttgccccgcagggaacagggctgcaggaacagctgccacacgcagtccagaatggaaatggggcagctggcaaggtggcccaccgctgccagggacaaggatgttttcatccccggccgacactgcgtctgctggcgaaccaaaagcattatcgacatggcgaggcgggagccccggccaagtcaccaggccccaccgaccgcctggaggacggtggtcgccgcctcttcgacagctgcttccgggatccacagagtgcaggtgcggggcggcaagtccctcccagccgcgtctccttccgcggtgccgggcgccgatgccaccgcagcggcaggcttggaggaggagtccgggctcggctgcacgtccgcgtccgccacgctggcggcggtctccggggctggcgcgccggccgctccgttcgcaccacgcgccccgtcgggcgcggccagggcccgcaggcgcctcaccagctcgtccatccacgcggggtccatcggcgcgggctcggcggcgccgccgggcgcctctgccgctgggccg

SEQ ID NO: 7724 - DNA, 588 bp, Chlorella protothecoides
atggccaacagcgtgtcgcgcctggcggccgacgcgacttcccccaccttctcaggcgaagactacgacaacatcgtgtcgctgagccaggacccggggctgatggagtgcctggccgggtcgctggccccctccatctacggctactcctgggtcaagcgcgcgctgctcctgctcctggtgggcggccgcgagcgcgtgctgggcaacggcacccacctccgcggcgacatcaactgcctgctggtgggcgaccccggggtggccaagtcccagctcctccgcgccgtcatgaatctggcgccgctgtcggtgtccaccacgggccgcggctcctcgggcgtcggcctgaccgccgccgtcaccaccgacgccgacacggggtcaatttgtgggatgcatgggcaggcctggcaggggctggtaggggtcaggtgcacggtcgagcctgcagtccaggaactggaatggtatttgctacccccctcggctctggcgcccctgtgcccccacggcgaaggtctcctcctgatcccacttctgctggcaacccccgcccaacaaccccccacccactcgcgcaggtga

SEQ ID NO: 7725 - DNA, 1122 bp, Chlorella protothecoides
atggtgttggcggaccgcggcgtggtctgcatcgacgagttcgacaagatgaacgacgccgaccgggtggccatccacgaggtcatggagcagcagacggtgaccatcgccaaggcgggcatcatgacgtctttgaatgcgcggcgtgcccgctgcagtctgccagccccaggcacggtcccacttctcccacattccgattgcccatcttccacaccccaccaaactcatagcgtggtggccgccgccaaccccatctatgggcactacgaccgctccatctccatcacccgcaacattgggctgcccgactccctgctctcccgtttcgatctcctgtttgtcgtcctggacaacaacgacgccgcccgcgacagacaggcgcgtcggctctgtggcatccttgtctcagctcacccacgcttatcatctccatcgaccctccccgcgcagattgcagagcacgtgctgggtcagcaccggtaccgcgcgcccggggatgacggccgcaacggcggcgacgaccgctacgtggaacaccgtgttctcgtcgattcgacacaaaattcccagccgggtcaccctggtcgccgattcactgttgcgcccctcgtgctgccgcccctctggaccatcgagccttccccacccacgctctctgatgcaccctgcaccaacgctgtcaccccttccccaacccacctcgcacccagcctggaggaggacgaagaccgggagcgcggcatcacgcccatgtacgtacggtacgatgccagactgtacggcccacgccagcctggcaagcgggagccgctgtccatcccctttttgaaaaagtacgtggcctttgccaagcagcgctttgccgcgccggagctcacgcccgaggcctcggacgccatcgccgagtactacgccgacctgcgcaccagccccgaggtcaaggcgctccccgtcaccgtgcggacgctggagacactcatccgcctgtcctgcgcccacgccaaggtctgtgacgttacggggggttgggggggggggagagtggcgtgctgtggtctggacaacagtcggttcgagaggagggttggagtttggagagcgagcggcggtgatcactga

SEQ ID NO: 7726 - DNA, 618 bp, Chlorella protothecoides
atgtccggccagaagctgcacagtcccggcgcaaaggccatgttcactgcacgggcattcagggcgcccaagctgccaaccatgcctcatgtccgcgcggcggcgacccaggccgtcgatgcccccgccaagaccgctcagcaaggatcatgtgcatcggactgggatggcttcagcacaggtggatgtcccatccatgcccatggcctggcaggtcactgccacccctgcctccctttccccctcgccggcacagaactggagggtggcgtgacggtggtcaccggctcctcccgcggcatcggccgcgccatcgcgctacgacttggtgccgcgggtgggcgcgtggtggtcaactatgccgcctccagcgccgcggcggaggatgtggcgcaccagatcgagggtctaggcgggtcggccattgtggtcaagggcgacctcgccaaggtgtgtcgccggtgcaatgcgctgagagtatgggaggggtggggaggaggttggcttggctggggagcagacctggaacctgggccgggctggtccagggagcctgggaaacattccatcccaggactctcttacagccacctttgttcgggcttgagaagggattaa

SEQ ID NO: 7727 - DNA, 1509 bp, Chlorella protothecoides
  modified_base (390)..(399): a, c, t, g, unknown or other
  modified_base (635)..(644): a, c, t, g, unknown or other
atgcgaggacttggcgcagttctgcgccttcccaggctaggcctgggtggaggtctgtcccacaccctcacttgcctccctcttttgctcgcccctgaccagccacagtcaggcacagcctctggtgtgatggagatcgacatggctcaggggatgccaacgaggctctgtgcaatgtgcaatgatgattgggggatatgtttgctctacaatactataagcattattatcaggtggctggaagcaggcggaaagcgggtgcagcgtgttctggatgatgaggcggcggctttccggcattacatggaagggacagagttcctgcaggcgagcctgctcgagagcatgctggcgcagctaccagaccagcaggccacagagccggaggcnnnnnnnnnnatggacacacctggcaagacgagttcaggtctgatggagaccgacatggcttgggggatgccaacgaggctctgtgcattgtgcaatgatgaatgggggatatggatggggtgtatcgcggtcgctacagggcgcctgctaacaccagaggacgatcctgtttccttgagaaggcaaagcaactcggcaggggaccagaaagcatcgctcaccggtccgtgcttgtgcatccccgnnnnnnnnnntcgctacagggcgcctgctaacaccagagggcgatcctgtttccttgagaagacaagcaacccggcaggggaccagaaagcatcgctcactgagccggagagtgtgggtggccatgaatacttgaccgagcagagtgcagaggcccctcaccgccgttacctgcgccgcgcaagggccggtgggagtgtcgaagttctgctggatgaaggcgtcctggccacagagtatggggacctgtgctccttgatccaggcagggcagatggggtcatgctgggacaaaatgaagctgtccagggatggcagcagcatcgcatacactgtggaccccggggatgggagcgagcggctgcaggttcatgtgcagcggataggcagtgcaggcctcggcaccaggctgccccagctggagggcagcgtcagcatcgagtggagccatgacggcagccacctgtactgcacccgtgcagacgggctgggttggggggtgctcgctgagcaagtccagccagatgcggttctgagggtcatatggggaaggcaaccgagcagcccggcgcgaggagctggatgctgccttctggctggacatcggcaagaccaaggactggaggtacctggtggtgagcagcaacgccaagcgcagcagcgaggtccgagtactggactgggaggccggggagggaccagggagcctccgcctggtccacccacgctcgccggggctggagtactttgtggagcatgccgacggggcacatgtgtttgttggcatgctctcggttggggggtgctcgctgagcaagcccagccagatgcgattctgagggtcatgtggggaaggcaaccgagcagcccggcgtga

SEQ ID NO: 7728 - DNA, 711 bp, Chlorella protothecoides
atgtgggtaccggcctgctgcggcagcagagcatcgcggaccaccagcgaggctgccgcggttgccccgctcacggaggcccccgcccatcagaaagcgggcctgccagtgcggggggtgtcccaccccaagaccgcccccctcgcgtcggctcacgaggaggtaattgggaacgagcgctccctgggcagcctgactgcctggcagctgctggcggaggacgtggccgcccacccgccaagcaggggtgagagcggcggcccggaccgcagcctgctccccagcccctccagcgcacacacagccgccgagctgatcttgggcagcccggagagcgggcggggaagcacctcccaccgcttggcggcctacgagctcctggaggaggtggggtccggcgcatttggcaccgcctggcgggcactgcgccgcggcgatggcgcggcggtctgcatcaagcagctccacaccggcagcatgggctggcgccagcaacaggcgcaacgggttggaggattgccttgtgggcatgatggcgatggagtgacccgagccatcgctgaggcggttcggcccggcaatcaggcagagccacgacagtgcagatgcgacgctaggttggcaatacctgctctgggtcagagcatcctgcaactccttgcctcctgcttccgcatccatgccccctgcccgcccccagactcgggatga

SEQ ID NO: 7729 - DNA, 231 bp, Chlorella protothecoides
cctccccctaggaagtccccgcccccacctcctagaaaggtagccccaccaccccctaagaagaaggccccaccaccccctaaaaagacgtctccaccgcccccaaagaaaaagtccccaccaccctccaagaaaaagtccccaccaccctccaagacgaagtcttcttcctcttctaggaggacttcacccccgcctcccaagaagcggccccctcctccgaggaagtag

SEQ ID NO: 7730 - DNA, 1221 bp, Chlorella protothecoides
  modified_base (160)..(169): a, c, t, g, unknown or other
atggtcccaactccctggcccgggacagggcactggagcctgtgtcctcagagtgcgctcagaagccctgctcttcgtgcttcacggcatggtcacagcccccctcaaccccccagcctgcacccccatctcccttaccctcaacacgcacctcgctctnnnnnnnnnntcacggcatggtcacagcccccctcaaccctccagcctgccaccccatctcccttaccctcaacacgtacctcactcccgctccccccggcaggccagttcccgcacctggaggtcaatcccttccccgaggagaacgactggttcacgcgggacacggaggtcatgcccctgaccggcgcccctgagcccaagcgccgcttcgtcccctccaagtgggaggagaagaaggtggtgaagctggtgcgtgccatccgcaggggctggctcaagctgggcgcgccgccagcggaggaggcggacaagccctaccttatgtggcaggacgacggccaggccagcagcaggactgggacggggctggcctacatccccgcgcccaagccgcgcctgccgggccacgccgagtcatacaacccgcccaaggagtacctgcccactgagagttgtcgcacggctgccgctgcctgcggttccccatcacccccaccccacccgaacaaacagaatccaaccagaagggtcgttccctttgccaccgacccacctccacacaaccctttcccacctttcctcccacccaccatgctcaggaggagctggcggccgtggccatgcagccggaggaggagcgccccgcctttgtgcccaccgccttcccctccctgcgcgcggtgcccgcctacgcggccttcattaaggagcgcttcgagcgctgcctggacctgtacctgtgccctcgcgggcggcgcaagcgcgcgcccgtcaaggaccccagcgtgctggtcccgcacctgcccaagccgcgcgacctgcagccctttccctcggcagagggcctgcgcttcctgggccacgccgcagccgtcacggggctggcccccgacgccagcggcgcgtggctggcctcctcctcccgcgacggcagcgtgcggctgtgggaggcgcgcaccggccgctgcgcggcgcgctgggacctgggcgagctgcagggcgccgagctggggcggggcgtggccgggctggcctggtgcccggaccccgcgctgcgcc

SEQ ID NO: 7731 - DNA, 618 bp, Chlorella protothecoides
atgagccccaaaagagccagtacgggtgcaagaaagccagctaagaatgaagagcgccctccctctgaggtggatgtctccgagctggtgctgagcagcgggagcgatactgaggaggaggacgtggaggccttctctggcgactcggactccgaggccgatgtcgagcacgagatagaccatgcagtcaaggactacgtcggtgccctcaggaggaacgtcggcaatggggctggccagccgccgacagtagacgcttcagaggaagatgaggggagggaggaggctgacgaggccgggtttgtgacctctgagagtgagacgggcacagatggagagatgggcgaggaggagccagcctccccccggccccaggacgaccccgcctccgactcctccgaggacgagcgccccggtcgcaacacggtggggaatgtgcccctcgagtggtacgacgccgaggaacacatcgggtacgacaaggatgggatgaagctggttaagaaggggaggaaggacaagctggacaccctgctggcacggaacgactccaccaaggcgaggctggcgggggagcttgggtcggggcatgtgggatgcatggggatgcttgactga

SEQ ID NO: 7732 - DNA, 807 bp, Chlorella protothecoides
  modified_base (525)..(534): a, c, t, g, unknown or other
atggtatctcgcgtctggtgctacagcctcctctcctctgggtctggacaccagcaccatgcagggcgccactctcggcccccgccggctcgaacatgggggtttccgcgcgcggagagatcgtggagctggatcgcaggtggaatacccaccctccctgccaggggacagtttgatcgccctccaccaatgctcctgaatcacgatctcatgtcaagaccaggtcctcgctcgttcaacatgcaactcggtgcatgcggcacatctcgggcctaccgaacccccatttcatcagcaactcatcgccagaacattcaaccacgggtcagattcgccgaacgaaccctggcgtcgcgcacggcgagccggggcaagggccatccaagggtgggcgcaggcaaagccacccctgtgaccagtaaacctgccaacaagactgccacccccaaaccgctggagcttgagccagttcctctccccttcactcccatgctctatacaggcagtgcatcgcctctgggtgcnnnnnnnnnnctatggctgctccctcgagttcctctccccttcattcccatgccctatacaggcagtgcatcgcctctgggtgcttccccagcagaggggggcgtcaactttgcattggcagctcctcatgccacagcggtaaccctgtgtctctataatgccgacaacagcccccttcaggagctgaagctgcacagtacgggtgcgggtcgggaatgctgcacctcccatccgctacttcgcagctcgggttgttccgctgattgggacatcggtgaatga

SEQ ID NO: 7733 - DNA, 2982 bp, Chlorella protothecoides
  modified_base (523)..(532): a, c, t, g, unknown or other
  modified_base (838)..(847): a, c, t, g, unknown or other
  modified_base (1619)..(1628): a, c, t, g, unknown or other
  modified_base (2369)..(2378): a, c, t, g, unknown or other
atgagcgccctgctcccacctcacgcagtaccagtgatgggggatgccggcttcaagcagaagtttgcgacccgcctggctggctcctcggacctctacaactacaacaagcggtgggtgactgggggagttgcgtggcttcccccgttcctctggctgtgggtccgagtccagctcccttgcctttgctgcgccacgccctcctcccccgcaccctgcaggaaagcctcagactccatcaactttgtgattgcgcacgatggattcaccctggcagactcagtggcctacaacgagaagcacaacgacgccaatggcgaattcaaccgtgagaccacctctttggctctgtcggccgtgggagggagtcagccactcaagacggggctgtggggtcagcgaagctcagtaggcaaccccgccacatgctgtgccatcccttcgcccatgcacccgcacctccggaaattggaggacgaggagaggcagctgcttcacgccaggctggcaggaagtgcatcannnnnnnnnntcatccctttacccatgcacccacacctctgtgcttccttccacataggcgacggcaccaacgacaatttcagctggaactgcggcgtggagggggagacgagtgaccccggcgtgttggcgctacgggcgcgccagatgcggaacctgcacctcgccctcatgctctcgcagggcacccctatgatcctcgcagctgcctggcgctgctgctctagtcaaatgcctcccgtccctgtcgggaggctcgctgggcacttgcttggacaggaatggccacacacggcataccaccttggcatcctcnnnnnnnnnngcaatgggggattcaacggaaagggaacggtctgccgacctctcactccttcaagaagcctccttgagactaagtattccaaattcgtctggtgcttgcaggggatgaatacgcgcagacgcggcacggcaacaacaactactacgggcacgacaccgagctcacgcactatgactgggagaagctggaggaggccaagcagagcgggtggttcaggtgggtcgtctggccgcatgctgagtgccatctgtgtttgcggacttgccaggaatggcggtgtcattctccatgccatggactggtggtatgccagaatgcagctgcctggcgctgctgctctggtcgaatgcctcccggccctgtcggggggcttgctgggcacttgcttggacagggatagcccacacacggcataccaccttggcatcctcaaagcactccaagcgaatcagcctcccacaccacctccttgccatcctcccaggttctacgccggcctcatccacttccggacaggtcaccccctgctggggcgggacaaattcctgggtccacaggacgtgacttggcacgaatccagctgggaggacccagagtcgcgcttccttgccttcaccctgcatgacaggtgggtggggggttggggaggttgggagcgggtctggacaccccacttgcatgttgttgtcagctcctttcagcaagcatggaagcatggacggggcatctctgagtcttgcggaggctcgccgtgcttgctgctctgcggccnnnnnnnnnnagacagggcatctctgagtcgtgcagaggctcgccgtgcttgctgctctgcggcctttgcgccgctgggtgtgtcaccttcagcgctcagccagtcttacctgaccctcctcaatccaggggccaagggggaggtgacatctatgccgcgttcaacgcccacggcttctccgtggatgtggacctcccgttgccccccccgggccagcgctgggcaagggtggtggacaccaacctcccgtcgccacgggacttcaccccaggggtgcgccgctgctcctcctgtcctgagagtcctccttgctcatggcatggacaggggaacacggggtggcaagcgccctgtgctcgagatggatgggatgtgacctccgttgatttctagttgcacacagcggtcttccacgacatcccgcttcatggctagggaaaaattcgcagaatccaatgctctcgccgacatcagcaggcgactcgcagcctcgagtgcctcggctgagaagcaggcgcaaggctctgcaggtggaaccatcaacagccctagaccgagattaaaaaaacagaagaggtctcagggtgagctgccggaaacaattaccagctccctctggacttgcacgtgtgcacatggccagacgctccatagcccctcccaccgccaacctggcttccttgcagggtctgatgaacctttgagctctggaaggcccgcccacagtgacagcttgagggtcactgaacnnnnnnnnnngattaccagctccctctggacttgcacttgtgcatatggccagacgctccatagcccctcccacctccaacctggcttctttgcagggtctgaagaacctttgagctctggaaagtccacccacagtgacagcttgagggtcactgaaccctcaggtagtctggaatccagactcctggcccttgctcgagtggcagacagcaatgacagccccggccagggccctttcagggcagcgggggcggtggcgcaagaactacgcgcttggatccagggcggcagcaccctgcaccaggcagggagtcctgctgccttggaagcggttcgagagctggaaaacgtggcctgcagtctgcaccatgacgccctgggcctttggcgactcagccaggcggccctgcgtgtgcaatgcatgctgagtcagcacatgcactcagaccaagcagagggtcaagcaaccagcgctgcagacaccgaggccttcatctccaggttctatgcctcgttccaggaggagctgggcgccatggaagcggaggggactgatgtcagcccagatgtgcttcgtgatactgtagcctcctgggcatgcgggcccctttga

SEQ ID NO: 7734 - DNA, 693 bp, Chlorella protothecoides
atgggcagtcatgggacgccatggcggtcgtgtctggtgtgtctcctggcagcctcaacctgggctggggtggctgccaggctggccccgtcgctgaacgccagtgcagacctcctcgacctggacgccccccatgaatggcagccctgcgctcgtggcctgcacacctccgacatgacactctgtttcctggggggcgccctttgcccagcccccctggtcggggaggagggccccttgggccttacggccccgttccaccggcgggacccccacaaggacctcttcccactgaacctacgtgacatcatcggcctgaccctggcctccctggccctggccctggcggcatctggcggcctgggcggcggcggcatcctggtgccattgtacctcatcgttctgaggtttgacacctacagcgcggtggcgctgtccaatgtgaccatcgtggggggcaccctaaccaacctggccatcaacatcgggcggcggcacccgctccgcgacgcgccgctcatcgactgggacctcatcctggtcatggagccgtccaccattctgggcgccatcctcggcacctatgtcaacgtgaggaggatggtcgggggtgatgtggtgatggaccggccggctctgacgccaaaccaggctgccatttcctcagcgtccttggccccacctccgatatag

SEQ ID NO: 7735 - DNA, 474 bp, Chlorella protothecoides
atggtccagggcaacccgcttgctcagagacgctgtctttcccaaggtggaacttgtgtcagaatcgctatcccagtccccagcagcttcactccaccactcgccacacccctcctttccaccctcaatgcaggcggcgacgacgacccgtacctgctgtcctggcgtgggatcaatgctggggtgtactaccagcaggaccccgcctcccacgccatcctcaacttttccgggtgtgggaacacggtggcggccaaccaccctctggtccaggaccagatcctcacctcgctgcgctggtgggtggaggagtaccatgtcgacggcttccgcttcgacctcgccccctgcctgtgccggggtcaggacggggagcccctcgccaccccccccgccatcgaggccatgagcaaggaccccatgctctccaaggtggggcggcggtgggccggtggtgggccgggcatgctctga

SEQ ID NO: 7736 - DNA, 606 bp, Chlorella protothecoides
atggtgacgtcctgcatcaggcttcccgggcgcatgtctggaatcaacaccctcctcaaacaccgccatcccgtcgcacccgccgcagaccactcgggagtcgaccgacgagtacatgctgcgcgtgggcgggtttgtgcgcctgtatgcggccttcacgcagtgcgacgccgccaacaacccgcacgggctgaagaaggcgtggacctggctggcaaggtggcgcgagaggggaaaaggctgctccgccccctgagcgctctgtcgtggggctgccgccgcctgctctgtgccttgatgccggggcaaggcacaaggaacctgttcctgaacgccgtgcccgcggacagggccagcgcgacggcgctgatcgccttcctccaggtggcagcgtaccgcctgcaccgtgcgtaccgaggccaggccctgaagctatttgaggtggtgcaccgcgactacctggccaggctgaacgcctgtgaggaccccgacgcgcgagccaacttcacccgcataaagacattcctggaggagagggcgtaccttgcggagccagaggggcgggcgctgccaaagtttgacacgtcgtccatagacagagcctga

SEQ ID NO: 7737 - DNA, 1470 bp, Chlorella protothecoides
  modified_base (43)..(52): a, c, t, g, unknown or other
  modified_base (1256)..(1265): a, c, t, g, unknown or other
atgcagcgcgctctgcccccaaggtgggaaatggtccgtgtgnnnnnnnnnnccctctctcaagaagggaacgaatgcagcgtgctctgcccccgaggtgggaaatgggagaccttgccgcccaactcttgcggtcctcttccacctctgggtcgctcttgggtagcaagactgggatatctgaggggctcagatgtggcagctgtgtctcgttactggctaagagggtgcaggccagtgggcctttccggtccttggtcttcagagccttgcgttgtggaaggaggggtaggagaatctgacagtacctgcctcctactactcagcaacattgctgtttgggccgaagcatgggtaggaagcattgatggtgctcaatcccaggctggcagtatcgtcggtggcatagggaaggccaggaatgagtggaagctcggctgcctatcggatcgtgtcggagagttaatcgagccatctagatgcaacaagagtgcccttcccagtgtgctcgctggatgcgcttggtcaaggaccgggcatgcggcacagcgccagccagcccacccatccgcatgccgcccatttgccgcgcagaaggcgcttcaagcctccatcacacagtcaagctgtcgactcagaccttccaccgggatccgactcgccgtgaaggccgtctccagcacggaggtggaaccggtggccagcgccttcacccagctctctgcgggcacggggcgcaagtacatcatggtcagtggcaaggggggcgtcggcaagaccagcctggctgcctccctggcggtgcgctttgctgaggagggtcacaccacgctcgtggtgtccacggatcccgcgcactcgctcagtgattccctggcccaggtgggcggagcgctgtttgcttcttggatggctccggtgtgcggctgtgcttgctgctccactgcgcaagggacagaggttgccctgtggcttgtactctcccatgcgcatatgtgtattttccataacccgctcaccctttggacccctcccaatcaccaggatgtgagcggcggcatgcctgtgatgctggagggcacagagctcccgctctgggcgctggagatcgacccagaaagggaaaaggccaagttcaaggcctataccgcaggggggcttgaacccatcgtccgagcaggcactggcgcatccagctcgaaagcacagcgtgcttcccagtgctgcctgagcattcatattttgtcagggcaatnnnnnnnnnncacagcgtgcttcccagtgctgcctgagcacacatatttcgtcagggccaagcatcctctcctgtgcccatcttcccccgccgccaggcgatgggaagcaggaggtcaaggacttcatggggggctttggcctgggaggcctgctggagcaattcacagacctgaagctgggggagttgctggacaccccccctccgggctttga

SEQ ID NO: 7738 - DNA, 918 bp, Chlorella protothecoides
atggtatacggcgccacccccttcagccacctgcccttcatccagaagatgcacgccatcatcgacccgagtcacgccatcgccttcccgcccctgcccaaccccgcgctggcagaggtgctgcggcgctgcctggaccgcgagcccaagacccgcgtctccatgcgcgagctgctggcacaccccttcctgcgtcccgtcacggccgcgcccgagggcgccggcggcatgcccgccacccccgcgccgcgccgcggccgcgtcgagctcagcgtggagcagctggagcgcctgatgctcaagctggcgcgggcgggggtgggcgcggagggcgaggagctcgccacgctctcccagcaggtgttcagccagctcagcgcggggctgtccccgcagctgcccagcacacgcagcgtgggcagagcggcgcggggcggcgggtcggaggcaggcgatggggcccagaggggggtgatgacaggcgcggggcccagtcggcttgcaggcgggggggctgggacgccggaccccggtcctggggccgcggtctcgccatcaactgatgccccaggctcgtctgccccggggccgcaaggcagtggagtggccgcccaggcggcgagggcggccgcctcgcgggcggcggcgcgcgccgtcgcgctcgccgcgctggaaagcggggcgtccgacggcgcaacatcaaagaccaccgccccgcgcgccccgctgcaccccatctcgcagacggcgctggcgacgcaagcggctgcgctacgccgtgtcaaccctcaggcggccaagccccgcgccgcggagccggcggcggggtcgctggaggacaagctgcggcgcggcttgcagcgcttcaatttcgagggcgtggccgacgctgcgcagggtacctccggcagcccctga

SEQ ID NO: 7739 - DNA, 738 bp, Chlorella protothecoides
atgcaggtctacaaggtgatggccccgaaccgcaagatattcgccctgaagcgcatcaggctcaccgtgagtgtgtgttcgtttgggtgcggtgaatccagctacgatggacttccttgccgtggcaagggcgagggctgcatggattggggggtcttgaggttctgctgcgccaagggccgcgactccgaggcggcggccggcttcatcgacgagatcacgctgctcaactccctgcgtggcaagtccaacatcatccagctcatcgatgcagaggtgagttgggagggaggagggaagcggtggcctcttcagtcgcacaggcccagggagagagggatggttcaggccctgtgccggccgcctggcaaggcagggctgatattcagctctgcatccggccattttccaccctgctgtcttctcgatccaaggttggcaaccctccccaaccctcccatttcccaccccccgtctttcaaaggtgtaccgggccgagggcataatcttcatggtgctggagtgcggggagatcgacctcgcccgcctgctgcagaagcgcgaggcggcgcggaaggaacacgacggcggcgctgcatcgctcgacgagaacttcatccggctgtactgggagcagatgttgcgagtgaggatcggaaagaggggagggggggcctggaggatacagccaaggcagaggagccagggttccggcgctgccttggcgtgcaggggtga

SEQ ID NO: 7740 - DNA, 2427 bp, Chlorella protothecoides
  modified_base (26)..(35): a, c, t, g, unknown or other
  modified_base (628)..(637): a, c, t, g, unknown or other
  modified_base (1422)..(1431): a, c, t, g, unknown or other
  modified_base (1860)..(1869): a, c, t, g, unknown or other
atggagggttgggaggccgggcagcnnnnnnnnnngagtgagaggagtggagggggccggggaatcggtgggggggaggagaagagagggaacattcaacgtggggaccaaggcaaggttgggacttgcggcaggatggagggttgggaggccgggcaggagggacgtgccaaggagaggctggcatggtggaaggggttgcaggatttgccggggggccccctgccttccgtcctggcattcagctgtgacgggcagccggaggggggactgctggtgcgccagggcgccgacctggacgccatggcagcgccagacaggtggggttctgagggagcaaggggaatcggtgggaggcgggacaatcgggtgacgatgtgcgcggcagacaccgtcctaggtgcgcgcctgggcctgctcggaggcctggcgatggcgctcatcgtgtctgtaagcaccgacgcgcatgctgctccctgcccgtcctccccacgcagcatgctgtacgagctgacgggggtggtggcccacgtctgtgacgccgacgagtcgctcgagtggggcacggacctctacgaaggtcacctggtggcgcacatcaaggtcagggcagggggcccgtgtgtgnnnnnnnnnngctcgagtggggcacggacctctacgaaggccacctggtggcacacatcaaggccagtgcaggggccccgtgtgttatgcgtggacagcaagccctctctggcccatccaccacatctgcaggccatgcatgcgtgcaccagccgccaatcaggggtagccaaggggacgggaacgtggttgtccaccggcctgcggccatggtgtcggcccacagctgctcccagtcttgtctgcaggttccgtggaagcagggcactggcggcgggcaaggtggtgcgccagcggcgcctgggccccctcccccagacgctgctgggctcccgactccacacccgcctgcgccacccgccccgcccgcaccatcagactggtggctcttcaacgacttcagcatccagcccgtgccggcggccgaggcgggggagctgtacgacggccagaaggtgccgtgcctgctcttctacacgcggcgggccgtggatgccgaggagcgcgcggctcgaatgcacgaggaggaggggctgctggatacgcgccccaccccggtgctgtcctcgctgggcttccaggccctctgccgcatctcacccctggtgggtgggtgatggcggcgatggcggtgatgggggagtgaggagtggccgatggtggggtgcagggctgagccaaccgaacggagcccaccggcatgcactctgtgcgcgccagaggcgccaccaaacctcagcgctggtgaggacctcgctgcacccgcacaatctcaccaccgccccatcccccatnnnnnnnnnngaggcgccaccaaacctcagcgctggtgagaaccccactgcacccgcacaatctcaccaccgcccatcccccacccgcaacagggtctgcgggccaacctgcgggcgccgaccttcctgccgctggggccggacgagctgccgcggccgggcatgctgctggctctggacgccgagttcgtgtcctacagcccgccccagtacagcctggtcaggtgctggacggtgctttggtgcgggagggtggctggccgggggtgaagtggagctccacaatgcgctcctcgaaggccggctccccgtgcagggtcccttcggcccggacgccgccgcacaccgctccacacccccctgctctcgggggtcgatgcaccgcccctcccgacccctctccatcccctggacttcccccccactccatcctggcttnnnnnnnnnngctctcgggggtcgatgcaccgcccctcccctcccctctgcaccccctggactcccccccccactccgccctggctccaggggcatggaggtcaccacgcggcccagccggctgggcctggcgcgggtgagcgtggtgcgcggggagggcgcgctggagggcaccgcctgcatcgacgactacatccgcagcccggaggcggtgcacgactacctcacgcgcttcagcggcatcgtccccggcgatctggaccccgcacgctcgccgcactgcctgaccacgctgcgccgcgcgtacctcaagctgcgctacctggtggactcgggggtgcgctttgtggggcacggcctcaagcaggacttccgcatgatcaacatcctggtgccctcggagcaggtgggtgggtgcttgggggtgttgcaaggcgcgggtgggagccgttgcatcggggaccgaggcaccgagcgctctgctgcgcatggcacccccacgtcgaggttgcgtgaccggacccgctggccgcccctgttcgcgacgcaccgccaaacacacgcctga

SEQ ID NO: 7741 - DNA, 261 bp, Chlorella protothecoides
atgcgtcagctgagcctgcgcttcctggcctcgtacctgctcaagacgtccatccagtccggcaaccacgactccatcgaggacgcgcacaccgcgctgcgcctgtacaaggaatatttgaggctcgaggcctctggagcgctggcctggaccctggacgagctgtacaactggggcaaggcgtttgggtgggagccggtggtctggaaggggggcaaaccccacccccaaggccctgcacccatgcctgtgccgccctga

SEQ ID NO: 7742 - DNA, 537 bp, Chlorella protothecoides
atgtccgtgctcgaggacgtggtggccctggtgtgctgcgccgacgcggtcaggaacgccaggcaggccatccaggctcgtctgcgagagcatggggcccgggtggtgcagcgcctgagcaaggacgtgtcccatgtcgtgttcgagcgcaagcacgtccccccctctgccaagagggccgagccggatgccgacctcctggagctttacaccaagctggacaaggggaaagtgtcgagatcgagcgccctgcttccgagccctccatgctgtacgagtctcgaacatctccagtccacctggccgcagttcgctctccctcccacggtcgtgaccccgctgtgggtggagcactctgccgccaagggccgcaggctcctggagaagaagtacatcgttgccaggcccaaggagtgcttgctggctccatctggcacaccccgcgccgcctcaggtgggcttcctggtggtgtaaggatgtgtgtgtgtggagtttccccgtacacctggcatgacccctccctcggccaacgctag

SEQ ID NO: 7743 - DNA, 1998 bp, Chlorella protothecoides
atggcaggcacgtgctctcgtccggcccagggtggatgttgccttggcgtgggacccagcaggcacggggcatcccctccttgcggcccagggcatgctccttcacccacccgcagtgtcgatgaccacaaccaccccctcccacacacaccgccgcctgtgccaggccgagactgcttggtgctcatgtcgacgggcagcggcaagtccctgtgcttctgccttcctcccctgctggctggcggtcacggccccggcgtggccctcgtggtcagcccgctgatcgctctgatggaggaccaggtgcagggcctgcgtgcgcggggtgtccctgccgccgccctttcctcctcgctccccacccagcagcggcgcgacctgctcgctgacctacaggcgccgcggcccgagacgcgggtcctgttcttgaccccggagtacctggccaccgcgccggcggacgcgctgctgggcgggcttgcggccgcggggaaactgaccctgtttgcggtggacgaggcccactgcatcagctcctggggccacgacttccgggccagctacaggaagctgggctccctcaggtcccgctttccagaggtgcccatcatggccctgaccgccacggccaccgccagggtccaggacgacattgtctcccagctcaggcttcgtgacccggtcaggctggcctcctccttcgacaggccaaacatacactactccggtgggcggggcgacgcggaaacgcagagtgcaggggtgggggggggagtctgcagtgcacccgccgaggtgcctgctgggctgtgtcctccgcaggcacatcaggacgggccttgcagctggatggtcgtgtacctggacatggccgcctcaacaccgttcctgcccgccacccccgcccactccgccgagggaacctccccccgggagcagtgggtcgacgacgacccagcgccgcacgtcacgcgcctgctgcagcagcaccgaccgcgcgcggccattgtgtactgtcgctcccgggagctggtggagagcgtggcgctcgcgctcgccagggccggcacggcggcgcggccctaccacgccggcctgggcgccgcccagcgtgccgagacgcaggccgcctggtcggcgcgccagctccacgtcatcgtcgccaccatcgcctttggcatgggcatcgacagaccaggtactggcggagtggagggcgatggggatgtgcccggagtgcaggggtgtgaggacaaagttgtgggttcgggtgctcagcttgctgccactctgtggtccctcactccccatcctcaccacacgccgccgtccttggaactccatgtcgatgcagacacccctccccccccgcccccccttccaccttctacagatgtggacctggtgatccacgccaccctgcccaagtccctggagggctactaccaggagagcgggcgctcggggcgtgatggctcccccgcccgggccatcctgctctgctcccaccgggactgcggggcgctgcgctacctcgcggccctcgagctgcggcgtgcggcgcagaagggaggcggggccgcggggaggagtgcggtgggcggagtgcgcggcgcgggcgccggcgatgcctccgacgacgcctctcgagacgcctccggccccgtggtcgactactgcctggtggcccgctgcaggcgccgggcgctgctcgcccactttggcgagtggctgaccgttggatcggggaaggccggcgaggctttgggccacgggtgctgcgacgtgtgcgacgcgcccgccgcggttgccctggctgcgcgggcggcggccctgggccccggcaccacgccgcgcctcgcccgccccgggcacacccgggaaggcagggccccggacctcctggactttgagcgggagcggccgcacgagggcttggactttgaggacgacccggacaggcgggaggcggcgtgcgaggtgcagcgcgcgcagagc

SEQ ID NO: 7744 - DNA, 1074 bp, Chlorella protothecoides
atggtggaggctggcgttcaggccgagctggagagcttgagggctcgcctggcacagtctgagctggacaaggcagccttgcagtcggacgtggagatgctgtgcctgcagaccacatccaacaccacattcaattcctcatctgtcctgcaagaaagaatccgggcagccctggccgcctcccaggcccaggcctccagcctgggggaggacctgcgtgccctgaaggctgcgcaccgagacacgggcgcccggctgcgagacgccctggaccggtccgccctactggaccgcgagcttgctttctaccagacctcctccgcccgggccgcccggctggaagacgcggagggccacgcggcgacgcagggcgcggcgcgcttggccgccgaagagcgggaggcggtcctccgggctgaggtcgcgcggctggaggccctggcggcggaggcggccaagctgccgggcctgagggaggagctggctgcggcgctgcggcgggaagctgccttggagcgccggctggcgcgggccggggaggaggcagaggacctgcgcggccggctggaggaggccgcacaggccgcggccgacgctgcggcggcctacgagcggcagggggccgagctggaggccgagcgcgacacgaagagaggggcgcaggcagaacttgaatcggcgcggcgccagctggcgggcctggaggcggagctggcggcagcggcggcgagcagggaggccgccgacgcggcgctggtccggcgcgacaaggaggcggtggcgctggaggcgggcgcagcggaggcgcggtcttcgctggaggaggtcgcggcgcagaaggtctcagccctgctgcggctgtcggaggcggagggcctgttggccaggtacaaggagcgggtggcgagcctggcggcgagcctggaggcggcgaggcgggacgcggcggcgggggcgccgtcggggaacgatagcgcgcactcctcgcccagcaagcctgccaccagcccggccaagggccgcgccgtgcctggcggggggtggtggggccgcagcaacagcctcgagccctga

SEQ ID NO: 7745 - DNA, 870 bp, Chlorella protothecoides
atgcgtcgggcaaggagttgcctggggcgtggtctccgtcaaatgatggccacaccgccactaggtgtggcgcaggccaccgagcccctcgcattgtcaaggcccgctgtaagaggcctggcatccggcacgcccatcacctctagaggggtgagtgtgggtggagctccctttgagggtgcaggtgtccacctggcgctcaccctcggcaccggagccggcctaatgtggtactttggccagcagcaggagaagaaggtggccagccaggccaccgtgggctccaaggtggcaggcgctgctgccatcggcggccctttccagctcatggaccagcatggcaagcccttcagcgacaagaacttgctgggccagtggagcctgctctactttggcttcacccagtgcccagacatctgccccgaggagctggagaagatcgtggaggccaagaacctggcaggttcgcggcccggtggcctggcgaggggaagggcagtccctgctgggcatgtgccatcgccggccggctgtgtgcatcatacgcctgtccgcggctgctggtgtctcgcgctggttttgaccacgctccacaatgctctccacttggcaaccacgcatgcagagaaggctacgggcaagagcatcaccacagtcttcatctctgtggacccagagcgggatagcgtggcacaggtggcagagtacgtgaaggagtttgacccaaagatgatcggtctgaccggaaccctagaccaggcatgtttgactcaggggcccttgggggtgggaatggttgattcgaggcttatcattggggcgatggcagattgcaaggggttgatccaggaccatgtggaacatgactag

SEQ ID NO: 7746 - DNA, 1566 bp, Chlorella protothecoides
  modified_base (1177)..(1186): a, c, t, g, unknown or other
atgacgggcaatcggtccctatacgaagtgctgggcctggacagcacagccacacagctggccgtgctcctccatccagacaagaaccctggtgacgaaacggccaatgagaggttccagaccctagcgcgcgtatatgctgtgctaggggacgaggaaaggcgcaagctttatgatgagacaggtgtcgcagatgacctggaaaacccctcagccggatcttttgaagatttattcgatttttaccgctccatgtataaggaggtgcgctggctgggggagctgggtgtgaaacgacctggcccggttcggatttggagtgaagggtgccagaatttgcacccctgggttgcagcatctcaacatgcgatccgccaaacccaagaggctccatgctgcgtgcaggtcacagaacaagatctcgacgattttgaggccaagtatcgcgggtctgaggaggaaaaggcggatgtcttgaagtactatgaccaattttccggggacatggacaaggtgtttgcatgggtgatgtgctcggaccctgggcatgatgcacaccggtttgccgacatcatcgccgacggcctacggactagcggagaggcaccctccaagaagtttgcggcttgggagaagaaaatgaggaggcgtaaagcccccgacctggcaacaagcgtggccaagggaggtggcagcaagaaggagaagacaaagggcaacacatcggatctggtggccctcattcggagaagacaaagggcaacacgtcggatcttgtggccctcattcggtgagtctttagggttagggactgggcagttctgggggcttggaggcgtggtaactagctggcatactcgcccatctccttccacccacccctcccatgctacattgcgaaggtcaaggaggagcggcggcccatccttcatcgacgccctggcttcaaaatatggtgtgaaccccagcggtgaccccgagcccagcgaggaggagtttgcagccgctgcggcgaggcacagggacagggctgcgggacaggggggagggactctctccgcaactgtggccgggagggcgccacacaggtcaggcactcaggggtcggcgggcatgtggttgggcagacataagtgtggcctccctttggcattcaactccaacctaccgaccaggnnnnnnnnnntgaagtcaggggagggactctctccgcaacgtggccgggagggcgccacacaggtcgggcactcaggggtcgcgggcatgtggttgggcagacatggtgtggcctccctttggcatccaactccaacctcccgaccagagacatccaccctcgccggcctaccgcgcccggaggtgcttctccaggctctcagccacctccgccgccatcatgttcttcccgaaaaaggtgacaaactcgccctgggggttgagcaggtaggtgataatggagtggtcgacgaggtagtccttctcatcccccgtcttgctgtggtacacgcggtatgcgcgcgccgcggcgttggtctgcggggcggggatatatcaagagtcaggtag

SEQ ID NO: 7747 - DNA, 975 bp, Chlorella protothecoides
atgacgtcagaagctggccctcttcccgaggcttctgaacggaatagccgagatgcatccacctcaaagccatcagctgatcccgaaggcagtaccatcgtgtttgcgaaacgccggaacaggggcagcatccggaagaagcccacaagcgaagcaggaggggagggcgcggaggctggtgagggacttgctccgctcataaaacggccggcgaggactcaggctccggcccagggtacggaacagccggcatcgggcgggcggccgtttgcattcgaaagcagcaacactttgcagcagtctcaggacggtggggccacccggaacctggagacggagacggcccacgaccgggatgccaggttggtgggtgggaggttgcatgatgtgggtgtagggaacagcatcgtgctcccagtcagggtctgcatgtccagtgcttcctggctgcaggcaatcattcagtattcccatgccatgccacgtactccgggttcccaggcgtccattctccacctccgccaccctttccttcacccctcacatcaccccagggcgctgcgggagcaggtcctggcccagcaggcggaggagggcggcgcggagggggccacgtacaaaggcatgaacaactaccgcgactaccgcgccggcttccggcgcgagcagaccatcggcgcggagaagggtggcggggcgcacggccccttgcgcgcctccaccaacgtgcgcatgacggtgcgcgtggactaccagcccgacatctgcaaggactacaaggagacggggtactgcggcttcggcgacgcctgcaagttcctgcacgaccgcggcgactacaaggccggctatgagctggaccgcgagtgggaggagaagcagaagagggagcgggagcggctgctgaccaactgggcgggcgcgggggaggcagaggcttcggggtgggggtgggaggcggaggcggaggactag

SEQ ID NO: 7748 - DNA, 354 bp, Chlorella protothecoides
cgtgggccacggtggacagcgacgcacccttgcggccctgcagcgcatctatacctggcaaggcatggagaaagacatcaggctctttgcagcacctgcgacgcctgtcaacgaaacaagccttcccaaggcctcagggccggacttctgcagcccctgcctacgccagactacccttggcagcacatgaccctggatctcatcaccggcctcccggatacgcttccaggatacaacgtcgttgtcgtttcgtggattgctgtaccaagttggcaagttggtgcactacgtgaccaccaccaagactgttgtgggggcgggctggcccctacaccggtggaactctgtatatga

SEQ ID NO: 7749 - DNA, 378 bp, Chlorella protothecoides
ggaggcagcgctggacgccatgcgcgccgcgcgcgccacggggcgccgtccaggtgtgcaggcgcacaacgcgctgctgcgcacgctggccggcggcgcgcagtggcgccacgcgcgcgcggtgctggagggcatggccggcggggaggggccggcgccggacgccgcctcgtttgcagccctgatcctggcgctggagcgggggggaaagtaccaggaggcctgggaggcgtacaaccagctgcaggcaagagggtgtggaagtctatgtgtgggatggtgggtgtgggtgggaggagggttgataaagtggctgcaaggggccctgatgaagctttggctgaactcaggagggtgtctggcgctgtgggtgcctga

SEQ ID NO: 7750 - DNA, 1359 bp, Chlorella protothecoides
atgagcctggactgctcccacccggactgcggatcggaatggggtgcgcctggggacctcccccgtcgaagggggaggtgggcagcgtgcggcggtccctggatgtcatgcgatgcgattacatttgtaatggatgatgtaaatagaacaggaggtgagatgctacccagactctcggctcgtttctgcacgttgcgatgggagatcggcccttactcaccaccacagcagcaccggccttcccgccagtccctggtgacagcaagccgttgccctccttgctgcgccgcttcaccacctctactcaccgccggcgcctgcgccctgattcggatacaccccttcgacccacctgatcaagaggcagaggcatccaacccgcaaggctgtaagcctggattgaagttggatcacctgagatccacgatgtcgtcgatcagcaacgcgacgcccgaggactggtatgtgatcaccaccctagcccttccccacctcctgtatgcctacatctggttcaacagctcgacatggctaaaaacgttcggaaagaagtctgttcaaagattcgagacagcagcttggctcctcaagggtacgtcgccggggggtgaggccagtggtggccgactttgctggaacccctctctggagagtggcctcacctgctcacagccgcgcacccctcacctcactctggagcttgcagtgctgcaattctcctcggtgatctactggtacagcgtcaaaaagcctgagggagtcatcctggggagcatttccccctttgcggctggcatctccctggtcttgctggctgccggccaggtaccggggggatgccatttgccatgggagattcctaggcggccagggacgacatgtgtagtgttttttgctgtttcaagtacaggaggatgtgcatcgtgccaaacccttcttgaggcggctcacggcaccccacccccacccgccccctcatgccaggcgctgaacatcggcatctaccgtgcaatcgggcacgccggggtgtactatggcttcaagctggggcacaagtgtgctgagcgtgtgggcggctgcgatcctggtgtgggcccaggggccagcaggcctgggcttgcttgtggcctactggaccggcccttcgtcccttttgtggggctgctcgatggcagagactcagagcctatgccacggagctcagcctctccatgctttctgaagtcaagccaatccacagcctcggctgtgagatgcatgtgcttttttccccgggtgctttgcagtgacaagctctttgctcaccccgctcgctttcatcttacgctttgccttttctgctttgccgaagcgatttga

SEQ ID NO: 7751 - DNA, 1971 bp, Chlorella protothecoides
  modified_base (407)..(416): a, c, t, g, unknown or other
  modified_base (520)..(529): a, c, t, g, unknown or other
  modified_base (820)..(829): a, c, t, g, unknown or other
  modified_base (1621)..(1630): a, c, t, g, unknown or other
atggtgggaaaaggggtcgcatatcccaacgcaaacccagtgtatgctcggcagctggggcatcacattgtcactaactctcggcctgtcaagtacacgagaaaatggtggggaaaggggtcgcatatcccaccgcaaacccagtgtatgctcggcaactggggcatcatactgtcactgagtgggttgcctccctttcaaggcccctcctccacacatcctcgctctcagctgggccaacctggcgagcgtggacgccctcaccaagctggtccccgccgtgctttccacgctggccatgatcatgaccatggagcacttcaaccacccgctggcgctgtccggggtactcacggccatcgtcctcgcgttccatgcggggcgcctgctgctgggctggagcctgnnnnnnnnnngctcacaaccatcgtcctcgcgttccacgcggggcgcctgctgctgggctggagcctggaggatgccatggacaagggctgggtgctgaggccggcgggaccannnnnnnnnnaggggggttacggtgcgcaaccttcccatcatgcatgtggggtgacgctgcaagggaccaggggcgctgtgggatggaccttcttcttgggtggggtctgccaaccggatttagcagactttgtcgccgctgtgtccttgggctggtctgaggaggtgcagcgccctcattctaacagatgcggtccgtcggacccactcgatccacggatgcacctgaatgataccccccactccttgcaacccaattcccaggaaggtaagcaggagttctgggagctgtggtctctgnnnnnnnnnnggcaggtgcagcgccctcattctaacagatgcgatccgtcagacccactcgatccacggatgcaactaaattataacccccactccttgcaacccaattaccaggagggcaagcaggagttctgggagctgtggtctctgttcaacatccatgacttcaagctggacggtatcttggtctcggcgggtcttgcccagataggcaaagtaagtggggcgagggctgcatgctatgcgcttcgtgatgggttcccatgttccacaggggtcatgaaagtgggaatacgccacagccgggcccctgctccaccaaccacgccgtgcctcgcgcttgccccgcagctggcgggcctgatcctggtggtgtgcttcggcagctgcatggacgtggctgccatccagcaggacctgccggagcgcattgatttcgaccacgagctggtcaccgtgggtgagcaggggattcccgaggcatgggccatgccctcgagagttccccggctccaactgccctttcaatcccccaggagtctccaatgtgatcaccgggctgactggcattgggtactgcggcagctacatcttcaggtgaggcagcgtatgtcagaggttcggcttgccctggttcctcattcaggagcctgtccagcctcagatgcccgtcggctcagaatccagcggtggactcgcggcctgctgctgatggatgtatggctaggttcgcatcccagggcctaccccaccacccctcccttccctctgtccacccaacagccagaccatcttcacgatnnnnnnnnnnccagatgcccttcggctcagaatccagcggtggactcgcagcctgctgctgctggacgtatggctaggctcgcatcccagggcataccccaccacccctcccttccctctatccacccaacagccagaccatcttcacgatgcgggcgggcgtcttcagccgctggaacgggatcatggtggcggccgtggagctcaccatcttcctcctccccttctccatcgtccaggtatgcggggtggcgttcttttgtagccaaggtctgcagtgggctcactcctcgcactctgggccttccgccgggatgcatttggagctgcgggttgcatcctgccgcctag

SEQ ID NO: 7752 - DNA, 360 bp, Chlorella protothecoides
atgcccaacttcttcttcggcgcgctcctggtctggtttggcgtcgagatctcgcgcgactggctcttcctttctttctacaagctgacgcgcattgagtacggcgtgctctggctcacctttgcctttgtcatgcagctgggcctagaaggcggcatctttgccggcatcgtgctggccacgctctacttcacctacgcctacgcccagagccagatcagcggcctcaggatcttccacaccatgaccagcaacgtcgttcgcaccagtgaggggggcggcggggcctgggggcgcggagggtggggagcgacgggtttgctggattgcaggcgctgccctgcacactgcagcgcatga

SEQ ID NO: 7753 - DNA, 1836 bp, Chlorella protothecoides
  modified_base (737)..(746): a, c, t, g, unknown or other
  modified_base (1070)..(1079): a, c, t, g, unknown or other
  modified_base (1440)..(1449): a, c, t, g, unknown or other
atgctgttcgggtcagatgtcagccaggaggacgcgtttgcgcagctggacgccgcgcatgaggcgggcgtcacgtgcttcgactccgctgagatgtatgcggtgccccccagcgcggccacctgcggcgcctcggagcgcatcctgggcgcctggctggcgcagcgcccacaggcacggcagggcgcctgcgtagccaccaaagtcagcggcccgggggccatgccctggctgcggggcgggcccagcgccctagaccccgagaacatcaccctggccattgagggcagcctgcagcgcctgggggtggactgcatcaacctcctccagctgcactggccagacagggaggggcctgagggggttctgggggggaccatggagaagagggaggcacgatgcagcacggggtggtggacgcaggaaacaagcctcaagcacatggccgcaccagcgtggtacaggcagggctggcttctgtccacccctacaccactgttcaccggaaagatgcctggcattgagagaaaggcatggcgcctggcacaggtcgcgctgccacagtcactgtcagcgcaccgtatcgccctacatgcccttgcatcagatagaccccacttgtgctgccgttgccacgccaccactcacaggaatgtgcccatgttcggcaaggtgaggtttgacccgaccggggactacccctcttgcgccatcgaggaccagctggcggccctggnnnnnnnnnnagcaccgtatcgccctacatgccctcgcataaaacagaccccactccgccatcgaggaccagctggcggccctgggcgaggcagttgcggcgggcaaggtgcgccatgtcgggctgtccaacgagacaccctggggcctcatgcgcttcctgggcgcggcagggacctcgctgcctcgcgtcgtctcgctgcagtcggcctacagcctgacctgccgctccttcgaccacgggctggcggagtgctgccaccgggagggcgtcggcttcatggcttacagccccctggcggccggcctgctgaccggcaaggggaggcgctccnnnnnnnnnncaggtggacttggatgtgcatggagggtttgggagatgtggtgggtcgggcaggcctgggaggtgcgaggatgggcacaatagtgttctctgggcaggggattcgtggagttcgagcagatcgcctggctgcgatgacagtgatggtggcctgtagtgggttgagaggtgcagggggaggcgctcccatccctgggctgctatatcggctcgggtctgagtgctttatgatcacagctctgcgccagaatcgcacggaaaggctgccacagcgatggggccatggacgtctgcacaagtttcagccccacgaacctcccacactgatacctgcacccaccccaaggttgaatctccatcgnnnnnnnnnnagaaggctgccaaagcgatggggccatgacagtctgcaccagctccagccccacgaacctcccacaccaatacgtgcacccaccccaaggttgaatctccatcgggaacggtattcagaggacggcaagcggtatgcacgccgggaaccggtggtggcggccgtcaggcagtatgctgagctggcgcgggagtggggcctgacgccggccgaaatggccctggcctgggtcctgaataacagcctggtcaccaccgccgtgatcggagccaccagcctgctgcagctgcgggagctcatcgccgcggcagaggggcggcccctggaccccgggttgctggccgcctgcgacagggtgcacgcgctgagccccaaccccacgccctga

SEQ ID NO: 7754 - DNA, 2574 bp, Chlorella protothecoides
  modified_base (161)..(170): a, c, t, g, unknown or other
  modified_base (820)..(829): a, c, t, g, unknown or other
  modified_base (2238)..(2247): a, c, t, g, unknown or other
atgggggcgggggatcgtagctacctgatccgggacggcgagatcaacgtcatgcgcaatgtgctgggggggatggaggacgcaggtgtggaaagtgggggggagggaagggggttgggaggggatccgtgcactctcagccccttgcaactccccggggnnnnnnnnnncatggaggacgcaggtggaaagcggggagggaggggggtgggaggggatccgcgcactctcagccccttgcaactccccggggtgtgggtgccgagcacattgaaggcaatgtcttttgcgctcgcatgctcacccttcctccctcattccaccgccccagcggtgaagctgtcttttggaatgcccgagtcggggggcacccccgggacgggccggcgcagcactcggcgctcatccctgggccccgcagccgcctcgggcggcggctcgctcacgccctcgcgcgcgctgctcatggcagccgagtccaagatggccatgctgacgccgctgcgcaagtccaacctcatccaggccgacatcgagacggggcgcgtggtgagtgagtggtccttccagaaggatggtgtggacatccccatggacgacatcgtgggcgacaccaaagcctcgcaggtgagaggggaagggagggatcctggcggtagtgttttgggggtagagcagggggatggcaaggggtccccgggaagtggcacatggcatgtgggcgtgctgactggcactgtggaccgccaaccagcgctggcaaggcagacccctgcacgccaaacgccatgtgctcttgatgccctccaactcgaacccnnnnnnnnnngctggcacagtggactgccaaccagcgctggcaaaggaccggcagaccttcctgggcctgggcaccaaccggctggtccgctgggacatgcgcgaccgggcgggggtggtgcaggagatggggtcgccgatcgtgcagtatgccggtggcaaggactatgcgcgcaacaccaacttcacctgcatggccaccagcggtgggtttctgggagagaggggagagtgtttctgctgtcagagagggagaaccatccaggacgccagtctcagagcctgggtgagctgtcgcccagctcatggggtcgccatggcatcgacaaaacaatatgccctgctgccttgtgcccttctttcctcaaacagggtaccctttccaacatccttcatcatgcccccccttcaggcgacgggtacgtggtggtgggctcccaggacgggcgggtgcggctgtacagcgagagcacactaacccaggcgcgcaccagcatcccctccctgggctaccccatcaccgacgtggacgtgacctacgacgggcgctgggtggtggccaccgccgcgcactacctcatggtggtcatgaccacctaccggccgccggggtcggaggccacgctctgcggcttcacctcgcgcatgggcgccaacagccccgcgccccgccttctgcgcctccgccttgaagacgcgttgcgcacggtgaacaaaggcttcatgagcaatttctgcgtgatagggcacgcaagcgtggcttggccctcaagggccatggcaggaaatgtgtgcgcagccagacgccgtcgcgcattctctcgcacacaatcagatgagagcctgtccacgacccaccgccccggcctcatcccctcgcagggcaacgcgccattgcagaaggggcggttcacctgggtcacggagcgcgggcgccaggagcggtgggtggtggcctcctgcggcagctacaccgtgcgctggaacctgcgggtggtcaagacggccaatgcgcagaccgtgagcgggggcggactgaccaccgtcgaccagtaccagctgctgtccaaggaggagcatgtggtggactccgccttcatgcacgacaactttgccaggagtgagtacctttttctatgtcggagcggaggagagggggagggaagggatgtgttgagagcccactgtgtgcaaggggcagcacatgaagggggggatctggattgcttagttggtcagggcttggggaatgctgactcgaggctatctagatctaccccggtgcctaccatgaaagtaataagcgaggcatgccttcacccacaggtcatggagagtccatggtggtggttaccgacaaccatgtgtacaacgtcaacgatgacgatgacagctcttgagatgctcccgatgcctccnnnnnnnnnnatgcctaccatgaaattattaactgaggcatgccttcacccgcaggtcatggagagtccatggtggtggtcaccgacaaccatgtgtacaacatcaacgatgacgaggacagctcttgagatgctcccgatgcctccgtctctggccacgtatcatcgctactgtgcatcaaagacgtcactctcatggctcgcattcctgggtcgcattgtggctccccgccattgcaagatttgcctgagtaggcttagctcaggagtgcagattggtgcttccacggcaagggtcttggcttgggaaattactttcatcacgcgagggaagtga

SEQ ID NO: 7755 - DNA, 219 bp, Chlorella protothecoides
atgtcgtcagagacggaggcagcagctcgggctgcagcctcgggcgccgcgacgagtgcccaacccaccatctttgacaagatcgtagccaaggagatccctgccaagattatctatgaggacgatcaggccctggcattccgggatgtctcccctcaggcccccattcatttcctcgtgagtatgcttgaactgccagctgcacaacgtccgggctga

SEQ ID NO: 7756 - DNA, 966 bp, Chlorella protothecoides
atgagcgggcagcgggcggtggtggccaaggcctccaaggaaaaggcggcacacggcaagctggaggccgtgcagcgggacgccgcggcccggctggtcgccctggccggggaggtggagagcagcgagggcacggcgcggcgcatcgaggctaacgcggagctggtggaggcggcgctggcgtcggtgcgcgaggcgctggcgggcggcctagactggtcggccttggggaagctggtgagggaggaggcgacggccggcaaccccatcgcggcggccatcgacagcctgaacctggataagggccaggtgacactcctgctgcccgatgcgggcggggacgacgcggcggcggaggcgaccggcgaggaggaggaagggactgcggctggtgaggccgggcggcacgggcgcgccaggcggcacgtggccaaggtgacggtggacctggccctgtcggcccacgccaatgcgcggttctactacgacgcccgccgcaagcaccaggccaagagggagcgaacgctggcggccagcgacaaggccatcaaggccgccgagcgcaaggcggcggcccagcttaagcaggttaggcttcttggaggtgtgtgtgttgaaaacctggctggttggaacttggtcgtgcatgagggatgggctgctacagagccaaatgacttactttcgctgagaagtcgtcacaggctttgccacagcagttgccgaatgctgacctgctgcagcccccgctccagcgcatgcggggccagaactcccatgcccccatttcccaagcactccattgccctcccgtcccaggttcacgctgcgccggtggctgccattgcccgcaagccacactggtttgagcggtttcactggttcatctcctccgaaaactacctggtcgtgtcgggcagggacgctcagcagaacgagctgctggtgaagcggtacatgaagtga

SEQ ID NO: 7757 - DNA, 483 bp, Chlorella protothecoides
atggccccacactcaccccctcaccacccctcctcgtccatctcagggcggagtcgcagcaggtccgagccggagggcagtgcctcggagggcgccgagtcggaggccgactcccggcccggcggcgacggcccacgccggaggcggacggagttgcggcggtcgaggagcagggtggatccgcatgagatcgaggacgcagaggaccagctggagaactactatgtcaaggtggacggcatgctgcgccgcctgctcatgatcgccgagcacatcgacgccaacgaggacttggtggagatccaggcgagtagggggcgccctgctgccacgtcttgtgacctccactcccccttctgctcggctacaactactttccagatggatcaccgccggaacgagctcgtagccttggacctgctggtcagcctggtgaccgcggcctttgcctgggtctccatgattgcagggttctgggggtga

SEQ ID NO: 7758 - DNA, 966 bp, Chlorella protothecoides
atgaagttgctggcaacactcctggtggagtattctgccggacagatggcgtgcatggcggggctgacggtgctgtccaccatcccctacagccgacaccagcactgccctctcatcctttgtaggtcccgcaaagagccggcgccagaggaaggaggagcacaaggcaaagctggcagcgaagaagacggcgcaaaacacggtgacggcaaagccgacgacatcgcccgagtgtttgacgcgcagtttgaggagttggcgggggaggagcgggaggaggaggagcgggaggaggagcgggaggggggctcggacgggcacggagatgggacggcgatagctccgggcacccaggagggggagcctgaggacgacgacgcctgcccagaggcacagacatttgagccggaggcggaggcgggtgtgtctgtgcatgctgatgacggagagccggagggaggccaagccggcaatgtggacgatgcacgcgaggtggcagccctgttgcaggaggaaaacatccagctcctagatgaggaggaccgcctacgtctgacagacctggacgccctcacgggcttgcccagaccagacgacgtcctgctgtacgccctgccggtgtgcgcgccataccaggtgggccttgctgctgctgggtgtgccgtctggggctctgagggtggccgctgtacagtgcgacgggccgtgcaaccagggactatagtattgaccagctacaagttcaaggtgaagatggtgccagggccgcagaagaagggcaaggccgtccgacaggccatggagctgttccagagggcggcggacacgacgggccgagagcgtgatctctgcagggccgtccccgagccggaggccgtcatcacgctggtgggcacggtgaagatccaggcggccggtacgcagaagctgaagcaggccatgcagcagcagaagaagaaaaagtga

SEQ ID NO: 7759 - DNA, 660 bp, Chlorella protothecoides
atgccgtacgagctgcgggccctggaggtggcgctggccacggtcaccgctacgttggagtcggaagtctgcaggctggaggcacgggcataccccgtcgttgaccgcctgaccacagatgtgagtgaacgggtgccgacatcccagctcaggtcgcatgagagtcctgtctgtccttttgcccgccccgcttccatcgccgcgcttctcacccctcctctgccctccttctggtcgcgacaggtcagcacgagcgtgctggagggggtgcgccaggtcaagcacgagctgaaccggctgcagacgcgcgtgcagcgcgtgaagcaggagctggaagagatcctggaggacgatgatgacatggcggacatgtacctggcgcggcgcgcggcgacgtatggggaggagctgcccgcccagccgcgtgacctgcccgaataccagcagcagccctgcgccgggtacgacggcccggaggcggacatggtccccctgctgcagggcacgagtgacgggcccacgcccatcggccagagcgaggccgggtcgcaggcgcacgggcccaccccccgcagcagcccggggtcccgagtcggcttccaccccgacccaattgttgtcgacagaggtgggcgggacgggaggtacttggcggtgtga

SEQ ID NO: 7760 - DNA, 708 bp, Chlorella protothecoides
atgtcggagagctcgctgcccgacatcttcgcggacctggtgccagggtccaaggccagggactcggtgaacgacgacagcgtgctccctagcctgaagtccaacgatcgtgcacagcacaaggaaggcctcaaggagctggaccctgcgctgcagagtttcctgggcaagctgacggagggcctgcagcgggtcgtagagtccgtggacaggtgtggggaggagggaggattggcagtctcgtgcatcgggggtgtacctccagctccacgtcacatgtgcccgcccgctcccctcagacgcctggagtcgctggagaaccgggtggagcagacgggtcgagccctggcagacctgcaggaggtgggggcggtgagggatgacgccgccagggagaggtttggcggcctggagaagtcgctgcgtgaggtgcaccgctgcgtccagatcatccgcgacaagcaggagctggccagcgcggcggacgagctgcgccagctctccacccagtcctccgggccctccctggccgaggtcaggcacgccgccgacactggcgccgctggtgcaggggaggcgccggcggccatcggggggacgcgccggcggccatcgggccccccgctgcgaccaccgctcctgccgcagccgctggcaagccgctggccggggtcgctgagggcctgcccgtggcccctgcgcccttga

SEQ ID NO: 7761 - DNA, 675 bp, Chlorella protothecoides
atgcagccactggtggtaggatttggcctgctcttccgggtggaggacagctgcatcgccgcccatctgggggagagggccgtcaagtctggacaggatggggaagaggacgacgcctatgttgccgcaaacatgagacatgcccccctcgccccctctgaacccgcgcccgggcacgaggaggaggaagaggagtctccggggccagaccccctggccaccttcatggactctggcctggaggcactcccctccctgggcggcaagggacagggcggccgggggggtcctgcggcgacgcaggatctccaggcccagtttcagaggtacgggctgggcgagcgcccgggcgcgggcgccgaggtgtacggcgcggggccggatgctggcctggcgcagggtggtcggcaaggcggcagggcagtgcgacacctgtctgctaaggagcggcaggcgctgaaggctggcactcccggcgtggaggccgggacgggtcagcgtggcggcggcagggcctcgaccgcggctgcgccgaccgtcgagagggggcagggcgcgtccactcggcgagggaagaaggttggcggaaagtacggggacgatgaggacgccgagcttgcacggcaggcactccagtcaggaggtgtggatgatggattgtgtgtgggtgattag

SEQ ID NO: 7762 - DNA, 873 bp, Chlorella protothecoides
atgtcggcgggaagcactggggaagacttggcctgggtcgcgcacgtcctcactggaggcgcccagggcgagcgtcgggcccctgtgcgacagttccgggtgacgcccaggccaggcaccccaaccagaccacgaggcggaacctctaaatctgctggtagggggcctttgtcccgtgtggtggcgaccagctccacagcagtcccgcagcgcccacggccagaggatgccgagcatggcgagaaggggatacttccaggtaccgttcctcgttgcttcatctcccatgtcaacccccacctgacccctgacctcaggggtctgcggtgccgactctgcgatgcctgggtgcccagtgccggggacaactgggcggtgcacgtggggggcatccggcaccgccgggccgtggccagcgtgaggctgaccggggcgcccggctcccacgtcacctccatctttgagcgcccggaggccgtggccgggcctgctgggagaaccgaccccgctcacccccccggccatgcacaagccgccggcgcccggcgcacccccctcctggacaccgggacgctcctcctggacacccaggccgccgtggctctgggttacgacggcgtgctgatcgagcgggcgcagcgggaggcggcgcgatccgccgggatagaccctgcgcaggcgcgggacctccagagggagctgctggcggcgctggcggacgtggcttccctcggcgacagacgtgcggatcggattgggctcgagggttggtgtctggctctgcatgagatacatgatggggctggtggccgctgcggcggctcattgccttggactcgtgggcgcccgatgggcggccatgcatccttctag

SEQ ID NO: 7763 - DNA, 438 bp, Chlorella protothecoides
atgcccgcctgcgatcgaggcgagcctcctttccaggcacagggtgttcaaatcagcgagcgcagacgccatgatggcatctgccgccacagccacgcccctgcccaggccagtccaggaaagggcggcgcaggcttcacatgcaccacgcccgcgcacctgctcctggctccagggtgctcactggccggggccgaggatgccctggctgcggcgtcgctgcgctaccccttggtgctgaagccctgctgggcagatggcagggagggagcccatgcacttgccctggtcacctcctctgccggcttgcagggcatcatcgagcgaggggcccagctggggttggctctgccggccctggcgcagccctacatcgagcatgggggctgcctgttcaaggtcggcacggggagcaccatggaggcaccggttgggtga

SEQ ID NO: 7764 - DNA, 189 bp, Chlorella protothecoides
atgccaccctgcaggagcaagtccaaccagtacacccacaccagcttggtgaagatcgacggtgtcaactccaagaccgagaccgagttctacctgggcaagcgtctggcttacgtgtacaaggccaagaccgagaagaagggcagcaagttccgcgtcatctggggcaaggtgaagcctgggggatga

SEQ ID NO: 7765 - DNA, 678 bp, Chlorella protothecoides
atggcctcggagcccgaggaggcgtccacccctgctgggatacctggtgactcgcaggaagaggatggaagccgcacaagctcacctcccctgcctgtaggatcagacgatgcggtgggaagcgcagctcagccgcctgagcgggagtccatggaggaggcgggtcctggtggccccgacttcgtgcctccactgcctgctggagatggaccgggccaggccctcatcctgcacggcaccggcgcatcctcagactctgactccgacgactacagtacctcatcggatgaggagccagacgagtcccagctcccgcccgggccgatcgacccctcccgctgctcggcgacgggcccaggcttctccggaggctcctccggcatgcccgtgaaaatggtaataacagcaaaagactctgctggccgtcgcatccgggatgggggtgcctacgtcctggtgacactcgacaaacccgcacccacagggtcagttgttgtggccagagcagaggtcactgatcacggggatggtacctacaccgccctgtacacatgtcctagttggcgcgtcatgggagcggctgcctttgctgtgggtgcgcatgtctgggaggggggaccagtgagaggatggtgggacatggcgactgtcgcccagctctggcacccagggctctga

SEQ ID NO: 7766 - DNA, 1011 bp, Chlorella protothecoides
  modified_base (255)..(264): a, c, t, g, unknown or other
  modified_base (545)..(554): a, c, t, g, unknown or other
ctggccgggggccgcgccgagcgcggccgcgaggcgggggccgaggcgcggcccgaggacgcggtgcgcgctctggacgcgctgctggcggccgcgcagcagctgcacgacctggcggcggagctgggcgggagcgtgggcgagaccatcatggacgacgccgctgcgatggtgggaggtggtgtgttggggggggttgtctggttggcaaatgtggacttgatgaaggcggggaagcggtgggggggagtgcannnnnnnnnnagaggtggtgtgttggggggggggggtctggtttgcaaacgtggaattgacgaaggcggggaagcggtgggggggagtgcaaggatggggggccacagggctcctgggccagatttgtggtcctcgaatggcttgcaacggcgggcttccaggcgcagaggtctgcggcggtggcacacatcttgctggccgccaggagctggagggaggccgcctccctctttgcacgcgcaggagagctggcgggtcatgctgtcgaaagacaccaggtgtgctggggnnnnnnnnnnccgcgcaggagagctggcgggtcgtgctgtcgaaagacaccaggagtgcgagcgggtggatgaggaggcagtgcggggcctcgtctctctgcagtcctccacggccgccttcagggccgtggctgccgcggaggctgccgccgaggccgcagccctcggcgacagagccgcctctgatgtggaagcgctggccctggatcccaatgccccaactgagtcagcagcggggcatgcgtacctgtgcgacgactgggacgctccccaggcattcgtgggcgagggcaagagcaccgctcgcatcgcacggatcccgccgcggctggagcccatccccgtgcggccgatcgtgctcgacgccgctctgaactacatcaccatgccctccctggcgcacagggtggcaaagaaagcgggcacgggcgtggtgtcccggctctttggctggggggagcgatga

SEQ ID NO: 7767 - DNA, 2205 bp, Chlorella protothecoides
  modified_base (481)..(490): a, c, t, g, unknown or other
atggatgtgatcgacctggaggatgacagtatcgatgcggaggtgctcaactccatggcggtgaccatggacaacttcaagaccgctctggggctgagcaatccctccgcgctgcgcgagacggtggtggaggtgcccaacgtcacctgggaggacgtgggcgggctggagggcgtcaagcgcgagctgcaggagacggtgcagtacccggtggagcacccagacaagtttgagaagtttggcatggcgccctcaaagggcgtgctcttctacggcccgccaggtgggaaaggaaggtgggagaggggagaaggtggagggtggccgcctggggtatgcgggctgatgtgcatgcgacttcgacaaaaggggagattgccacggcgagagcaacgatacttcccatggcttggtctggctctagaaaggagcagggcatctgcctgtcctcccatgctcgatgtcctggagtgtcacagcnnnnnnnnnncccccccccccccccccccccccctctctgcaggctgcggtaagacgctgctggccaaggccatcgccaacgagtgccaggccaacttcatctccatcaagggccccgagctgctcaccatgtggtttggcgagtcggaggccaacgtgcgcgagatcttcgacaaggcgcgccagtccgcgccctgcgtcctcttctttgacgagctggactccatcgcggtgcagcgcggcgggtcggtgggcgacgccggcggcgcgggggaccgcgtgctcaaccagctgctgacggagatggacggcatgaacagcaagaagacggtgttcatcatcggggccaccaaccgcccggacatcatcgacccggcgctgctgcgcccggggcgcctggaccagctcatctacatcccgctgccggacgacgcgtcgcgccgccagatcttcaaggcctgcctgcgcaagagccccgtggcgcccgacgtcgacctggacctcctgtccaaggtgggtgttgtgcggggtggtagtgtttgggcaggaaggaggggctggtgcttagacatcagagggaggtgtagagtggtgggagggtgggaggtgagcccgcactctgggcttggcagggagattgaggcccaggaggatggaatgtggagactgctgagtggtgtgggggctcctgcagcgaccagggaacccgagactctcaccgtgcacagcgcactgtctgccgagcctgcggaggtgttgctctggcgtccctttgagcagccccctagaaacatcacggagatctgccagagggcgtgcaagtatgccatccgcgaaagcatcgagcaggacatccgccgcgaggcggagcatggcgccagcgaggccgccggcgagctgatggacgaggacatgccggacccggtccctgccctcaccaggtgtgtgtgggcgggaagtgctgggtgtggctctgggtcgcgcactggctcgggagtgtggcgcagtgtgtggaatgtggcctgcattgtttttgtgggtcccggactttcaggaataccatgcgctgtggcagatatggtggcacgtccttcgggccagtgtttccggacggcccacccctccacccgccccctccacaacctccagggcgcacttcgaggaggccatgaagtacgcgcggcgctcggtgtcggacggggacatccgcaagtaccaggcctttgcgcagaccctgcagcagtcgcgcgggtttgggtccgacttcaggttccccgacgccccggggaccgaggcagggaccggcggcagcgccgcggcaggcgatgccgccctggcctccgctggggccgtggacgacgacgacctctatgcctgaggagcggcgcggagacagagtgcccatgcgaggacggcacgtgcgatcacggccgccctgcattgctctgtgtgtgggggatgcattggtcccattggagcaaacatgatcatgacacagacaggcgagactgtccccagacgcttgtgggggtggggcaagagataaacagtgaagcacatgaggggcagcttggtcacccttttctatggccgctgcgcgtcccaagctgccagtcctcatcatccactgtgcgagcactcatccctgggagactcgatcctgtctggttacacagcaacgagcaggtggcagggctgtacaggcgctgccacgcccgatgctga

SEQ ID NO: 7768 - DNA, 1404 bp, Chlorella protothecoides
atgcccagcttctccaccaccccttctggcctgtcacgaccccaccctcacatccatgccttgatcgtccacgcacctccatcccaccccactccaccaagctctcagatgccccagggccgccccccccacacacaccctctcctaaacacacgccaaacctcccacctcatccaggcgctcctcgtcctcgcgcttgatgctctcgccctcgcagtagatctcggtgtccggcgcgacgatgcagtactcggcggggtcggtctccacgaccttgaactccacggtgcgcatgccgccgcggacgaggaaggtgtcgcccttgcgcacggggcggtaagcctccacgaagtagggcttgaggaaggcgtcgaacaggttccccgtgatgccctccaccgtgtcctcgaagggcagcacgtgcacgcgctggccgtacttgacgtcggggcactggtgcaccgacacgatgtcgcccaggcgcacgcgcaggttcttgcgcaccaccttgttcagccggatcttggcctcctcgcaggtgtcgtcggagaggacgatgcacaccgtgtccttgcgcttcttgcccttcagcagcaccgtgtcgccgcggaacaggtccagcgtctccatggtcttggggtgcagggtgccaggggtctgacagccacgaagaacactggaagtgcatggacagtggagcatgggcacgccgccctgacgtcaaggactagcacccctcgcgccgtggggagacaacagggcatgcaggatcacaaacaacctcctcacacaggcgctgtggcctcgcacatccaggcagggcatctgacccacaatacaccatgccacacttggccaacccccctcccctgcccaacgcacatcatcgaccagcaggcgattggggctcttctttcgctccaggattgccgcccgaagggtgcggaggtatgcgcaggggaacggcacctcgtgaggacgactcctcacgcacagccctctcgtcgagccctgtgccaaaactcacccctccgccacagcctcagatttgaccggagtgtccggcattgccttgggtggtctatgcctcggcgatcagatagcaaccaggcgagcggtgatcgttcactccggcaatatcccagcggcaggagtgctgtatcagaccactggaattcacaagaatatatggccctgcatcatccgcgatgcactggtatcgagccttggccgggcgtggatggttcggggccctggaagggaaaggatgtttcccgcgatcacgactctcgcaagtggaggggtgggagttcaccgcttatgcacggagagctccatgcatctgcatccctctccatccatctcaggccttactggccgtacaactcacccaacaatagatga

SEQ ID NO: 7769 - DNA, 1239 bp, Chlorella protothecoides
atggagacgctggacctgttccgcggcgacacggtgctgctgaagggcaagaagcgcaaggacacggtgtgcatcgtcctctccgacgacacctgcgaggaggccaagatccggctgaacaaggtggtgcgcaagaacctgcgcgtgcgcctgggcgacatcgtgtcggtgcaccagtgccccgacgtcaagtacggccagcgcgtgcacgtgctgcccttcgaggacacggtggagggcatcacggggaacctgttcgacgccttcctcaagccctacttcgtggaggcttaccgccccgtgcgcaagggcgacaccttcctcgtccgcggcggcatgcgcaccgtggagttcaaggtcgtggagaccgaccccgccgagtactgcatcgtcgcgccggacaccgagatctactgcgagggcgagagcatcaagcgcgaggacgaggagcgcctggatgaggtgggagggtacgacgacgtgggcggcgtgcgcaagcagatggcccagatccgggagctggtggagctgccgctgcgccacccgcagctgttcaagaccatcggggtgaagccgcccaagggcatcctgctgtacggtccccccgggtcgggcaagaccttgatcgcgcgcgcggtggccaacgagacgggcgccttctttttcctcatcaatggccccgagatcatgagcaagctggcaggggagtccgagtccaacctgcgcaaggcgttcgaggaggcggagaagaacgcgcccgccatcatcttcatcgatgagatcgactccatcgcgcccaagcgcgacaagacgcagggcgaggtggagcgccgcatcgtcagccagctgctgaccctgatggatgggctgaagtcgcggagccacgtcatcgtcatgggcgccaccaaccgccccaactccatcgacgccgcgctgcgccgctttggccggtttgaccgggagatcgacatcggcgtgccggacgaggtgggccgcctggaggtcctacgcatccactcccgcaacatgaagctgggggaggacgtggacctggaggccgtggcgcgcgacacccacggctacgtcggcgccgacctggccgccctgtgcacggaggccgcgctgcaggcgctgggcgctgggatgcatctcccgcctgcttgggaattgcgtgccacgaggaccgtgcggttgcagggtctttggcagcacactattccatttgctgccacgtggtga

SEQ ID NO: 7770 - DNA, 1257 bp, Chlorella protothecoides
atggtcgactccgaagtgatcgcctccttttgcggggtcaccggcgcagacagcgatgtggccattcagatgctggaagcaaccaatggagatctagaatctgccatcaatttctactttgctgccgagggcgctgcaggcggtccagatcgcgaggacgacgaggcccttgctcgcaggctccaacaggaagcgaacgagccgctagaagatgctgtgcgggctcccatgcccgtcgtcaatcagaggcttgtgggggatctcctgccggggcccattcagactcgacgcaggccatggtccatcaaagggtggacctccgctggcgctgatgcagttgctcctctccaacttgtcgtgcagggctgtgccgattccccaatcggttgccaacacattcagggaatccatgtgagtgttgggcacgtgctggtttgtggttgcgatgcggacgcatctgagcagccctccagcgggggactggcggcgagctttgagcctccccgcgagctgctcttccacggctcatttgaagatgccaaggagtctgctgcctccaaggagcagtggctggtgagactgatgggagcttgccagtggtgtcctgaagtgcaacagctgccgcccaccttgttgatggcgcccatgcgggcttcgcctctgcgcgatgtccttgcacgtcttcatgcgcactccacatggtccaatgcccctcccactcatccctcgcacacccctctcccttcccccaaccagttgctgaacctccaggcggccgaccagtttgcttcccaccagctcaaccgcgacacatggcgggaccccatgatttccgggctcgtgtcacagaactttgtgcttttccagcctgggcacacaggtcactggtgccctgggcatgcaggtcaggcaccaatgcccccgctgtgtccccggccttctgtgcccagcaacgatgctgtttcctcccctcccccccctccccaatgcaccatgccaggtttaccagggggtggaggaggcggaggtgctgtgcggggtctatcgcgtctccaagctgccctgcatcctcgccatcgacccggccacgggggcgctcatgcggcagtgggcggggttcctgccgccagacaggtgcgtgcgaggaggtcctgggcggctggcggccgccaggtgctcaaagggactgccaggcagagtgtcgctgctgggcctccgttccacttgacaagttccggctgggactgcgggacctga

SEQ ID NO: 7771 - DNA, 394 bp, Chlorella protothecoides
atggacactgccactggagaatacttcttcatggagatgaacacgcggctgcaggtggagcaccccgtcagcgaggccatctccggcgtggacctggtggagtggcagctgcgcgtggccgcgggggagcgcctgcccctgacccaggaccagctgcgcatcgggggccacgcctttgaggcgcggatctacgccgagaacccggccaacaactttttgccggcgggggggcggctgctgcggtggcggcccccgcccggcgccgccgagttcgggccgggcgcggtgcgcgtcgacagcggcatcaaccagggggaccaggggagggggccaggggatctgcggggcgcggtgtccagggggaggaggttggccagtggatgtagagcccggt

SEQ ID NO: 7772 - DNA, 309 bp, Chlorella protothecoides
atggctccgaaatccgcacccgcgcatccgccgtacctgtcgctgatcagcgaggccatctccggcctgaaggagcgcacgggaagcagctacccggcaattaagaagttcattggctctaagcacaagcttcctaccggctgggagaaggtgctggctcagcagctgaagaagcaggcgggcgcgggcaagctggtgagggtgaagtcctccttcaagctgtccgatgctctgaagaagcccgcgaagaagcccgtgaagaaggcagcccccgcgaccaaggtgagggtgggtactgacatgccgtga

SEQ ID NO: 7773 - DNA, 924 bp, Chlorella protothecoides
atggcgggcaaggatgctcgtgaccggccctgggcctgtgttgcagaaggctctccctcctcctcccccggccccactccctcgcaacccaaccctcctcccctgcaggtgggcgtccactacgaccccatgatcgccaagctcatcgtgcacggcccgacgcgcgaggcggcgctgcgcacgctgcatgcagccctgggcgagacgcaggtggcgggcctgcccaccaacatcgagttcatgcgccgcgtgacgcaggacccagatttccagacggtgggttgttcagctcatgctaggaatggggcaggcctaggagcgggctccaggcctttgggcctgcttccaggcctggagcctgctccgagcctggcaagggaagcacgcgtgaccaaggaccgcacctggttgtttccgcgccacggaatgcacctgcagggtaatgcgccctatgatccagagaaaatcagaaccttcgaattccaacccacacacgctcacatccctgcccctcttgctctccagggtggcgtcgacacctccttcatcgccgagcatgaggacagcctgctggagagggtcgccccgggcaccgacgagctttgtctggcggccctgatctacgcggcgccgcatgcgtccggcgagccctcggcctccaccaaggccccctgccccgagccctggcgccagcccagcgccttccgcgtcaaccacccggcgcgcgcgagcgtgggcttcggccacgcccccgccaccggcggcctggagctggacctggtgggggccggcggcggcgtgaccctggagggggccgccctcgcggaggggtccggtctgggcgccgaggcccgcgtggaggtgaggcgagggaggagttggggcgggcagggtcagggggttggacggcggggcggcatctga

SEQ ID NO: 7774 - DNA, 819 bp, Chlorella protothecoides
  modified_base (445)..(454): a, c, t, g, unknown or other
ggtcccccgcccgccccacctgcacaggtgctgctgtcggaccaggccaagcggtcggcgcggcggcgcggccccgcgcccaacggctcgccggccgtgacaccgccccccggctcccccggctggtcccccggcgccggcgctcagtcctggcaggcgctgctgggcgcgctgaccaacgtggtggagacgctgcgcggcgagggggtgcccccccccgcggtccgtgcgctggccgccgcctgcctgcgcttcgtggacgcggagctgctcaatgccctgctcctgcgccgcgactgctgctcggtctccgcggcgcgagtgctcctggccggcctggccgagctgcgcggctgggcggcctacctggggccagaatggtgtccggggcgtgagaccgcggccgcggcgctcgagcgcgtcgcccaggcggcgcgctacctcnnnnnnnnnnctggtgcccgggtcctgagaccgcggccgcggcgctggagcgcgtcgcccaggcggcgcgctacctcgtccaggcacgggcgctgggtgttgaggttatggtttggggggggtccggggatcttggtaccagatggagggaggctgggtctgagcggtggcaccagattccacggcgcaccgcggcgtgcccatcctggccgacctgggccgcctctgccccagcctgaccctgcagcaggtgtaccgcctgacggagcaccagcacgacgactggatttcgggggcggggctgggctcgcaaaacatggtgctgctggagacgctgcagcgcctcatggcctcccagccctccatggcaggtga

SEQ ID NO: 7775 - DNA, 1299 bp, Chlorella protothecoides
atgacggaccaagagactgccccccccgcaccatcagtgcccgcccggccgcggctgaacctgaagccgagggatccagaggccgtggccaggatggaggctgagagacaggcttcaattgggaaggtaagatgtgtggcgatcacactgctttgtcgtggctcatcgaggccgcagccaccacctcgcttgcacggtgactgctggagctcacgacccatccctgctcgcgcgcagagccccttcggcaacgcaaaaccccgagaggccgtgattgctggccgcgtggggaagaccgaggaggaggctgggatgctggagcgtccgggggtcttcgtcgcagagccggggtcccacacagagctgggtgcccgcggcaggaatgctggggggcccaagcagcagctctcaaaagtctctgccgttcgtaatctttcccatggggccaaaccatcgactccccctgcaccctctcctcctcagctgcgcctgagtcccagccagctggacgagaagaaggcccaggaggctgtgattaggcaggcagaggagaccgccgaggccgaggaggatgccgagaagaaggcggagctcaacagcgaggtggccgtgcagaaggagaagttggcggagctcctgggcggctttgaggtgcatcttgtcatccgtgcacgcttccctccgtcccgccctgccgtgcgtgggacctcctcgaccgcacgcgcggccctcagtgatcccaccccacctcccgacccacccacttcccctccaactccccccctcggaccccccccacacacacagaaactggcccttgagacagccatgtctggctcggggccgcgcatgtccagcctgcgccgtgctcaggcggaggccgccgccgcggcgggccagtacgactccgccgccggcggcaaccgctaccaccccacgcaggggtacggcccgccccccgacgcggtggccggcgccccgccctcccgcggcttccccaacgggcagtacggcgcggcggggcgtgcgcccccccgctcccagggctttcccgagtaccagcagcaggcggggcacggggctcggggcggggagtatcaggaggcccggcaggggcgcagccagtaccaggagccgcgccagcagggcggcgcggacgcggcgaccagcttccaccgcgcgcccggcgcgttcgtccccggcgaggactcagacgccggtcgcgcggcggcggcagcgggtaccggcagggcgggagccagggcggcgggcgcagggagggcgggcggcaggcgggcg

SEQ ID NO: 7776 - DNA, 594 bp, Chlorella protothecoides
atgcggctgtggatgtcagggacgatgaggctacggcattatgggcatgcactgcgcggtgaagacgcaggggggccctgcccggctgcagctgatgatttactgcccctgtcagccgcttctcggttcttaaacaacacgccgcactcaacccaccataaccccatgttcctcctacacaaggctcgcctgacggtggatgcggggagcgtggaggctgtgaaacgcgattatggccccatcactgtgcagtttgtcctcccaggaaagccttcaggtgaggtggagatggtgggagggagggggaccccaaatcaacacaattgctgggcatggcgtagactctgttgccaggcaaagcctttgccgagtttccacaccaacttggggccgcgaggcgatgctggcgccagcgatgccctggtttcaaagcaccccgagacaccctggctttccaccctatccctcccagcatcggggctggatgtccggtacatgaagatcctgaagcaagagaaaaactacaacccagcccgctggttcagggtggtggcagtcgccaactcataccagatcaggccgcactggttgtga

SEQ ID NO: 7777 - DNA, 1065 bp, Chlorella protothecoides
cccccattttccccctcgagcccctcccccacccactcaccgcccctccctcaacaacacccaggccccgtcaaggacgagatcttcgtggacatcgtggagcggctgacggctacctttgacgccacggggcgccagaagtcgagctccatcactggcgcggtgcagatcaagtcttacctgtctggcaacccgcccatccagctgggcctgaacgaggacctgatcatccgcgggcgggagggcggccctgcctcccacgcctcctccgacgcggtggtgctggagacctgctccctgcaccaggcggtggacccgcgccgcctggacaccgaccgcgtcctggagctggtgccccccaacgggcactttgcggccatgaactaccggtgcgtgtgtggggtgggggctgggggaggcgatcgtgcagtgtggggcaatcacgggggctggcgtgcacctgggcctccatgggttctgggagagggccgtggcacagcatcggtccccacacgcgacccacctctgccgcgccaggtcgacgcgcagcttccggccgcccttccgggtctacccgctcatggaggacgatgcggtggcccccgacaagctgacgctgtatgtgcggctgcgggcggagttcccgccgagcaagacggccactggcgtggagctcaggctgcccctgccgcgcagcgtccagcgtgtgcacgtcgagacgggtgcgggtttgggaggggaggttggtggggaggggaggagggagcgtggtgctgggcgcggggatcggggggggcgcgcgggggttgggcgaggaagcgattgctccgatgtgcgcctcagatggtcagagcacgcccatgcactcacatcaccgcgcggtccccttccaacaaaccagacggggcgcggcctgccacgctggggctaccgagcaagacccactttgcgcagggggcggagtgggtggagcgggacagggtgctcgtctggaacctgaagcacctgcgtggcagccaggagcacacgctgagggtgggtgcggtgctgctggctggagtgtaa

SEQ ID NO: 7778 - DNA, 1287 bp, Chlorella protothecoides
atgcgccctcgcatcaccggaacccacccctgcaccacagacccggcagagatagtggagcgcaagctggacaaggcagttgacaagcggctggacgagtgggtgcctgcttcccgcatctccggcctgcacagcgtgggcagcggggagggtctgtcccgcgccagcaccgcgccggcgtcggacctgctggcgggcctgacaggggaccagaagatgacgcggcgcctgaagcgccagtttgcggagatgcaccatgtgggccccggggtggaggagctgccccctctggaccagcacgcggagaaggagcaccaggagaagaccaaggttaagaacgtgcagagcatcgagctggggcggtaccagatggacacctggtactacagcccctaccccgagccgcacgcgtcctgcgagcggctgtacatctgcgagtacacgctgaagtacttccgcaagcggcgcacgctgctgcgccacctggccaagacccccctgcgcgcgccgcccggagacgagatctaccgctcgccgccgccgccggcgtcggacccgggccgtgtgggcggcgcgatcgcgtccccccccctctccatgtacgaggtggacgggaagaaggccaaggtgtactgccagaacctgtgcctgctcagcaagctgttcctagaccacaagacgctgtactacgacgtcgaccccttcctcttctacgtgctctgcgagcgcgatgcgcacggcagccacgtcgtaggctacttcagcaaggagaaggactcggcggaggggaacaacctggcgtgcatcctcaccctccccgcgcatcagcgcaaggggtatggccgcttcctcatcgccttctcctacgagctgagcaagaaggagggccggctgggcagcccggagcggccgctctccgacctgggcgccgtgtcataccgctcgtactggatgcgggccatcctggaggcgctgcgagatcaccgctctgccatgagcatcaaggacatcagcgaggccaccgccatccgcaccgacgatgtcgtgaagacgctcgagagcctgagtctgatcaaggtgtgtgagtcgatttttggggggggggttggggagggggggcgggtaacggaaagaatggcggaagtggcacggtgtctggatggaggaacgagggaggccgggaagaaagtggcagagggttgggagaggattctgcacggactcggtcggggagcgggtagagggatggtgcatgtcgccgtgcaaactggcgagcaccagtcctga

SEQ ID NO: 7779 - DNA, 540 bp, Chlorella protothecoides
atgaatgatggcggctgcggcactgtgcccaggcgcctgattattgtctcttccttgtcatgcgctctcctcccggtgaccccgcggtccctccatacagtactccgcttccgcatctatgccacagctgctctccatgcacatccccttccgcccgcaggcacgccggaggagccacgctgtgggttcagccgcaaggtcgtggacgcactgaggagcaccgggacggcgttcgggacctttgacattctgtccgaccaggacgttcgagcacgtctcaaggctcttatgccctcgccaaaggcacaagttgcagcaagcgtgtattcccccatgagtgcaggagtactccaactggccgacatacccccagctatatgtcaagggacagctactgggaggctgcgacatcgtgctcgagatggctgcagatggcagcctcaaggaaaccattacggagatgctggcgtgatttatgatgttgtaattctgcatttagggcttgactatcatcaccattgtattgtctgtcctgtacct

SEQ ID NO: 7780 - DNA, 1299 bp, Chlorella protothecoides
  modified_base (464)..(473): a, c, t, g, unknown or other
atgtcgtcgtccgcctggtgcagcgctacccccagtacaggtgcttgggcaggggagggcacatcacgtgctggtcaggcctctgggcacatgcaagcgccttcctggccatcactccaggtggtggtctttgactgcctggactactgcgccaccctgcacaacctccaagccgtcaaggatgcccccaactttaaggtagggtggtgctaccagcgatcgcctgcctggatcgcaatggatctcacatgtgtcaccttgcagggtttggcttatgactatgtcatgagccttgaagggcacgccggagccacataccatcccgcctacaccggcatccccacccaaccaatcaacacaacataccgtgcagttcatcaaaggggacatcaagagcggggacctgctgtattacgtgatggaaaccgagaaaatcgacaccgtcatgcactttgccgcccagnnnnnnnnnnacatgtggaccactcgtttgggaacagcgtcagcttcaccatcaacaacatgtacggtacccatgtcctgctggaggctgctcggcggtacgggcaagtccatcgcttcatcaatgtatccacagatgaggtgtatggggagacctcctttggcctggcggccggcctggtcgagaagagccggctggagcccaccaatccgtatgcggcagccaaggcacgcaggaggggaaggagactcttaaggcttgtggctgtgaaatctgatgttatcattaagtccggcctctcctgtctgccgcacagcactagcagggcacaggttgaggacagctgcatgcccgtccctgcgggggcagagatcatggccctggcatactacacctcctatcagctccccgtcatcatcacccgtggcaacaatgtctacggtccgggccagttcccagagaagctcagtgagtgtgactgtgggagcagccctggaggtggctcatgctgtgcagctggcttgtctgttgggatgttcttgtccaacctacggctgtatcgagtatcaatccccaaattcatcctcctggcggccagcgaccggcccctcaccgtgtacggggcgggcgaggccgtacgctcttacctgtacattgctgacgtggctgcggcctacgacgccgtcctgcactgtgggctggttggggaggtgtataacatcggcagcgtgcgggagcgctcggtgctggaggtggctcacgacatcggcgccgcctttggcaggcaggcgccgctgctcgagcatgtgcgcgaccgagccttcaatgataggtga

SEQ ID NO: 7781 - DNA, 1365 bp, Chlorella protothecoides
atgcatagctgctgtccacaaagaacacgtctgtgtgcatgcagtttaatagtatccccgtgtgcagaatcgccgtttagctgcacgcattgcagcctctgctcctgcaagcattgtccagatccctcacccagactcctcctcccacattcctcctcccgtccatggccagggtccctcgtggagattgcagagccagagttcctggccgccgtgatgaaggcggagcatgccctctgccacttcttccatgctgggtttcagcgatgcgccagcatggatcgccacctggcgatccttgcacctcgctttccagggacctcctttctcagactgtcggcaccggtgcgtgggtgttcatgggaagggagagggatagggccagcacaggagaactctgtgcttggccggcgctctagcaaaattgctcgggtgataactgctggcaacagaggtgaatgccaatttactgattgctgcgggcacagggatgcccccttcttcacagaaaagttgaagattcgaacgctcccctgcgtcattgtcttccaccgtggcgtcgctgtggataggatcgttggattcgagggtatccgcggggcaggcgcggacttcaaaactgcagcgttggaggagcggctacaagagtctggcgttctggtgggcgtcaatccatgcagcgactctgaagcggaagctgaggctgtggacagacggacagtgcgacatgggttcacagcacggggcaagggcggtgtgtgggagaggcgggccacggctatgtgtgacacgagatcgtgttatttgcgtcagccaggaccaggagctgttgcactgggcgtcgcgagcaggatagactgtccctgtcctcaattgggcaccactcgccgctggcgattcagtccagcatgcggctggagggcagcatccacattcccattgtccctgttggcatacatggagagtgtgcatgttatgttcacctcaaggccaactcagctcgaggtctctgtctgcaccaccatcacccaatccccatcttcgctaagcacacacttgttgcaacccgcacatccacaatccagagagccttccttgccaacacccgctgatctcactcaccaatactcagcgggcgatggcaggttcaggtaccagtctatcgtcttcctcagaccctgctcccacgacgtgctctcctcccaacccagtgccgccagcttgtcattgttgatgaagtatcgcctgcagatgggatggcatcgggtgcccgatcctgggggtcaagtcgcacaagagtacgatttcagcaggaggatcaacggatgcaaaggagttgcccacgacacagccgcgtcgccgtaa

SEQ ID NO: 7782 - DNA, 1098 bp, Chlorella protothecoides
  modified_base (394)..(403): a, c, t, g, unknown or other
  modified_base (489)..(498): a, c, t, g, unknown or other
atgagtctggaggatgcagccgcggcagatgatggccgggacctggcgtcctacgactttgatggggatgtggtgggaagaatccaatcctgtgaggggccagcaccggcgtcagacgaccccgggccctgctcccctccccccgaagcggcatatcggtaccgggaggcgcacctgcggtactcccttggcctgctggccgacgccgcgctgcccagctctgaccggctctggcacgccactgacacgctggccgctggctggctgacggccgcgcaggggctgctggccgcctgccttgcccgcctgccggtgctgctgggcgccgcgctggggcccccgctgcacgctggcgcccgcgaccacctgccccaggtccggcatgtggctgttnnnnnnnnnntgatggggatgtggtgggaagaatccaatcttgtgaggggccggcaccggcgtcaaacgaccccgggccctgcacccctcccccgnnnnnnnnnnctgccggtgctgctgggcgccgcgctggggaccccgtcgcacgctggcgtccgcgaccacctgccccaggtccggcacgtggccgtcacctcctcggacctgctgccctccctggccaagctggccctgtttcgcctggaccgcttcttcgccggcagggacgtgctgtcctctcgcgtgcacggcaagctggagtgctttgccaggctgcgtgaccgcttcccggggagcgcggccttcgtggcaataggggacggcagggaggaggaggcggctgctgcggcgcttggctggcccttcatcaaggtgtccctcggcaggtgccctgggcatctgactgggttttccgtatcccaggacagtgtcaggcacgctccctggatgtcggggtccccctctcaatcctgcaccccaccactgcagcccatttttggtccagtcatacctcccgtgaccttaccccttggtgcactgcttgtttacacattctacgcagctccatgtgacccatatttcttctctcagtccgcaaggggcgctgcctgtggtctggttagaggccggaacggccccacaccaccagggagatggagaaggtga

SEQ ID NO: 7783 - DNA, 309 bp, Chlorella protothecoides
atgggaggtggtggcaccgaatccccagacagcaagaaggcccgtactcacgcgcaggccccgccgcccccccccgtggttctggtctgggacattgacgaaaccctggttattttcaactccctgcagaatggggagtgggagcgtgcccactcggacagcggtgcaggggaggcccaggccctgggctcccagtggtcctccgcggtgctagacctcgcggactcccacctcttctacaagcaggtgcttgagtggtcagtggaaggtcatgggctgactgatgctgtccctgggaagcacttttga

SEQ ID NO: 7784 - DNA, 2106 bp, Chlorella protothecoides
  modified_base (399)..(408): a, c, t, g, unknown or other
  modified_base (966)..(975): a, c, t, g, unknown or other
atggcaggcgaggacatctggtcacccaatagccaggtgcccaggaccgaggtccgggtgctctggctggcggggtggctgttggccatggccttcgcagtctccccttggggttatacccatctcactgttccctccgtcagcacccctgtcacgcctgcaaggtggacacaggacatctggttcgtcatatttggtctccaggcagtaggcatggtttaccagctcctcccatcaggtgaggggatcatactcatgccctgtcctgctgtgtcccttcaagagtctgttgtgctcaacctccttgtccatgcaccagcgctggcaggtatccccattctgagcatccaaccctctcctacctgttcaggctacgatccagatggagacaagcagcgnnnnnnnnnngtcatactcatgccctgtcctgctgtatcccttgaagcgtctgttgtgctgaacctccttgtccatgcaccagcgctgtcaggtatccccattctgagcatccacccctctcctacctgtttaggctacgatccagatggagacaagcagcgttgtgtgcatgccaccagtttcctgtgggctctgggagcgatgtgcacgctgggctggctggcggcgctggcccagggcaccccgggtgggacctggctgggtctagcatgcatcctggcagccctcttcatcacactgcgcagcctcctgcacctctacaggtgtttgttttggaccgatgatggggattgggaggaggggctggtggttgcattggaggcgttccatttacgctgtacatgtctaggagtggttgtcggtttcacattcccggctgcccggcagctggaacatggtggagatggctggccgagaagatgggttcgatctcaccagcccagcacaaccccgctcgctgccaggcctcatccttccctcacaatctcacaggctgagacgccaatnnnnnnnnnntacatggtggagatggctggccatgaggatgggttcgatctcaccagcccagcacagacccgctcgctgccaggcctcatcctcgcctcacaatctcacaggctgagacgccaattcgggcgcacctccagccgcctgctgtacctggcctacttcctcccgacctccatgctggcagcctggctgacgctggctgccgcgaccaccgcagtggccgcactcatcgtcagcgtggacccagcggacctcgacctggcgagcctggccttcctggcaggggtgatgctgctgggtgcggccgtcacgctgcgtcagcgcgacaccgtcttcggactgaccctggtgtggggcctggtggggacgtatgagggcaccagcgacgagtccgccatgctccaatgggcgagcctcgccgctgtggccctcatggtggtcctctgcgcgctgtcaggtggggggcgggtgtgggctggtggcgggagggcgtgcctgtgcgggagaaaggatgaccctgcttgccgggcatgcctggtgtcttgcggaggaagggcagccagagcccgagcatcgacatcgaggcgcaggagccgctgcgggcgcatgagctgcgatgagattgatcatccaagcacgggactcctcttgcggcgtgcatggtggccctgggtccaggtaccaggagcaccaccagtggaccacaccgtgtgccatgcccatcatctatcgctcttgtcatacaaccttgcagtgagacatcccctggatgcgcaagccttcatgctgcttttcgctatgtcaacattcttaaagctctccttcgccagtgctgtgcagcaaaaattcaaaccctgcaatggtacaaagggcaggcgattggtgccaggagcaccaccagtggagcacaccgtgtgccatgcccatcatctattgctctcgttatacaaccttgcagcgagacatcccctggatgcgcaagccttcatgctgcttttcgctatgtcaacattcttaaagctctccttcgccggtgctgtgcagcaaaacttcaaaccctgcaatggtaccaagggcaggcgattggtattgtcggcctttgtagtccacaggcaaggtgccagtgagctttggtga

SEQ ID NO: 7785 - DNA, 483 bp, Chlorella protothecoides
  modified_base (357)..(366): a, c, t, g, unknown or other
atgtgcgcagtgcaaaatagttgtggctgtggatctgggcctccataccaccaaggatgcctgtggcagagggaacagtctgcacgagaggcacctcatttggcccctccccggcgaacccattgcatctcccccgcaggcatcatgctgagcagccagttccccatcaactactttgctgtgtcggaggtcgaccagtccttcccggagttcaacgccgtgtttgctgacgtgggcgaattgccagggtccaaggcagcctggtacttcaggcgcacagaggactatggctacaagggggagaacgagagtgcggatgacctagggcgtcagttcgccctggagtggggcagcaannnnnnnnnnaggatggatgctttgtggctcaggggtggactgtgtcgctctggactcttcccatgcggtcccgggttggtgatacaggggcagcattctcaggtgggagtgctgggtctcgtttga

SEQ ID NO: 7786 - DNA, 1059 bp, Chlorella protothecoides
  modified_base (91)..(100): a, c, t, g, unknown or other
atgggcgccatgtcgctacagatgtcgtgccggagggcacagctgggtgacaggaggttagctaaggaggtgatgcctcgagcggggcccnnnnnnnnnngtgacaggaggttagctaaggaggtgacacctcgagcggggccatgtggactgcggtccgcccgtgctgcacagaactccatgcaccgaaacggactgcttccacccaaagccccctccgtgcctcccgcgacccgcgcgcaaaagcaatctaggctgcatgctgcggcatcggcatctgctccagccacccagtccctcgagagtcttgagatgtttgcggtgctggataagagaggcctcatcaggccggaagtgccggcaggaacattggccactgtctttgcggtgtatgatgaggccaaggacttgcagtacattgggttttcgagggatctgaagaactcactccgcaccgtgttctcccgtcgccctgagaagactcatcacatcaggtgggtgacggggccaagaggaaaagggaggaacctaattcgaggactgtatgatccactgtcacaatctaccagctttacacctcaccctctgatcatggctctgcatcagggcactgcacctgccacgattggatcaaaccgagctgtgagagtgacctatggctgggtatttcttgcacctgcccgtactcaacccggctctcctatttgttatgatcttgcagtggatgctgagaaggctgcttggcagcagccggtggaacccttcaccatctctgagcgtgggaaggcggctgcggctcttgagaccgtcaaggagcatttccaagacgggcccatgcttcccgtttgggcccctgttcccatcacccctctccacaaccaaacatctctgcagttgcaaacaaggatgaagctgaggggctgcaaggaagtctttgaggccaacgaggagctgcttgcggagggaagggtggactttgtcccagccaagcaaatcacggcagaggacgaggcacgccgggaggccgaggaggccgaggcggcaagggccgtgaggtga

SEQ ID NO: 7787 - DNA, 2358 bp, Chlorella protothecoides
  modified_base (1649)..(1658): a, c, t, g, unknown or other
atgggcaaggtggtcacccgcttcccgcccgaaccctcgggctacctgcacattgggcatgccaaggcggccctcatcaatcagcacatcgccgacatgtacaaggggcgaatgctggttcgcttcgacgataccaatccttcaaaggagaaggatgagtacacccagagcatcatcgccgacatgcagaggctgggcctgcgctacgcaggcatcacctacacgtctggtgcggcccttatgcattgggttgcagagagccaggggctgcggtgtggtagctggtcaatggcatcgaccaatccagcactctccactctctccttccccccatctcacaccctcccaatcacaaaatccgatccagactactttgagcagctggccgaatgtgcgcggcgtatgatcgccaagggctatctgtatgctgatgatacacccgtggagcaaatgcgtgagacgcctggggatgcgcctttgggggtgggcctctctggaggagcgcatggcggggacgccttctgtgcggcgggacaggcccgtgtcggaaacgacggcgatcttcgaggagatgctggtggcgtcggaggagggccagcggcactgcctacgagtgaagctggacatgtcggcacccaacaaagctctgagggaccccgtggcgtaccgctgcaacctggagccgcactggaggaccggccagaagtacaagctcagcccctccttaccacttcccatgatgcacagtgctaccccacctacgactttgcttgcccctttgtggacgccattgagggtgtgacgcatgcgctccgcacctcggagtacaaggatcgcgaggcccagttctacatgatcctgaagctgcagcaggatgtctggcctggtctgccccacgtcaccatgtgggactacgccagactgtccttcatctacaccgtcctctccaagcgcaagctcacctggtttgtggaaaacggcatcgtggatggctgggatgaccccaggatgcctactgtccaggcgaagcttgtgagcctccatgatcttgacaaacatgctcatgcggtgtggtccaccgtagaggcttgtggcacatctgtcatgggcatcatgaggcgtgggctaaagatggaggcgctcaaggagttcatgctggggcagggcgcctccaagaacatgacgtaccaggtggggaaccggtgggaagctgagagatcgcatgtactccacaatcaatcctgcacccttttgctctgccaggagtgggacaagatctggaccatcaacaagaagctgattgaccctgtgtgcccgcgtcacactgcactagggctttgtggacagagtgaccagctcctggcagctgtgcctcctcgtccatcacgcttcaccctgtccccctcacatgagccatacaaattgttgcatgatcgtccaccggttccaacccccccattggcaattgccagggtgctggtcacgctttccaatggtcctgccagtcccgagaccgtgtctgtgcctaagcacgcaaagcattggagagctggatgctggggagtcccggcctctacagagtcactgagtgccagaggggttgcgttccttccaactctaggaattgcacccggcctgtcgcccactgnnnnnnnnnngggagtcccggcctctacagagtcactgagagccagaggggttgctttccttccaactctaggaattgctcccggcctgtcgcccactactgcccctctctaccacctgcagcgcatctggtgggaccaggccgacgccgccgtggtggccgagggggaggaggtcacgctcatgggctggggcaatgccattgtgcggaagatctctaagcgcgaggatgacactgtgcagtccattgaagcaggtgggcatgtgtgcgaagcatcctctgtggtctgggggttacagatcacaacctggacatttgccgcttggatctggtccaaagcttcacctcgagggagacttcaagaagacgaagctgaaactcacctggcttgcagatgtgaggaagaacagtcattctgttgggtgcattgtgatgtggtagtatcttggatggtaacatctacacccagattgccttgctggataaggctccaccatccatctgagatgagctcaggggaaggacgggtcacccccctaacatcacaccgcctcctcgtgcagattccagagctggtaccactcgagctccaccacctgggttacctcatcaacaagaagaggctggaagaggatgacatatttgaggagtgtgtcaataggaactcggtgcgtaggggtcagggtctgcgtgggggggaccctgcttga

SEQ ID NO: 7788 - DNA, 1077 bp, Chlorella protothecoides
  modified_base (648)..(657): a, c, t, g, unknown or other
atgagcgccacgaaccttcgtgctgacagactccagcccagccaccctcatgctccacaggaatggattggggtgccctacggcagccgcgtgcacgcccgggccccagactctggctgggcctatctgctggcccccacgccagagctgtggacggcagtgctcaggcaccggacccagatcctgtacgtcgctgacatcagcatggtggttgccatgctggagctgcggcctggttgcacaggtaagccctgggtcaatgcgctgtgtggatgccaggcctgctgtcatgcagagcccttgcattctgaaaatctcgccctctacccgcactctgccgtaccacgccctcctcacccccactctcctgcagtgctggaatctggcacggggagtgggtccctgacaacctcacttgccagagcagtggcgcccacgggacacgtgtacacctttgagttccacgagcagcgggcacagctcgcccgggaagactttgctgccaatggtgggcggcgaggtttctccttttcaatgctgtacatagacacacacagtgtgcatcatctggagggttaccgtgtgcaaggtttcagctccgtgcagcgccatgccttgtctctctctttcttcctgactcctacttannnnnnnnnncggtgggcggcgaggtttctccctttccatgctgtacatggacacacacagtgtgcaccatctggaaggttcacgtgttcaaggcttcagctcagtgcagcgccatgcctcgtctctctctttcttcctgactcctacttatgtgcaccgcctgcagggctgagtgatgtgatcaccgtccagcatcgcaacatagaggagtcgggcttcccttctgatctacatggcaaagcggacggcctcttcctggaccttcccggcccatggaaggctgtcaaatcggcagcagcctgcctccgaccagatggggtgttctgttccttcagcccctgcatagagcaggtgagggaggtcaggggggctgcagaaggagcattgtggaagagccacagccacaatcctttgcgaattatgttctaa

SEQ ID NO: 7789 - DNA, 528 bp, Chlorella protothecoides
  modified_base (325)..(334): a, c, t, g, unknown or other
atgacctcaatctcccccgccgcccccccacccccccgctcccgacccaaggtgcaacgcacgtgtggtgcgctggctcggagcgggtttcactgcctgcgcaccatggaggtcctgctgcgcagctacgaggtcacatccagtgggctcaaggccgtggaggagtcggtcctaggagacgatttgccttccggtgaacctgccgatgtgggcggcgacccagattccaagcgcgcaaagcgagaggacggagcagcgccggaggaggcacacaccgcagcttcggccgcccccacactgcccagccaagcccaggttctggccnnnnnnnnnngtgccgcagctccggccgcccctacactgcccagccaagcccaggttctggcccggcccgtggcctctggtcggggtcacacagggtacctgacctttgcccgcctggcagtcactgtgcccgggccacagccgcaggctgtgctggttgtgcctgccccggcagaggggggtgctgaacaggacactgcttga

SEQ ID NO: 7790 - DNA, 216 bp, Chlorella protothecoides
atgggcgtgaaggtcaccgaaggagaggcgacttccgtgacgggggagaagctctacacgacatcatacctccctgatgagccgcccagagccgcctttgtgattcatcatgggctggcggagcatatagggcggtatacaccaagtaagatggtggaatgtctctggggagtttcggacgtacgtgactgttcggggaccgggggcactgcttaa

SEQ ID NO: 7791 - DNA, 2952 bp, Chlorella protothecoides
  modified_base (378)..(412): a, c, t, g, unknown or other
  modified_base (1029)..(1038): a, c, t, g, unknown or other
  modified_base (1398)..(1407): a, c, t, g, unknown or other
  modified_base (1830)..(1839): a, c, t, g, unknown or other
atggaagggagggtggaaagctttggtggggggttggaagcagagcaggcagcgatgctcagggtgggctgcagcgagctcgaaatgggccatagctcactacgctggtgcacctccctgtgctcaacactgcaacgacatgccccttggtcccttgatcaagggaagtatactgtgctcagccactcccgtgacctgctggtggcgcaggcactcaggcccacagcagtcatcctggaggccagctatcatcaggacggggacgacggtgcggcgctgatgtggtggtactcgggaggttgggagcctaagagcggcagcatgttgaatggcaacgcgggatctgcgccgagggccaaacatagtgagctggatttnnnnnnnnnnnnnnnnnnnnnnnnnnnnnnnnnnncccctcttttcccagtgcaagatgtgcagcttgtgtccatcgacgacccagaggatggggcattcgactccatccaaggcatcctagcagagtttgggcctgcctttgccccgccttgccagctgggctcctctgctggacctgctgcagaggacgaggcagagctggggagtgggcaatcagcctctcgacctacatcaggtggtggccccgttgaataccgtgatcctggccaggctccctgcacatgtcccgagcctcgactgcaagacctgctcctgggttgccccggcacgggagctgcgggacaggattttctgacagaggtgaaggggccgctgctccttgcccagcccctcttcctgtgcggcggcgaggctgggccaggcgatccagccccgcccgcccgcgggagtgtgctcctggcggggaggggccggtgcccctttgcagacaaggccagggcggccgccgcctcccgggccgccgccctgatcgtcatcaactccggcgaggacgagcgggctgtctggccgatgagcggcgatggcgcgccaggtggggcggggatggtgggtatggggctgatgtactcgtgcacccaggtgtcgcctcannnnnnnnnnggggcggggatggtgggtatggggctgatgcgctcgtgcacccaggtgtcgcttcggagtgcttggcgggggcagcgagcatcgccagtcggcacggggccagagcaccgactcagatgtgtgcgcgccgcgtctggtggtgccgcgcctgccatggcatgcccctcccgctggccgaccgcagacctcggcgcgctgaccatgccggccgtcatggtcagcgcggcagctggcgggaagctgctggacctgctgcggtcccgcacccggcccaccctgcgcctgcgcgccgcggaggggatcccggccccggccaacgcctcggccctcccctccgcgagcacagccgggcccttgctnnnnnnnnnngcgcgccgcggaggggatcccggccccggcaaacgccacggccctcccctccgcgagcgcagccgggcccttgccgctggaccccggcctgcgcctggcctccctggagctgatggtccccccgcgctcccaggcccacgccctgcgtcacctgtcgagtggggaggccgagatggccggcatcgtcgcggccgtgcagctcgctctgcaggcaggcgaccagacgccgggggctgccaaggagggagcgcttcacccgttgctggccgcccggcaggacgagacctgccccgcgccatgagaagaatgatggcggcgggtggctgcgtcgacagttttcctgggcgggtccttcttgtgccgggtgttccttgcatggactttgctctggtcgggtctgcactgctgacatgcatggcgacnnnnnnnnnnttttcctgggcgggtccttcttgtgccgggggttctttgcatggactttgctctggtcgggcctgcactgctgacacgcatggcgatgtgcagtgtcccagcacacattctcgcccgatattcctcgacccgtcaatcccgaggctaggcacacgctgcggcacggagggcagcctacacatattcgcaaccatggcctctgaggccgtcactgccactgcgatgaaaactcagcgtcccgtgcgccccgctggatgctggaccctgtgctgcggccgcagcacgagccagactctccaaaaggcatcgggctttccggtgtcgaggctctgcaccaccctctcagagcctggcaggcacggcgctgcgcgccaggatccactcggcgatgccctcgatcagctcgtccttctgcggccccagcaggacctcgtggtaacccccagccacgaggcggtacgtcttgtcctggctgcccaccgcctccgtccagcggcgggtaaagagctcgtgggtgatgcggtcggagtcgccgtggtgcgcgtagatgggcatcgtcagccccggcgcgccccggaaaacctcgcgcattcccctgcgcagggacaccgcggtcttcaggctcagcggcgccaccgtgttgagggggtcatccacgtaggcctgcaccagggcggggtcggcgttcagcccggtggggtccaccaccttgagggccttgagccgcggcacgatgtgcaccagcaccccggcgacggcctcctgcaccaccaggcccagggaggccgggacgcccatggcgggggacatgatgaccgccccggccaggcccacgggctgcgcctgggcggccagcgcggcgatcaggccgcccatggagtgaccccccaggaagagggcgggggcctccccgggccagatggccgcgatctcggacagggcggtggcgcgccgggagttcaggtcggccaccatggtgtcgcaggaggggatgtaggcccgctccccggagctcttgccgtggccgtatgcgtcgtgcaggaacacggcgatgcccttctccgccaggatagtggccactgcagcaagagacgaggcgatttaaagtcatga

SEQ ID NO: 7792 - DNA, 2115 bp, Chlorella protothecoides
  modified_base (1009)..(1018): a, c, t, g, unknown or other
atggcacagcgaagaagtcctttgaactgcattctgcccggtaagctccccaaccctcacccacccaccctgagcacaggtgcacgcagcctcatcggccttgtggggaacaccatcagctgcgacaccaggggctgggagcggcacgactctgggatcggggctggagtggactcgtactatgagtatctcctcaaggtaacaggagggcccaatttgtggttggaactagcgaaacaggccccggtcgtcgctgggcagggctggcggcttggagtgctggctgctgcgctcatgtgctgctcagcgggggttttaagggggttcgggtgcgactctcctagcacagctcccacaagggtcaggtgttgcgcattggcgcggaggccggctcccgcatcctatcaccccctcactccgaaccccaaatccccgcaggcctacctgatgtttggcaacaggacccacctgcagtgggccagcgagtcttatgccgccctcctgacgcacagcgccgtgggcgccccgctgtctggttcgccctggctgctggacgtccacatgtccacggccctgctgctgcacacaggagtctggtcgctgtcggcgtactggccgggcttccaggcccttgcaggtgcgccgtggagggagggccaggagcaagggaaggggtgcgcaaaggggcggggagccctgactcagcggaaagacttcagagagggcatgcgaccaggctgttgggtctcaaacttgcctctcccccagaggcagcttgaggaggcggccgcccagcaccggcagtggctggccgtctggaacaagtttggctggctgccggagatgtttgacgtccagaaacagacacggcacccgacgctcagcggtgggttggggagactgttcctggtgggcgactcctcagccccgggcaatgtgggcagcgtggaagctagcttgttgctcaccgtgactctgctgacgcacacacattgctgctctacaaggnnnnnnnnnnccgggcaatgtgggcagcggtacccgctccgccccgagctcatggagtccaccttcatgctggccgccgacgcacccgacgcctcatacctgcgggcaggggaggccatgctgggcacgctgcgctcccgcaaccaggtggcctgcgggtacgccgctgtgcacgacgtcagcacaggaaagctatcggacagcatggagtccttcttcctgtccgagactgtcaagtacctgtacctcctcttcgccaacgcttcagcggccctggaccggtgggtgctgaccacggagggccacttcttggacgcctgggctgatacggaggagcagtgggaggcagagcatgggacagtcatgctcggggctgcgggcgcggagggccccatcggtgcgaatgcaacgagtggtggccctgtgggagcacctgtcccggccagcactggcaagggtagcggggccaggccaggcggctatgtgacggaggcacctcccgggaatgcgtcccatgatgcagcagccctgatgctggccggaaccttcctgagccatgaagagaccaccgtcgcccctacgcaagaggtggtgtccatggaagtagaaaccgtagcggctcgctgccggcacctgtgcgaggcgcaggaccccgaccagtttgccaggcgcgcagccgccctgcgcgccgccctgcctgcgctgcccgactcccagccgctgcaaccgtcgctcatccggcgccggcgctgcacggcgtgccaggccttcacgcgcgccggcgaggcggcgcgccgcgcaagggccgcgagacgccacgtcggcgcaaccgccgccttcgcgcgccagctggccagcgccacggcacgcaaggccgcagaggcggcgcggcggggctggacgccgcccgcgtacttcctgtgcgacctgcgcaggaccgggggggtgctgggctgcggcgcgctgaaggtgctgcaagccggcatggaactggaggacctcatggtgcgttatggaagggagggtggaaggctttggtgggagtctggaagcagagcgggcagcgatgctcagggtgggctgcagcgagctcgaaatggggcatag

SEQ ID NO: 7793 - DNA, 636 bp, Chlorella protothecoides
atggctgagcgcacaagtgatccgtggctctgcttggaccctcctcagctttacaatctagatgcaaccttaaattgcgatattgcagtcaatttgaggtcgcttacggccgagcctgctcgtagcagcgctgtcgctgttggtgctcttgaccccatctacaagggcattggacatagagggcagggtgatcctcccagtgggtgccgttccctctcttacaccacacccacgctggctcacccttgcaccccaacagagacaaccccgaatgcgctggacacagagctggtgctgagtaaggagcagggtgacgaggtgcgcaccttccccctcccggacggtcgcttcgccttccacaacgtgcctgctggcaagcactacttggaggtggagttggtcggactcgtctactccaccgtcgagctcaccgtgggtgttgctggggacgtcaatgctctcctgtcggatgtcatcaatgtaaggtctcacgcgtggtgggagggttggtgtgggacttcttggatgctgggacaggtgacgagatgtgatgatgtgctcgtcgcatgtttttcacagatgttgtcctatgtgtttgcccttgttggtgttcctcggcacaaacagttcagctga

SEQ ID NO: 7794 - DNA, 600 bp, Chlorella protothecoides
atgggtgtgggacccggcgtgcctccccagaaacagcctagatgctcgagcccctgtcccattgccctctgccaggatgaccttcgaccactcagctgcaatgggagtgattcccaagggggcatcgggctcacgaccctggacagcctcgacaccctcctggtgaggacctacagcctagagcagggagtgatgaaccagctggaagcattttacaaagccctctgctgggtcactggggagggaaccgactgcgggagcggcggcgatccccctccccgcctcacctttgaccttgatgtcagggtgcatgtctttgaggtcacaattcgtgccctgggaggcctcctctccgctcaccagctgctcactcagaatctgcagctggcaccctggtatcgggggggcctcctgctcgctgcggtcgatctggccgatcgcctccttcctgcattcaacacgccatccgggatccccctgtcatggatcaacctgaggcatggccaggcaagtgacagggttgtggagggttggcaagggactttaagcatgagcttaaagcattctgcatcattggaacccccaggcatctgcgtttga

SEQ ID NO: 7795 - DNA, 504 bp, Chlorella protothecoides
atgcaattcacccaggcggtgcacatgtttgagtttgatcgccacctggcgccctacgacctcgccaacctggcgacctggcgctcgctctccgcccacgtgacccccgccgtcatcgaccgcctccaacccgtgggagggaacatctgcgtgctggcggaggcgccgccggggtcgcgcgggaggcgccaaaccccagcagaagcggccctggaggcccagctcagccggcgcaaggccacctcaagctcgcagggaggcggggggtcggatgacagtgcagtgccaggctctcacccccaaggtgccctcttcgcggcgccgcacgccggccgctgcttttacacccgcactcagaccgtctccagagacggggtttatgatgcggctgcgcgcacacggcacaacctggaccggtccgaggggctggactcgctgattcgggaagagtacgcaggggacggcgacctcctgctgggtgagccgttggcgggaggaggatga

SEQ ID NO: 7796 - DNA, 267 bp, Chlorella protothecoides
atgtgcctccaatccctccctccctgggtcccaaccacaggcgagctgcagtttgctttcctggccttcctggtgggccagagctttgcggggctcatacagtggcgggcgctcctccagctcctgctcggctgcttctctgccgccctggggcagcaccagcagctctttgcccaggctctcgatgtgctggcggcacagctggctgcctcaagccagaagcaggtgatagtcagggatgtgcaaggcatacttgacccagggtag

SEQ ID NO: 7797 - DNA, 636 bp, Chlorella protothecoides
atgcgtgtgggggggtgtggaaccccgcctcggtcgacacatcgagatgccttgagggatggcgcgcggtttgccttgcaccgggtgccccgggatgcctcacatgaggtgacggaagcagcacctgccgtggcaggcgaggagcgcctgcgggccctggtccagcgcagccccatcatgctcttcatgaagggctcccccgacgccccccagtgcggcttctccgccaaggtcgtggccgcattgcgcgccgtgggagcggacttcgactcctttgacatcctgggcgacgctggggtgcgccaaggcctcaaggcctactccaactggcccaccttcccgcagctctacgtggcgggggagctcctgggcggctgcgacattgtcctcgagctggccgccagcggcgagctggccgctgagctggcggctgcgggcgcgccaggggacgcggaccgcaccgcgcagctcacggcgctcgtcaactcctcccccgtcatgctcttcatgaagggtgagcagagggggagatgggtggtgagaggagcatgggaaggcaggactccctgcccgcacgggcatgcccccggcccaaagctgcccctgaatcaagtaccgcgcccgcgtcgtggatga

SEQ ID NO: 7798 - DNA, 273 bp, Chlorella protothecoides
atggacgccgcgaacctggccaaggtcaagggccagatgcacagcttcgcgatgggcgaggccatggctcaggccgcacaagactaccagcaacatattctggcgagtcagcaagctgccgccggcaagggcttgccggccttctacgcggatgacatgctgaacgatccggaggtggagagcctgcaggccgagcgcttggaggagctgaagatgcaggccgagagacgtgcagcaaagactgcccagacctcttatggtgaggcagactga

SEQ ID NO: 7799 - DNA, 663 bp, Chlorella protothecoides
atggaggacgcccaggcggtggccgaggttgcgcacgacgcctccagcctggcggcgctggtgggcgcgctgggcgccacgggcgctgcggggcgggtgcgcacgctgctggccgggtcgggagtggcgcccagtcaggccctgctcaacgcgggcgtggcggcctgcgcgcgggagggccgtgtggcggacgccgcgcggctgctggccgacttccgcggcgcgggcgtcgcgccggacgcacgcacctacaccagcctgatcgcggggtgctccttcgggcggcagggcgcgctggcctgggaccttctgggccgtatgcgcgagcggggcctggcgccgggggcacccaccttcaacgccttggtcaaggtggagtgccacgtggcggggccggacggcgggctggccgccgtcaacgccatgctcaccgccggggtcaagccggatgtcgtgacctggaccacgctgctagccgcggggcggcaggcggggcgggaggacgtcgtgcagcaggtgctgcttgaatgggtgctggagaggtgtggaggggcggggatggcactggaggagctcagggccctgcaggcagcgagggaggacgccgcccgggacgcgcagtggcgagggcattacgcggtggacgaggatgacgaatggtag

SEQ ID NO: 7800 - DNA, 453 bp, Chlorella protothecoides
atggcgatgcccacagccgactcgagaatgcttatgcaggtggggcctgggggcgtggatgacggggcggggccttgctgccaggggtgcggtgatgctgcatcggagcaacatgcgccgggtgccgtcgctgcctgcatgccggaccttgtcgaagcatgtgcccagggccacaggcgccagcccctgcctcccatccccaaccctaccccatctttgtctcctgcctgcgcatgcagcgtgctcatattcgaggtcaccgagcccggcttcccggtcgaggaagctgtgcgcatcttcatccagttctccagtgccggggaggccacacaggtgggtggcccggtggtcgtagagccaaacctcagcagaatcccttgttgcagagttttacctggatgcggacaagtcttgcacaccccttccggcacatccaggccatgctggacttga

SEQ ID NO: 7801 - DNA, 1464 bp, Chlorella protothecoides
  modified_base (453)..(462): a, c, t, g, unknown or other
  modified_base (993)..(1002): a, c, t, g, unknown or other
atgccggacctgccccccggctacgcgtcggcgtttgagggtgccaagcgcggcggcctggcctccgacggcgagctgctggactacccctccaccgagaccttcctgcgccgcgccttcttcgacctgggcgagctctgtgcccgccgcccgggcctcattctggccgccactgtcaccgcggccgggctcgctgcgcttggcctgttggcccttcgcatcgagtccgacccggagcggctgtgggtggggccggggtcgcaggcggcgagggagcaggccgactatgagggtggctgggagtgggaagtgcgtgccttgctgatgccatgtatgggaacccagcagcgcctgcatgtgtctggcccctggacgctagtgtcgcatccgcccgctcgccacacgccgaccgcccgcaccgtccgcaccgcccgcaggcgtccttcggccccnnnnnnnnnnggtgttgcacccgcctgctcgccgcacgccgaccgcccgcaccgcccgcaccgcccgcaggcgtccttcggccccttctaccgcatcagccagctcatcctgagcaccggcgagggcggcggggccatcaccaccgattcccacctgcgcacgctgtttgccatgcacgagctcgtggatcagctcgcggcgccctacggcgaggaggctggggcggccgggaacgccacgctctcctccgtctgcttcaagccgctgggtgctgagtgcgccatccagagcgtggcgcagtactggcaactcagcgtggatgtctacgagcatggtgggtgtttgggggtgggggtcctgagtggctttgttttggtgctgattgggtgtcggtgtacctgggcattggggactgagacagtcatgtgcgaggtcggagtggaggaaggattgtgccgagcagatgatggtcccttacaccagtgctcttctcctttggccttggtgcatgggctgcccagccctgcctggtcgggtacnnnnnnnnnnatacctgggcgttggggactgagtcagtcatgtgcgaggttggaatggaggaagaattgtgcagaacagatgctggtcccttacaccagtgcgcttgtctttggccgggtgcgtgggctgcccagccctgcctggtcgggcagcccgcccatgatggtccctgtgacacctgagttctgctatgggcattggaacacgcagtgcctgagcgcctatggcgcccccattgacccgcacgtcgtgctgggcggcttccccacggccgccgcggagttccgcaatttttcggcggatgccacggccttcgtggtgaccttcctcctcgaccccgccccggcgctgcggtgtgtggggagtgcgatgcttgagttagggtttggcctatgtatagataaagaacttttgttccgcatccctactctccgtcaatatccctccctcgggctgttcctggcattctga

SEQ ID NO: 7802 - DNA, 1770 bp, Chlorella protothecoides
  modified_base (182)..(191): a, c, t, g, unknown or other
  modified_base (464)..(473): a, c, t, g, unknown or other
  modified_base (1051)..(1060): a, c, t, g, unknown or other
  modified_base (1381)..(1390): a, c, t, g, unknown or other
  modified_base (1639)..(1648): a, c, t, g, unknown or other
atgcgcattgttacacattgcatatgtggtcaggctgggcatcacacatatggtggattgggactattttctcctcgtggaatctcgaggaggcacgtggtgccagcagcactgtcacacacagggattccgtctcacgaagtgcatgacgattgtggcatgctcctaagcatcttcaatgnnnnnnnnnnattgcatatgtggtcaggctgggcatcacaaatatggtggcttgggactatttccccctcgtggaatctcgaggaggcacgtggtgccagcagcactttcacacacagggattccgtctcacaaacgcacgtcatggcacccgcaccctctcctgaagacttcctccttgccgagccggacgcactgtcggatgtgcagctggatgcctactacatggatggcctggacgaggaccagcgactgccccataggccgttgcatttcctcctcannnnnnnnnnctgccccataggtgggacagcctgggtctgtcctggataccatgcgagtttgaagaggcccatcctcataaaaccttgtgctcgctctcggtcaaggccgttgcatttcctcctcaccccatgcaggttggagcccaattcccctgcgccaccccaggcacttcgtgccctgggtgtgctgagctggaggcttaaccccgacactcccgaaggagcacagaagcttgctgcgatcaggcgcgtccgaaactacacttatgaggcgagtgtggctgatcaggacatcgcatggcatgtgccgagaccttggcactcccgcccatgcagctccaggcaccacacactgccatcgcctctttgccacaggacaccatcgacgtgtcgccagccacccttccggggtacgatgagaagatcaagaccttctttgaggagcacatccacactgatgaggagatccgattcgtgctggaaggcagcggtgcggcggctggttggggggtccctggatatgatggtggcgtgcatcatgggactagagcgtattcatgctctgcagcgccatgtggcgtgcaaannnnnnnnnntggatatgatggtggcgtgcatcatgggacaagagcgtattcatgctctgcagagccatgcggcgtgcaacctcttactagatcaattcagaagctgcaagccagtccctctgagcgatacacttcctttccacaccctttccacaggatactttgacgtgcgggacctggaggaccgctggatccgcatccatgtgaagacaggggacatgttggtgctgcccgaggggatctaccaccgcttcacgctggacaccagcaaccacatcaaggtgcgcagtttgaagctgctttgggatggtgcagaagctggagtggggnnnnnnnnnngggatggtgcagaagctggagtgggcgtgcatcagatcaatgttcctcctcaatcctgtgccctcgtcgcatgcctcccaccctcaggccctgagactcttcatcggagacccggtgtggacccctctgaaccggccgcaggagacacacccgtcgagggaaaaatggcatgcatttcgatggtcaagagggattcccgtcgaggtcgtgcatgctcttatgcgtgtgccaatgactctgactggtctnnnnnnnnnncgatggtcaagagggattcccgtcgaggtcatgcatgctcttatgcgtgtgcccctgactctgactggccattgtgtttcaatgtagctggcctgttggctggcgacgatgatgcagtttga

SEQ ID NO: 7803 - DNA, 624 bp, Chlorella protothecoides
atgctggccattacggggtctcttgcagtggcgagccccgccctgcggggctgtggtaggaagcagccacgagcactccgagcatgcaggcgggccccccgccccatgcaccgacgccaggcttgtgcagcgctacccaatgatgagaatcctgaacaggcggtgcagcgacgccttcgggagagcgaggaggtcgcggagagggtgaagttcctgcaagaccgtgtggagctggatgcggcgctggagagggtgcggccggatttgggggccggggcgagtgcgtcgactaagcatggagggcatcccgctgagatgcttacaggggatggctttgtcgcaggggactccttggtggtcctggaagtagcctccgaggaaatttgccagacggggtgggacgaggagccggagctgcagtgggacgaagataagcgggcggcgctggagccctgcctgcgcctcaagcacacctttgcccgcattgcccgtgactgctcggatgccgtgtttctcgccatcagcgtgcgcgtctggggcaaggattggagtgggggcctgtgtttgaatggggtgtgcatgccgcactcggaccagccatcctattgcaagccgggaagctag

SEQ ID NO: 7804 - DNA, 1074 bp, Chlorella protothecoides
  modified_base (841)..(850): a, c, t, g, unknown or other
atggcgcggttggcgatcacctcgttggcgttcatgttgctctgcgtcccggaccccgtctgccacaccaccagcgggaagtggtcggtcaggcggccctctgccacctcgcccgccgccgacacgatggcttcgccctggcgccgatccagcacgcccatctgcatgttgacgcgcgcggcggcgcgcttgagcacgccaaaggcgcggaccacgggctcgggcatgcgttctgcggggcccccaatcttgaagttctggatggagcgctgggtctgggcgccccagtacctgaggtgcaatcggggtttgaggggtgggatgggatcagggatgatcaggggcgctgtgggacacggatcgcaggtgcgtacgggggcccgcatcgcagtgcctcgaaggagcgaggagtcctcgggcctgaccatcgtgagatcgggtgcatgcatgtccagaacccaaagcccgatggggccccatctcaccggtcggacggcacctccaggggtccgaatgtgtcacgctccgctagggacgacgcgcacggatggcgacaaaaccctgtcaccacggcacccacggactgaaatcaatggaaattcaccattcatatatgcacctggcagtgaccgggcctcggctccatgcgccaggactcgggcggacaggcgctgcaggggtcccgacatactaaaagaaagcaggatcgctgttccccgtccagatcccggtgctgatgctaggcaacgactgttgcccgatccagcgaacgttcagcctgcagggaagggcagcgcatcctttggaaatatatactcgaacaaatccaggctattatttnnnnnnnnnntgcccgatccagcgaacgttcagcctgcagagaagggcagcgcatcctttgaaagtatatactcgaacaaatccaggtcattattcatacagcctgaacgccatccccgggtccaaagccgtagaccaccgagtggctgcagcaggcacccatctgctggctgcgagtatgctgcagcggctgcgccatgtagcatgcgcagtgcgccccgcagtggttgctga

SEQ ID NO: 7805 - DNA, 1269 bp, Chlorella protothecoides
atgggcccggttgcaactccaacgctggccgaaccccgctgttcatgctgcgagcccgttgtttccctctcatttgcacccgtgtgcgtaatgcagtgcttacaagacggcactcggtccaggaacatattcgggggcatcccatggcagcggggcccctggctgcaaccctcggtgtcgaggcatgagacctttctccctgacgccaccgtccgcctcaccccactccccaagcgccgagccccgggttcagggcgtgggcgcgagcatgtcctcgggcctcacccatgcgtcaaactcctgctcggtgcagtggcccagtgccagcgccgcctgcttcagcgtactgccgtccttgtgcgccttcttggcgatggctgctgccttgtcgtacccgatgtggttgttcagcgcggtgaccagcatgagggactcgtgcagaagctgcgcgatgcgcgactcgttggcccggatgccccccacgcagttgtcggtgaaggagcgcgcggcgtcggccagcaggcgcgcggagtgcagcaggttgcgcgccatcatgggcttgaacacgttgagctcgaagtggccgttggagccgccgaccgtgaccgccacgtggttgcccatcacctgcgcgcacaccatggtcagcgcctcgcactgcgtggggttcaccttcccgggcatgatgctggacccgggctcgttctccggcaggctcagctcgcccaggccgcagcgcgggcccgaccccaggaagcgcacgtcgttggcgatcttcatcaggctcaccgccagcgtgttgagcgcgccgctggcctccaccaccgcgtcgtgcgcggccagggcctcaaacttgttgggcgcggtgacgaagggcaggccggtgtcctccgccaccgccgccgccacggcctcggcgaagccgacgcgcgcgttcaggccggtgccgacggcggtgccgccctgggccagcatggccaggcgcgggagggaggagcgcacgcgctcgatgccgtaggccacctgcgtcgcgtagccggagaattcctggcccagcgtcagcggcgtcgcgtcctgggtgtgggtgcggccgatcttgacgatgtgcgcaaactcggcctgcttggcctccagcgcggactgcaggtgcgccagcgcgggcagcaggcggcgctcgatctctgtcacccccgcgatgtgcatgacggtggggaaggtgtcgttggaggactggcccttgttcacgtggtcgttggggtgcaccagtga

SEQ ID NO: 7806 - DNA, 1032 bp, Chlorella protothecoides
atgacgaccaatggcgctcctgcagaagcatcaccaccaccagacgccaatgaacgtgagcactcgagggcttgcaccgcttggatgtgtcatgttcatcaaccccccttatcattcactcacatactccccaccccaccgtcccccccaggctgcccgggcaccgccagcaccgccgcgggcacctccgacgcctgcaagggctgccccaatcagcaggcctgcgcctccgcgcccaagggtcccgaccccgacatgttggccatagcggagcgcctggcccccatcaagcatatcatcctggtcctgtccggcaagggcggggtgggcaagtccaccaccgccgcccagctggcctttgcgctggccggcgaggggcacgaggtggggctcatggacatcgacatctgcggcccctccgtccccaaaatgctgggcctggagggggaggaggtgcaccagagtggggcggggtggtcgccggtctacattcagtctcccgatcagctgccaggggttgcactgccggcacctttgaacttgcaactgctcaaagcaaaatcgcagtgccatgccggatcaacacagacttcgggtctcctgtgtgctctcactctgaatccattcccaccctctatcccttcccccttcttcatcgtcccaaaggagaacctgggtgtgatgagcattggattcatgctgcccaaccccgacgacgcggtagtgtggcgcgggccgcgtaagaacgggctcatcaagcagttcctcaaggacgtgcactggggggacctggactacctcatcatcgacacgcccccggggacgagcgacgagcacatctccatcgtgcagtacttgaaagcagggcgggtggcgggggcggtggtggtcaccaccccacaggaggttgccatcgtggatgtgcgcaaggagatcagcttctgcagaaaggtagggccggaggctggcaatgggagtgctggcattatttggatacctcgagcggcgtattttatttccgtgatggggtaa

SEQ ID NO: 7807 - DNA, 666 bp, Chlorella protothecoides
  modified_base (396)..(405): a, c, t, g, unknown or other
atgatctgcacactcccacgccccccccctcagatcctcatattcgtgaacagcgtggagtcggggctcagggtccggctcttcctggaggcctttggcgtgcgcgcggcgctggtgcactcggagctgccgctgaactcccggcaccacatcctgcaagagttcaatcgaggcctgtttgacatcctggtggccaccgacgacgtgcacgccggggagaagaaggaggccaaggaggggacgggcaggcgcgggcggcgggcccagaagcagccccagggaccgaatggtgaggctggcgtcacgaggtgcagaggcagacgcatttgctgtgtggccgagggtggtgttgcagaccagagtccgtccccagccagtccttctgatcgatctgcnnnnnnnnnngggggctctggagtgatgatggtgttcttaggttgcagtgaattgagtcaaaatggtgaggctggcgtcaggaggtgcagaggcagacgcctttgctgtgtggccgacggtggtgttgcagaccagagtccgtcaccagccagtccttccgatccatctggtgcacctcaacctggccacatgcacaatgccgcaggcaaaggacgaggagtttggggtcacaagaggcatcgacttcaagggcgtgaacacagtgattaa

SEQ ID NO: 7808 - DNA, 849 bp, Chlorella protothecoides
  modified_base (472)..(481): a, c, t, g, unknown or other
atggagggggaggagatgggtgccaggatggagagggaggacaaaaagacctttcggaagccagaaggcgccggtgagtgcagggcagtgtggcccgctcgcactgctacaagtggtcttactgagctgatgtgctgttgcataccgccaagacctgggtctgggaatcaggaggacctgaggcgtgcgatctcgtttcatcaggcgggtcctctccacatcccatccacggcagttcctctggatcaagaaggagcgctagatgctctccgcatgggcacttggcggcttcgtgggcacacgtgctcgcagatagaagccctcgtggcgcagatcgagggcgcctggaggaccgtgtttgggtcagactttcgcctctaccagctggacagggaacctcttcagggtttcagcccagcaacggtctcccatcactctgtcgcacacccgcccaggacatgcgttttgcggnnnnnnnnnnaagccatgtgcttacaggaagggaagcccgtcacaggaacctcttcagggtttcagcctagcaacggtctcccatcactccgttgcacacccgcccaggacatgcgttttgcggacagcgtcgacatgaacaaggactacccctcctcctgggcggagctgatggaccccaccaaggacgagcccggctaccctcggctcatgctggagaatcgggcgtaccaaacgcgcgtctttcgcaaggtgcaccttgaggtcggtatccgccaggacaacatccaggtgagccttcgatcctggtcaggaagctgcgctgggaatcttgatggggcaaccatcctcaagtcgcagtctcctggtggtgattga

SEQ ID NO: 7809 - DNA, 360 bp, Chlorella protothecoides
atgtccagggagatgcaggagcggtattccctgggcaaggcgcgggacatcccggcctgggcgtcctccatcctctcccccctggccgtcgtcacctcccccgccacgcccgaggaggtgggcaacttcatcaagtacgccatcaccctcgtccgctaccacacagaagtcgggcgcatcatcgaccccgtctctggcgcgggcgccgcggcgcgactgcagaccatccgggccgcgcacaagcactactgcacccagaacctgcggaacctgaaaacacgtcgcatgctggaggcgtcctttggcgtggagtggtcggacaagtacctgcgacacatcatgttcgacttcgagggctga

SEQ ID NO: 7810 - DNA, 273 bp, Chlorella protothecoides
atgcagatccagatagctaacatttttctgctcggctgccccgcctgctcccacaacttcaagcacctcttctgcctgctggagtgccaccccgaccaggcgaccttcactaacgtgactgccacccagccagcacacgacaccggggtaacctccgttgccaacgtgtcctactacgtcacaccgcactttggccaggcactctttgacagctgcaaggatgtcacctaccctgtcctcaaccaaaaggccatgaagttcgtgggcgggtga

SEQ ID NO: 7811 - DNA, 366 bp, Chlorella protothecoides
atgtcatctcccacccatggatcattgtcgcccttgagcggaagcctgctcaggcccgccctcctcccatccctccccatacaggcggatgaccccaagtccaaggagcttgtggaggagctgcaggtcaagacgatcccgacggtgcaattcatcaagaacaagcaactgctctgggagcacaagggcatcaacaagctggagcagaatctgagcgagggcgtgctctattatggtgaccaggcggccgagaacctgaaggccagcagctttgtcaaggatctgcacagccccgaggagttccaggagtttgtcaagtcgcaggagaaagacgtgagatggtgtgggagggtgggtggggcatag

SEQ ID NO: 7812 - DNA, 642 bp, Chlorella protothecoides
atggcggaggaggccggcctgcgcctgtccttcagcgcgcagcgctccgtggcggatgagatctcgcgcgagggctgggccgatgcctggacggtggtcgcctcctacgcggccatgctggcctacattgcggcggccatgggcaccttcccgcgcggccaaccccgcctcctccactcccgcatcggcctggggctggcgggcgtgagctgcgtggccgcctccgtggctgcggcgctgggcttgtttggctgggcagggacccccgctacgctcatcgtcatggaggtcatccccttcctcgcgctggcaggatgcgtgggttggagtgccgccaactattcactggcctggtgcttcaccactctctccgtccccacagtcggcgtggacaacatgttcatcctcgcctcggcgctggagcggcagcctcgcagccggcccctcccccagcgtgcggggctggccctggccgccgtcgggccatccatcctcctggccgccacctgcgaggtactgtcattggcaagggtggcatttgtgggacattggcttgtcagcaatgctttcaaggggcaaaaggcttccgatcaggccagtgtggcccattcctggcacgttgtgttgtatgcccgtccctga

SEQ ID NO: 7813 - DNA, 1284 bp, Chlorella protothecoides
atggccttcaccagaagcttgcgccccctccacaccccttcattgcccccctctttaccgagcacacccaccacctccaggtacatctacaccgagggcgacccgcccctggacaggctgcaccagctggcccaggcggccgtggcacgccgcaaaacccccctctccgccggcgacgtagtggccggcgtgtttgtggagcgcggcgtcgactgcggcgaggccctgctggccagggtcaaggccctgcagcccttgctggcccgcgtcgcgggcaccccagcccccgtgcgcctgctggtggtcgactccctggccgccccgctccgcgacctgggccccagccccggccgacgcgagctcctggcccgggcgcagaccttcttccgcctcgcggccgcgctgcgcgcgctggcggaccgccacggctttgcggtgctggtcacgaaccaggtgacggacgtggtggcggggccgggggcggcgctggcgcgcagcgccacgggcggcgcgcccctgctcacctcggggcgcgaagtgacgcccgcgctgggcctggcctgggcatcctgcgtcaacacccgcctcttcgccgcgcacgccgccggggggggagcgcctgggccgcgcgtcctgcacctgcgcctgggccacgcgtcctgcacctggtctggggccctggcctgggcgccaggcgctgcgagttcgtcgtgggggccggcggcgtgcggggccggcggcccgagggccccgggggggaaagcatggcgcggagaccctgaccccccaggcggtgtgggcgtccgtgtggccgcgactgccagggaggctcccatccccccctactcgggacaggcagattcattgccaggcggtgggtcgcatgcatggggccccttcactcacgtaatcggttcagcccctccccgaccttgctcccgcggagccctgcgccgccagggacgcgcccacgccttcctcctcctcgtcccggaacagctcggagggcagcgcggcgcccagcgacccccgccaccgccccgagggcgcggggcacagctcccagcggtcccaggcgctggggcccagcaggctcagcaggacagggagcaggatcaggccgtgagcggcgcccaccagcaccagcgccaggtacatgcggaagaagtagacgcggaagatctgggtgcgcgcaaaggccagcaccgccacgcctgcgggttggatttgtttttttgggggggggggcaatatgagcgtggtcgtgatcgagagggacgatga

SEQ ID NO: 7814 - DNA, 732 bp, Chlorella protothecoides
atgttctcgggactttacggcgacctcccatccgccaaaggggaggatacgaaaccctcagatggcccctgggtcggcaaaggcctggtggcaccctccagcctgaacgcccggcgagctgggccaggtgcctcggcccccatgccccccccctcggtcctgcgcgccggcaggggccggggacgggagggtcccggccccgtcgctcctgggcgcggaggccgcggcggccgagggccgggccctggtcccaccgcccccccagctgaagctacctcctccgccgccgcggcgatcgcgtctgcggcgccgctgccgcagggcagcgcgcccagcgtggcagacgagtacgaccccgcccgccccaacgactacgaggcggtgcgccgcgcgcgggaggccaagcgcctggaggcggaggcggcggcggcgcgccaggaggcggcgcgggaggcgacggaggcggcggcgcgactggcggaggacgtcgcggcgcagaggcatgcaccccccgcgcccgctgacgagcggtcggccaggctggcgctgagcggggaggaggcgtggcagaagcgaggcgcgccgcagcgcccggcctgggccacggcgcaagaccccggggcgggggccgccggtccaccacaggccgcgccgccggcagagaagaagtccctggcgcaggtgaggggctcggagtgtgccagtgcggtgacttgtgattggactgcgtag

SEQ ID NO: 7815 - DNA, 354 bp, Chlorella protothecoides
atgtcgacattcacgggtggcgccttgaagctgaagggtggtctgaaacccaccggcatcaagaagaagaagaaaaagtcctcgaccaccaccgagctcgtcgccgagggcgagggcgccagcgcacccctcgcagtggaggcccgccgcaccgccgcagagaaggctgccgatgcccacgcgctcaagtacgaggaggcccgcatccgcaaggcggcggccaagtcccaccgcgagcgcatcgcggagatgaacgagaagctggccaacctgaccgaggtgagtgggcaagcgtgcaggagggtcgtcggtggtgtgagggggaggggagctgtgtgcagccccccgtcctaa

SEQ ID NO: 7816 - DNA, 390 bp, Chlorella protothecoides
atgaagaatagaccccaaccgccagcactgcgcagccaaactcacccttgcttgaaacacacggtgcaattcccctgcagatatgtgcacagactgggtcggacggggcgtgctggggaggatggtttcggcatcagcatcgtagggccgtccgagaccgagctggcggccagcatcgaggagatgctggcggggggaagcacgaaggcaggagagagcggtgaggaggaggcggcctgtgagcccgtcatgaagccgtacaccaaattgacggcagtggcgctggaggggctgcggtaccgcggcaccgacgtcgcccgcagcctgaccaagaggaccatcatagaggtgggcttggatgcctccgtgtgtcctctgtgcatttcttga

SEQ ID NO: 7817 - DNA, 1437 bp, Chlorella protothecoides
atgcgggcccccgtacgcacctgcgatccgtgtcccacagcgcccctgatcatccctgatcccatcccacccctcaaaccccgattgcacctcaggtactggggcgcccagacccagcgctccatccagaacttcaagattgggggccccgcagaacgcatgcccgagcccgtggtccgcgcctttggcgtgctcaagcgcgccgccgcgcgcgtcaacatgcagatgggcgtgctggatcggcgccagggcgaagccatcgtgtcggcggcgggcgaggtggcagagggccgcctgaccgaccacttcccgctggtggtgtggcagacggggtccgggacgcagagcaacatgaacgccaacgaggtgatcgccaaccgcgccatcgagatcctgggcggggagctgggggacaagtcactggtgcaccccaacgaccacgtgaacaagggccagtcctccaacgacaccttccccaccgtcatgcacatcgcgggggtgacagagatcgagcgccgcctgctgcccgcgctggcgcacctgcagtccgcgctggaggccaagcaggccgagtttgcgcacatcgtcaagatcggccgcacccacacccaggacgcgacgccgctgacgctgggccaggaattctccggctacgcgacgcaggtggcctacggcatcgagcgcgtgcgctcctccctcccgcgcctggccatgctggcccagggcggcaccgccgtcggcaccggcctgaacgcgcgcgtcggcttcgccgaggccgtggcggcggcggtggcggaggacaccggcctgcccttcgtcaccgcgcccaacaagtttgaggccctggccgcgcacgacgcggtggtggaggccagcggcgcgctcaacacgctggcggtgagcctgatgaagatcgccaacgacgtgcgcttcctggggtcgggcccgcgctgcggcctgggcgagctgagcctgccggagaacgagcccgggtccagcatcatgcccgggaaggtgaaccccacgcagtgcgaggcgctgaccatggtgtgcgcgcaggtgatgggcaaccacgtggcggtcacggtcggcggctccaacggccacttcgagctcaacgtgttcaagcccatgatggcgcgcaacctgctgcactccgcgcgcctgctggccgacgccgcgcgctccttcaccgacaactgcgtggggggcatccgggccaacgagtcgcgcatcgcgcagcttctgcacgagtccctcatgctggtcaccgcgctgaacaaccacatcgggtacgacaaggcagcagccatcgccaagaaggcgcacaaggacggcagtacgctgaagcaggcggcgctggcactgggccactgcaccgagcaggagtttgacgcatgggtgaggcccgaggacatgctcgcgcccacgccctga

SEQ ID NO: 7818 - DNA, 327 bp, Chlorella protothecoides
atgtgcgagccctgcgtgcacatctttcccgcggtcctggcgctggcgcgcaacttcgaaaagcacgcggcctttgcgcgcgtccagctggacgagacgcccgagctggaggcgctgctggcggggtctctgggcatccgcgacgtccccaccttcctcttctaccgcaacggcgcagcggtaggacgccacgtgggcggttcccgtgccgacctcatcggcaacatcctgcagcagcaggtgggggcggggcaccccctgccgcctcccggacccaaggcgaccaaggccgcgcccgcggcggcccgcaagttctccaattggtga

SEQ ID NO: 7819 - DNA, 1650 bp, Chlorella protothecoides
atgtcccgcctgcagccagaatgcacagggcatgtccccagccttcaccccttgttctccctggcagatgacgacctgggcgaggcctcctggggggagcgcagcgtcacgggcgcccttcgcgccctcatccgcgaccgcctggtcccggcgctgcgccgcccagcggtgaagagcggcgtccttgtgaccttcactgtcttcttcatcctcagtctggccgccctgcctcgcctggaaaggggcacttttgatgtctccaactgcatgcttccgtttgcacctggaatggcagcccgggcagttcccataaaagccaccaggtggccagcattgacagccccaatactctgccgccactccgcctctgtcacgctcaccaagccagcccatctcaacctccacaggggcttggagcagtccacggccctaccggccgactcctacctgcaggactactttgctgacgtggcagggctgctccgcgtcggcccgcctctcatcctcgtggtggaaggcctggacctgacccagcacgcgcatgacaatgtcaccgccatatgctccgtgtccggctgcgacccagactccctgctcaacgaggtgtcgcgcgccgcgctcgcgccctggcagtccttcctggccgcccccgcggcctcctggctggacgacttcatcacatggctgtccccggacgccccgctctgctgccgtcagcacgggggggaccttggaggtggtattctcggcctcggccccgatcctgaccccgcctactgcccgccccccgaccaggagccctgcgcctctgatcccaccgcctgcgccgactgccggccctgcctggggccgggcgagttgtccgacggccgccccactctggcccagttccaggcgcgcctgccgtggttcctggcggctaagcccagcgcggcctgcgccaagggcggcgcgggggcctacgacgccgctctgcgccgctctgcgtccgatgccaccgccgtcgcaggcctgtcccggggcagggtggacgcctccgccttccgcaccagctacgtgtctctgtcgcgccaggccgacttcatccaggctctccaggcgtcgcgtgggtttgcggaggagcagtcgcgggcgctaggcctgcaggtctacgcctactccatcttccacgtcttcttcgagcagtacctgaccatcgcaggcgaggcggccaccatcctgggcatcgccgccaccgccgtattcgtcatttgcctggccatgacaggtggtgtgactgggtttcgaagagcggatgtgcatgcccgactgtattctcctgacctctccacccacccctttgcaacccctcccgtcaccacaggcagccctgttgcggcctgcctggtgctgctgaccctggcttccatggtggtggacttgctgggcctgatgacgctgacggggatccagctgaatgcggtgtctgtggtcaacctggtcgccgccctgggcattggcgtggagttctgcgcccacctgctccacgccttcatggaggagtcgggggatcgggagcagcgcaccgccgcggcgctgacgcacgtcggcgcggcggtgctggccggcatcaccctcaccaagtttgtcggtgggtggtggagggtctga

SEQ ID NO: 7820 - DNA, 894 bp, Chlorella protothecoides
  modified_base (54)..(63): a, c, t, g, unknown or other
atggctttgctgccgggtctcttgtatccagccatgctgcactcttggagtgcnnnnnnnnnnacgtggtgctgcgatgcgggggctctgcacctaaaattaccccttcaagattcgggggtcaagcattgtctcctgaggcatggctttgctgccgggtctctggtatccagccatgctgcactcttggagtgccatcccttccccggcattcatgccgtgcacccaccttgcagacctgctcaagctcatgcggcaacagcagctctcgcggcaccttcagtccgaactgcaagtgctgacggctctcagcgactgcaacaccaggcgcgaccccgccctgaggttgcaggggaggcccggcaagcaatcatcgagcagtacctgtgggcagctggcactgctctgccgtcgcagcctgcatcagcgaggtcaggcgacgatgtgccagacgaagtccagtcccccacccagcgcatcagggcgctggccaacgcagcttcccaggtcatcgcgcacatggaagctgcagacaagaccctcaccccttcccagtcagggcaactcacccagctcccgtctcctctcatcatacaggtcctggatcgccggctgctggcccgcctctgcctcgtcctgctcgacctggaagaggaaacggcgtcccccgggcgtgacgggcacggcgcggtgactgcggtacccaatgccatgcccagccccttcttctttgacgccgactcgctgtatgtgcggctggaggtcgtgccaccccacatcatggcctttgtcaaggagctactggccgtgccagggccggacgagaggtggggtcgcgtttgggagggaaggggaaggtggctgcatagctcaacaattaaagggcccccctga

SEQ ID NO: 7821 - DNA, 1218 bp, Chlorella protothecoides
atgcagtggggaagcgcggtgttcatgggcgggatacatgacttccaagccgctggtgctgattcgtttcctgtcttgtctcgggggcgggaacacaactcgggtggccacggtctgagtgccgacggcgccccagcccccagcgcatcggcggccagcctctcggcgtcgttcggttggtcgctcgctcaggcgcccatggccttggcgatctgcacctccagcttgtcctggccatggagtggagatctcgtgtgcccccctccaaatttagaggcccctgctctcaacaccagactctcccttcaggcctcgccctccagacatccagccatacccccccctcatcccttgtcaaactcactggtcctcgccatgcatctgcaggaaggtgccctccgccttgcccgacaggtcgtagtgggggtcggtggagccgccctgggtgggccacagcgcgtagggcagggggtcggtggaggcctccagctcggcgagcagggcgggggagatggtgatgttgtcgcaccccgccagctcccggatctcgccgatgttgcggaaggaggcggccatgacgatggtgtcgtacccgtactgcttgtagtaggagtagatgcgcttcacgctttccacacccgggtcctcgtgaggcgcatagtcgcgcccatttgccttcttgtaccagtccaggatgcgacccacgaagggggagatcagggacgcgcccgcgtcggcgcatgccccggcctgggtgatttttgtgtggtgggggggaggggtatgagagagagttgtggagtttggggcaattatgaggggcgatggcaaaggacagagtgcattccgtgtctgatccaccacccagcaggaagcatggcacagccacgatcgaaaactcggaggtcctttccccccccttccactttccaagccactcacttgcgcaaaggagaagatgagggtcatgttggtgctgatgccctgcttttgcagcacctcacaggcgcgaatgccctcccaggtggaggccaccttgatgtaaatcttggaggggtccacgcccttggcggcgtagaggtcgatcaggcgcagagccttgtccaccgtggcctgggtgtcgaagctcaggtgcgcatccacctcggtggagacctgggtgcagggcagggtgtggggcgtgaaggaatggattgttgggattgttggggcccctga

SEQ ID NO: 7822 - DNA, 3255 bp, Chlorella protothecoides
  modified_base (88)..(140): a, c, t, g, unknown or other
  modified_base (214)..(223): a, c, t, g, unknown or other
atgccgggggggaggggaatggacagggctgggcatgggggttttgagtggggtggacctcagagcaaggagggcggcgcgcataccnnnnnnnnnnnnnnnnnnnnnnnnnnnnnnnnnnnnnnnnnnnnnnnnnnnnntatgattgcttggtggggagaggcacccctgcctgcaactgcctctggtgcagctcagccattgcagggccacnnnnnnnnnnaccagcacgaccttgtggaccggaacacacgcggcgcaggctgttcacagcaaacagttcacacacctggtgcaccctttccctcaccgtaccaggtgatcaccaaggccaaggtccccatcatcaagtttgaggaggcagagtcgtgttacaaattcgacatctcctttgatgtggccaatgggccagagctcagccgctgcagggccaagcaggggctgaagggcactggtggtccacgaaagccggcacacgccgctgcactgccatccctgtgcctgcaacccccgcctgctgcgcaagtgcaccccccaactttcccgtcccccatacccacaggcggccgagtcggtgagggcgctgatggacgtggcctgggctcctacgccctgctggtgctggtggccgccttcctgcagctgcacccctcccgtcagccctcccgacgctttggcaaggggcccagcaagcctgaggacctggagcagaacctgggcatcctgctcatcgacttcttcaggctctacggccggacactcaacacttacgatgtgagggaaggggacaggcgcgggcgcaggttgtgcatcatcctgggaggccgagagaggcagggcacgccacgggatgcgctgctccaatctgcagcatcgccgacgcaccaaccttccgcaggtgggggtgagctgccgcaacgggggagcctacatcaagaagtcggcctccggtttctactcggcaaagctcagattcttgagacttctcggtcgccatgctgccccatctcacctcaaccctttcagagtgaacgtccctacctgctcgcggtagaggacccctgcgacccgaccaatgaccttgcccgaaactcttacaacattagcagggtgcgcgccgcgtttgagtatgcatatctgcggatggtggcaccttctagcccaaaggagtccatccttgcccgcgtgctgcgcttggaccctgtgctcttcatgcggacgccggttgcacacccggagtcaccacagcgccctcacaagaagtccaggaagaagcgaaaaagtgaatccccggcagcacaggtagggcggaaggttgccgctcacattgtgatggtgcacgcggagaggccgccgagaagcagaataagaagaagaggaagcacagggagcgcagtctcagcctggaggaggagggggctgcgcctgccgcaagagaagacacacgcaacccttcccatcctctgtctcctgccccaatcgccagatcgggacaagacggccataggagatcgcgaagaagggaggcccaaggactcgaagctgcggatggcattgcagggcattcagggtcgtcaaacgctagtggcagcaggcacatccgatttgattgacgaggctgtgttgcaaaatgatgcaaacgaactggtgagtgccaggagagctcatgaacgagccgagtccgggcaccgccgcctgacaggaggctcctgtgctgggcgtcctgtgcgagaccaagattcgaacctcaaacacttgttcaaacgcctacatgctcgtatggaagcatggcccaaagagcgctcggccacggtgcatgtgcaggtcgggacctcgtcgacggagaccgggcccaggtttccgcaggcgagcgctcccccccggccggctccatgggtgcaaataattggtgccattaccattatgagcatattcgtggctgctgcagcggccctggcagtcctagcgagtctgggcttgttgggccgggccgcggagtcggggccgcaagacctctactccgggacactggactccgtaaacagctcctcttacccgcccgcctactatggatccctgcatacctacctgaatagtgcgcagctcaacagccagggaatgagcgtcgatcacgacgtcatagtcatcggggcgggattggctggcatcgcggcggctacgaagcttcaggcggcgggcctgtctgtcgtcgtcctggaggccaggaagcaaccatgctgtccagatgtgtgcgctaggcttgattgggtacaaacagccacctacgacgactcacctgccgagcttggggcctctgtcctccatggcgacatcagcaacccattggcccctcccctcactgggctcggggtcaagcgcgccatcttcgaccccggctgggactcccagaccgtcttggccctgcctggcagcggcaacgcagagatagacccctcgctcgccagcagctccacctggcttggcttcctggcggctgctgaggccctgtgcaccgcaaccctcgcagacatcgtggaggggctgtcgcctgacaacgcacccgggtcggacgagggggacgaagttgcagagggctctccgcctctgggtccctcgacccctgctcacagctcaacagttcagtcccccggggtaccgacagcctcgccccccagcctggcgccctgcagtgagggcacgctcccatcctgccagccgcccccgccgccacccccctcgcccagccccgctccggccccatccctccaagacgcagtggatgcctacctggcctctgcgccgctcacggccgccgcgaggagggccctcctggcccgcatccggctcgtcgagggtcaggccggtgcccacgcctccagcctctccctggcctacgcttttgccgtggggccgacctccggcgtggacgacctggtggtgtccggactgggggcagtggtcgacagcctggctgccgacctggacgtccgcctgggcacgaccgtgagatcgatcagccacggcgacctggctgccggcgtcacagacgcgtctggcgcggcgctcagcgcgcagttcgtgctgtgcacgctgccgctggggctgctgcgcaccggcgctgtggacatccagccgccgctgcccgaccagctgacgcgagccatgaggcggctgggcgtgggcggcgcggcggcgttggccctctggtttgaccaggtccggtggcttactgggtggataggagggatgcgatga

SEQ ID NO: 7823 - DNA, 873 bp, Chlorella protothecoides
atgtactcaggaccctgccatgtgcctctttaccgagttcgatccggacaaggtgcgtgccgcggccgccgcctcgaccgagcgctggcggaatggcagccccctcagcccgctggacggcgtgccctttggcgtgaaggacctggtggacgtgctgggctacaagaccaccgccggcacctcctggatggcagactggtgggtgggtgttggctggagcagggggaaagtgcgcgccgggtcgaggccaccaaccccgccgtggcggctctgctgtcggccggggcgctgctgctgggcaagctggccacgcacgagatagggctgggcaccaccgggctcaacacggtgctgggcacgccgcgcaatccccacgaccccgggcgccacacgggcggcagcagcagcgggtcggcggcggcggtggccgccgggctgtgcccgctggcgctcggctccgacggcggcggcagcgtccgcatccccgccgcactctgcggctgtgtggggctcaagcccacgcacgaccgcctggaccacagccaggggccggaggtggactgcaccgtggctgtgctgggcccgctggccgccagcgtggcggactgccagctggcgtacgcggtgatggccggggccagggggccgggatcgtgtgcggggccacatggctttgaccccgggcccacacaccccccggtccgcttgtcggcggggctgccgcgggccgggcaggacctctcaggggccctggcggggaagcaggccggcatctactggaaggcaagcctgcgggggtggagaaggggtggtacatcttggtgtgtgtctctcgtccccgatgatcaccctggcacacagccacccaggtga

SEQ ID NO: 7824 - DNA, 1107 bp, Chlorella protothecoides
atgacgtcccccgtcaccatgaaagtgaacgcgcagagcgccccctttgcccagaggagacagatgagtgcttccgtgtctcggtcgcgcaccgtgaccatggcagctgcctcaacctttcagagcaccaaggtgcgagtcagggtttgggagcagctggacctcctccggagctactcgcggacttcagggtggaatgctactgacggaaccgccccggccacgctgaaggccgccaaccagcttgaggccctgaagcagatgagcaaggtggtggccgacaccggcgaggtggatgccatccgccggtacaagcccttcgactgcaccaccaaccccagcctggtgtacaaggccatgcagctgccagagtacgagccgtacctgcgcgccgccatcgccgccgagaaggagtcgcacaagggtgcccgcccctacgcctacatcgccgaccgcctggcggtcaacattggcgccgagctgtccaagctggtgccagggcgggtctccaccgaggtggatgcgcacctgagcttcgacacccaggccacggtggacaaggctctgcgcctgatcgacctctacgccgccaagggcgtggacccctccaagatttacatcaaggtggcctccacctgggagggcattcgcgcctgtgaggtgctgcaaaagcagggcatcagcaccaacatgaccctcatcttctcctttgcgcaagccggggcatgcgccgacgcgggcgcgtccctgatctcccccttcgtgggtcgcatcctggactggtacaagaaggcaaatgggcgcgactatgcgcctcacgaggacccgggtgtggaaagcgtgaagcgcatctactcctactacaagcagtacgggtacgacaccatcgtcatggccgcctccttccgcaacatcggcgagatccgggagctggcggggtgcgacaacatcaccatctcccccgccctgctcgccgagctggaggcctccaccgaccccctgccctacgcgctgtggcccacccagggcggctccaccgacccccactacgacctgtcgggcaaggcggagggcaccttcctgcagatgcatggcgaggaccagtga

SEQ ID NO: 7825 - DNA, 252 bp, Chlorella protothecoides
atggtggagctggaaccagagctgtcagatgtggagcgagctggcgcggcgttcaagctgactttcggcgaggatccagcaaccgaccagggcccctggcgccagcacacctgcgcagactaccgcagggcatacgctagcgggcagagcacgcccagccaggtggcggagcgcgtcatcactgcagtcgcggccagcgaggagcagggtgagggagcgtgccttgcccccacggacggacacatcttgtga

SEQ ID NO: 7826 - DNA, 432 bp, Chlorella protothecoides
atggaccccaaaaatcctcacatgcaaccacaggagaagccgacgggtgcgacggcagaggcctggctggcgcggctcctgcaggccgacctggccaccgtggatgcctccgccggcctggcccacgccatggctgtcaaggacgaggacgaggtgaagaacgtgaagaaggccgcgttcctggccagcggtgtcctgacccagttcatggtcaaggagatcgagggtgggtggggtttgggggtggttggctggcacagagaatgcatggatgttgacgtcccagcccccatgtgcgccactcctctgtcacccacaggcgtcatcgataatgaggagaaggtgcgacacagcaagattgcggagaagacggaggacaccatcctgaaccccagcaagatcaacatcaagctcaaggtgtgggagggatga

SEQ ID NO: 7827 - DNA, 582 bp, Chlorella protothecoides
atgccatcccctcatcgtccacacgccatggctgtgcagacatctccctcctggaacggagccaccgccctggccatcgtcacgggacagcccacggaggagatccgttactatacctcctccagtctgcacctctggctgctgggatacgatccgtgtggcgcatgcagaccgattgctcacgcgagctccgtcaaggaaggcgttcatgctccttgtcatgcagtcaatgcagaaactgctccttcccagctgggcatggcctgtttaatgttggatggtatcttgccccactccaccacagacaccatcctggtgctcaccaagactgagctgcatgccctggccgggtccaagaagacagacctgctgggccccctggccccggcagccgaggccgccggggtcaagctggtgctacacaccaagccccgcaaggaggacggcgcggcccagatgcagagcttgctggatgccttgaaggggtctggagaggtcgggaccgtgacggtgggtaccctgccaaaggtgagcgctggattggctgggggaggagcccctcctgcagtgctcatgttgtga

SEQ ID NO: 7828 - DNA, 1515 bp, Chlorella protothecoides
atgtccacgcacatgtacttgatatcgggggtaactgagccgagaggcaaaggcggttgccctgtgcactgcaagtccaaagtgcaatcacccctccctcgcgccccgcatccaaccacccacatccaacctcaccatgctctccatcggtggcaggagggcgagggggaagaggaggaggacccggcggcggcgggggacggcgacgacttcttgctcaccgacaccggcgccgaccttgacctccgcttggcccggctcgaggcgttgatgcagcgccgccccgagctgctgtcctccgtggtgctgcgccagaacccgcacaacgtgcacgagtggcacaagcgcgccaagctcttcgccgccgaccccaccaagcaaatcctgtgctacaccgaggctgtgcgcaccgtcgacccggacaaggtgagttgggcgtggaggcgcggagaagggatgggggagtggaatccttttccccctaggcggtggggaaggtgcacagcctctgggtggcttttgccaagctgtacgaacagcacggcgacctcgtcaacgcccgcttcatatacggcaaggcggccgaggttagtgtgtgggctttgcgaggaggatggtggattgagatggcgcggggatgtgcgggttcgggtgctctgcggctgggcaaatggcgtgcagcgtgcggatcgcaaggtggccggacagggggtgttgcatctttacccgacacacagtaggagtcccggcacctacagcccgaggattagggtttgctttgacccgccacaacccacaaccccctcccctccaacctcccaggtgccgtacaagtacgtggatgacctggccaccatctactgtgagtgggccgagatggagatgcgggccaaggcctacaagaaggcgctcgccctcatgcgcacggccaccacgccgccccagcggccgcgcacgcgggaggtagggacgctcggcagttggggtggggatgcacattgggcaccaggatccctcgcgcctggcactcgttcccctgctgtgaagagcgcctggcgcccatatgatgaggagaacaagttgccggtacaggagcggctgtaccgctccctgcgcctctggtccctgctggtggacctggaggaaagcctgggcgacctggcctccacccgcgcggtctacgagacggtgctggacctgaagatcgccacgccccagattgtgctcaactacgccgccttcctgcaggagagcaagtactgggaggactccttcaggcacgtgggcggaggatctgtgggaaggaggggggtatgggtgttaaatagggggagcaccgtccggcttggggtgtacgagcgtggcgtggcgctgttcaaatacccgcacgtcaaggacatctggcaggcctacctggccttcttcaaccagcgatacgggggaaagaaggtggagcgggcacgcgacctctatcgccaggccattgacgaggtgggaggtttgtcagggttttga

SEQ ID NO: 7829 - DNA, 1410 bp, Chlorella protothecoides
atggcccccgccagccggcccaacggcagcgatgcccctgagaatggcatcgacagcctgctgccagacgaagcggatctcctgtatgaggaagagctgctgcgcaacccctactccctgcgcatgtgggttcggtacctggatgcccggaagagcgcccccaccctgaagcggcgcctgctgtatgagcgtgccctggagaagctgcctggctcctacaaggtgctatggcgtggaatgatgccccgcatgcggggaacgtggggtcaggagcggtgggcagtggtgttgagcagggtcgcaggagttcttgcgcatgtgcccgacctttggccccccccaccccaccccacacacaccccacacacacgcattcacgccccctcccccctttctcccccgcccccagctgtggcatgcgtacctgcaggagcggcggcaggaggtgcgcgacctctcccccgcccacccggccctggaggctctgaacaacgtgtacgagcgcgcgctggtgtccatgcacaagatgccgcgcatctgggccgagtacctggagttcctggtccgtcaggcctgggtcacgcggtgccgccgcgccttcgaccgcgccctcatggcgctgccggtgacgcagcacgcgcgcgtctggcccgcctacctggccttcatctcgcaccgcggcacgccacaggagaccgcggtgcgcatataccggcgctacctgcgcttcgagcccgcgcacgccgaggagtacgtggcctacctcacgactcacggccgctggggcgaggccgccgcgcgcctggccctcctggtcaacgacgagggcttccgctcgctggagggcaagtccaagcacgcgctgtggctggagctgtgcgacatcatcacccgccacccgcaggaagtcaagggcctgaaggtggacgccatcctacgctccggcatccgcaagttcaccaacgaggtggggcggctgtggacctcgctggccgactactacatccgcagggggctcttcgagcgggccagggacgtgtacgaggagggcctcgcgtcagggggggggcccttggaaccccttcaggacctccaggaagcccacccagtgttccaagggaagggactgacgtggcaatgtgcctcggcgccagaccctggacaccaatgagatgtcatcatgccgttccattgccgctcgccctcgtgctcatcgtgaagctctccccacctccgcacacactcccagtcgtgacggtgcgagacttctcgctcgtgttcgacgccctgacccagtttgaggagtcgctcatctccgccaagctggagcaggtaggaagtgagggggagatagcttatttggggggttgggggctgattgcatgcgacggacctgggctggatgcatag

SEQ ID NO: 7830 - DNA, 1914 bp, Chlorella protothecoides
atggtagtgaatgagcgtcaatacgtaaagggattgaagaagactcacaagtgcgggtcccagcatcatgcaaagtcgagggaggtggggctagcacccccgatcagtcccagcacacggagcgcagctttcgaaccagggagcctgcagggggagccagggcatgcaccccactcgctcccatggctgacaacaaaatgcccttgcatcatcgcatggttattcaaggaggtcaccccgaaatccagcttagacttttctctccttaaccgcctcagttgttgggtgctacccggtgccacgccaatccgacactgtgctcctgcgaacggacccccttgccctcacgagaacgggcacactcctgaccccactccgccgtccgatgttgatccgagtctatccagcgaccagttgaccgtcgggatgcggaacgagcatacgccgcgtgggaggtacacccggcgcctgttcctgtccgccggcctggccctggccctctacgcctggtgggagcagccggggcgcggcgtcggcaccccccccaacccccccccgctcctcgacctcgccgagccctcggccaacgcttctctgccgggcagggccgcgcgcgccgacctggcggcccgcttcgccgccgaggacaggctgctgtcctccgtggccccccctcccccacccggcgacgcctggccgctgctcggcccccgcctgcagcccgccatgcccgccgcccgcaacggcacgctggtcctctacgtctaccaccacacgcggggaccagagcacgccgcgcgcgccgcgttgtttgtccgcgccgcgctccaggacggcgacggcgtggcggcgcgcctgctgatgccgcgcggcacgcgccacctgctggccccgcgcctggcccccctgcctcgcaacgccagctgggtggagctgccggagggtgcctgccaggcctccacctggggcgtgctgggcgcggcgctgcccctcctggcctcggacctggccgccagcacgtacgtcgtggtggtggactctggtaccgccggccccttcctgcctgcccacctccgggcccacctgcactggacggagccgctgctggcgcggctgagcgagcgggtgaggatggtgggccccgccatcagctgcgagggaaccccgcgcggcggagatgtggcgggggactggcgccggcagccccacctcccggcgcacgcctgggccaccgacgcgcagggctgggcgctgctcagccgcccccaggccggggtcatggcctgccacgccgacccctgggacgtgcgctggcactccgacctcggcgcggctgcggcactcttcgacgcggggcacaccatcgactgcctcatgccgcgctaccagggcgtggactggcgggacgagcgcaactgggcctgcaatgaccggtgggaagggggcgcgggaggggggtggtggggtactgaggggagagagaaggtgactgccggcaaagcgaggctcgctgcgttaaagcgctggctgatctgggtgtggtcccggtggagtcactgcagctgggagggtgtgtactgccagcgtgccagagcaccattctcgcgtgcctgggaacctgggtgtatgtcattgatggctctccgcgcctccgcactctcccctccccgcaccaggttgccgccagaccgccagcggtcgaacgacgggctctccgtgacgccctacgaagtgatgttctggcccttctcgctggcccaggcggagagctatgttgagctgaggtcggggcttaagtacgcccagtggagccaggcgagcgggcttttgtcgtgtatgggggggagaggaggtgaatcgcccaggctgagcggcaggcttgcctgctggggtactggcgaggtgttccagtga

SEQ ID NO: 7831 - DNA, 1152 bp, Chlorella protothecoides
atggttgctccctccggccctcctgctgacgagtcgccctgtcgcgctttccccctctgccaggctgacgccatcgacgtggcctatccgcccatcctgcaatccggggggacctatgaccccaagctgtcggcgggcagcaatgacgacaccctttcctacgacgtgatcctctgccaagtgggagcgaggtacgcgtcctactgcgccaccgtgggccgcaccctctttgtcaaccccacgccgcggcaggaggcggagtacgcggccctgcgcgccgcacacgccgcggcgatcgcggcgctggtggagggcgcgccactgtcggccgcgcacgccgcggccgtggccgctctggatgagaggggccagggcgcgctggtggaggcgctggggaagaacgtggggacggggatcgggttggacctgcgggacgggtcgtgcgccctcaccgccaccgccgccggccaggtccgggcagggaccaccttccacgtcgctgtcggtgagctgtggcggtggctttgggagggggaggtcgagggtggggggaagatgcaaagggggagctgggccggcatgttcgacatgcagaactcatcggagaggagggctccgggtgtgcttatgcggtctagagattgcgatgctgcgaagagtcagggactggtccagggttgtctgactgagccaagctcagcatcctcccccccctgccccctccctcgctgcccagctgccacggggctgcgccagccggcgccggacggggaggaaggcgcggagcagacctacgccatcctgctggccgacacggtggtggtgcggggcggcggccagagccccgaggtggccaccatcgcggcctccaaggactgggaggaggtggcctactttctcaacgacgacgaagaggaggaggaggcagagggcgagggggggagtggagggaagggcggcgggcgcacgctgcagcctctggacccccaggacctggccgggcgcaggtcccagcgcacggagcaggttgacttccgcctgcgtgacgaggagaggtgtgtgagggggagggggaggccttatggactgtgggcatgcacgggtggtggcgccgggttgtgggtggggggtccggtgaaagggaggggttga

SEQ ID NO: 7832 - DNA, 1170 bp, Chlorella protothecoides
atggcagatgagcgatgtgggctgccgcctgtggccggggaaggggttggaggtgcgagcactggcgtgtgcttcacccagctccgcacgggcccttccccccggaagccatccaagcgctgctccacgcatgcacgtccacacaacccccccccccacaaaaacaaacaaacctctccgcaggttcgggaggtgtacgagacggccattgaggcgcagccgccctttgcgctgtcggacgccgacacgcgcacgctgtgcctgcgctacgcccacctggagcagaagctgggggaggtggaccgcgcgcgcgccatctacgtttgtggtcgtggctgtgagcacgggggctggaggctcgctccccgcgcgcacacgctcgcgaggacgacgtgggagccagccggcctgtcgcgggatggggcgctggagccagaccgcgacatctgggccctccagcatcatgataccctttcttcaggccctcagcgccctccgatcacgccccgaccccacgcccctcgacccctccccccccttccccccgcacacgcagacccgcgccgggacgcggccttctggagcgactggaacgcgttcgaggtccagcacgggcacgaggagaccttcaggtgggggtggtcgcgcgcggggcgtgcgtgggttgcagcgaggggcctgggggggcttggctgcacggacccactgggcagcctcgccaccggcgtccaacccccctcctcgcctgccctgcgcagggagatgctgcgcatcaagcgctccgtggctgcgtccttctcacagacccacttcaacacgaccgtggtggacgccgtggcggtggcggccaaggccatggcggcggggggcgccccccccccggccgtggacgacatggcggccctggaggcggagctggcggccgagccggcggggggtaccaggctcccgggcttcgtctcggcaggcgtcatccagcagggggatgctgggcaggagggtggggaggcggcagcggctgccgccgtcaatccggaggacatcgagctggacgaggaggaggaagaggagggggagcccgccgcactggagctggagcagaaagaggtgccgcaggaggtgtttggcagcctcgcgccccctgccaagaagtcacgagtggatgcctga

SEQ ID NO: 7833 - DNA, 309 bp, Chlorella protothecoides
atgctcaggcacgaccccgacgagatcgaggacgagcagagggagcgggagcgccgcaaccagatcaaccaccagttctcacagttcgtgaagcgggtgcagaccaacatctgggaacgcgagttcccggacctaaacctggagtttgaggtgcccttccgggaactgggttttgacggtgtgccggcacggaccacctgcttcatcatgcccaccgtcaattgcctggttgagctgacggagatgcccttcaccgtcatcaccctggcaggtgcggcgagcgggctggcacttgttgcacgctcgtga

SEQ ID NO: 7834 - DNA, 444 bp, Chlorella protothecoides
atgaggccggcgttcggcgggaaggggcgcaaggcggcgggcgagctgcaggcgcatgcgaatggcttccgctacacctctgggcgtggcgaggaggtggacgtcatgtaccgcaacatcaagcacgctttcttccagccggcgcagaacgagatgatcactctggtccacttccacctcatccaccccatcatggggagtgctttgcgggaggtcctgctcgtctctacggaggctgggcgatgcaatccaactcatcccctgctcaagcatgtggcgccctgccagctgctgatgaacccctgtgccagcacgcgtgcgagacacccctccccgcacgcccacggacggcaggtagggaagaagaagacgatggacgtgcagttctacacggaggtgatggactccgtgcagaccctcgaggccgggcggcgctcggcgtga

SEQ ID NO: 7835 - DNA, 372 bp, Chlorella protothecoides
atggtgcccttccacgtgctgactgtgaagaacgcaaccctcaaccaggacggcgaccacgccttcatccgcgtcaccttcaactacggcggcgcgtacgagcccaccgccaagttcccgggcgccgccttcctcaaggagctcaccttccgcagctccgacccacgccatgccgccaaggtcgtgcaggagatcaagaccatgcgcagcatggtgctgcagcgcgacaaggagcacgcggagcgggccacgctggtggcgcaggagcggctcatccgcggcaaggtgcgcgtgtcggtgggaatgagggtgggtgtggggaaggtagacgatccaccctgccaggcagaagcacggacctggctgttttga

SEQ ID NO: 7836 - DNA, 444 bp, Chlorella protothecoides
atgaatgcaaggccagtaaagggctcatcatctgtttttacaatcccgcttcaggacctggatcgggatgtgggcaggatcgacgccatccagtccaaggcgctggacaccatcaaggactggctcacctccgtggacatcaagtactacgagtccaaggtcaacctgaactggaagaacatcctcaagagcatcaaggaggtacgtggtgttgagggaccaggcggtgcggcacagactcagtgttgtcatcgggcgactgcactgctggcctgccctcatgaaggccacgactccctggtgtcaccgcaatcccactcctcatctgcccccccgcaggaccctgagggcttcatccacagtggcggctggagtttcctggacacctcccagaccgattcggaggaggaggcggaggaggagtcggagttctcacccacgtaa

SEQ ID NO: 7837 - DNA, 2799 bp, Chlorella protothecoides
atggggggcgtggaaggagcagagacagtgagtagggttggggacgtccaattaggcaggggtggggcccggcacggctgcaggtcatctccctcagcccctgtccagcatgggaacaactatctgaagcccaccgctgggctgcctccaggatctctcacgtactccccccatcccctgtcacggtccccaaactcttaccaggatgttgaactcgttgaagtcgcagtgcaccaggcccatctgtgccagccgctccatgaggtcgatgagctgggtgtagatcctggcagggctggccagttccttgatctgcatgcattggtgatgagaaggtttaggggatgtactggcagccaagccatgaagacaggtcgggtgcgagcgtgcatcgggagatgtgctccccacatccttcacgagccctctccgccagataattttgggatgcacacgtcatctccaccgcttcgaaaaatgggtccctcttacagccctctgcacaatctagtctgccccaggagccacctcgcgccctggctccccacgctacccgacctggaccaaggggaatgcgtccaccaggctcatgagcaccgcatgtcgattctggtcaatggcctccgggacggggaggcccctggtctgcagcgccctcatgaaggcaaactccttgaccgccgagaggcgggagaggtagagccagctgtagtgggagccctgcctcaggtagtcgcgcttggacttgaccgcccggaaggaggtgcgccccagccggtgcagcttcaggcacatgcggttgccctcgtcgtctgcgacctcgtacacatcggcctccttaccgacgccaatctgggaaccgatgggaaatggaagcgtgggtgtgggctggggaggagggaccacacaggggtctccagagcttatgtcgagtccatcaagacatccactcatgtgcaaatatcagcccccgcaactgcccctcaccttgcgacccacgctgctcattacacctcgggccgtgagagtcttgattgccaggaagtcaatgcagaaggggcgagggctgggtgtgccagatggaacttggctgaggagcggggaggaagcaacgcttccagaacagacaggacaagccaacaaccctctctcctcctgcctctcacttcttggactcatggtgaaccagcttgtgtcgtaagagctccttcaagcacttgtgcgttcccccgtgcctgtggcagggcgcatcaagcattcagtcaattcacagacacagcacacatcacaggagagagcctcccctcgacacagcctcttcggacccagagctgcatgaaggacgtacttgagactggcgatgagaacagcactcctgggagtattctcaaggcgagtgcaggttcagtactctccacggaaacgcacgttcttctgacccatctcgacggcagtgagtactctgaagtcatcttttccaaggttcagcttctctccgtgcccaagcccgactctgtgtcgcatgcatggaatttgagcgcgcgcgctggtgtaggctccgggcgccctctagcgcacgatttgttgtcgggacggacacatgcccgccagggcggccgagtgcgtccagggagggcgagcacgcaggcagccacagtaggggggatacctaggcggcatagggatggcaccccgtgccaagcagcagaagctgtccccgcccgagcctgtggttgccaatgtcgtcatccagtttcagtcccaggagggggaggtcacaggtgggcgagatgtgaatgtccacagctagacatccctaccaacgtgtccacaccccagctggagatcctgctgaacagtgtgctgaaggccgaggatggggagaaggttccctactccttccacatcgatgataaggaggtggtccaggagttaggggcccacctgctccacaacaaggtgtggtcgagcctttttataatctgcaaggcgtggtcctgctcctcatgcctactcgagccgctacctggtcaggccccaggccctgttcagggtccgccccgtcgcccgctgctccgccagcatggccgggcacggcgacgccgtgctttctgtcaacttctcgcccaacggtcgccacctggccagcgggtctggggacaccacggtccgattctgggacctgaacacccagacgccacgctttacagggcaggtgagagtgcggtgggtgggcgggaggcagggctccatcgtggtttcctcccttggtttgtgaagtctcaagaaagttatatacttgcggagccggaaagagacatcaagctgcgcaaaaccaataaaatcgtgtccagagattctttcgctgacagtatcctcagctctgcatgcatctccactgcgcacaagagctgggtcctggtagtggcctggtctccggatgctaagcttgttgcatctggtgaccgaagtggggagatcttcctctgggatcccaccaccggcaaagctgtgggacagtgcaaggtggggccgggaggaggaggtcgtccagggccccatttcaagggccttcctcgttatcgcccatccctcctggtgcctccacagggccacaagaactacgtgagcagcctggcatgggagccggcacatgctgagcttcccgccagacgcttctgctccgggtcaaaggacgccaccatcaaagtttgggatgccaacctgaggtatgtgtggtggtctggttatgggtttgattgtgggcatcattgccgctcctggaacggtcctgcctga

SEQ ID NO: 7838 - DNA, 909 bp, Chlorella protothecoides
atggtgtccaccaaccatgccaatgcagaggagctgtttgagcgagacgttgactgcctcatccgcttcttctccaagaagctggggtatgtgccatcgttggactcggcgctgaagcgtgtccggcccaacttccaggcgagagtcagacttcccctgggtgggcagagatgcgtcctggcctcgccgtctgccggggatctggactctgagctccgcgcatctggcttcaagcgtgagcaccaagcggctctggacagcctgcggcacctgcaaagtccggcctcccccatgccttggcacaatgtccacagtgtggcagaggatgacagtgacagtgaggctggaagtggcgaggaggaggaggaggaggagagcagctctgagccagagtgtgagccagaggcaagcagcagcagcggcagtgatggagaggaggaggaggacagcgaagaggaggccagtgaggaggaggcggatacaaaggcagggcgggcttccccggcagcagtggcggcgacggagaagcccagggaaggagtcgcagaagcttccgggaaggattcagacaacgatgatgcggcctccttgagcacagtagccacgggcgggacggtttggagagaggcatcgggtaaacttgtaaaacgccaacccccaggcatccacgaggtgctcgaatgctgcgagcagaacccacgtgaccccggaccgctgcactgcgcaggggcccaatgtagtggcagacacactgcgtcagcagcagaagcgggcggcgcggagggctgcaatggcgagcgcgtctcggaacgcgatgaaggggaggaacaagggaaagcggaagggggagggggcggatggtggcggcggtggcatcacatggggctgaggccgcagaggcggtgctga

SEQ ID NO: 7839 - DNA, 441 bp, Chlorella protothecoides
atgcgcagtgcgcccggccggcggtcctcaacgtcctgcaggtgggcggggcacgggggatgcggggcgccgcactcggcatgcggcggtgcggcgggggtgcgacatgtttacccccgccatcaccccctccccctgctcacacgtgcctcccccgctcagggctacaacgcgtccatcatcgcctacggccagacggggacagggaagaccttcacgatggagggggaggagggcagcgaccggtctggcatcatcccccgcgccatccaggacgtcttctccagcatcgcgcgggacacgggggagcgctgccgcttcctggtgcgggcctcctacctccagatctacaacgaggtgtgcgaggggggagggcgggcgggtctgccttgggcaaaggatgggaggagtgagatggcacgtccatggtgtggccggtga

SEQ ID NO: 7840 - DNA, 3849 bp, Chlorella protothecoides
  modified_base (1973)..(1982): a, c, t, g, unknown or other
  modified_base (2164)..(2173): a, c, t, g, unknown or other
  modified_base (3693)..(3702): a, c, t, g, unknown or other
atggactacgaattccacatctcgagatgcgacccagattccgagtcccgtgcatcttcattatccgactacgacctgacggacgtgaatcgaaaatcgaagaggctcctgcgggtggaaaggatgggtccgctgcaacattgtgccccatggggaccagcacagaggtgcgcatccatccatgccatatgtacatatacatatgtcgcactcacacgcgtttttcatggtatggcggttccaaatgtgcatgaggggtgcagcgatggtcacatcgcccatgccctgctgcctcgtcccggcagcttgtcgctgaccgacaggggcctcatgggagcagatcatacaagcatggaaggcctggccgctgaatttgcatcatgccttcttgtaatgcggctatctttgccaatcaaagtaggtggaaaccgaccctgtggcggggtaaggagagggtgcttcacccagccaaaagtgatgacgccctctcctgtcctgtccctaatccagagagggacattggtggcccacctgagtgcaaacacgtcccgaggcctgacagccctgctggccagcacagctctgggcggcatcgcagttccactgaaccgcaggtggagtgcaaagcagagcgctggggcgctgcatcgcttaggctgccgcatgctggtgacagaccatggccttgccagcagggcatgtgctgtggtacaggaattgaaggcacgggcgggtgcagggcaaggaccagatgtggagttgctgattctggatggtcgtagtggccagaggggtgcgtcagaggagctgtccttgctgtcccctccaggagcaagaacggtcaaggaatgcgctgcggctcatcccttgctcccatgtgcaactttctgtacagcccaacttctactgccggcatcgccgacatgcctgggtccaccactgaccggcccacatggagctgccgttctcattttcacctctgggaccacaaagcaacccaaggcggtggggctcagccatgccgccctcctgtcccagagttgcgccaagattgccacggtgaggatggtggtgtggtggggaggtgtttcttattacagggtcgctccttgggggtttcagcttgggcccttgctgggtctatcgagcagtgacaccttcctgcactgcaccgccttcttccatgttgggggcctgcactgggcgctgaccggactggaagcgggtgccagccaggtcttcctccccgactggtcgccggcggccgccctccagatgatcaaagacgccaaagtcacggccattgccctggtgccggctatggcgtatgaccttgtcgctgaggcgcgaaggaaggcaggcggggccaccacggcaccgctggcgggcatgagggtggtgctggtgggcgccggccgcctggaagacgccacgctggcgggcctggcggccctcttcccgcgcgctgtcgtgtgggcggcctacggcctcaccgagtgcgcttcctccctgacctttgcctgtctgagagaacccggggatgacccgggcccggcgatcctggcgccagcccgccgccaggctgggggatgggccgtgggccggccgccagccggcgtcgaggtcgcggtgctgggaggctatggcgacgtgacccgctgcggggagggcgagctggtaacaaggggaccgcacatcatgatgggatactgggcggacggcggtgcgcatcggagccagtccatggcgcagggttggctgaggacgggggatgccggcgcagtcgccgaggacgctatgagcatgctccacatagtttgggctggtaacacaactctgaatgctcacgagtcgagatgcctcgcccaagccggtgaggctgtcaggggaaagtgcaacccttttcgagcgggtgtccgctgccgtccaccaccccctgtttccaccgccccagccctgcaccccacgcctcnnnnnnnnnngggggaaagcgcaaccctttccgagcgggtgtccgctgccgttcaccacccgctgttaccaccgccccagccctgcaccccacgcctctcttcaggttcggtctacctgtctggcagactgagcgacaccatccggtcagggggggagagcgtccctgccgggctggtggaggaggccctcnnnnnnnnnncggcagactcagcgacaccatccggtcggggggggagagtgtccctgccgggctggtggaggaggccctccttgccatccacgctgtgcaggaggcagtcgtggtgggcctgcccgatccccgcctgggtcaaacagtggcagccgtcgtggtgttgcgccccgaaccgacggctggcgacgctagtggcccagaaaacagctgcaccaccagcggggcggtgctgcagcgactgcggcagggcggggccttggcgggcttccagcttccgcgcagcatcacaatcatgggtgcaggtgacataccccggacagccacggggaaagtgcggaagcaggagctcgtggcacaactccaggctgtccgggcatccaagctgtgacataccccggacatccactgggaaagtgcggaagcaggagctcgtggcgcaactccaggctgcccaggcatccaagctcagcagccctgcccatcaggcctctcactttgcagtgctatgccgtcatgtgaatgcatgtgttcaatgctcttccctgcaaccacgcagctgtacacgagcactgggtctaggcgatgttcattatggtgctcaagtcacccagcgaagccctcacctctcccacatcacacatcacacatgccacctggcaactgcagaacaaggtctcgttcacgatggttgccgtcacataaccatccgtctggccatcccagaggcacttgctggaaagcaaggagccttgattggcccgctgaccgtaggtgacgtggacggcgtacttgtatcgatgccaattaaaggagtaggtttggcatctgaccaggttgagagttggtataaggcgctgcagctcatattatggggtgctcggcatgtgctgatgccctttggggcactcaccttggactgctccggtgggctgcatatcaccaacaccgcggcagatcgtaaactggttttggcattgcgacactcaccggtccgtggccgtccggccccacgatggggtgtaagatcatctctggatcctcgagaggatgtaccgtacaggcggagacctgccgtggcgcccatgcagaagagtcaaaaggtcaagggagatcccccgtccgccccggacggatccggacgggaatcgcatatcgatcacggggaggtgaggtgccatttcctcatgagctcggccccgtcacttcttcctgcttgggaggcaaggtggcgcactgctcgaccctttccacaccctcgcgccctcccagctgctcacagcctccgggggtggccgttccagccgtgtcctgctcctcccactgctccttgccaggagggtcccggcccagccccacatcaccggggacgtcatggggcggcccctctttgggtcgcagcaaataggcgaaagcgtcccgacacgtcggcggccgctgctgcgcctcctgcacacagccagggcaagagcattgtgaaggggcctggcttttgcaggttcagccccggaatgcggacagtggccatnnnnnnnnnnggtcaaggcaagagcattgtgaaggggcctgggttttgcaagttcagccccggaatgcggacagtggccatggcagattgggcaacgctcaccacgcacttgcccaaacatgaagcagcactctttggcactctcgctgcagcctga

SEQ ID NO: 7841 - DNA, 2748 bp, Chlorella protothecoides
  modified_base (1254)..(1263): a, c, t, g, unknown or other
  modified_base (1527)..(1536): a, c, t, g, unknown or other
  modified_base (1974)..(1983): a, c, t, g, unknown or other
atgccgtcgcaaaaatgcgaaagtgcatgcaatatgccagctcctcagttcagggaatcctgtagaccacgttcgcattcgaccttcgcgacatgcacacttgcgacggacatgtcgggtcacagcccgagagcaggaatcagcaacaaggacctgcataccttcaccaccgtgtatgcgcccggaatgcctttcccagcagctggatgcacgatccgaaggccggtgtacgtttcgataccgtgttgcattagctcaagcacttttatagagccgagccgcaagccgcaaccaagcaggaggagggacctgggcaacatgctggggccgagggcacgcacgaattgcacggagcagcgtgatgcccgttgtgggccttgcagcaccccgcatgtcatacatggtgcccggccggctgaggtgagaggggctggtaggccagattggctcgctcgctctagaggttgcaaggctagcatacggtgctcatcggaccgatgcgggcggtggagttctacagcggccttggaggtggggatgctgataggggtatcggtgggtgtgaggcagctctgctggctgggcttccatcgcggatgcctttccttccctctctccactcaacaccctctcctccaagctgtgactcctctcgcactttccccagccggtgcacacgaagcccgcctcactaaaccaacccctccctccctcgctccaggcttgcactatgcgctggccctggccgtccctggcgcggaggtggtgacggcctttgacatcaacgacaccgccaacgacgtctaccagcacaactttgggcgccggccctcccagtccaacatcgactcgctgaccgcggcgcgcctggaccggctgcgcgccgagctctggctgctctccccgccctgccagccctacacccggcgcggcctgcagcggcagtcggccgacgggcgcgccgcctccttcctctccctgctccggcggctgggggagatgcagcacccgcccaccgccctcctcctggagaacgtggtgggtttcgaggcctccgacacctgcgccgccatgctgcgcacgctgcgcgacctgggctatgccgtgctggaggtgctggcctcgcccaccgacctgggcctgccctactcccggccgcggtactttgcgctggccacgcgggcgcgcggcgccggcctcgcacggcacacgctgccctttgtcgtcgtgcggaggggggagggaggggagccnnnnnnnnnncgcgcgcggcgccggcctggcacggcacacgctgccatttgccgtcgtgcggaggggggagggaggggagcccaccgtcctgccggctcgggagcccacgacgcgccggccgctggcggaattcctggaggccgacccggcggcggagctggcgggcggcgcggaggtgggccgcggcgacgcagcagccgaggatccaccgccgtcgccgacgggagcggcggccgcggcaccaggatcggggccgcccctcgcagcagcagnnnnnnnnnntcgtcgccgacgggagcggcagccgcggcactgggatcgggggcgccccttgcagcaccaggatcgggggcgcccctcgtagcagcaggatcgggggcgccccttgcagcagcaggatcgggggtgcccctttcagcaccggcgtctgcgacatgcgacgaccccttccgggtcccagatgtcaccctcctgaagaatggctggtgcatggacgtcgtcaccccctcagcactgcggacctgctgcttcaccaagacctatggccagtacatcaaggtgggcgggagggaagggcggctgggtgggcgcggagcccggggtcttggtccaaatgtccttagcagcggcggggaggcggcacgggctcctccccgccggcgctcgcacaccggcgggcctgctttctacccactggcgcacacccatggatgggacgcnnnnnnnnnntggagcccggggtcttggtccagatgtccttggcagcggcggggaggtggcacgggctcctccccactggcgctcgcacaccggcgggcctgctttccccccactggcgcacacccatggatgggacgccccaccgaccggacacccccatccctgcgccctgcacgcgcaggggtctgggtcggtgctcacgctggccagcgaggacagcgtgcgtggcgtgatgcagcgcttcccctgcctggtgccgggcgggggcggcacggggggggacgcccccgcgcccagcgcggcatccctggccgaggcgctgagggcgctggacctgcgcttcttctcgccgcgggagatcgcaaacctgcacggcttccccccggccttcgccttcccgccagccgtcacgctgcgccagcgctacgccctgctgggcaacagcctgcacgtgggcgtggtggcgaggctgctgggccacctcttcgctggtgcaggggaggcaggcgcgcccggctgagcggtgggccgcggtgtgttggtgcgtgctgcgcagcggctggcgcgccccccacacatccccaggtgcaaggtgttgtggtgccggccaggtccccccgcaacgtgtgctcatgtgcttggtctgcggtggagctgctacagccaaggcgcatgtgcatagggtttcgtggacatgggcggccggcgcgggcactgcgcagagcacggatatcgatgagcagggagggagggctcggggagagcaccacatga

SEQ ID NO: 7842 - DNA, 423 bp, Chlorella protothecoides
atgcggctggaggcggagctcgggccgggccaccccgccgtgggcagggcctacgttgacctggcgcggctctacaccgcctcatgcgcgtcgtgcacagcgcggcagctggccgaggcggccctgacgcgcgcgtcggaggtgctggccacgtgccaggaggcgcagcagcggccgccgacgtgtcgggacgctttcgcctatttgctgcgacccaaagaggggccgccccatgacgtccccggtgatgtggggctgggccgggaccctcctggcaaggagcagtgggaggagcaggacacggctggaacggccacccccggaggctgtgagcagctgggagggcgcgagggtgtggaaagggtcgagcagtgcgccaccttgcctcccaagcaggaagaagtgacggggccgagctcatga

SEQ ID NO: 7843 - DNA, 591 bp, Chlorella protothecoides
atggtggggactcgtttgtcccggctccaacctcgagcctcgtccctgcgcagggaggaggaggcggcgagcagcccgcgcgaggaggcggacgatggcgcctggcctcggcgtcctcccgcccccgccggccccggccgcccgcctgctggcccggagggcggcggcatcttcaagcaggctgcagtggaggtgctgcgcgccgagcggcggctgatgagcacaggcgagatcacgcgcctggccctggcccggcggctggtccgctgcacggggaagacgcccgaggccaccatggccagcgcgctgtacaccgacatcaagcggcgggaggggcgcagcgtgttcatccgcccccacgagggcatgttttggctgcgggagtggatcgagctgggcattggcttccgggatgaccatgcggaggacatggcccgccgcgtccgagacggctatagtggctacctggccgccgtcccgggcgtccccccatcggccctgggcctggccgcgccggggtatgcacccggcctcgtgcccggcctcgcttccaggccgccgctggggtcgcccggccgcccggggctgtag

SEQ ID NO: 7844 - DNA, 2040 bp, Chlorella protothecoides
  modified_base (1724)..(1769): a, c, t, g, unknown or other
ggcgcggcgcgcgccgcgccgcgcctcgccccggaggcccgtgcggcgctggagcgcgaggcgctgcggtccaccgacagcgacgaggtgccggcggcgggcgccgcgccgctccccgacggcgaggacgtggagtggttcaacatgtgctggcgcaaggtgtggcgcgtgtaccagcgcggcatcgagtcctggctggcggagatgttgcagccggtgctggacggcgtggtcaccgactccccggtccccgccatgctcaagcgcatccgcatcatggaggtgaacctggatcacgaggccccctacttctccaacatgaggcgccgctcctcccgcaaggcaagcctgggaggcaggcgcccagacatatgggggtgggattcaaaaggggtggcagaaatcgcgtgtgttgtcgatgttggtgttagcgctcctggcgcctcccctggtcgtgctggcgctggaggtcggccagggccgctggaaggccaaggtggggggtatggccgagggttggcctcttgggaccaggatgaagggggttgctgcgtcggtcctgggtgccagacggctcgtgctgcccgattcaagcgtgctcactgttgtgtggcagtggcagggctttccaggccagccgggatgggacgccgacggccccgtcttcaaactccccaaacctgccccctccttccatcccgccctcctcagatcccggtgctggtgtctgacctggacgtggaggccaccgtgtggctcaagctgcggctggcccccatggcgccctacatcggtgcggtgtcctttgccttcgtggggccgcccgccatcaagatccagctggcgccctacggccgcgtgcgcctcatgaacatccccgtcctccagtctgggtggctcagagggcccgcaggcgccgcgccgtggcctcgttcccatcggctcttccttccaagccccttccacaagttcccctccccgccaacccctcccttggtcacctgcttaccctccactctgcaaacgacactcgcccttcccgcagcccatcctgtcgcggctgctgacggtggcgctgccgggcctcatgactctgccccagcgcctggacatcgacgtcccccccgctgtgaccgcgatcgcggaggccgcggtggggagggacgccatcatgcgcgccgtggcttcggccgtgcttcaggcgagaaactgggaacgtctgtgcgagaaccttgtgccctgcctctgatccttgcaccccgggccggtgtgcccggccgcgacctgctcctcgatgcccgggtccaaaacaaaacacgcctcgctccttcgcctgcctcctcgtctccaggcggatgcgctggagcacgcgctgctggcggcgctgccgctggggccgcagggcgacgctgggggtgtgtcccttcccgatttcttcacgggggagctgcaggtgacgctggtggaggcgcgcgccctccccgtctggggcttcccctggcagagcaacccctactgccgcctgacgctgggcgggcaggcggtgcagtcccggcgggacagcgagacgagccacgcgtcgcgccaccgcgcgcccgcctggaaccaggagttcacctttctggtggaggacccgcgcgtccaggtgaggaaggggtacattctcgggcagggaacatggtccgtcagagctcaccctcctcccccccccccccaaacccccnnnnnnnnnnnnnnnnnnnnnnnnnnnnnnnnnnnnnnnnnnnnnnatgcctcgctgcaggtgctggagatcgtggtccgcgactcgcccatcacgggcaggacggaggtgggcagggtggtcttccccctggcccgcctgccgagcgagggggtgctcaaggcctggctgcccgtggtgaccgacgccacaggcatgttgcctgcgaggggtggagaggggaggagaggggaggagaggggagggggtgcggggctttgggccagggtgttcaggtcgctccagcaccccgacgctgcttggcttcgggggcatga

SEQ ID NO: 7845 - DNA, 2958 bp, Chlorella protothecoides
atggggaaggtgggtgcagtgggagggggtgtggtgggtgtgcacaagttcagcatgaggacgtgcggcaggacgtcagggatgtacgacttgcatatggtgggcgagcgggcttggaggccttggcggccgcgcttgtcccacgccgtgagcaggccaagatgcagccaggattcagggattgcatgcggtgacggtgtcgtgcacgcgcctgtgcccaccccctcctacgcggtgcagcaggggtgttgtggccctgacggaggagcatgccctgtggcccgcgccaccgttgttggccctgaccgccttgaggcggaacacctccaccagcgcggcaaagaccatggacatgatggcgatgccaaagccgatgcccatgcgcaggaggcgggagatggggcggccgatgcgcttgaagtaggggtcgatgaccaggtcgtagatggggacccagatgaggacagagatgatgtccagggtggagatgatggcggggggcaccgcccaggagcccaggtggcggttcatggcggagccttgcaggacgaagagggtggacatctgggcataggttgcaaagtagacggcgaggatcaccatgaaagggatcaggcgcaccacacacttcagctcctccacctccgtgacggtcaccagccagcgatcccgcacgccgggggcctcagtcgccgtggccgccttgtccagccaacggaactgggaaagggggggggaggagagcggacggggttgggaagacaggaggatcggatagggggagacgtgatgcagggtggggtggagcattgggatggacatttgccggcagtctcaggaagccagcgattagcaaatgtcccgaggcttcctgggcaaggcaaggggcctgagctgacctctcccctggcgagtgtttcccccaccccctcccacccactggagccgggactgccagggccgccacccaccaggcgggcatcgtggggcactttggccctccaatgggcgcaggcgccggcgaggacgcggaaccagcggttgatggggctgccaccgggcgggcagcgacggtaccacctggaccctgatacgaagcagatgatggcgatggcaaaggagatggtagggatcaggaagccgatcatccagctgcgtggcggtcaggggagtgtcggggtggggcactggagccctgggcggtcagccatgcggcggccagggttgcgaagtgagcttgccccgccaggtgaaccctccgccggcccacctgacgtcggtctggacccagaccacgagcgtgctggcaaaaaagctgccgatgttgacaaaggcgtagaaccagttgtagaagcgtgggatgagggccagctcctcggggttgccctcgtcaaactggtcggcgccaaacacggagacgcagggcttgatgccgcccgtgccgatggagaccagatactggggggagggggggacagaggtttggttgaggggttcgtcggcgcaggggcccctgcgccctgcatcacagctcaacctgccatggctacgctccttgcatcagcccctgctccctcaacgcccaccatgaaggcccagaagaagcccgtctggctcccgctcacccgccctctcctcgcaggggtacctcggccacttggggcgcccactgtccattgcgtgcctctttcacctcccaccacaaagcctgccatgcgctttgctcaccaccaggtacacgctgcagaaactcaggatcgtccagaagcgtcccgtgtaggtgtctgccagccaggcaccgacgatgggcgtcacatagcaggtaccaatccaggcggagacctggcagcggttggagggaaggcgaatagtggggcaggggcggctccgaggtctggcagccattcgtgggtagcgaggccagtgccagcacatcctccctgtgtctgcaggtggtgtacatctcagaataccatctcactccagagagccttattgctccaaaattcaccacagcagcgtcacactcaccgattgagctgcgtcagagttggtcaggttgagcttgttggtgagatacatgacgatgttcgtctgcacagtgggtggggaggggcgtgtgacgcggttggctctaatcctgtgggaaggcgctcacacagctcggtacctgcaatgagggtatgggatgcgttgggagggagaaagttttgggagggccttcttggaagtactgccagaaggccatgcagtgcgcccacacccaggacacatcccgtcacgcacacagaatgggcgttgcgcgcaggaatgctttcccaaaacgcttattgggggttgcatcggtcccctcctccgtttttacgtcctggagatcctggtctttggtctcggaccctgactcggggccgcgcgccataagcgaattatgcaaaaggtgcccaaatcgacgcaaagcggcggtgttgcgggctggggttggtcctaggtaaaggggcgacagggcaatcgctcctgatgaacttctccacccgactaattcagccgaaaagggcacaacgatgccttttgagattggattctcttgtaagcgcatgcataatcggaaaggctgctgttttgtggtacaaagggacgctggtgaggacgtcagcagcgcgcggttgccgcagccggaacggggtccaacccggagctcgatgtgatatacattggcgtctaagccagcagggccaccgttttgggggaaaggtaaaaataacaattacactcccgagtagatctcccaatggtcattctggtgtgcctgtttctattactgtatacgacaagcagcgagtgtgccatcaacccgaaactgtcggccacgtggcgcttgcgtgcgagctcgcggacttgtcccctgatcccgaatttcaggcacccgtatacccagtttcacagctggaagacttctag

SEQ ID NO: 7846 - DNA, 396 bp, Chlorella protothecoides
atgtcggtgtggtggcaggtcccgcagtactttgccgtgggcatggccgaggtgtttgcctccgtcggggcgctggagttcttctactcccagtccccagaggcgatgcgctccatggcctctgcactcaacctcatcgccatagcgatgggaagctacctctccacaggcctgcttgtgctagcaaaggacggctccactgcggcctgggtgcctcttgcccacattcccctatcaatgtcaggctgccaccgtgaacatgcgcaggttgccatcgttgccgccatcaccaccaagaatggagctcccggctgggtggcgaacaatctcaaccaaggccacctggactacttctttgcaatgctggccgtgctcatggtgaggctgggtgtgtag

SEQ ID NO: 7847 - DNA, 4170 bp, Chlorella protothecoides
  modified_base (196)..(205): a, c, t, g, unknown or other
  modified_base (780)..(789): a, c, t, g, unknown or other
  modified_base (948)..(957): a, c, t, g, unknown or other
  modified_base (1488)..(1497): a, c, t, g, unknown or other
  modified_base (3193)..(3202): a, c, t, g, unknown or other
atggtgcgggtgacactcctcgcttcacggatggttgtgctggggggttgcacaggcaggttctgtgcccctcacatcagccctgcagcagccagcacacctggcattatgtgcccaaccgtacaacatgccgatcactgtcgttacaaacgccttaaaacccctgcccctgccccagattgtcgctggggtgctnnnnnnnnnnacccaaccgtaccacatgccgatcactgccgttatcaacgcctcaaaacccccgcccctgccccagattgtcgctggggtgctgctgaaatatgtcaacttgggggctggatggcggcatcgtctgtttgtcctggaggatggtgtgcttcggtactacaaggtgaggctgggcaggggcaggatatacgatgggcacatggctctcaagcagatgattgcacgagatcttcttctgtggatagagtggtagtgtccctgctgatgcacaaaagcccatccccccctcagatctttggccctgctgccatcaagatccacatgcttctggactccctgcgagccaagggagagatcttcctggtcggtgctgaaaatattctggagagggacaggttgacagtgacccagccctcatattctggagagggacaggtcgacagtgacccagccctcatgcaatctcacctccattgcatgcttccccatgaagcaggagcagcgccggagggaagcaggggtcgggcagtggccgcctgccccctgcacagggcgagatccatctccaggtggctnnnnnnnnnnggagggggaggaggagcgagcaagtgcgagtgcactgtctatgagcggcattctcctggacccgggttcactcggaagagatcgggccggcgtggcatggcttcaagacccacacgctccgagtcagggctcgtggggccatgctctgcgtcacgtgcnnnnnnnnnnagagggggaggaggagcgagcaagtgtgagtgccctgtctatgaccggcattctcctggaccggggttcacttggaagagatcgggccggcgtggcgtggcttcaagacccaaagcctccgagtcagtgctcgtggggccatgctctgcgtcacgtgctcgctctcacactccctctggcagggaggatcgctgggtttggagcgaagcgctgcgggctgccaagggagcctggcaagggctcactccctcggaggcgggcgctttggcacgagacaatgaggacaggtgcgttccagctcctgtgcatggttgggtggggtatgtctgctggggagatgggtggggcccaagctctgatccccagcctggcggtgcgcaggggaagcagggccctgtggttggtagggcatgggcgcctgggttggggccttggctgcagaagggcctccacccatggcacggagcacagcgttggggcttcatccctctccaacaattgctgctgtgtgccctgcaggatcctctctgnnnnnnnnnncaagggcctccacccatggcacggagcacacaactggggcttcatccctcgccaacaatagctgctgtgtgccctgcaggatcctctctggcgacgacgtcttcctgcagtacctttccaccgtcgaagataatcttgtgtccaggaatgtggactctgccgccagggcctacgtcgccgatttgctggtccaggggcccggcatccagcgcttgtactcaaagcgcacggcggggcgcgctgctgccgctgcatcaggcagtgcagagacccagcgtcacctcgaatccacccactccccgcacaggagcaccagaagctgcaccaggtcttggttgcagaggcaaacaagcgcagctctctgctgaagaggatctaccagctggagccggagggtttggacccgggctgcaggcctgcttggtagcccctcttgcgctgagcacactcgaagtacagggccgccgcaccgcgtcagtcggagggtttggctcagggctgcgggcctgcttggtagcccctcttgcgctgagcacacgcgaagtacagggccgccgcatcacatcagcaagccgccaggctcagcccacactccgtgccacgcagaacgagaagcgggagctggaaacggccatcgtggtggaggggcggcaaacctcagacaaacggatatcacccagcgaatctgcttctggtgcggcgatgggatggtgttcaccggcctcccttgtctgggctagaggagggcaggtcgtctggggtttaaggagtgcagtgtggcagcgctgcagattcagccgtcttaatccctggccgcggcctgaggcgtgtcggaggctgggggtcaggccttcatgcaccatgcttggcagatccggcagccgtgtgctcgacaaggcgctcatacgccaatgtccctctcccttcatcctgtgccagtcgtgtcggatggagaggagagggaggaggaacgcgtcagccacatcttctgtgctgacggcggggacggcaacgagacggatgatgaggagacccacagatgctccttgtggtgggtcgcgcgggtggaatttctggggtcatcgggatgggaagcaggacctcccgcgccgcagtggggcagaggaccctggcgcagggctcagggcacgcatgggtggcctgcccctcgctcggtggccctgcacatgcacgatctctgcctctgcacagtcggcgacgcccagccccccgcctcccgcccccgtccatgtctcgcaggagttcttcgacgtggacgatgcccagggcactgcagggcggcactcgcgcggcaacagcctggcgagcatgctgacgcccaccggctccctcctggacggcctcgatctggaggcagaggcctccgccaaggagccggggtcgacagaggccggcgccctggccccggccccggcccagcctgcctccgccgcggcggcgcccgctcggtgggagcagggcacccccggcgacccggcctggctcctggccgagaagggtgagagcacacgtgagggctgtggcgtgcagggcatgcccaggccgcccttccccctgtacagtgctcccagcgaggagggtctgcagccatttttaccttgtcttgatcagcgtctgctgcgccgccatacctgctgggccctcccccctcctcccatgggcgctgctcgcccgnnnnnnnnnntcagcgaggagggtctgcagccttttttatcttgtcttgatcagcgtctgctgcgccgtcatacctgctgggcccctccccctcctcccatgggcgctgctcgcccgagctcacccccccacccccaccccttgcctgcagccaagggcatcccgcgccgccgcgcctcgctacctccccccgcgcagcaggagaagaccgtgagcctctggtccctgatcaagggcatggtgggcaaggacctgtcccgcgtctgcctgcccgtgtacttcaacgagccgctgtcggcgctgcagaagagcgccgaggacctggagtactcggagctgctggacgccgcggcagccctgccccgcgcctccgcggaccgcctgctctacgtcgcggcctttgcggtgtcaggctactccggcacggtggggcgcgccgccaagcccttcaacccgctgctgggcgagacgtacgagctggtgctgccggagaagggactgcgcctggtggcggagaaggtggtgcaccaccccaccgtcctcgtcatgcgcgccgaggggcgggcctggtgcatggacgcggacgcggaggtgcggtccaagttctggggccggtccatcgagctgcggcccgagggcgtgctgcgcgtgcgcttcgccgacggcgacacctacgtctggagcaaggtcaccaccagcatcaacaacctggtgctgggcaagatctacgtcgaccacggcggcatcatgcgggttcgcggcctcgactcgggcctcaccgcgcgcgtgcgcttcaaggagaccggcatcttcgaccgcgacccgcgccaggtgggtgggtatggggtggatggtgtggggggggggcccggggattgggaacgtgaaggggggggccaacaaagggaaggaaggggcgtgaatcagaggatgggcatgagcgccgggggggggaagcgctgtccggctctatcttga

SEQ ID NO: 7848 - DNA, 378 bp, Chlorella protothecoides
atgacatcaggattcagcgtgctctgggcgcagtggaggcgccatgcagtcctcggaagtcgtttgcaaacactctgcgccgtgtttctgttctggctaggaactgtacgggcgggcaaggtcgaagtggcttccgtgcgggccatgagagaggcacttaacgacacctcgattacccatgtcgtactcctcgatcggcccgggggttacgtcctgaccgaggaagatttcccgaaggatagcatctggattgatgggcgggacgtgctgctggaggggaaaggacccaatcccgtctacctcgatgtgagcaacagagctttcctgcaatgtggccacaaccccctatccgacgctgttcaggcagagcagcagtga

SEQ ID NO: 7849 - DNA, 1977 bp, Chlorella protothecoides
  modified_base (347)..(356): a, c, t, g, unknown or other
  modified_base (894)..(903): a, c, t, g, unknown or other
atggcccttgcctccttcacgacggttgtcggccggcgcccactccttccccccacccacccaccccagctcgccaagaaagcacacgccagcactttgccatcaaggtcatcacggtgtacacgccgcgccagctggaggcggcctacgctgagtgccggaccatgctgggcatccggcacccacactgtgcccaggtgcactcctacttctccgcacgcatggagcactcgttgcgctccgtggatggaaaaggctctgggaagcggccgtcccctggcgcgacgcgcgggccaccaggcacggcccaatatatgtcagccccagccagcccccccccccccccnnnnnnnnnngggaggggggcccgaggctacaagcgcgcagggccttcaagtgtgtggtgcagaggctttgggaagcggccgtcccctggcgcgacgtgcgggccaccaggcaccgcccaatatatgtcagccccaggccccccccctccccgcttccccattcccccccttgtgcagctctgggagcgacgcttacctggagcaggcgttccagctgcggggtccggacgccgcagcatcgccggcctcctccgcagcgactggcaccgggtccctggtcagcaccctctggcgtgccacaaggctccgcggcagcgggagtgagtccgtggcgggggacttgggccctacagggtctcaaagagcctgtttggggccatggcctggaccctgcagtgcttcgtgcaccctgcagacctctccacagagcggccactcgcaagttggatttgcacccatccccacccccgcagccagcctcacactcccgaccactcaaatcggctcgataccccactcccacccgcaggctcctccagtgacgcannnnnnnnnntggccacttgcaagttggatttgcacccatccccatccccgcagccggcctcacgctcccaaccactcaaatcagctcgatacccctctcccacccgcaggctcctccagtgacgcaggcaccgccccctcctccctggccatgcaagtgcacatggtggtcgagttctgcgaccacggcacactggaggctgcggtgcagagcggcatcttcctggaccccgccctcggccgcccgcggatggtgcgggatttgttttggggtggggcccggagggaggggcgagggtcatgtcgtgttgggatgatgagcatacctggggcggtgccgagggtgtgcaactcggccctgcttaccagcctcctcagcagagtcagttcccccccattctcctccccgcccgcctcgacggcaggactgggtgctgcagacggtgctggaggtggcttcagggctggagtacctgcacgcccccgggcgccgagtcgtgcaccgcgacctctccgccggcaacgtgctcctggcgtcggcgcggcgcgggggcggcgacgccgcgccgggtcccgccggcatgcgcccggcgagcacgcgccccttccgcgccgtcatctccgactttgggctgagcatgatgctgagtgccgcggccacccaccgcacctcccacatgaagggcaccgtagcatacatgagccccgaggtgttcaggaccagcgacgtcacaccggccctggacatctactcccttggcatcataaaggaacgagcaaccatcggggccagggctgtgcagatggctcgccccctccaggcctgcatgcatgtgcacctcttggtgccgacgggaagtgcgccgtcccagcgacacctcaccccaccccgggcctcccccacgcagtgtactatgtatacatgggctcgctgccctacccagacaggaacccaggacaggtggggctggtggcagggccctggtcggcgtggcagggcggctgcacacgatgggatgacgaggcggagtcgccgccaggccctggtgagactgcccattcccccgactgcctgaactgctga

SEQ ID NO: 7850 - DNA, 483 bp, Chlorella protothecoides
atgtcgtgctctggcagactggcgtacgccctgacaatggtcaggactttagcgttcccatgtgctccacagacctgccctcccaccgatgcgcaggtcctgctgtggcgcaagaacccgcctgccaaggagccgacgcggtacaacctcactgccttctccatcctgctgaacgaggtggtgccggggacagaggggctggcggctcccaccgactgccgtcgcaggcccgaccaacactgcctggagctgggcgagtatgacgaggtgagactgcggcgaggggtggagagggggaatggatgtctctggaggggtgagtgcatgggtaggtggctgcggggggggagggcgtcccgatactcggttgcgctcacccgggaactgggcgtcatcggcgcggtgggaaagagtctgaaaacttgtgcgccctcctcgcccctgctgggcatgcgctcatccgctcttggagcgcgcgcatag

SEQ ID NO: 7851 - DNA, 507 bp, Chlorella protothecoides
atgggaaggggtggggaaactgcgacccgtgctgggcgagcgagcctgcccgcgcgccgcgcctgggagcctcatggtggtgctggcctggtagcatgcaggatcattcacccggccgcttgccccccctccccttcccagcgccccagtcaaccctcccctccctccgtgccacagatcagcgacgcgttttgcgtcgagcaggagcagtcctcaggcctgcgctccctttccagcaccatccactacatgaacctgatgggcctggccaaatcgtccctggacgcccccccccaggtgcagatcgacgcgaggaggacccaggtggtggactctggctggatcaacttccccatgggctccgtgtggcgcatgctgaattgcacgctgtcctgcaccggaaatgtcacccacgagctcaccgactcggcgctgctggggctgtccaaggtgccgcgctttcctgtttgggggaaaagaggtgaagagcttaccatctcctggtga

SEQ ID NO: 7852 - DNA, 1164 bp, Chlorella protothecoides
atgcggtgctcgccgcggccaaacaccccgacctcgtgcgcgcgctcttcagcgccaccctgcccgagacggtgcgggggctgccggggtgcttggggcgtggggggaaaggggggaatgtcgggcggccagaggatccccccttggagcgggggccggcgccgctcgcccctccccccgaccccatcggaccccccgagcctcgacacacacccaaccctcccctccctccaaggtggaaagcatggcgcggagcgtgctgcgcgaccccctgcgcatcacggtgggggagcggggcaacgcctcggccacggtgacccagaccctgcagttcgtgggccgggaagcgggcaaggcgctggcgctgcgccagctgctggcggggggtgtcaagcctcccatcctggtcttcgtggccagccgggagcgcgccaaggaggtgcacaggcgagccccatgtgcgtgcatggcactggggctctggaggttccttcagctcgcaagagggcgctcgtcgtacgcatacccgtccagcaactgcttcatctcctccaaaatgttccttcctttcttcccagggagctgcgcttcgacggcgtgcacgtggactgcatccattcggaccagagcgatgccgcgcggggcgccgccatcgccagcttccgcaggggcagcacctgggtgctgatcgccaccgacctgctggggcgcggcatggacttcccgggggtcaacaccgtggtcaactacgactgcccccgctccaccaccgactacgtgcaccgggttgggaggaccgggcgcgccgggcgagcaggtgcgagggtttatgtggctttgtttctggaagacaggaatgactggctctggagaggatgggcttgcctggtgtggcagaccaggtgcgtgagggtgtgtactcaacctcccgccaagccgtacgatcgccgccagcaccaccaatctcctgcaacccctggcagggtcggcgatcaccttcttcacggaagaggacgtcaagtacctgcggggcatcgccaacgttgtacgggcgtcgggctcccccgtcccagactggatgctggcgctgaggaaggagcggcggcggaagcgctccgacccggagcaggcggttgcgctggaggaaggcgacgtggccgctga

SEQ ID NO: 7853 - DNA, 1281 bp, Chlorella protothecoides
  modified_base (1102)..(1111): a, c, t, g, unknown or other
atgcaggatcccgtgcttgatgggctcattgagaattgcagaagtgaacgcctgcggtgcgcgctgtgtcaggcgcgcgcgcctgcatacatgaaagccatgcacataccaggccgcgacaatcacggctgcaatccaaagcaacgcaatgtatcttgcactctgaacatcgatgcgactcgtgagggattcaccccgcacaggtcggctggccggatgtcgatgttgacacgctgtcgcgcccacagtcgtcctccaaccttcacacctgcatccccaggcgacgatgaagccacattggatgccacagcccggccgggtctctcccgggggggcgccgagggtgcaggccccccctcggaagcctccaccccggccttcctggacagcctgccccacgtcagcacgcgtgacccgaacgaggaggccaacgtcatccgcaagctgcaccgcatccgcgtgtccggcagcctgcccccaccccccctgcgcacctttgcccagctggcgggtgagggggagggggggggcgacccgcggccctcccgcctcctgcgcaacctggccggcgcgggtttcctggagcccacccccatccagcgccaggccatccctgccctgctcgcccggcgcgaggtgctggccgtggcgcccactggctccggcaagaccctggccttcctcctgcccctgctgctgcacgcgcgcgcgatgcgccgcgagctgggccccgccggcgcgggcccggggaccgcgccggggccccgcgccgtggtcctcagccccactcgtgagctgaccgcgcagtcggcgcgcgtgctggccctgctgctgccgggcctgggcctgcgcgccgcgctgctctccaaggccaccgccgcgggcaccgactttgcgcgtgtggacgtgctgctggcgaacccgctgcgccttgccgcgctcgccggcggccagggccagggggctggcggccgggaggccgaggggcaggcgccgccgaggggcgaggagccgcggagcggcgcggagcatcccccccatcaacacccccccggcgagtcgtccggcacacgagttccagcatctcgcggaccccccgagnnnnnnnnnncaggcgccgccgaggggcgaggagccgcggggcggcgcggagcgtcaaccccatcaacacccccccggcgagttgtccggcacacgagttccagcatctcgcgacccccccgataccacacagccccgccggctggacctgagtcaggtgcggaccctggtgctggatga

SEQ ID NO: 7854 - DNA, 1539 bp, Chlorella protothecoides
atggggacagcagggggcaggggcagatgtgcacgtacactctcgcacagacagttccccctccacccccccttcgccgcgcgggcgactgcgcgctcagttgttgtatccggaggtggtgatgctgtccgcggagccaaaggacgcgtcccacacggtgtgcgtccaccccggccggtccacacgctcgtaggtgtgggagccgaagaagtcgcgctgcgcctggaccaggttggcgggcaggcggccgcggcggtaggagtcaaagtagcccagggagccggtgatgccggggatgccaatgccggcgcccacggccacggccaccacgcggcgccaggcgtcctgcttccgcgccagctcggcggcaaagtcggggtccaccaggaggttgggcaggtcggggttgcgctggtaggccaacttgatccggtccaggaacgcggcgcggatgatgcagccgccctggggcggaggccagggggttgcatgtcagcagagtcacggagtcggaagatgggaggcccaggccgcgtcaggagcgacaccgttgcccaccagaaacacaagaaagaaacacaccccaaccccaccgggtaccttccagatgcggcccaggtctgccagctcgatgccccagcccttctccatgctcttggcgcggatgatgttgtagccctgtgcgtaggagcagatcttggcggcgtacagtgcctcgcgcacatcggccaccagcgccgccttgtccacgccgggcgcggcggccggggccgccacgcccagtcccgcatacagcgcctccgccgccacgcgctcgtccttgagccccgacaggaagcgcgcgtccagcgcggcggccatggtgggcgcggccacgctcagctccgcggcctgctggatggtccacttccccgtccccttcatccccgtcttgtccaggatcttgtccagcaggaagccctcgccctcggtgtcgcgcacggagaagatgaggctggtgatcatgaccaggaaggactccagctcgccgccgttccactccacaaaggtggccgccagctcctcgttgctcagcccacccacggtgcgcagcacgtcgtacgcctccgcgatcagctgcatgtcgccgtactcgatgccgttgtgcaccatcttcacgtagttcccagcgcccccgggcccgatgtaggtcacgcaggggccgtcgtcggtctgcgccgccacgcgctccaccacgggtcggaggtgggagtaggcgccctcgtcgccgccaggcatcatggcggggccgttgcgcgcgccctcctcgccaccggacacccccatgccaatgtggtggatgcccagggccgccagctccgcctggcgccgctccgtgttctcgtaccactcgttcccgccgtcgatgatgatgtcgccgggctccaggaactgcgtcagctgcttgatggtcgcgtccacgggggcgcccgccttcaccagaatgatcacgcgcctgcttgttggtgttggaggggggaggaaaggcggggtgagtaa

SEQ ID NO: 7855 - DNA, 930 bp, Chlorella protothecoides
cgcgaggcgaccgcgcgggcgctggcggcggcgctgcggcccgagctggagcgcgcggcgcgcgacaactccgacccgcccggctcgccgtacgagttcgaggcgggggcctgcgcgcggcgcgcgctgaagaacgccgcgctgggcgcgctggcgcggctggggggcgagggcgtaacgcaggacctgctggcgcgcttccgggcggccaccaacatgaccgacgaggccgccgccctggccgccctcgaccgcatcgggcacgaacagagccctcctcgtcgtggagcggcaccggggcagcgcatcggtgatgtgcatccctccatccctccccccgctcctccagggggcaaggtgcggcaggaggcgctggacgccttttacgccaagtggaagcacgagccgctggtcctgctcaagtggatcgccatgcaggcggccagcaacctgccgggcaacacggcggcggtgcggaccctgatgcagcacgaggcggtcaagctgtccaaccccaacacctgctactccctcttcctggcctttgcgcgctcccccgtcaatttccacgcagaccgccacaccattcctgtgtgggtccgatcctggatgacaggggagtggcagacttcccgcactgcctctgtgctccgtttgagcccatcaaagcggtggcctcacgtccatcctccccacaaccttgccatttccgcagccgacggctcggggtacgagttcatggctgactcggtgctgcagatcgaccagatcaaccaccaggtggccgcacggatggtgggtgtcttcaacagctggcgcaactacgacgccgagcgtggcgccctgatgaccgccgccctgcgccgcatggcctctgccaacggcatctctgccaatgtgtacgagatcgtgaccaaggccctgccctga

SEQ ID NO: 7856 - DNA, 2031 bp, Chlorella protothecoides
  modified_base (271)..(280): a, c, t, g, unknown or other
  modified_base (1959)..(1968): a, c, t, g, unknown or other
atgtggacgcagagcagttggcctggttcaggaatcaactggatgcctcacagggtcgcccagtcattgtgttcagccatgcgcccattctcggcagcggcgtcagggtgggtcgctggcgggctgtcggcttgggtcgacggtcgacccgtcagcgatcttgctccaaggaatgcagaggttgcagtttcatgggtgcatgccgcctcccaatcaagaaccggcagtacattgcatgcactgtgccatggtacagtagcacaacagagtnnnnnnnnnnaatcaagaaccggcagtacattgcatgcacggtgccacggttcagtagaacaacagagaaaagctgaccttccacgcagtccgtgctggatgtccacgtcaagaatcgatgcgcctggcttaaccacagcaccaacccccatgtgttcatggagctggtggagtcccaccccaacatacacctgtggttcagcgggcacttccacctcagccacaactatgcagctgcacgagccagaaggtggatgtattccttgctcccagcctcctcctctcccaagcacagacagcatatcggtggtgggtcgaacagccttcgccacgacaggtgtcatcggcaaggccaatcgggatggcttcaggcactcctgggtcctttcaggtatgaaactcattgcagcggtgggcctgaagtcaacacccacagagtacagactgcagactttggaccatggcactggcagactgaggctggaccttgtacaagaatggtgcgaatcagtgatgttgatgccttcagtgcttgatggatgtaccatgtcaacagcacaaaccattgcgcgtgccggacctcagcccaccttcatgggtgctgagacgatccatggagcttccaccgccctccaatggaggcatgagtgtcttcgcctgcgtgccagacgcgtcccatcatcccttccccaatctcctgccagggggagcagggcagcgccagcccctcgtccaaacagaacaaacctgctgaaagccccatcagtcgtgtacggtggtgacctgagcatgggcgcatgcctgtgtgtcagccacccctccccaggccgacacccttccactcccatcctgtgcagacccgtgatgtctgctctgcctgggctccagttcgagggaggggaggcgctagaatccacagcagcacagtggtttcagattgggaacggcgccgtcttaggaaggaaggagggcctgctggtggaatatgaggcagcctcggcatcgcccatcggagtcgtgctgactgacctcgaggatgatcaccagctgggcgccatctcatcgccgcaaccaaccgtgctgtcactcgccctgcctcccgtcttgccagatacgattcaggggcgcagacggtgggatcctgtcgggcatcgcgctcgacgaggccgcaaccttggaatggcaagtgcccagctgggcgccatcccatcgccgcaaccaaccgtgctatcactcaccctacctcccgtgttaccagatacgattcaggggcgcggacggtgggatcctgtcgggcatcgcgctcgacgaggccacaagcttggaagtgcatggaccggagggagacggggccgcagaggtcgcggtgctgcactccatcccccggaatgcgcaagggacattctaccaggcgaggatggaggcgactctgcggctgaatgcattgctcggggtggtgggatgtttcggatgtgcagccaaaccctagagagactggcgtacggcatggatggactgttgggcaccccccttcccatctcgaatacctccatgcccatcctctaccactcactaccccctgcagattttccagcggaacaagtggcagctgcggctggcaaaggaatctgccaccaaggcccaccctgccgcaaccagccagtgatttccagggctgcaagtccctannnnnnnnnntggcagctgcggctggcaaaggaatctgccgccaaggcccaccctgccgcaagcagccagtga

SEQ ID NO: 7857 - DNA, 291 bp, Chlorella protothecoides
atgggcgatgcccacactgtcgttgccgatgtggcagctgcactctgtttcttttatgaccgcccaaaaggaggcccttttccacaccctttcccaacttccccagagggtctcgagttcaagacggatgccttgaatctcgcggcctggcaggaaacattccagcaggagcaccactggcgggtagatgtggggcccgccatcctcttgggcctcggcacgtctcgcttcaggagtaaccaacactctgcacatgaagtaagacacgtgataggtgcactgggctcgtga

SEQ ID NO: 7858 - DNA, 1008 bp, Chlorella protothecoides
cccgccctgccgcccccgccgcccctccctgccctgcggaccctggttctgtccagcacgggggtaggctgggggggcgcgctgcggatcggtcgctctctgccctccctcgccgcgctgtgcctctgcgacgagagcgtggaggacgtgagccctgctgagatgggcgagtgcgacctgacggccaccttccctgctctggagtccctagacctgagcgggaacctccttgccagctggcggcaggtggcagccctggccaccctcccgtcgctccaaaccctcaacctcacgggtaacccctggggcagcagtggcgacgacagcgactgcgcagtgccctgcccccctggcttccgcacgctgcgtacgctactcctgggcggcacccgcgtgtccagctggagccaagttcaggccctggacggcctgccagcgctggccagccttcgcctgactgacacgcccctgtggactcgggcccccgccaccgcacgagcccagaccatcgcccgactggggggcctggtgcagctcaacggcagccaggtggcggctgaggagcggagggatgctgagctgtggtacctccgtaaagtcactggtggggtggcgacgggggaagagttgagggccctgaatgcggctgaagttgtcggaggcaggggttggccgacgccctgtgtgatgaggcgctgcacctctgcctggcccatgcctgatgagcacagggtcatcgccctcccccgccctgctcatcagatgagctggctgcgagcccgcaggataaagagggcgtgctcgcctgccacccccgctaccccgctctgctgcaagcactgggggcccctgcccctgccctggcttccagggggactgggccagggtccagccggctcctggagatcgccctgcaccatgaagagcgtgtggtcatcaagcgcctgccaggtgctgcttgtcggtggaggaagtcggatgaatgcgggcccatcggtgtctagatag

SEQ ID NO: 7859 - DNA, 249 bp, Chlorella protothecoides
atgtgtccgcgcacgcctcgcctccatggctccgtgcggcaaagttgcaccccatcgccctgcctccaggaggaggcagcctccctggcctccctgaaggacgaagccaacatcgcctttgctaagcgggagtacgatcatgccctggcaacctgggaccgcgccctgaagctggcgccttcgggcagcaccgatgcggcgctgctgcattccaacaaggctgcctgccacatgatcaacaagcggtga

SEQ ID NO: 7860 - DNA, 282 bp, Chlorella protothecoides
atgcaccaactacagtgcaaggatctggagacccagaaggaggtggcggtgaaggcgttgtccctgcgctccctgcgctcctggaaacagctggacctgtttgagagggaggccgccgcgctaaagggcctgcgtcaccccgggatcccccagtacctgggatactgcgaggaggacacgcccgacgaccgccgcttcctgctcatccaagtgggtggttacgctgtcgctgaggcgccttcatgttggggctcttgcgtgaggatccagggcctcttatag

SEQ ID NO: 7861 - DNA, 507 bp, Chlorella protothecoides
atgcgagtctcccggctacgccaactgccagaatgcgcccccccatccctccgccttctgtgcagcttcaaagaggctgtgaatgagtgctccacagccctggagctgcagccctccttcttcaaggccctggtgcggcgcggcaaggcctacgagcagatgggccagctgaagaatgcgctgacggatctacagcgtgccaacaagctggatgccgccacccaagagagcaaggaagcagagcagcggttgagggacgccgtggccggcaagaagccatccggcttgggcaacggcctgggcccccgccgcacaggcggagcggcgggctcgggcaaggcccccgccccctctcgccagatcgtcttcccggccaagctgtctttcgaggatgatgtgcgcgccctgcagctggtccctggcgtcacgtatctggagctgatcgagcatgtccgccagctcttccccgcggccagcccctttgtgctcaagtacctggacaagtga

SEQ ID NO: 7862 - DNA, 1104 bp, Chlorella protothecoides
atgaccacgatgaccaggcttgcgggggtgctcctgctctgcggactcgcggctctggctcccacccccgcccgggcctcgctgtacgatccacatgtccccacaatgtacgatcccgccttccgaacctggttcgagggatggtatgtccggatcacgaccgcacagccagagggcgagggaggagacgacgggacgggcccggtcctgccctcctccctgggcctcatcgtgggcaccatgcctcgcgggaggttgggctggaacatctccctggcgagcctgctggtgcagcagggcagccgggccctacagaccttcgagagcacgggtgtgcagctgtcggtcacgggggccggtggtcaaaccgtggtgcgggaccccgagccccacacccccccggacttctcggtggtggcggacgacggtaccgccctgctgcacatgcggggggagcagtgcgccctgcatgtgacactgggtgggctgaccatggacgcacgctgcactggccctcccctgcgctggggccccaacgacgagtccccggaaggcggcatctccggcctcccaacccagctggtgggcctgcactggtttgtctactccctgggcacgcctgtggcctggtccctgcgcaacgactccagcggtgagaccgtgacgggcgctggcctggcgcacttcgagaagaactggggcggcacctttccgcccggctgggcctgggcccagggcctggacctggcgccgggtcgagacccgtcccggccccgcgccgccgtggcgctggcgggcggccagctgccaaccccagtgctgccagggcgggcggttggttccggacgcctggctgctgggcgtgcgctcgccaggcgggcgggagtgggacttccggccccaggaccccacctccttcacagcagaggcggatccctgcaacgccacgctgcgcctcaccgcgcactcgccctggacggggcagacggcggtggtgacggcgcgcgccccgccaggcctgtttgggcacgtgacctgccccatggcggagggcttcgagccgggcacggcggtggaggcgtaccgagcaagcctcaccgttga

SEQ ID NO: 7863 - DNA, 1335 bp, Chlorella protothecoides
atgtccacccctccctgctccagggagggtgacctggtcaccatcggctcccgtaacgacgtccagagggccatgcaggaggcggtggagaccgcgtcccgctcatctgggaaccgcggccccgtcacccaggcatccctggcgcccatacgcctgcaggtcgtccgcgtctccagcgagcgatggcgtggcaccccacagcacagcacactgacgcatcggtatccttctcacaccccgaacacccctccccacccacacacccaggaccaagtgcccaaggtgccagaggacgagctggcgtacgtgcagcagatgctggcgcagctgcagaaggcgcaggcggcgcgcggcggcgcggccgagcccgaggccgcggagcccgaggccggccccgtgcaggtggacgagtggatcctgtcctttgtggaccttctgaaggagcactgcggcatcgatcccgaccgccccctggaggcgtcggaggtgggcaacgacaagctgcaggccgccttccaggagatgatggagggcgaccccaaggccgacaccctgctggacgcggcgctggagaagttcgaggaccaggtctgcttcggcatgtacaaccaggccacggtgcaccagtaccgtgcggagtttgccatgtaccgcgccgcgcgcgcgggcgagcccgcctccagcgtggcggaggaggtggagcgccacctggcacgcgccgaagccaagcacgccgaggcgctggagtacaagcccaccttcctggacgggtacctggggcagtccagcgtggcccagagccgcgccaagctggcggcagactacctgctggagccggtgcggccgcgcgaggacctcaaggacgccgccgagcgcgccgctgcggaggaggcggccaaccgcgccgcgcaggccaaggcgtttcagcgcgtgagtgccgagtcggcgcaggccgcggaggccttcatggacgccagctatgcgctgatcggggccgccatcgaccacatgtcggaggaggagcgggggaaggaggtgaagccgatgcggcccactgcggagcagacgcccggcgacccggagtcggaaatgccggtcaaggcctccctcctcatcaacctgggcaatgcgcactacgagcactccatcctgcgcgccgcgggagggctggactggaggccgctggtggagaaggccgccgccaagttccgagaagctggtgagggagttgtctgggggacgaggggaggttggggggaagaagggaggttggggggaagaagggaggttggggggaagaagggagagtgggccaggcatggtcaagcgggatga

SEQ ID NO: 7864 - DNA, 303 bp, Chlorella protothecoides
atgtacctcctcctgtcgccatctgggaggaccaacttgttcttgctggtctcttgccctgaatccccagctcataggcactcgccccctttcaccccccttgcaggtgcgcaccaggtggacatccgcaatgcgctcaagggccacccattgtccgaggagctggcggacttgatagggcccgagccggaggagccggaggtgtcccaggatgcacccacggaggagagcaccaccgcgcccaagggtctgcccgcgctgccgagcaagtcgaagaagaaggaggccgaggcggcggcctga

SEQ ID NO: 7865 - DNA, 690 bp, Chlorella protothecoides
atgaaaccactgagagccgcatcccctcgtcttcctcaccacccaaccctcaacagagagcggctccagatagggcttaagaagtggaatgtcaagcagcagctggccctgttccgcggtggccagcctcagtgggacggctccggcgtcaaagaggtgggcggacgctccagcgacctctcccgcgccggcctggtggtggcggggtatgtgaatggtcagccccagacccagctcgtcctccaggaaggcacacgcaaggtggtcctgggtgagggcctggggctggaggagcaggaatggctgtcgcggctgatcaacacccacctggcggccaatcgggagctgcggggggaggagccgctgccggagccccggccgcggggcaggcggggctggatggcagacatggaggagcggatggccaccttctcggaggacctgagctccaccttcaaccagggccgctccttcctggtggatgtcgaggacagggcgcagcgtgaggcccagcgtgcacagcgcgccgcccgccaggctcagcgcggcgcggaggagggggcccggcgcgcgcggggcgaggctgaggccgccggccgtgcggcgaggcgcttcggcaaggacctcggcccacgagtgagtcccactggcaccatcgacgtcgactttgacgtgctggacgatgagtga

SEQ ID NO: 7866 - DNA, 852 bp, Chlorella protothecoides
atggccccggagcagtttgcggggggtgcctcccccgcctccgacctgtacggcctgggcgccacgctgctcttcctgctgacggggcgcgcgcccgtggcgtccgaccgcatgcgcgtcagcacgagcgccaccgccatgtcgccgcgcctgcgcgcgctggtggagggcctgctggagcccatggccgaggaccggctgagcgtggaggaggcgcaggagatcctggagggcggacgggcgcgcgcggtgggggcgcggaagcgggatgacgccgaggccgggcggccgtcgggcagcagggtccaggtcacgcgccgcgggccgcgcctggagatcgacatcccgccgcccgggttctctggcggcctggtgtgcctgggggcgtcagctgactgcgcggagcccacaggacagccatgggaactcaaggtgtatggggtccagcagcaacgggaaggtcaccgccttgcagagtttgtggcgcgacatgccgctgctgcacgagtctgcccacaagacttggccgatggcctggccctgccactgccgatgcttgcccccaatctcaaaccctcacccacctcccacacaccctccacctctcatgcaggcgactcgctgcccagcgccgcctttgctttggcctggaacgcgtttgtggccttctggacggtgagcgcgctggcgggaggcggcatcatcttcgccctcttctccctgcccttctgggcggcaggattgaaactctccagagcggccctggccggccagttcctcaggtgggcgggggtggagccacgaggtgtttttttgagaagactgtctgtgtcagcgcatgccaggtcctag

SEQ ID NO: 7867 - DNA, 531 bp, Chlorella protothecoides
atgccgccaacctgggggactcgggtgcgaggggtcgagctgctgagaagggtggtggtgccgagtgctttggttgcacgggaggggagcctcgaggggggacctctgcgtggcaaccactcgtcagcccgcctcacgatccctcctctcctccctttcctcccgccagggttcatgatcgtgcggggggacgagctggccttcatgtccccacagcagcaacacgacttcaacttccccttccagatcgggtcccccgactcgatgtccgacttccccagcgctgcacaggtttgtcgtggacggagggggatgatgagaggagcagaggatcctggaggcgccggcctgcctgagggagctgctgcggatcgtgatggcccagtggccatgagctcacaccaactccaatcgctcccccgtgccaccatgccttacctcccgacctacccccctcccttcacaacagcgcttctccctgaagacgtacgagggcgacgtgctggtgctggccaccgacggcgtgtttga

SEQ ID NO: 7868 - DNA, 507 bp, Chlorella protothecoides
atgccctctccaggccagcacgcagcattgcccgcgcagtctgatgcacatgcgcctccgcagcctgctctgcgctgcccctcatacccatcggaacccaccccccggcactgcaagagcaggtggcaagaaggcaactgcaggtttggcaatcgctgcaactttgcacacggcgaggcggagcttcgagggctccccccacgctcccgtggcccatcaggggggccatactcccaggtggggcctggcgcgggaccaggcacatggcagggccaccagcaaacccatgggcctgggtcgaacagctcgtctgggaccccggccgcagaccatgctgccaaaccggagaagatgaccgacagggaggtgtgggtagcttccggctgtcctgtcgccggaccaaatgggtggacgcagtaccaggtgaacatcgtagtgggctggggatctgcgccggcgtgttgccttgtatcgttgccaatcgaggtcgccatgcagggtccatga

SEQ ID NO: 7869 - DNA, 816 bp, Chlorella protothecoides
atggttgggcttcctgaggcctgcgacacccccgagacggtacgcgtgcctgccttccccctacagggtcccgatgactacgattacgacgataagttcctagtgcgagaggacgaggacgaggatggcgatggtgagcctcgaggtcaagtagcttgcccatgttaccttatgctgcggcgaggctcttgtcctgtgagacctggggataatcgtggtagaagtttcatgcattctgagaggggtgatcaggttggtatgggtcttcagcccccctcccggcccatgcccgccgctggcacaggcgcagcagagggcgaggcccagccccccgccggcgccgccaagcacgccaagaagaaacgacggcaccgggagctggtgctggaggacgacgactacgacctgctggaggagaacacggggatccggagagcccgccccgccgcccatcgccgcatcaagaaagcgcgggatgcggaccggggcctgggccgcgagggcggcgcccaggccctgcaggaggagctctttggcgccgagctggaagaccttgaggatgaggacgcggaggccgccccctccgcgcccactgcgcccccgggccgcgccgcacctgggcctggcgcccgcgccggggacgaattcgatgcggaggaggaggacgaggacgactggatcgtggacgacttcgagggcgccgaggacgagggcgccgcggccgcggccggcgcggagcggcggcggcgccgccgcgccatgcgcgagggcgtgcccgacattgaccccgacgccctggacgtgagcgctcagtga

SEQ ID NO: 7870 - DNA, 2103 bp, Chlorella protothecoides
  modified_base (373)..(382): a, c, t, g, unknown or other
  modified_base (807)..(816): a, c, t, g, unknown or other
  modified_base (1008)..(1017): a, c, t, g, unknown or other
  modified_base (1764)..(1773): a, c, t, g, unknown or other
atgcacacagactgttgcgcccggcgccatgcccgccctaattacccccgaccccccaacctttccgctccagcaataaaaacctccctctgctccctcctgccgacatccacccacccaccaaacactccaggcattgtggcggtgggcggcgacggcgccttccacgagctggtcaatgcgctgttctcggagcaccgcgctgcgctgcgcgctctgcgcctggcgcatgtccccgccggctccaccgacgccgtggcctgctcgctgcacggctgccgcagcgcgtttggcgcggcggcgcgcgtcgcgctcggctacgacggcctcttggatgtgctgcgcgtcgaccccggccccggccgcgcgccgnnnnnnnnnntgtggcggtgggcggcgacggcgccttccatgagctgcgcgtttggcgcggcggcgcgagtcgcgctcggcgacgacggcctcttggatgtgctgcgcgttgacctcggccccggccgcgcccccgtccacgcctgctgcatcgcagcggccgggttcatgggcgaggtctgcgcgcgcgcggaggcctggcgcgcgctgggtccgttgcgctacgacctgctgggcgcggcggcgctgctgacagggcgaggcgtgcgcgcccgcgtcagcaccctgccctcgcctctgaccgggatggcggccgagcggctgggccccggggcggagggcgccgcctgccgcgccggctgccccgtctgcgagctggccggggaggggggtggtgcgagtgccagttcggatggggacgtgtggtcggagagnnnnnnnnnngccccgtctgcgagctggccggggagggggctggtgcgagtgcgagttcggatggggacgtatggtcggagaccgacccgccgctggacaccgacgcgcggagggtgcccagcgacgcgtctgcgggcggacccgacgctctccaccggcaaggctcgcccagtgccctcgctctggaccctgtgggccctnnnnnnnnnncccgccgctggacaccgacgcgcggagggtacccagcgacgcgtcgccgggcggaaccgacgatctccaccagcaaggctcacccagtgccctcgctctagaccctatgggcccccagccaggcaccccgccgacgaaatgggagtcgcgggaagggcgctggcgcagcgtgaagctgatcgtgacgccgtgccgcagcgacaagacgccgtgcggcatggcgcgcgccgggcacctagccgacgggcgggtcaaggtggtgctggtgcccaacctgggcgcgctgggcatgctgcgcgtactggcgcacatggcggcgcgcggcctggcggcgggggacctgccgggcgtggaggtgctggacgtgcgggcggtgagggtggagggcggccgcggcgcgaacctggactggaacctggacggcgaggcgacgcccgccgctttgctgcgggcccacgtgatcaggggggggctgcgcgtgtttgcccggggggtggagacggggcggtgagggggtgttttcactgtcctccctgccaggccgggcgtcgtccattccctgacgcgcggcatcgttcggtgcactggcgtagaccgccagggcaatggccagggacccagggcccacagccagatgagggttgcgggggctctgggcggccgccaaccgtgtcgtgcctcagaccctcgggagagaccctgtggccaccaagctcgacgactcgcacagcccctgcatctcccgcnnnnnnnnnnctcagaccctcgggagagaccctgtggccaacaagctcaacgactcgcacagcccccgcatctcccgagggtcagtcctcggcggagctgaaggccaggcgcagctcctccagccgccccaagatgccctccgcgtcgtcggccacggcgtccgaggccaggggcgtgcgcagggcgcgccgcaccgtgccctgcgccgcccgtgcctcgtcagcgaaggccggaccggcccaccagagcgtcagcgtggacgcctgggccgcccgcggcggggccataccgtctgcctcccgcaggccgcgcgcgattgccgtgcaggcggaggggccg

SEQ ID NO: 7871 - DNA, 921 bp, Chlorella protothecoides
atggcatgccgggcacgaaaccggcgcctgcctgccccaagaacaggcgcggcgtcgacgctcacgccgggcccacaccctgcttcccacaggggcgaggcgtactatgtgcgcagggacctggccgacgtccacacccaagaccggtggcggcgcctgggacgagacgtgctggaggaggagctcgcacgccccgccaaggccctggcccggcggcgggcgccgggcctgagccccggccccgcgggtggagtttccaagaccatctccggccgcgtcgcagggagggacccccctccagacccagcaggggtcccccccgaggctacagagccagccgcgccgatggtgcactactacggcgagtggcagacgagggtggcggtgccgctggcggccaggaacggcaaggtgccgcgcaacgccatgggcaacgtggaggtgccgccgctggcgcatgcgctccccctgggcaccgtgcacttggacctgccctccgtcttcgccgtctgccaggcgctgcgcgtggacgccgcccccgccctggccggctttgagcaccgcggcggccgggccacgccctgcctgcgtggcgtggtcgtcgccgccgaacacgagggcgctgtgctggagctgtactggcgccaggccagggagcgggaggccagggccgaggcgcggcggcgccaggcggcggaggcggcatggcggagcctgctccgggcgctgctggcccgggtcaggctgcaggcgcggtacggagaggagggcgcggggcagggcggcagcatgcaggacgccgcggcgacgctgctggagcccgaggctcggggggggtccgtggcggcgggacggcgggtcgatgccgagcgggggcttcagcacaccagcgcgccggaggaggaggcggaggagatatga

SEQ ID NO: 7872 - DNA, 1293 bp, Chlorella protothecoides
  modified_base (368)..(377): a, c, t, g, unknown or other
  modified_base (803)..(812): a, c, t, g, unknown or other
atgtcccgacaggcgatggtgtgtgagagagtccttgggcaggattgcgagcgggtgtgcgtcgcatggattctatctgcaaccatgcgtcatcctgctgcagaacagcgagtgacggccctgctgtcggcactccagcccagccctgcctcggaagcgaggcgcctggccatagcgcgcttgatctgctccatcatccgtaaatgcttccataacgagtttgaggtgcgtttcatagcaaccagggatggagcgagggtggaggtggcgacatcccacagctgcttctggcgcacctccgtcaccgaccccaatcacgcaaactccatgccaggtggaggcattcctcttcggatctgtccctctannnnnnnnnngcgacatcccacagctgcttctggcgcacccccgtcaccaacccgcatcacgcaaactccatgccaggtggaggccttcctcttcggatctgtccctctgcgcacctacctccccgatggtgacgtcgacgtcagcatcttctgctcacgacgcacggatcaggccaccctgcggggcgtatgggcccctcgcctcgtccgtgcattagagtgggaggccaggcgggggcccgtccacctccccatccgggacatacaggtcatccaggccgaggtgcagctggtgaagtgcatcgtgtcgggtgtggtggtggacatctcctttgagacggtgggaggcctctgcacggtggcctttctggagagcatggaccgccgcattgggagggcccacctcttcaagcgcagcatcctcttggtagcatnnnnnnnnnntcttcaagcgcagcatcctcttggtgaggcacggcggtttggggtcaatcgtgggatcctaggaatgggaggggtcggtgaaggcaggcagcagtaccaggtgtcagaatgtgaggccactgtgcaggttttctgggcacattgtgagcgccgggacgtcacctgccttgtcaggcagtgcccatcttaccaaccgaggagtaccctctcaaccttgccccatccaagatctgcagatcaaggcctggtgctactacgagtcccgcctgctgggcgcccaccatggcctgctgagttcctacgccctggaaacccttgtgctgaatgtcatcaacctgcaccacagcgtggtgcacacccccctccaggtctgcttagccgtgttaatctgggagattcacagtacaggggcagtctctgctttgagcttcactttgtcaaagtctgcctgcaccttccaatcaccctctccttcccgtag

SEQ ID NO: 7873 - DNA, 1182 bp, Chlorella protothecoides
atgcagcagcagcagttggccgcccagcagcaggccgcactgcagaagcagattctggcgcagcagatgctggcgggcggtggcgctgcggggctggccgccgcggccggcggcgccgcggccggcggcctcaccgacaagcgccagcgcgaggtctacatcggcaacctggccatgggccaggtcacggccgacatgctgcgcgagttcttcaaccaggcgttctcccacctgaccccagaccccgtcaacgcgccccctgtcacccgctctgccatggagggtccctcccgctacgcctttgtggagttccgcaccgaggagatgacgctggtggcgctgagcatggacaaggtggtggagctgtgcggacgcccgctcaccatcggccggcccaagggctggacgccgccgctgcccagcgcggcgcccgccgctgcagcagccgcgggtcccactgcaccagcggcggccccggagcagactttgctgctcagcaatgcgcttccggtgagcggggtgcggcaggcagaggatcgagcggtgctggcggctgaagtgagggaggaggcggagcgccatggccgcgtcgaggaggtggctgtgccagcgccgcccacgagcatccagcacactgcctgcgaccctgccccccaacaccccagcttcccacctgcgcaggatgccatgccgtcgcgggtgtacatccggtatgcgaccccggaagacgccaaggcggcggtggccatcttcaataaacgcacgctggatgggaacgtcatcaaggcagtcctcgtgccagacgaggagtggcaagactcgcgcgccgggcagtgggtcacgcggcacagcagcatcgccggcatcccacttcctggtgcgagggaaggacggggttttatcgcgggaaactctggccgagacttttgtgtgtacatgtgggggcaaaggtggctacttctgggaggctgtgcatgggcagagatcgtatttcgtgggcgtccagaaacttacctgacaacccttccctctcccctggctgcatttctcgccaggcctgtataccaagacacccctgcccgccgggatcacggggctggcagccctcaactccgcgctctccgctctggtccagacgaatccgggaatcgcgacggtgctcaccgccgggatcaacgctga

SEQ ID NO: 7874 - DNA, 1227 bp, Chlorella protothecoides
atgctcttcatcaacgacaccttacctccgttccctgctcctgctgcggccccgacgcctgcgatccgggctcctggaacgggaccttgccatcgcctcctccctctcactctgggccgagtctatccgaccagggcagcagagttgacctcaccatgtttggtcggtgttcgacttccctgcgtgtatggaggagctggacgtcaatgtcgccctggcctgcgttggatcaacttgttgatcctgtctccaacgaggccatcaggtgagacatctcgagctatcgatatgaagtctgaagctcgcacagctggtatcccacgcagcagccagcacctcctttcagagtacagccagcagcactccccgaccccaacccgcatcgaattcagtgcatggtcccagcaccgtgaacgcccgggaggctgccaagttcagggagttggcaggaaagtggtgggacccccttggccccttcaagcccctccaccacctaaaccccacacgcgtggagttcatggtccagtccatctgcgatcacctgggtgtgtgcccagcccctccttgcctggctacacacttggaagcagggcgccctcgcctgagcaaggtgcctgctgcacatcctacgcgcgcctctctgctgactcagctacacacccatgcctcgcgcgtccctgcaggctggatgcatcgctgcctgcgccgctccgcggcctggacattttggacgtcgggtgcggcggcggcatcctggcagagtcgctggccaagcgcggggcggcagtgctgggcatagacgtgaacgaggaggggctggcggcggctcgggcccatgcccaggccgacccccggctggccagcctctgcagctaccgcgcgacgacccttgaggacctggcggctgctgggaacaagtttgacgtcggtgaggctgctgcatccagggaggatgtccactcgaggaagggaggggtgtgcaggtgccttggtgacagggccggggttctgcggatgtgcacacatcgggctgatgcactgccctgtaactgctgcatcacatcccccactcgcccgcacatcccatccctcactgtctcccacgtcccccccatactccagtcattgccagcgaggtcatcgagcacgtgcgttccctgccgacctttgtgtccagcctggcagagtgcgcgcgccttcaggcccccgtcctggtcaccaccctga

SEQ ID NO: 7875 - DNA, 705 bp, Chlorella protothecoides
  modified_base (364)..(373): a, c, t, g, unknown or other
atgactgttggcaccctgatcggcgataagcatgggttgattcacatgttgggtgcggaccaatctgatgcacatatgtacgtgataatccgtgatcatcaccccacaatccgttgctcaccatgccaagtcaaccctcagatgcctggattgcgagaggagaaagaatctccaagctgtctggctacacccggcagctcgacggtgagcattgggggtgtttctgcagggctgcttgctttgatgcagactgtgggtcgtctctcctgcacactcatcattcctaaactccgtttaaagccaccctcccttccctccacagagctggaggggcaagtgaaggtgacccagacgaccgacatgnnnnnnnnnntctgcacactcatcattctttacctccttttgcaacccccctcccttccctccacagagctggagggccaagtgaaggtgacccagacgaccgacatggtggactttgctcgccggtttgggctggagatgctggtccgccccgagtcggtgaagaaggaggaggacgagctgctgcacggccgcacgcgcgccacagtggacgaggtgtgccctgactgcggggcgcagggcatggagttctacacgctgcagctgcgctccgcagacgagggccagaccgtgttctacgagtgcacggaatgcggccacaagcatagcacaaataactag

SEQ ID NO: 7876 - DNA, 1638 bp, Chlorella protothecoides
  modified_base (294)..(303): a, c, t, g, unknown or other
  modified_base (407)..(416): a, c, t, g, unknown or other
  modified_base (680)..(689): a, c, t, g, unknown or other
atgttccaaccccgcctccaacaccaaggttccaggccctccctccccaaacctccaacggcacagggcctgcccgagggagggctgcgacgcatcatcctaacggcatctggcggtgccttccgcgacctccccgtctcggagctgcccaaggtgacggtggccgatgcccttaagcaccctaactgggccatgggcaagaagatcaccatcgactccggagttcaagcaacaggagctgggtgctgccctgtggttcagtgtgacgcatgtgcattttctcgtatctttttnnnnnnnnnnggagttcaagcaacaggagctgggtgctgcactctggctcactgtgatgcatgtgcattttcgcatatcgtttcccacgctgatgaacaagggactggagagtnnnnnnnnnnactggaggtgatcgaggcgcactaccttttcggcgcgtcctacgacaacatcgacatcgtcatccacccccagagcatcgtgcacagcatgatcgagacccaggactcctcggtgctggctcagctgggctggcctgacatgcggctccccatcctctacaccatgtcctggccggagcgagtgccctgctccgaggtcacctggccacgcctggactttgtcaaggccgggaacctgaccttcaggtctgcctgtggtgacgnnnnnnnnnngctgggtccatctgcctgttggacccttgcgatccctgcaggagcgctaccttgcgatgctcagtccctaagctgccctgtggtaacattcctcaggatcttggcttacccctgcgagcccaagctcgcctcgccccgcagacccctctttcccattcctattcatatacacaggcaacccgaccatgccaagtaccccgccatggagctggcctactcagcggggcgggcgggcggcaccatgacgggagtgatgtccgccgcgaatgaggcggccgtcgagctgttcctggaggaggccattgggtacctggacatcgtgccagtggtggaggcagcgtgtgaagcacacagcactgctgatggccggattgcttctgccacaccacatctgcttgaatgggagcctgatgccccctcttcacattttcacagggtggagctggtggagcgacccagtctggaggagatcgtgcattacgaccagtgggcccgccggcatgtgcgagagtcggtcgccaagcgtgctcctgccgccgtgcctgccctctagatctttccagccagagcgaggagattgtacggctcgaatgtgaatcaagtcgtgcctgtccctacatcccttcccagttccccctcagtacaccactgggtcacccaaaggttcctggaagatgtgaggcatgcgtgcgagttagcaccctcgcctgccaccacagatcggacgggagctcgagtgccgatctcgatcgaggtgagctccgtgcgggtggcagcggtcgatcggatgccggaaggtcagacccctgccagggctcggtccactcaaagccctcatttcctgccatcccaccagccccacccgcgcccctgcacaggtgcattcggttgggtgcagcacgcccgcaaccgcttcacaggtgggagatctgcagggcgggctgtgtag

SEQ ID NO: 7877 - DNA, 1632 bp, Chlorella protothecoides
atgggccagcctgcatgcgaggagggaaacaccctgctccaggcccttcaagcggagcgaaacaggctccatagggcggtgtgcaagctcaaagagtccaatgcggagctgaaagcagagctcgacaaggaatttgaccgcgactacaaggaggccatccaggacaacatccctgtcatcgcaaaatacacggcccgtgtcgcatccctggatgaagagatcgccgaactccaggcagggaggcaacgaatatctggaccggaggtactggtgtcgacgaggaatgataccaccgagactggcaggcaggaggctcctgagcagcaggcctatgaactaccatgtgttgcaaaaggcaatgcacagctccagtgttccattgagcgggctgctacttttcaacatccagagtggcctcaggaatacaaaatcgccttgactggtctcacaggctgttcatctgtatccgcagtgaggggagctctgatatcaggagtggcctcgggaatgcaaaatcgccttgactggtctcagaggctgttcatctgtatccgcagtgagaggaggtctgatatcagggttcagaattccattgcagggagtaaaagagggggcacttcatgtaccccttccacccgcaaaccccatgattcgtttcatgtctccgtgagaccagcccccctcagatatccatgccgggttaccgcgcaaggcttcatcattgatccacagatacgcgtttaccaccactcacgggtagaattcgaatacgttggtggttgcgggcatccagccacagcagcttgcttccggggtgcagctcgccatgcgctgctcagcacagttcaacacccgggggccgaccctccccaactctgcgcggccgcgaacgtgcagggttgtgagtgcatcagctgcaccagtgccctctgcctggccaggccgtgtcgtcttgccggagaaatccgcctccaggaccggacccaaggcacgtccgatccgtcccgcattgcagcacggaccctggtgcattcgcctgtgttgcagcgcgacctcacggcgtcgacccccagtcaacccagctccgcggggcaccatgatacccgcactcaccagcctcgcaccaccccatcccctgcacccagaaattctcgctcctgggctccaccggctccatcggcacccagaccctggacatcgtggccgagcaccccgaccgcttccagtggaggggcgcgggcactggaggcggcgctggacgccgccggggtcgaccgtcggcccgagattcagatcggcgcggcggggatcgacgcggtggcggcccacccggaagcggacgcctgcgtgacgggcatcgtgggctgcgcgggcttgcgcccgaccatggccgccatcgaggccgggaaggacatctgcctggccaacaaggaaaccctgattgcgggggggccgacggtgctgccagccgcggccaagcacggcgtcagcatcctgcccgccgactccgagcactctgctatcttccagtgtcttcaggtgggagggggagtggacggggtgggtgggaggatgggtggagcggaggagtccagggaggcatgcctgttgctgagtttgagcttgggatga

SEQ ID NO: 7878 - DNA, 3096 bp, Chlorella protothecoides
  modified_base (72)..(81): a, c, t, g, unknown or other
  modified_base (1559)..(1568): a, c, t, g, unknown or other
  modified_base (2535)..(2544): a, c, t, g, unknown or other
atgcatggaatcccaacatccacacgcccatgcctgtcacctcgcacccacaagctcttggcagttccatgnnnnnnnnnnccgcgccccaggtgtgcgctgagggtggatgcatggaatctcaacatccacatgcccatgcctgtcacttcgcacccacaagctcttggcagttccatgggtgacctgattcgtcgatccagatactctgtcccatcccctgacagcagccagtgctgctcctcattccccctagattacatacagccagtgctgggacatgactgcactggagggtcccctgcccaccaaaggttccctgcgcgaaaggctgctgccctgcccgccggctgtccgccatgcgtcccaccgagcaccgtctcccatcacgaacacgccgtgcatccgtcacccacgccgccgcgcggccgacagctccttggtcagctgcacaaaggcgcccacgctggcctccggcgtgccctcgatcacgccatgccccaggttcatgatgtgccgctccggccccgcctcctccaggcacgccgccaccccggcgcgcacgtcggcttcgctgccgaagagcagcatggggtccacgttgccctgcaccacgacgtcggcgcccagcgccgcgcgcgcgtcgcgcatgggctggtgccagtccacgccgaccgcggcggcgggcagcgcgcccagcgcggccagcttccccgcgcagccgttggtgtgcagcatgaccggcacgccggggcaggaggcggccaggcggcgcaggacccgctcagtctgcgcagcgccgtgggcggcgtgctgcgcgggggtcaggtggtgcgcccaggagtcgaagagctggagcacctgcgcccccgaggccacctggtactccaggtgcgccgcgatggcgtcggccagcctgtccatgaggcaggcgagcagggccgggtcgcgcagcatcatggtcttggtcgcacggcagttgcggtccgcgcgaccctccacgcagctggccgcggggtcctccaacgggcgcagcgcggccacggccgaggcgtcgcgcaggggggcggcgatgagtggaccgcggcccttgatcacctggaactccacgccgatggcggggaggagggtgaggatgtcggagaacatgattacgccgtcggggtgaaaggcgtgccagggctgcaggctcagctccgtggcgatgtcggcgttctcggaccgctccctgaaagtatacttgtcggagaacctgccgaaagggaggggggaggaggggggaggtcatgggggtgtgggcagaggaattgggatgagaggcagcgtgccgaggagcaggtggttctgagagcaactctgtgcacacgccagccagtccctgcagaggggtccacatccccaagcacattccgcgcccctaccactcacttccgaaaggcggccatgtaccgccccgcctgccgcatcagccagaccggggatctcgcacggaggccgcatcatgatacacatttaggccaagaaatgtcccaccctgccaagctacgcactttctcctnnnnnnnnnngcaggggctggcacgtcacctgaattatgtctctcaaccttgggggcatcctaggatcttgcacggaggccgcatcatgatacacattaaggccaagaaatgccccaccctgccaagctacgcactttctcctctggcgacacgaagcagtagggggtccttggtcgcctggctggcgcctgggtgcgcctgttggggcgccgcgacgcttgagaccgtgcttggtctacatctcgaaaccggattggagggtgtcacgctctcggaggttgcgcctggcgagggtgaccaatgccgtcgacagggaggccaggatgtcacgtcatgcactcttggggagaaatcagctgtctgtcagaagtttctaacaatggctagcattgacagccgcgtttggctttgtgacgctgcagaaagatttcggaagatttcgcgttccattaccaaaagcatgaaccaatcaagcatactgggctcaaagcaagcagttgtaactgtagatccccaaacctccagcgaatcccagcatggcctcgaggatggcatgccgcaccggcccagtgtcccaggtggcgtggagcactgcgcgatcccgggtgccgagggtgctcccgaggaccacgagatcaacgcgctgcagacccatgcgacagagcgccgcagtgtccgcgctctacggcgctgtctggaacacccccaccgacgcctacttgacgctggtggggcaggggattgcatgtgttttggagaagcagtgatggcatggagctcaggagcagatgccttaacacacaatgctcacacacgcactccattgtccccccagggtctggcacactgtttcgagaagacagacgatggcaagctggtggatcggtacatcattgaacccctgtcggcaaattccctggagtgcatggcaaacggtgcggacctggagtgacgctgctcgatcatggtgcctccnnnnnnnnnngacgtcgggatacatgatccaccccaggacgctgctcgatcatggtgcctcccgaccgcctttccacctattctcgcgactgacctcctccaaccccacctcccacctccatttacctccccaggcggcaagacctgctacaagcacgtattcagcacaaccctggagcaggcccagtcccgggacaaggcagccctgcccgccgagttcgccgaggcccgcttctgcgaggagtacgagacgcgctgcgactccgcggcccgcacctggctgcgcccccacgcactggacaacctgctgggcattgtgcctctgggccaggtgaagagcaacttccagtacagcgtggtggacaagcgggtgctgaactttgagaatgtggtggatgacgatgacaacatcaagcaggacctgagcatcgacgtgtacgggcgcaaggctgcggacgaggcggccgccgcgctggctgcggacggggcgagtcccgttgcggggggcgccgcggaggtggccgaggaggaagaggatgacatcgacgccttgctggcataa

SEQ ID NO: 7879 - DNA, 3897 bp, Chlorella protothecoides
  modified_base (723)..(732): a, c, t, g, unknown or other
  modified_base (1270)..(1279): a, c, t, g, unknown or other
atgcccaggagggccagcagggtcaggcagaaccccatgcgccgcctgcaggtgggtgagcgtcatgacatggggatggagacgaaggtgaggaccgagtcaaaggccaaggtttgccagcggtgctcctggtcggtggccagccacagcgacgcacgtgcacactcgcgcacgccagcacacacccagagcacccaccaccggtcgcacttgcggtggatggctgtcgcggcgaggttggaggccttcacccccaccaggctccggtccagtgccgtctccgtggcgtccagcagcgagccgcgctccctcacccgcccctccatggccagcgtgttggacttgagcgaggcggccagcaccgccagctcgtcggtcagcgcgtcctggagctgggcctgggagtctagaccccggtcatcattggcatcggggccagggccgtcgcggcggcgcaggcccaggcccgtgcgcggggaggggggcgcggccggatccgcctgctcggcaggctgtgtatcctctgaaatgaaagggtccgggccctggaaggtggccgggactgcgggctcctgcagggaggcccgcagcgcagccaccgcacccctgtacgcccgcagcacctccggttccagcctgcgcaggggtttctcctcccctcgggcggagccccgactcaggtatgcaactcagcgcgagacacacttggcggtacttgccttnnnnnnnnnngcctacaatgcattggcatgtataacagttcctcctcccctcaggcggagccccgactcagccaggcaactcatcgcgagacacacttggcggtacttgcctcgagccagagactttctgcagctcgaccagctgctcctcgagcgttgcaatgtactgaggaaggcaaaggctaccctcataacacccagctcacgtggtgaaagagaggcgacaccggccaatgggcaaactcaggctgtgacctgtcgctgccctgcacaacagcttcgcactcctccagcagccggcggaaggagacctcaaggaaggtgccggtccgaggcgagggcagggtggccgtggacatggcgcctgtggcgatcaggtggtcaagcacggcatttcctggtgagtctgacgccaacgccgtcctctcacggggagctcccccttcgcactatactagagctctgcatggagcccaccgtcttcctctgccagcagtgcaagacccggatcctcatctcggcttccgatgcggagcctccgctgccannnnnnnnnngctctgcatggagcccaccgtcttcctctgtcagcagtgcaagactcggatcctcatctcggcctccgatgcggagcctccgctgccgggccccggcgaagtgccctctgcgctggaggagtcgttcatgcagctggaggacactctgtatgggccacggggcgagtccagcccacgtgagtgggattggcggcagtgacgggcattcaggaccgcacctgggagcgtggtgcaccttcaaggctcggtcccacacacgtttcttggattggtttgtcccatgtggtcctccatcgaatggcatcccccaaccctcaccccaatcccaattccccgaagcagatcctcctgcacggcgcatggaggagtccttcgtggtgctgccctccggcaccgcgcgcggccccccagctccgcccgcgccccgcgtgcccttccacgccacgctgcgcgcgctgaccaacgtcctggaggccgccagcgccgccacgggcgtggaccaccccgtctgcaccgactgcgccgcggacgtgcaccgggagctggacgcccagaccgcggacctgcaggccgacctggcggcgctggaggtggcgctgggcaggctggagggcgcgccccctgacaccccggaccccgccgcccaggacgcagagctggccgctgctagacgggccgtcgaggagggcaggtgggggggctttgggggactcttctgggtgcagggtgggccacgaacgagggggggcgtatggattttggtccatgggtggtgtcctgcccttctggcgcagcgcgcatggtccctctctctccttttcccttggttcactaagacacacagccatgcaaaccttcttgaactccccctcccccaccccacacactcacaacatcacagagcccgcctgggcgaggcggaggcggcggccgcggcggctgaggcggaggtggccgcgctggaggccgccgccgccgacctgtcggccgcggagacggcatactggcacgagtttaacgcgcaccaaggggcgctggcggcgcacgtagcagagcgtgatgcggtggccgcgcggctgcaggccggcagtgccgcgctgggcacgctgcgccgcgccaacgtgctgaacgacgccttccgcatctggttctcggggccctttggcaccatcgggggcctgcgcctgggccgcaccccggcctgccccgtgccctgggaggaggtgaacgcggcctggggtgccgccgtggccctgcttttcatcctggcgcggctggcaggggcgcagctgagcgccgcgcgcctgctgcccatgggctcctacccgcgcgtcgccgacgcgcgcggcacgcacgagctctatggccccgtgtccaagctgctctgccccagctacgacaaggcccaggggctcaaagcatgtatgtccctagattgtgtgagcccagcgttaccctgctgcatgacatgcgttgcatcatgggagagggaatgctctgcagcggtgcggcagatgcttactgggcgccggctaaaggggatttgccttgcaacgttgctgagtgagcagcagaactctgctggagagtctgcgtggggctggctgactgctgtcacacgatgtacgccttgcaaggccccacctggcacaggtattgatccccccccccctgaactcacaagcatctcacccaccctcccctgcaccgcaggagtatgcggagtggctggcggcccggggggccagcccagggttcagcctgccctgggcaatcgagggggaccgggtggggtcgcagtccatccgctacatgctggccaaggacaagaactggaccaaggcgctgaagtacatgctggtggacctgaagttctgcctcaaggccacggtcgcgctggacaacgggcgcgcggtgggcgcggcgccgccctccgcccagcgcgaggacccggactggagccgggccaggggatgacaggcggcagcggtgagtttgaagaaaagtggggggggggcgcggtggagctgctacatgcaggccagttgcggctggagacgaagatggcagggttccttggggtgccagcgagcatcacagactgcccatggacctctgtggcccggagcaagcgtagtcagcgctgcgtctggctaccctggcacgctgtgtacaaccatgcagtggcacggcggcagtctgcatgcccggtcaagctcaacttccagtgtccacaggcatgctgggggatatcatcagtcaagttgaggctgacactttggatgagttggcctcacagcatgagcctgcctggctcttcgtcgtcatggcctcccctggcagtccccccagggccgtcctcatgtccgccacaaactggcctatggcggtcagctgggcgtcttgcccctgcaactcactcggatgccccagcctgctccgactcaacaccctgctgtacatgtctgccacggccacttgcccctgtaaaggtttgcaggcgatgcgctcttgtcacattggcaccgaaaggctcagagccggagatgtacagatcatattggtcggatatggacctccctatgtgccagatccaactacacagcctcagcgcctaa

SEQ ID NO: 7880 - DNA, 318 bp, Chlorella protothecoides
atggtcgtactcccatctcggtccggtattgatctgggttcggagcgactccgtcaccggttcaccatcggctgggccttgatgacagacatcttcgtgtatggcaccctgcagtatcccgaggtcctccgagcactgatcggccgagtaccggacctcacgccagccacgctgactgggtatcggcgctactgtgtctcccagcaagtcttcccagcgatcatcccaggggaagctgacgactcggtgagtggacccagaataggttcaatggttcctggtcgtgatgtcaggagagagtctgccaaacaaggatga

SEQ ID NO: 7881 - DNA, 936 bp, Chlorella protothecoides
atgcctgctcccacttccatcacccagcccgtcaacagccaccccaccccctttccccctcccccagaccgccgcttcttcgaggggtggtactggcgcctgaccctgcccggccgcggccagagctttgccgtcatctactcggtggaggaccccggctcccagcgccccaccagcggcgtgggcgcccagatcatgggcccaaacgacagctacctgctgcagtacgaggagggcaccgccggcttctgggcggacccgcatgagctggcgctgggcaaggtcttcgccgccagccccggctgcgcccccgcggccgcgccctgccccccggagcgcttcgaggccctcgtctccgagggcttccaggtgcagggagggcggcaccaggggcgcatcgtgtcacgggaggccggggtcgtccccggccccgcccccagcgttgcctccgcgcgctgggacttccaggtcacccccaggctgggctggggcagccccgggcagcgccagctctccaccgccggctggctggccgcggtgcccatcttcgagccgcactggcaggggctcatggcgcacggctccgcctcgggctggatcgagtggggaggggagaggtacgccttccagggcgtgcccacctacgcgggtgagcgcctcggcatcgggagggttgctggtggaggggcgggctggtgttgcccccaagaggttgaagttgggtggcggtctcgcatggcacgccccggagcagggtgccgttgtattgagtcaatgagtgtgcagtcatcagtctgctgctctcttccccggcccctatcgcgtgccctccaacacccaatcccacgcacgaccccttgctccccacccgccagagaagaactgggggggcggcttccccagccgctggtgctgggtgcagtgcaacagctttga

SEQ ID NO: 7882 - DNA, 324 bp, Chlorella protothecoides
atgagggtcaagctctccaggcaaagggttcggcgtgccgggcaagatcacttcctgggcgtcagtgcccgcttcagcgggggcatcatcgcaagggaggaggacgaaggagatggaaatgccgtgcttgaccacctgatcgccacaggcgccatgtccacggccaccctgccctcgcctcggaccggcaccttccttgaggtctccttccgccggctgctggaggagtgcgaagctgttgtgcagggcagcgacaggtcacagcctgagtttgcccattggccggtgtcgcctctctttcaccacgtgagctgggtgttatga

SEQ ID NO: 7883 - DNA, 843 bp, Chlorella protothecoides
atgttctccgacatcctcaccctcctccccgccatcggcgtggagttccaggtgatcaagggccgcggtccactcatcgccgcccccctgcgcgacgcctcggccgtggccgcgctgcgcccgttggaggaccccgcggccagcctgcccttcgtgggcgagacgctgcgcaacctacgcgccgaggtgggcgacggcgccgcggtgctgggcttcgcgcccacgccctggaccctggcagcctactgcgtggagggtcgcgcggaccgcaactgccgtgcgaccaagaccatgatgctgcgcgacccggccctgctcgcctgcctcatggacaggctggccgacgccatcgcggcgcacctggagtaccaggtggcctcgggggcgcaggtgctccagctcttcgactcctgggcgcaccacctgacccccgcgcagcacgccgcccacggcgctgcgcagactgagcgggtcctgcgccgcctggccgcctcctgccccggcgtgccggtcatgctgcacaccaacggctgcgcggggaagctggccgcgctgggcgcgctgcccgccgccgcggtcggcgtggactggcaccagcccatgcgcgacgcgcgcgcggcgctgggcgccgacgtcgtggtgcagggcaacgtggaccccatgctgctcttcggcagcgaagccgacgtgcgcgccggggtggcggcgtgcctggaggaggcggggccggagcggcacatcatgaacctggggcatggcgtgatcgagggcacgccggaggccagcgtgggcgcctttgtgcagctgaccaaggagctgtcggccgcgcggcggcgtgggtga

SEQ ID NO: 7884 - DNA, 894 bp, Chlorella protothecoides
atgagcggcatgcaccaggctgtttggctggccccaccgtctgctccaggtgcccacactccacacaccgtgggcatgggtccccccccacgccgccccacaggcgcccggcgcggggtccgcctcgtgccggggctggaggaggacgtgggcctgatcgggctgcacgcggccggcgacttccacgagttcgtgcccaacaagggcgacatcgggtgggaggtggagccgtggggcacatggcgcatccacggcgagaacgcggagcacacggcgctggtggaggccacctgcccccctgaggtgggcaccgtgctgcgggcccccaccgccgacctgggactggcgcccttctgccgcgacagcttctcgggcagggtgaggcgcttgcgatcgagagggtggggggagggggcctgctggcccgggcttggcgatcgtgcccaaagcgtcctcccccgaggggccagagcggccactccggccactcaccgggttccaaacaccatcccaggtgcgcgtcaggatgtggcggcgcggggaggaggggcgcgcgccgccggtggtagactgcgtgagcctggaggagacgggggcggtggaggtggggggcgggccctggtggagcgggtggaaggcccgggcggccatggcggggggggtcaaggcgctgctcaacctccccgtggacgtggaggggctgacgggctggctcccgggaggcctccgccccaagggactctagggtctgtgtcgcgaggcagtcagagactcctccctcgaggtagtcccgctggctcgaatggaaaggtcctcattgtcagcacccgaggtctgcctgattcacatgggaggcacctcacagccaagccgaggtctgccgtacctcggtga

SEQ ID NO: 7885 - DNA, 555 bp, Chlorella protothecoides
atggctgccatcgtgggggcagagtacgttctgcgctgggtgcccaagggtgaggcgctgagagggtgggaggggaagaatgttttggtggatgtcggcagggcaaggtgggggcttggatgtgctggctggcgtgttcaccgctgctcctgcttcggagtacgccgactcaccccctccctgtggcaggatgcatgcttcagcaccttgcctcccatccaacgtgtgtgtgcacggtatcacagcgaccatggctctgtgcctggtcaccctcgtccactcaagttcttccctcccaccacccaccacccctcccactccacaggcacccaccactggagcaagttcctgacccccacggagctcacccagctgttcagagcacacacccctttccacctctggcagctggccggcatggagttcaacccggtcaccggcacctggtccctgggcaccaacacctccatcaactacgctgcctgcttcacgagggcggcggcgaacgcaccactggccgaggagccggcggagtacccaccccccgaacagtga

SEQ ID NO: 7886 - DNA, 228 bp, Chlorella protothecoides
atggatgaatttgagtcggaggagtatgtgaaaaccgcgggggctgtactcaatgcagagacggaccgcctcgagtcggtgctctactatgtctggcacccttccctggagagccaactggagcggcgggcctggagccccgaggctttccgggagcagcacctccaggcatacaccaagatgtgcatcgagtttgcagccgaactcaggtcccgagcgcagtggtag

SEQ ID NO: 7887 - DNA, 366 bp, Chlorella protothecoides
atggagtttgttgggggcggcaacctgcagcagtatgtggaacgggccggcacgcttcccgagtggctcgcgcgctgcttcttccagcagctcatcctggcgctcaactactgccaccagcacctgaacatcgcgcaccgcgacatcaagctgggcaacatcctgctgaacaccaagtaccagatacccatcctcaaaatctgcgactttggctactctaagaacatcgtgacggggtcggtgcccaagacgcgcgtcggcaccgccgcctacatcagccccgaggtggccaagagccacggcgtcacagcttatgacacaggtatgggggttaggatgggtaaatgtgacgatgcgggaaggtga

SEQ ID NO: 7888 - DNA, 339 bp, Chlorella protothecoides
atggccgcgctgcccccggtctcgcccgagtgcctggccctgctgcaccgaatactggtcatcgacagcggggcgcgtgcctccttctccgacatcatggccgacccctggttccgccttttcctgcccaacctgggggagatgggttcggcggtggcggaggaggtgcagagcgaggcggaggtgctggagcggctggcagaggcggcggtgcactcggacgagcgcgcgcgggaggaggcgctgagcgacgaggccatcgcgcggggcatcgaggacgtgttcctggaggtggacccctcccaggccctgtccatggaccttagcttccagcgatag

SEQ ID NO: 7889 - DNA, 618 bp, Chlorella protothecoides
atgcattgtaggcctggtgaactgctaggacaccccctgcgcaggctggaaccggaggtgctgcgggcgtacaggggtgcggtggctgcgctgcgggcctccctgcaggagcccgcagtcccggccaccttccagggcccggaccctttcatttcagaggatacacagcctgccgagcaggcggatccggccgcgcccccctccccgcgcacgggcctgggcctgcgccgccgcgacggccctggccccgatgccaatgatgaccggggtctagactcccaggcccagctccaggacgcgctgaccgacgagctggcggtgctggccgcctcgctcaagtccaacacgctggccatggaggggcgggtgagggagcgcggctcgctgctggacgccacggagacggcactggaccggagcctggtgggggtgaaggcctccaacctcgccgcgacagccatccaccgcaagtgcgaccggtggtgggtgctctgggtgtgtgctggcgtgcgcgagtgtgcacgtgcgtcgctgtggctggccaccgaccaggagcaccgctggcaaaccttggcctttgactcggtcctcaccttcgtctccatccccatgtcatga

SEQ ID NO: 7890 - DNA, 222 bp, Chlorella protothecoides
atggcccagcagcacggctgcggagtgcaggccgagtcggatgtgacgctggtgtacagcgccgacggcacctccctgggcgaggcctttgtgcacttctcgggcccgcaggcgcggctcaggctgggcctctcccgcgacgccacagtcatgcccgtgcgtgggatgtcggagagggtaggctgtcgcatgtgcatgtcgcggcaccaagaagtgccttga

SEQ ID NO: 7891 - DNA, 366 bp, Chlorella protothecoides
atgattgaggtcggctcgcggaaagcgttggagtcggagccgttccggctgcgccaggcgctggccgaggtcaacgccgcgcttgcacagcagcggcgggacaacgatgcacaggagcgcatgctgcgagctcgggaggacgccatgaagaccaaggacctggagctgcaggcatcgatacttagatttgcacagttcctgcagcaaaatgagggtaagaggagtcgtgctgctcgccgtgttcaggaagagacttcggccgaggaagcggccagggtccgggcggaaaccctagccgccgaactcagggacgcacattccgcggtggagacgctgcgcaaggagctggcgaagattcagaggtga

SEQ ID NO: 7892 - DNA, 660 bp, Chlorella protothecoides
  modified_base (407)..(503): a, c, t, g, unknown or other
atgcgcgaggacttcatcgtggcccacctggcggagccgtgcagctcctgccgcggctacatctctggggacgtgcgtctggtgcacccctccccccccgcgcgcgtcacggtgcgcgcggagcgcacctttgacggcatcgcgctggaccgccccggcggcgaggccagccgcacccagaccctcacccgcttccagctctgccccgcctgctacagcgcggcggccgccggcgccggtgccgggtcgggggcgctggccgcgccgcgtgcccccgacccctccgccccgccctgcctgccgggcctgcccgcgggcatcgagctgggcgcgctgcggcccctgccctgcgccctcatcccgcccaccgccgacggcgcgccggagatggagaacgagttcttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctgtgccagggcaaccactaccagttcgactccctgcgccgcaccaagcacagctccatgatggtcctgtaccacctccacaaccccacggtgggtggctggggctgggttctgtttctggtggaaaggggggcagggaggaggggggatggggg

SEQ ID NO: 7893 - DNA, 1695 bp, Chlorella protothecoides
  modified_base (1596)..(1605): a, c, t, g, unknown or other
atggccccacctggggatcaggacccatctggcgtaaaaatactgagccagactgtgttcttaaatgtgtcgacagtcaagcaggcctgctccgggtgcggcgcaggaggaatgtgctctcattctagcatccggagaaggaaccatgtttcacagcttgccactgccctgtgcaggtggtcggagatcggcctggaggttcccatcagcacagctgccctgctctttcagacagctggactggcggtgacctgcgtgttggtgaacggcgtggaggttcaactcagtcccactggactggcggtgacctgcgttttggtgaacggcgtggaggtccaactcagtcccagtaaagcaggcgccgactcacctttgcctttggaggctccctcactggagactgtcactgctgcacacatccgccacttcaaagacgacctttctggtcatgtggcgtctgttcccatgcccagtgtactggacgcccctctgcagcatgcacacgtgaccgtggcgttccgcttcagtctacggaatgactatggcaccatgctctgccatggcggcgctggcgcaggccctgcacaggtgcgccttgaggcaacctggcgtctctggtcccgccatgttgatgtctgcaagcttgctttgatgggtccctggccgcggcctctgtttccagaactgctcagcgacgggcgggatgtgattgtggcccagacaccgctccgcttattcctggtggtgccggaaggccatgtggccgtagcctccggcaagatgctggagtgtcgagcgcatggcagcagtcagcggaggtacgagtacctcgtggcgcagcctgccacgccgagcatagccgcgggcgcactccatggccgctggcatcgggcgcctgccaagccaggcgacccctgcatcgtgctgcatgctccacagtcggctgtggagtgcctcgaagccaccgcggcattcctggggctgctaaacgattgctattctgacaagctcttggtgccactgccactggaggagtacacccaggggcgtgtgcatcaggtgcatgctgttgctcatctggtctcatcccctccccaccccctgacctcacacaaggtgtttgtgcccccgggtgtgctcacccgaccgcacatcacccctggctgggctgtgcaccctacaacctgcctggtcaccaggggctgcgatgagggggccaccggcacgcgcttggagcttgccgctgcattcgcaaagcaggtgtttgggctggccctgcgcccagctagcccagctgatgcctggctggtgacggggctggcagcctggctggtggaccagttcatccgcgagtacctggggcgcaatgagctgcagtatcggaaatggaaagcttcagctgcagtgtgcaccgctgatgacggcagtcttccacccctggcgtcccagttgcctggtggtgccgcgacggctgctcagctgctggcgggcgcattccccctttcagaggtcatggaactcaaggtatgcttggatgcaaggggaaaagggatgaggggagacccgtgcagctctcagatttggggctctggaaannnnnnnnnngtcatggaactcaaggtatgcttggatgcacgggggaaaggggttgaggggagactcgtgcagctctcagattcggcgctctggaagtga

SEQ ID NO: 7894 - DNA, 1029 bp, Chlorella protothecoides
atgcatacgaaggacatacaggcagactgcaagatctgccctttgcgcctgccccagaaaccgcaagatgccacaggcaaagatgctctcgtcctctctaccttgaaggctgccgcggtagtgcgcctgttggagcggcgggcgggcgaggatctattccgcaagcatgtccaaacctcagtggctgcagctctctccgaagcatccacgcaagcagcggagactggcgccggtgcaccctctcagacttctgctactccgccctcacgaacactggacgccacacagtttgtgacggagctgggaaggctggccggctttcgtaaggacgtccctgccttcttcgcacgctgggtcttgggctctggcaccccgcgtatcaccgccggctttgtctaccacgcgggcccgcagcgacgcagcgtcctcgagctggccttgcggcaggagggcgggacgcgcgctgcagcagcggccgctgccgcagcgactcgtgtctctgactcagcaggagcgggcgtgggaatactgcgtgtaagcgtgcaggaggcagaggtcgcggttgagcaccctgtgcacctgggcgccgagccatggaaacttgcggaactcaaggtgaacccggatgtgaagaaggtgcccggtcggcgaggagccaagcgacgcaaggtgcaagaggaagcgcaggatgagagcgcggctctcttgtctaccttggaaggagtggagaatcctttgcagccggtgcagtgggtgcgcatcgacccaggcggggaatggctgtgctcggtgtggctggagcagccgctccggtgctgggtcgcgcagctggcgcacagccgggatgtcgtggcccaggcagaagcagtggcggcactggcacagcatccgtctctggcggcagtcgcagccttggtacgctgcttcacagacgagggtgtgtaccatcgtgtccgcgctgacgccgcagtagcactggggcgccggacggaaggggcaggggtcccagaaggtgagcgatgcttataa

SEQ ID NO: 7895 - DNA, 852 bp, Chlorella protothecoides
  modified_base (344)..(353): a, c, t, g, unknown or other
  modified_base (501)..(510): a, c, t, g, unknown or other
cggtgggtcgccgctggcgccgctgcccacgggcgcctccccccgctccggcgcttcgtccggcgctccctttgggcgcgggtggcgcgcgccggcggccagccgcctggcccccaccccgcccctcctgcgcctggactcggaggtgtcggagctgtcgcgcaacgtgggcgcgggcgagtaccgcggcatcatgaatctgtgccgtgtgctgcgcgcgggcgccgacgccaaggaggccgtggacgccgccatcgacgcgtgcggggccatcggcgacctgcgcgccgacatcgcgcagtgccgggcctcttgcgccgctgcgacggacgggagcacgggcnnnnnnnnnngttaagatcccggggaggtgctgatcgtggttgctttagattgaaccagggagcacgggcttgtgcttccttgcgtctgcatggcctgcccctttcgtcaacaaacgggacgaagctgctgggacgcctgttgtcgaggtggcctcgnnnnnnnnnncctgcatggcccgcccctttcgtcaacaaacgggaagaagccgctgggacgcctgttgtcgaggtggcctcgtgccgtgcccttccttcctcctcatccccaacaacagttcctcttcccacacgatcaatcgcagacgagggcggggacgtggagcacacgcatgctgcggcctcggcggcgcgccggctgggcctgcactacctccagcgctacttcctgctcatcgcctacatgggctacatggaggccgttgccccgccccgcgacgtctcctttgcgcagtggatgggggagcggcgggagcaaaagtacctgctggccaccctggagctcgagtga

SEQ ID NO: 7896 - DNA, 1494 bp, Chlorella protothecoides
  modified_base (300)..(309): a, c, t, g, unknown or other
atggcattgcaggcctgtcacgtagcacgcaccccggccttcgggggcagggtggccaccctcgccacccgcagggtggccacagctgcaggccacggcacattcttcgttggaggaaactggaaagccaatgggagcactgcatcggtgaacacgctggtgaaggagctcaatgaagacatccattggttcccagcggatgaggttgcagggtgtgtggttggcttcgtggaccacctgatcagtgtccttgttacatgcaaccaactacctggtagcctggcctggcaccctggcacnnnnnnnnnncgggaaatccactcgactgcaggcatccattggttcccagcggatgagggtgctgggtgtgcggtgggcttcgtggtccacctgatcagtgtccttgttgcatgcaaccagccacctgcggggagcctgcccaagaatgtggaggtggtggtcgctcctcccttcatcttcctggatcaggtccagcagagtctgcaggccccattccagctggccgcccagaattgctggaaggggaagaacggggcctttactggggagatcactgcggagatgctggtggacaagaaggtgccctgggtgatcctcggccactctgagcgaaggtgcggcgccaggggaccgcggggcaaggccggttgtgctgaagggcggtaagtcttgcatgcatgcatgcatgcaaacatgtctcccttgcggaccccacagggcactcatgggcgactgcaacgaggtggttgccgagaaggtggcgtacgcgctgtccaagggcttgaaggtgatcgcctgcatcggagagacgctggaggagcgggagacggggcacatttgggacgtcctggagaaccaactgcggtgggtgtgacccgggaggtggggttgagggcgagtgctggagagcttggggttgtgagggggcgatgtgggttcaatgcgcgccaccacagtcctgtgcggtctcaaccctggcctctctctgtggctgtgtgtctgcgtgacgcggcgcgcctgtcaccgcggcactggcccatgcccacgcgagcactcacaaccccaaacatggccgataccaatgccatacagctggccacgtctcccctccacccatccccctctcccctcacttcacccctgggcaggcatattgcggatgcggtgacggactggggctcggtggtggtggcctacgagccggtgtgggccatcggcacgggcaaggtggcctcccccgagcaggcgcaggaggtgcacgccttcctgcgcaagtggctgcgggagaaggtgggcgcggacaccgccgctggggtgcgtgtaatctacggcggctccgtcaccgacgccaacgctgagacgctggcggggcaggaggatgtggacggcttcctggttgggggggcgtccctcaaggggccgtccttcgtcaccatctgcggcgcggcgactagcgtcgcgcagcccgcctga

SEQ ID NO: 7897 - DNA, 375 bp, Chlorella protothecoides
  modified_base (285)..(294): a, c, t, g, unknown or other
atgcctgaggagaagatcgagtacaaggtcgccgtgttcagctccagcgagtgggtcaccgactccttcacggagcccttttccgtcttctccaccgtcaactacttcccggcccgccttgagcccaagagcgccaagctcgctgcagggcacgatgctgtctgcatctttgtcaatgacgacgcgggcgcagaggtgagagggattggaggcagacagacctctggggccttgtgcacagcgggtgccgcgccgaagccacctgaggcatgcgcctcgatcatnnnnnnnnnntggcgcagaggtgagagggattggaggcatgcagacctctggggccttgtgcacatcgggtgccgcgcggaagccacctga

SEQ ID NO: 7898 - DNA, 651 bp, Chlorella protothecoides
  modified_base (28)..(37): a, c, t, g, unknown or other
  modified_base (614)..(623): a, c, t, g, unknown or other
atgtcactaaacttgcagggcttcgaannnnnnnnnngaccatccgctcagagtccatcaccatcccctgatcgtccaccctcccccgccgtgatgtcactaaacttgcagggcttcgaaggcaaggtcctggcctacgacccctacccctccgagaaggccaaggagctgggcgtgtcctacgtgcccctggagcagctcatgcgtgaggccgatgtggtcagcctgcacgtccccctgctgcccagcacccgccacatcatcggccccgccaacctcaagctgctcaagcccaccgccctggtcatcaacgtgtcgcgcggcgggctcattgacaccagcgccgccatcgcatcgctgaccgatgggaacctgggtgggctggcggtggatgtctacgagggcgaaggtgggtgtgacgtgggggaggacggaagggggggtaggtggtttgggccaaccgtctgtgccccgaggcatcaggaatgctcccccaccccttccattccatttttagaacgtatggacactcccttgccattggcatttccactcattacctctcccctccccaatcacccgttgcacccctcacagagtccctgttcttcaannnnnnnnnngcgtggggaaggagggaatggggtttag

SEQ ID NO: 7899 - DNA, 342 bp, Chlorella protothecoides
atgcgcgtgatagacgggtacactatggaggatgccgtcaatgtcatgcaggtatggtggaaggatcggctagactcccttgatgttgggcgggctgatgctttggcacttcaatgtgctgcagtccaggacaaatgggaacgtcttgcctgggtctcaggccatgcactctctcactgcatccttctccgacccacactctctcaggaagcacacatgaatgggctcgcactcgtgacggcatgcgctcaggaaactgcggaagagtactgtgagcagctgaggggagcggggctgattgctagtctggagccagatgggggaggcggcggatcatcctga

SEQ ID NO: 7900 - DNA, 1464 bp, Chlorella protothecoides
  modified_base (277)..(291): a, c, t, g, unknown or other
  modified_base (789)..(798): a, c, t, g, unknown or other
atgacttctggagacgtggagggtgatgggggggacgagagtggcgtgggctgccgccaaggagttcaagggcaaggacatcgagaagggcattgccgtgcccacctgcgtctccgtgaacaagtgggtaccccggtggtgtttgacgccgctcatgccgtgccttcctcatggctgaccgccagagggcgtgctttgaggagctgccttggcctggaggcccaacatgagtggcgagaaggggcaccatacccccacagacccgcccacccaggcnnnnnnnnnnnnnnnccctcccctcccccggcaccactccctcgcagctgcatcgggcacttctccccccccgccgacaacacggccaccctcaaggagggcgacgtggtgaagatcgacctgggggcgcacatcgacggcttcatcgcccaggccgcgcactcgctggtggcggtggatggccctgccaagggccgcgccgccgacgtggtggccgccgcacacgccgcctacgaggccgccagccgactggtgcgtgccggtcggcgcgccaaggaggtgggccccgtgctgagcaagatcgccgaggcctatggctgcaccctggtggagggcgtgctgtcccatgagatgaagcgcttcatcatcgacgccagcaaggcggtgctgccgcgcccgggtgccgaccaaaaggcgcggggggcgcgcgggggtggcggggccgcccgagcgagggccggagtccgtgacttcatgccgggcttccctctgtcctgtctgggcgcagcgcannnnnnnnnnccagcaaggcggtgctgccgcgcccgggtgtcgaccaaaaggcgcggggggggcacgggggtggcgggggggcccgggcgagggccggggtccgtgacttcatgccgggctcccctgtcctgcctgggcgcagcgcgcacccgcctgcctgcctcacctcccgtccccatctcatccacatgcaaagtacttcttgaatgccatccacaaatacttacacaaccccctaacccccatcttttgcaggccgacgactttgagatcgaggagggcgaggtgtacgcgatcgacatcgtgatgtccaccggcgagggcaagtccaaggtggtggatgagaaggagaccaccgtcttcaagcgcgctctggacgtccagtaccagctcaagatcaaggtgggcgcgatggagcagtggagcgtgaccgcccacacagtcggcctctccagcctaccatgccgtcagcattcacccttccccgctttccactctcaaacaagcgcaggcgtcccgcgaggtcctgtcggagatcaacaagaagttccccaccatgatgttctccagcagggggctcgaaagcacaaagaccaggcaggcatcgggggaatggtagtggagggggaagggaggggtccacctcgacaagggggacgagacacggtgcaataa

SEQ ID NO: 7901 - DNA, 960 bp, Chlorella protothecoides
  modified_base (45)..(54): a, c, t, g, unknown or other
  modified_base (564)..(573): a, c, t, g, unknown or other
atgcttgctaagcagggcatcaggccgccctgcacgtccacatcnnnnnnnnnngtgtggcgaatggttgctgagccgggcatcaggccgccctgcacgtccacatcgaatcaccctgcacaggattcaagctccaggagcatgatctggggcgtggggtgtccccttcggccgagctgtgattgcgagacccgcgacggtgggcgccccttcccactccgacaagcactcaccgttgacgatcttggccgcggctttgtacttggtcacgacatcggggttggaaatggactcattctcctgcacaggtggcgtatcgggtgtgtgagtggccacgctccgccacgccgattgaatggaccaaagggacctcctcggctgcgacaggctgccctcaatctgcccgagaggcgtcactactggggagatgttatgccacgtggttccagcttggacaacctcctgaaatctggcgtgagcgcgagagcatcatgccgtgctattgtcgaggctaggcatgggaaacctacgaaatgtatgcagatcgtgcagaataacaaacgnnnnnnnnnngatgccgtgctattgccgaggccaggcatgggaaacctacgagatatcataccgctgaggtcgcctgcgccatgtctctctggaccctgctccaggtgcgtaagaggtggtaggtgctgccgacatcacattgttccatatgaacacttgagcgtgtgtgttggcggtgaacgctgcggccatcctcaacaacgaccgcttcttggagcgacgcttgcattggacgaacgtaaaagtttgtgggacccacccctctctcgttccacagatggctggggtttctcacagctgggagggggcgcggcaggcacacacagcccaggagccctgaagcagcagatcatcggcgcgctgcacgccacccagtacctacgaggtgagctgtga

SEQ ID NO: 7902 - DNA, 948 bp, Chlorella protothecoides
atgctggcgctgctgacgggaatgctgctcatcctggtccccctctccatcaatgcggcccggcgcacgaatgtccagcggcagactggacacgctccacccccgcccccacccctggtggacgccgagggcgtgcccctgttcggagcgggtgacggcggcggagcgagcgaggacgggctggactgcgcaaccacgctggccgtgccctacgaggcctacgtcgccggcgcggaggccgccgatgcagccctcttcggcgcccccttgaacgacctgtcagctgagcgggcgaacacgaccctggcggccctgtcgcgctggacgctgcgcctcgccttcttcatgctggtggagccggggcagaacgcgaccgggctggccgcctttgccgcaggccaggcagcgctgctgaccgccgccttccgcggcgcgggcatcgccttctcccccgccacggcggtggccgtgccagtcgggcccggaggtgcgacgtgcggcgtggacgccgccggcgcgccgtcacccgccgctctcgatgcgctgggcgccgccgcgcccgtggatgtcatcaccgtcctggcctgcgacctggtcggcggcgtgcgcggtgccagcgccgtgctttccagtaacgcttcaaagatcccggcgctggtgctgctgcaccgagcggcgcttgtctccagcgagacagcgctgatccaccagattgggcacctgctgggcctgccccaccccttcccggaggtcgccacctgcaagcgggacggcgactgtatagccgacacgccgctgcagcacgccgccaacacggggtgccccgacccctccacctccgacatgaacctgtgtccggggaccgacggcgcagtgcccatctacaacttcatggacctcaccgacgacgcctgcaggtgcatttgcggggggggaggggggccctaa

SEQ ID NO: 7903 - DNA, 264 bp, Chlorella protothecoides
atgcatgctgttgcagccctggtgccgaaccgctcccagccaccatcacccacacgactcccccctcatccccacctgcagttcaagggcacggtgctgttggtgccctcgggcgtcgaccgcatcaccaacagcaccctgcaagccctggagagcgacaagagcatcgaggacgcagaagtgaaggcgctactggcgacctctctcaagaccaagaagaagaagaagagcaagggcgaggcacccaaggctgtggaggcttga

SEQ ID NO: 7904 - DNA, 570 bp, Chlorella protothecoides
  modified_base (379)..(388): a, c, t, g, unknown or other
atgttggtcaagggtgagggtgccgcgttcacggcagagatggacgctgcgctgcggcctcggcgagcgctggtgcacgttttgcgtggaggtcgatcagaggggccccaagcccagctgtcctttgcccacccccctcccagctacgactggatggacagcgacaccatcatcgccgccctgatccccgaggaccatcccacgctccccgtcaagcccgccaccgtcggcgggcccaagattgaggacaacagcagcggcaagaagtcacaggcccgcacctacccggatctcctggccagtccccacgatgaagcggtgtttgaccacctgggcacctcccagctcgtgtctgtcaaggtgcggagcgtggtgcctnnnnnnnnnncctgctggccagtccctacgatgaggcgctgtttgaccacttgggcacctcccagctggtgtctgtcaaggtgcggagcgtggtgcctgatcgggattctgatgatgtcatcatgtcgtgtgcgggcaaggtgcaggcgggttgagctgcaccctcgtagtcttccacgggagcaggcttag

SEQ ID NO: 7905 - DNA, 963 bp, Chlorella protothecoides
  modified_base (256)..(265): a, c, t, g, unknown or other
atgcaggacggcggggatcctgcagtggctgccgagcctcgcgacattgtctacacgctggaggcgggcgacctggaagcagaggccaggccgctggtgtctaccaacctgcgctgcgggggaattgtctggggggacgatgacctggcgctggtaggctcatttgggtggcatgatattgttcgacgctctatggaggggttgggccaccagatcgcgcctgtttgtggtcggactgtctggcatggcatggctnnnnnnnnnngtgcggaggggtggggcctccagatcgcgcctctgtacgagtctgagtggaaatcgcggcgcagcatcgtgtcgaccttcagtccggggagcgggggggcggcgccccaggtcctctttgaccgcaactacgaggatgcctacacaggcaaggcccctgggtgcacagggtgggtatcgtcctggcagaccactcgcagcgcatggcatgcaaggctgagggaggaggcctcccaacccctcaaccctcccctgcgccgccaccctttagaccccggctcgcccgcgctgcgacggacgaggtggagcacgtacgtgctggccaggctggacggcgcgcggcggctgctcctgcagggctccggcgccgggccgacgggcagtcgtcctttcctggacgtgctggaggtggactccaaggccacgcgccggctgtggcagagcagccccccttttttcgagaccaccagcaccattctttccgatgaggacgagcggacaatcaccctggacggcctgcgcatcctggccaccaggtgcgtagtcggggtggtaggggtgtggtactcgctgcattgggttgagtgcttgccggatggaggctcagagacagggagaaattcggcgtctggcaggcctcccccatccggcttctatgattcgagtgtctccggtggcttccctatcggcatgttctga

SEQ ID NO: 7906 - DNA, 1722 bp, Chlorella protothecoides
  modified_base (247)..(256): a, c, t, g, unknown or other
  modified_base (476)..(485): a, c, t, g, unknown or other
  modified_base (836)..(845): a, c, t, g, unknown or other
  modified_base (1063)..(1072): a, c, t, g, unknown or other
atgaatgtgggcctgacccgagcccgctcctcgctcctggtggtgggcaacgccgccgccctggcccaggacgggaactggggcgccctggtctccgtctgcgccaccaaggtgctgggtggggagggttcacgggggtgggtcgctggaggaaatgatggcaggatgtgtcattggcctgctgccttgtcactctctgttgcaccgggtctaccttgcccagccaagggcctgcggcatggtaagnnnnnnnnnngtcattggcctgctgccttgtcactctctgctgcaccgggtctgccttgcccagccaagtgcctgcggcatgccctacaacgagtttgtgggccgcgtggcggagggccaggtggccccccaggacctggccagcctgcaggcgcgcgccaagggaaagaaagagcggaacggaccccaggagatggaggtggaccagccccggccagccgtgcccgacnnnnnnnnnncctggccagcctgcaggcgcgcgccaaggggaagaaagagcggaacggaccccagaagatggaggtggaccagcccaggccggccgtgcccgagggcgacgacccctacctctacagcgacgaggaggagggcggggtgggcgcccccgccagcaagctcgggagtgtcgcccagggggtgtgggcgaagcggcacgtcaagggagtgacgcgagcactttgggaagatgaatcactcaacgagtctgttgagacccatcctacctggaaagatcgttgcaaagtgcccttgcaggggtaccctgccgtcacactcatgcaagtcaacctgaagccgctgctgttcaaccnnnnnnnnnntgagacccatcctacctggaaagatcgttgtaaagtgctcatgcaggggggtgtccacaagccagcggtccgatgtagagggagctggtaccgtctgttgcatgggccagcccctctgtacagtgcacaccaggccaaggcggccacaccaggcagcgcgagagtgcttacaccatggctcacacggcactcacgctctacaggctccacaccacacnnnnnnnnnnccaggccaaggcggccacaccaggcagcgcaagagtgcttacatcatggctcacacggcattcacggtcctcaggctccacgccacaacccctcctcaggtgtcgcgctctgcggctgcggccacgagcgcgtcgcccgaccgctccgcggccccttgcttctgctcaccagcccggtcctcccccgctaccatccctgccgccccccgctgcccctccagcgcgctccgacagaagcggtccagccaggcgttcatctcatacagcgcgtgcatgaccgactcgcgcgcgcggtagccgtggctctcgtgcggcagcaccaccaggcgtgtgacgcagccgtgccccttcagcgcggcgtaaaagcgctccgactgcagcgtgaaggtccccgtgttgttatcgtcggcgccgtggatgagcaggagcgggcgacgcaccttgtccgcgtgcatgaagggcgacatcttgaggtaggtctccggcacctcccacagcgtgcgctgctcctgctggaaggagaagggggtgagcgtgcggttgtaagccccgctgcggcccacaccacaggcgaagaggtcgggggcgtgcgccagcaggttggcagccatgaaggcgccgtagctgtgcccggcgatggccacggctga

SEQ ID NO: 7907 - DNA, 366 bp, Chlorella protothecoides
  modified_base (335)..(344): a, c, t, g, unknown or other
gcggcgcccgccgcgccggcggcgccgggcgggcgcacccgcgacgcgctgggcggcgacgtcttctgcaccttcctgggcgctctgaacttcgagctgccctttgaggcgacacgcgcggcggggctgtacgcccacctctttgtcaacggcggcaacgtggtggggctgggcccggcctgcagggaggaggccgccgcctttgcgtcgggtttccggtggtccatggtgagccgtgcagatgggcctcagagggagggggagggccatcgatgccccttgcgcgggcatcgtggcgccgggcagggtgtatgctcgtcgacgtgggacgaggnnnnnnnnnnggtttccggtggtccatggtga

SEQ ID NO: 7908 - DNA, 831 bp, Chlorella protothecoides
atgcagggccgcatcaccaaggtcctgaacatgaagccgcccgagatcctggggctgatcgaggaggcggcggggacgaagatgtacgagggcaagaagcaggcggcgctgcgcaccctggacaagaagcaggtgaagctggaggagatcaaccgggtgctgacggaggacatcatgcccgcgctgaacaagctgaggggggagaaggccgcctacatggagtggcagcacgcctcctccagcctggagcgcctgcgccacttctgcgtcgctcaccgctatgtcgaggccgagaggtgggccggccgtactttgggagggggggaatcatgttgggatgtgcacctgagagggcaaggtggatggagccatggctcacaccctggggccttgcagccccggatgcctacatgctcagcccatgccctctccatcccccccgcctccatcccacatggcagatcccagaagcggggccaggccgacatcgacgccctgatcgccgacatgaaggagctggaggccaagggggcggccctgcagcaggcactcaaggatcgcgacgatgacatcgccggcctgcagaccgagaaggacctgcagagctcgggggaggtccgggagctgacggcggcggtggacgccctgtccaagaggctcgtcacggagacgtccacctggaagcatgccaaagagagcctggcgcaggagcagggggagctggcgcgcctggaggccgccctggccgacctgggggaggcggagctggccgccaggctggaggccgcgcaggtggacgcggccgccgcagacgccacgctggcaaagtga

SEQ ID NO: 7909 - DNA, 1809 bp, Chlorella protothecoides
atggagagtgggtatgcggctcagctgcaggagatcgtgcagtcctgggactactggcagctggaacgggatgtgacggacggtaagggacctatatcccagctcccaaccatccccaagaccttttccagcgtccaggtcggtgggttactgcgcgacttctgcatggtgggcctgagtgactccgcccatgtcgaagtccagggttccaggaatgaattattacgagaaagcctcgtcatgcacgactgctggccagccagggcgcccggccgcacacccctgcaggcctacacctccaccttccagccgctgctgctggaggaggcggcggcccagctcctgcgaggccaggatgagggcagcgttgcactgagtcagcgctgtgtggtggcggcatgcgaggacaagggtgaggggcgcttgctgctcgtcctcactctccccccgggggtcaacagctccttttcagagaacgatgtcgtcctggtgtctcgagatgacccacaggtgcacagggttgcaggggctgcagcgggaccgaggtctgcaggcgatgtcgtggggcagtccatcgtcattcccaaacgctgccagacggcgcgccgcgtacaggcaccgagccctgctgtgccatcatccgaggggctcgctgaccagtctggcgtcctccacatcccctgccgtgcactgcagtcggaagaaagcacggacgaggtgcaccatgccctgggaatggtggcggggcacgagggcgagcagagtctgcgagtccggttcaacctctccgaagtggcccaggccggcagcgccgccgggacggccaggcaagttgtgggttgggattggcgatgcatgtggccatccccggtgctgcagagtaacggtgcaatgggttccagcggcatgccgtgctgtgcatcgccggcgctcttgtcctgggccagcggatactgggccccaccccgagcgtgcgaccagccagcccacccaaccctccatgcattctcccaacaacccagggtcaaacgcatgagcgcgctcctgcctgtggccggctccggctggtggctcctgcgcctggccaacaccagcaccatccagcgcgagtgggcggcggtgcactgcatggcccactccccactgcatgacgtcctcctctccgccaaggtcggggctgatgagaggctgtactgtgctgaagggctgtattggagttgggcagccccttctcgtgtggctccacatgtcccagcactgtccttcatcactcagtacaagcatgactggcagcggcccagctcctccggcgtggcggccaagcagctggaggccccgccgcgcatgctggaggccatggccgagtcctacaacgcctcccagcttgcggcagtgacggcggggctggacggcacctccctgacgctcatccagggcccgccgggtacggggaagaccaagaccatcctgggcctgctctccatcgtcctgcacgccgcgccacgcggcgccttttcctcccagcgtgcgcagcctgccggcgagggctccgcggcgcaggcagggaaacccgaggcccgggcgcggccaagccgcagcctgacccccgccgaggtgcacgccacctggcaggcgcactgcccctggctcacgggcgcacccgacccgcgcgcggcggtggtgccggcggagctggcggaccccagcgacgactacggcctgacgcggcgcgcgatccccttccgcatcgggaagtccgcgggtatcaaggcccgcgtcctcgtgagtggtgattattctctggggtag

SEQ ID NO: 7910 - DNA, 333 bp, Chlorella protothecoides
atggtcagctggggatccccatccacggacccacccaaccgccccccaccccacacgccgccctttcctcctggccaggtgtgcgcgccggccaactcggcgctggacgagatcgtgctgcggctgatcacttcgggcctgaccgacaaggacggcaaggccttcacgcccagcgtggttcgggtgggggtgaacatccaccacagcgtgcagagcgtggcgctggacacgctggtcacgctacgcctcggctccgaggcgggcaaggcgagctgcgggcggtgcagaaggaggatggttttgtggggggggcgaggtggtgatgtgatatga

SEQ ID NO: 7911 - DNA, 516 bp, Chlorella protothecoides
atggctgccaacctgctggcgcacgcccccgacctcttcgcctgtggtgtgggccgcagcggggcttacaaccgcacgctcacccccttctccttccagcaggagcagcgcacgctgtgggaggtgccggagacctacctcaagatgtcgcccttcatgcacgcggacaaggtgcgtcgcccgctcctgctcatccacggcgccgacgataacaacacggggaccttcacgctgcagtcggagcgcttttacgccgcgctgaaggggcacggctgcgtcacacgcctggtggtgctgccgcacgagagccacggctaccgcgcgcgcgagtcggtcatgcacgcgctgtatgagatgaacgcctggctggaccgcttctgtcggagcgcgctggaggggcagcggggggcggcagggatggtagcgggggaggaccgggctggtgagcagaagcaaggggccgcggagcggtcgggcgacgcgctcgtggccgcagccgcagagcgcgacacctga

SEQ ID NO: 7912 - DNA, 492 bp, Chlorella protothecoides
atgcacatcaaggaaatcaccgtggatggcttcaagtcctatgcccagcgcgtggtcattccaggattcgatccccagttcaacgccatcacgggcctgaatgggagcgggaagagcaacatcctggactccatttgcttcgtcctgggcattcaaaacctgcagcaggcgagtcctggggacggtggtgaggatatacttgccatggatggaatcccttacttgcacagtcgcgtgcatgcacgcatgtcggtccaagctccacccccctgttccctgcaggttcgggcctccaacctgacagacctggtgtacaagcaaggcctggcaggggtcaccaaggccacagtgtcaatcgtgtttgacaatgctgccaaggatcgcagcccggtggggtacgaccacctggacgagatcacggtgacccgccagctggttatcggcggccgcagcaagtacctcatcaacggcaaagtggcggagccatcgtga

SEQ ID NO: 7913 - DNA, 783 bp, Chlorella protothecoides
atgaccacacctctcggccagccacgaggcagcgctgccgcacggctccgccagacgctgcgcatggtacaggccggcaggccgatggcagctgccgcagacaattctgaggccacaccccccgcgatggctcataccgatgccaggacggggtacatgctccccccgcccgagatggcagcggtggtggacgccccccccgagcccactctgtccttctcacccgacaggaagatggtgctgcaactgggcagacccccttccaacccccccatctccgagctggctcgcccggagctcaagcttgcagactgcctttggtttggacgctttacttccggcgatgtggggttccacagtcgcagctccgccttcctgatgctggctgcccggccctctccattcccgcccccctctggtcgccaaacaggcctgcgcatcgacccggagaccttctcgcgcagcaggatgtcctactacacggatctcatgttcacacccttccacgacgcgctggttctccccgccccggcggccgactgccaccacccgacgggcatcccccccggctcctggatcaactacgcgcgctggtcgccggacagccgccacgtggcgctgacgctgcgcagcagcgccgagggcgcgcgcgggccgctgcgcctgtggacggtggacactgagtcctggcaggcgcgggaggtcttccccggcactcggggcctcaacacaatcttcatcaggcatgtggagggcgggatgggggggtggggcgtggggtga

SEQ ID NO: 7914 - DNA, 969 bp, Chlorella protothecoides
  modified_base (403)..(412): a, c, t, g, unknown or other
  modified_base (948)..(957): a, c, t, g, unknown or other
atggtctgcaggtcattctcattaaatgagaccaaggactcacttgacggcggggaggtagagcctccggctcagcacctgactccagctccccggggccgcacagagatcaaccacgcggtccacgcctgtggattgcagcaatgtggtagacgtcgtccagctgcaggagcttgtaggcgctacgtgctcgccacccctcctccttggccttgcggtagtagatgtcgcgcttgtccttggacgccttgcccatggtcagggcgcgcagagcaagggggagacctgatagatgctccaagccgaggtgcacctatattccaaccattaaggtacatttgggcgcgaggtcgacatcagcaacatgagttggggcatggggcaccgagcgatggtgaagctnnnnnnnnnncagcgtacatttgggcgcgaggtggacattcgcaacatgagttagggcatggggcaccgagcgatggtgaagctcacatgcgcaagaatttgggaatttatcggtcaaggggagatcgtctacttgtggtcgaaggcacaatggctccaatggaggagctctccttcgaggactttcctggcacgacactcagggtctggctgttcaccaatgtcacaaacagcaaggacgtccaggcggccatggtggaaggcacactcgagtacgaagccgccatcatgaatgcagccgtcgtgccttccctgtttgcggtgcacctcgccgcgcatcacgccttgctttctaagcagcgggggagtcttcggaccaggtccttgcactctgagctggtgtgcaacctgtcaggctccaagcacgtgagtcctgcactgggggaggggagggttgggttctcagtgcgtgtctgcatgtgtaattcgcttgcagggctgatgggggagcgtgcaaccgcagcgctcacggctgtgttggggctnnnnnnnnnnatgcatatgtaa

SEQ ID NO: 7915 - DNA, 450 bp, Chlorella protothecoides
atggcccccattgccggggtcacacagctccagggcgacatcacctcggcggccacggcggccggcgtggtggccgccttcgagggccgaccagcacagctggtggtctgcgacggcgcgcccgacgtcacgggcctgcacgacctggacgagtacgtgcaggggcagctgctgctggccgcgctggccatcgccgccgcggtgctgcagcccggcggcggcttcgtggccaagatcttccgcgggcgggacgcagccctgctcaccgcgcagctgcgctgcctgttccggggcgtggaggtggccaagccgcgcagctcccgaaactccagcatcgaggcgtttgtggtgtgccgcgacttcgcgccgcccccggggtttgaccccacctgcctccaggcgctgctggaggcgggagcggccgagtacgaggcggccggggacaggtga

SEQ ID NO: 7916 - DNA, 201 bp, Chlorella protothecoides
atgcgcagcttggcggtacggcagctggtgcccttcatggcgtgcggggacctgtctggctgggacgccgaccggtcctacgacctccccagccagggggcagcggggtacaccccactgcagccggtccagccgcccaccgccccggcctacaaggccgccatcgccctgtccaggacaggggggtctcgggcccgatga

SEQ ID NO: 7917 - DNA, 2409 bp, Chlorella protothecoides
  modified_base (580)..(655): a, c, t, g, unknown or other
  modified_base (820)..(829): a, c, t, g, unknown or other
  modified_base (1267)..(1276): a, c, t, g, unknown or other
  modified_base (1843)..(1852): a, c, t, g, unknown or other
atggatgtctgcgtgtggcgaggctacgtgcatgctactaatccagatcgccctgcatcggatgtgccatcaggtctggggaaagcatgtgtgcttggatgcgtcgtcctcactcccgcaccctgtcacaccccccctgccaaacacccgttgcgtgcagtcaaccgggcgaggcccctccagaacctcttcaacctcaaaccctccctgggcaccgacgcctttgtcgcgcccaatgcctctgtcatcggcgacgtgaccctgggcccccgatcctccgtcttctatgggtcggtgctgcgggcagactccggcagcatcaaggtgggggcagggaccaacatccaggacggctccctcatccgcaccgccccccagtccatcgacgagcacgcggcggacacgaccatcggcgccaacgtgaccatcgggcaccaggtgtccatgcatggcgtcaccctggaggacgaagtgctggtggggatgggggccgtcctctcacatggcacagtggtgagtgtggggtgccacccctcgcaccaggcatggctgcagcctgccgccggggctttctgtgccnnnnnnnnnnnnnnnnnnnnnnnnnnnnnnnnnnnnnnnnnnnnnnnnnnnnnnnnnnnnnnnnnnnnnnnnnnnngcggtcaaactgtgtctgaggtcgctggcagaccttggtgttgccctgaggggaatccgtggcaccctgtgcatgtgttgccagctggggggctggggagggtgtctgctccccgcagcaatgcacacatagaccatatgggtgacgcatcacttgcctcaccgnnnnnnnnnntggccaggggctggggagggtgtctgctccgcagcaatgcacacatagaccatgtacgcaagggggccatggtggcagctggagcggttgtgcccccgggcacagagatccctgctggtcaaatttggggaggcaaccccgcccgcttcctgagggacctcaaggacaacgagagctcattcctggcaggtgtggcatgcaggagatgtgatcgcctgggggtggcaggctgcccgcagcctccaggacacaaattgactcgtaaacccagagtcatgctccaagggctgcagtctctgcgggaggcagttgcggacggagtgcaggaccttcgccaccaagtggcagtcgaggcagtggatgctgctaaagtgggcaagaatctggccaagctgaacagttcaagggacccaccgccagtgcgcacagccagagcgnnnnnnnnnntgcgcacgtcgggcaagaatctggccaaggtaaagagttcaagggacccaccgccagtgcgctcagccagagcaaagactaagcacgaacttgttgctcttgacctcaggctgcaccctcactggaggcctgggatgtcggaggcttttcactcgagcgggccgactcacaggaatcctcaaggtgtgctcttgtcaagtgctgatgaagagactgggtcaaagccgctcagtaatcagcatgccctgcagagcgccagagacattctctcggccttgaagtcttccataccctccacggggatcccgtccttgccggttgggacatctggcacccaaccagcatcccctgggtccaagcctctcaatcatgtctctggattagaaggagcctctacccctgttgctggcgaggatgctgccgagacgagcggggccctctgcaatgccgaaagctcagagacagataggccgcatgtcgggcatgatgtgccaaagacctctgagctgctcaggacttcacctgacttgagcacggaattggctctgcctgccatttctaaagtcnnnnnnnnnnatgatgtgccaaagacctctgagctgctcaagacttcacctgacttgagtacggaattggctctgcctgccttttctaaagtaagtcctgcttcagacctggaaaccatgctggctgagctgggaaccagactgcaatccctggaggaccaggccttcacattcagtcaacgtcgttatcctcgtcagtgtgtggtcctgctcttggcaaggctcacacccgtgtttgtccctgctgagccagccgctcagtcctaccgtcagacatctggtcccattcctgcagtccgcagagcaggaggctgcagtgcaggaggcccgtatggccagagcccacgccgaggcccgctgcagcaccctggagcaggagcgggcctcggtgcagagggaggctgcggagctggccgcccaggtggagaggctgaccaatcaggcgagcgccaacgagaagaagatggccgtcctgcggcgaggcatggccacgcaaaaggagcggcagcagggggcggaggaggcggcccgccaggcctccctcgcggccacctcagcgatgcgtga

SEQ ID NO: 7918 - DNA, 696 bp, Chlorella protothecoides
atgctggacacgctggctacgctgtgcgtgcgcacgggcgagttccgcatgggcatgcaggccctgcgcgctctggagcgcatgggcgtggaggtggacaagtccaagtaccgccagctgctggagggcggcgggcgcggcgcgggcgaggcggggaaggccgcgagccggcccctgctggccaacgagcacctggagcgcctcaagttctggctaggcctgcccaacaactactatgagggcggctggggcgggacgcgggggggcggccaggaaataatgcagcagatacatcggcgggcaggaggggggggtgactgtgagcatgtcatcaagcgagtccatgtggagtgcagtgtcagccaaggcatcatattggagcgctccactccgcagcacttcccagcacaggacaaaaattcttctcgtgccccgtcgccaaagcggcagtggaggcaggaatgcaggtgggacggtgcccctcacggctccagggcatcaccacccgcccctcatagcagtgcctcggcttcaccgcaccccccccagctccagctgattgagcacggacaccacatcatccatggagaagccgtagctgttcagctggcgaaggagctgcttgccgttgcacatgccgatgcccagctcgtcgcacagcgctgcgcgccgccgcaccgtcgccgcgctgtttga

SEQ ID NO: 7919 - DNA, 276 bp, Chlorella protothecoides
atgtcccggcaccatcaatctcacccgcgcccgccgcacctgtgccagggggtggccgcgctgacgacgtgccatgagcccacttgccagctggcggtccctgccggcggcgagcctggggcggtgcgcgtttacgacgcagcctccggcagcggcagcgtcctcggcgagctccgggcacaccgctcgccgctggtggggggcgttgggggatgggaatggagagccttagtggggaccgggaaggggccggacagaggcatggcgtcagggtga

SEQ ID NO: 7920 - DNA, 798 bp, Chlorella protothecoides
atgagcggcacaggcgccagtcccatctttgcaagcctgcgcctgcggcgcagacccttctcacccccctcccacgatactccccaggtgctgctcgtcaccgaggcgaagcgcagccacagcgtgatcaacccggatctgttccagtaccacaaccactttgagttcctgcgcctgattggcaagaccgccaccagcgaggtgttctgtgtgcgccaccgcgcttccggcgagctgtttgccgtcaagcgcccccggcgccgcttcaggtccaagatgcagcgggagcggtgcctgagggaggtgcgggccgtggcggccctgcccgcgcacgccaacatcgtgagccagtaccgcgcctggcaggagggcggccacttccacatccagatggacctgtgccagggcgggaccctgctggaagctcttgggcaggtgggcgaggggccaggggcgtgtatgaagcgggcccgggagggcctggtgtgggcatgcgcgtggcatcacacatcctcagccatgccgccccctgcccgtctcgacacgcagagccatcgcatggacgacgccgcgctctggcgcgtcgccgccgacgtggcggccgggctcgctttcctgcacgagtccggcatcctgcacctggacatcaagccagagaacatctaccgggatcttggtggggcgtggcgtatcggcgactttgggctggccgtggccaacgagagccgggtgggtgaaagtgagggtgccgaggctggggagaggttcccacctgggcggggaggagctgggtcgtga

SEQ ID NO: 7921 - DNA, 498 bp, Chlorella protothecoides
atggcacgcgttcctccccgtccgccactgcacctctctctctgccacgccgtgagccaggggctctgtgggtggtcagctgccgcgaggatgtgcgctggccttgcggcgcgagggtcgtgcgccctcggcgccctccccgtgggcgcctccccgtaccacgaggttggcaacgtcggggtggagcacgccagcccagaggcgctgcgcctggccctggcggcggccaggcccagctcgcccgagcgcactgcgttcacgagggagcggctggaggcgctgggcctggtcgccagcggcattggacctgctgcgggggcccgggcagagggatcaaacagcgcggcgacggtgcggcggcgcgcagcgctgtgcgacgagctgggcatcggcatgtgcaacggcaagcagctccttcgccagctgaacagctacggcttctccatggatgatgtggtgtccgtgctcaatcagctggagctggggggggtgcggtga

SEQ ID NO: 7922 - DNA, 603 bp, Chlorella protothecoides
  modified_base (72)..(81): a, c, t, g, unknown or other
atgcgcgggcgcgcatatgcgcaagggtttcagctgctttctgagcgtggagtgtgctggaatgctggactnnnnnnnnnntggtgtgcatgggggtgtagaatgacagccagggtgatgaagggttttaatggaacaggcatctggaactccatcaacgttggcctcagcagcccattcgaccgcttctccatcggcacactggaccctaggaccttgaagatctgcactcccagcgcagcaacgatctgtcccgccgtctctgtggttgagtgcgtcgccgtgcgcgtcgggaaatgtctacatgacgctagcggaaatattggcaatggcaacacaggggtccagaacatcggttacaacaacattggcagcaataatcaaggtttgtatcgagaggagatagcccagccaatgtttatccccgtcgctccagaaacttcctcaggcctcccattatcacctgcgatgcaggcaatggtaatcgaggggattccaacatcggcaccgggaatcaaggtcaccacatcgtttgcaaccaactggactcccagcaaggaaattcgtgcgagctgtctgcccttcggacagcagaaacactga

SEQ ID NO: 7923 - DNA, 243 bp, Chlorella protothecoides
atgacgcggtgcaactgccgggcgacggtcatcgtctacaactttgaccacccaccccacgtggtgccggcccacctggcggccgcgccggacgtgctcaccgtggagcgcgccctggtgttcccgccgggggctgagggctctgtgctgcgcaacgtgctcatggaccaccagaacatagagcgcgtggtgctggaaaggacggcggacgacgcgctgcggcgcatgcgtgacctcgccttc

SEQ ID NO: 7924 - DNA, 1209 bp, Chlorella protothecoides
  modified_base (516)..(525): a, c, t, g, unknown or other
atggctgcgggagctcacctcggcgaagccgtgaaactccttggagtaacaggagctgcgttcattgcagggaaatggcatcaaagacgtcggcgtggccagaaaggggtgagattgcgtcacaggatcgtgttcgtgctcgccatccaggtgaagttcgagagtgaagcagatcgcgatatcttcatcgacctgttcagacccctggccaagtacgttgcggagcatgagccccagaccctctcctatgacctggccatcgccgatacagaccccacactggtgctcatccacgagaggtgcggtggggggcccacatgggatacagtctccttgcccttgaggtatgctaccaagaaggatctgacagaagtccaccacgtctcggagccattccttgccttcaagaaggctacacaagaactgccctttcccttcgttaagactgggcagtcctactacgagcaaggcattggcgtcaaaggactgcaaagcaaaaaagtatgcaaggttttnnnnnnnnnntcgaagggcctgttgcacggcattgcagagcccttacaactcacaggagtcccgtatatcttcccctactccccatggtgcagaccagtccccgggtttgcacctttctctgcccccaatgcatgtgcaacgccctgcagcgtcaaaggactgcaaagtaaaaaagtatgcaaggtttctgagcatagcaagcatgagcacgtgatcctccagcgacaagattggtacatgcaaggcagctggggtccacggcgtggttacaggagccgcagaggcacagcgtccccgacaagcagggcgactggtcctggtgacgccggccaccggcttcaggcaccgcagattccgtcacaacgacctcccggcactgaggccccgccgcccgcctcagccggtcaccagcaggtccagccccaggagcacaggcgcgggcacatccacggccttgcgcgcccgcaccccctccagcccatctatgtccgccctgcagaaagggcagatgggcctctccacgctccccgcaaccagccgcaccgcgcagcccaggcacagcgtgtgcaggcaggtgggtatgcgtgtgtcggccgccgcgtccatgcagatgctgcactcgtcggcccgcggcgccgtcggcggctggacgcccgcgccgccgcccccgccgccgccgccctggatcagagt

SEQ ID NO: 7925 - DNA, 3642 bp, Chlorella protothecoides
  modified_base (625)..(634): a, c, t, g, unknown or other
  modified_base (941)..(950): a, c, t, g, unknown or other
  modified_base (1134)..(1143): a, c, t, g, unknown or other
  modified_base (1887)..(1915): a, c, t, g, unknown or other
  modified_base (2087)..(2096): a, c, t, g, unknown or other
  modified_base (2424)..(2433): a, c, t, g, unknown or other
  modified_base (2759)..(2768): a, c, t, g, unknown or other
atggacggtgaggttgtagaccgtggggactgtgacgtgctgaggagtggtcatgtttggggagcgaggagtagtgctggctcatcactaagggaaggaggcgccctgatcacatgcgtgcctggcgtcgaccctcgacgagcatactggtcgcaatgctcacgctgccctcccggtgtcgccccaggtcatgataaaaaagcatccactggaggacgggctcacggcctggaacctgctcagcctgctgtacctggtcatctgttcagtctactgcgtcctggccctggggcgatctggcactcgttccctggcatcccccacccctcgtgcaggctcacttggtcatggaggtgcggggtctggctgagatccagcactttttcaaccagaagctgggcatctcggagcgccgcatcaagaccatcacctggccagaggtcctgcaccgcctggtgcaggtgggatcgggtgctgctcagggggttgggcgactggggcgttgcatttgtggcaccgccatgcttgtgtcgaagacaaaccctctgggggggctcggttccgcatcgatcgctgcctgggtttccaggacgctgcgggagcatgcttgccctcctagcggctnnnnnnnnnnctgcctgggtttccaggacgctgcgggagcgtgcctgccgtcctgggagctccccccccaactcccttgatgcaggtccagcgaaccacccgcctgtgcgcgtcccgcgacctcagcgagcacgacattgtgtcgcgcatcatgcgccgcgaaaactacctgataggcatgctcaacctgggggtcctcgctctgaacgcgcccgtcatgggggccaggccgcgctttctgctcaccaagacgctggagtggaacctgtactggtgggtgggggctatttgcggagggcaaggggggcgtctgcagnnnnnnnnnngagtggaacctgtactggtgggtgggggctttttgaggagggcaagggggacgtctgcatgggaggtcgcctgctgcgcctggaatggaacctggtcggcgcaaacaatgcacccagcgtcaagatcttgtggtcatgcccggacacccatgcccgtcaacttcctcccttgcccccggctggnnnnnnnnnnctgctgcgcctggaatggaacctggtcggcccaaacaatgcacccagcgtcgagatcttgtggtcatgccctgacacccccacgcccgtcgacttcctcccctggccccggctgccagcatgccagacaatgatcagacagggatgctgcggcggtgcatggctggcaccggatgacaatggacgcccacatcacacccatctcatcctctgccagggtcatggccggcttgaatctgctcatgtcgcccttcctcctggccttcctgctgatgtactttttcatgaagaaggccgagcagttttaccaccacccctcctccctgggtgggtggcagggtgcctgggggaggagtgcatcggtcgctgcaccgggcagccatgccgtgatgcgctgcccttcgaggcacttgcccctgccatgagtgggatggtctgcgcaggtgtgcgaagatgtattcgtctgcacgaccctgtcccgttcctccccatatataggggcgcggtcggtccgtgggcaaaagggatgggtggggcaagaacggaccacagcatgtgctgctacctttgtgattgtcgatcgctccatctgttcctgtctcaaaccatttccatgaagttcctgcccgacaggttgaatgccagcaacgaagcagctgagaagtacatatcgcaattcccgctgcccgccatcaggcgggcaacgcatctcgtggaaattgcccaagagaggtgcttgactctnnnnnnnnnnnnnnnnnnnnnnnnnnnnngccccccccccccccccctccccctcacacagccacgtggctcgctttgtggcgtttgtggccggctcctttgctgccctcctactcctgctgaccctggtggacgggcggttgctggagcgggaccttctgggtcggcacgttgtttggtgaggaggcggcccagtgtcannnnnnnnnnggtggacgggcggttgctggagcgggacctcctgggtcggcacgttgtttgcgtcgcgggcgttcattgtggaaagcaccactgcgttcgacccagaggcggccctgacggaggtggtgacgcacacccactacctgccccgccactggagagggaggtgggtggcaggagggggggtggtgggctctcgaatgtggtgtgtcatggcgtgcaccttgtgccacagtggccctgtggcccctcctcagccaatgcacagaagcaaggcaccagccggcgggccgtagcttactgttggttggcgtcaggctctcgtacccctgactannnnnnnnnnagtggccctgtggcccctcctcagccaatgaacagaagcaaggcaccagcctgcgggccggaggcgtttcaaggtctgttccagttcaaggcagtgctcttctttgaggagatggcatcaatcctgctcactcccctactcctctacttctcgctgcccggctgtgctggtgagggtctgtcctgggtggtgccagggagatgtggtcgaacaatttcgggccttctgagaacgtgcacgctcacttgcaggcacctggaacaccctttgattcgatctacacaggacgtgacgctcatgagtttgccaactctacactcttcccnnnnnnnnnncttgcaggcacctggaacaccctttgattcaatctgcacaggacgtagcgctcatgacttttccaactctacactcttcctttgccttgcaggagccatactgacgtttgtagagcagaacactgtgcacgtggatggcattggggacgtgtgctcattctcagcatttgacctggagcgacacggcaacagacgctatggctcacctgtagaggcacccaaggccgcgaggagtcatcagggaaaacttgaaaagtctttcctttccttcgcggccgcctatcccacgtgggagccgccagcgcctggccaagcgctcgtgcaggcggtgggcgcagcgcccgctgctggaggatgggcggcagctggaagtcgaatccttcctcccctcggcgcttccagcggagtgctcggcggcagcaccagccgcttccgcctccaccccatgcagccagtgggggacgtcatggacgtgggctggggtgcagaggagcgaatggccgtgtcccagatgcagctccacagcttctacaaggccgcaaggggcgccgagaactccctgcacttagaaggtgcccacgacagacatcctctagcgccgccagctgagagccagcaaattggtccagagcatagttccagaccgcctgcacctgagtctgctatagcagaaagggtgtctgagctcctgcccatgcataacataactggctctagaatgggtgggagctccttcctgtccaacagcaattatgtgaaattgaagggctcccatgtacgcaagaggaaatgcaaatcttttccggctccggcgggcgagtgccggagatctccccacctgcaagatttgtcatcacggaactggcaactgtaa

SEQ ID NO: 7926 - DNA, 1647 bp, Chlorella protothecoides
  modified_base (647)..(656): a, c, t, g, unknown or other
  modified_base (832)..(841): a, c, t, g, unknown or other
  modified_base (1569)..(1578): a, c, t, g, unknown or other
atgcaggtctgggagtttggcattcccgtgcaaataaaatacattgccgaccctgccatgcacgccatctcggccgtgagtgtcaccccgaacaagaagtggtggtgtggccagtcgatggacaacaagagtgagtgggtctgggcagtgggtggtccgttgagcagttgcgagggggagtcaaatgcatgcatggaggtggtgccggggtgtggaggtgctgagacaggcgtgctggttttggaccttcccaccctgccagtggtctgtcgccctctggtggtcattctgatcaattttccaaacgccctttctacgtttacagttgttacatacagcgcaaccgaccgtgtgaagcccaacaccaagaagacgtttgccgggcacaatgttgcagggtatgcgtgtgaggtgagcttctcaccagacagccggtacgtgacgtctggagatggcgagggcaagctcttcatgtgggactggaagaccaagaagatagcccgcaccatcaaggcgcatgagggcgtgtgcataggttctgcctggcatccgctggagacatcgcgggtggccacttgcggctgggatgggctcatcaaggagcatatgacctgcgacgtgctacttgactgtgatccctccctccnnnnnnnnnnggtgtttggaatcggacggtgtgaacgcccggctggcttttctcgagcatggtcctgctgcgacagcagtaggctgccgacgagcatcgatccgtacggaatcttttcagcatttttgcgagcaaatgttcatgcatcatcggtaacctacagcaagggttctggtggcgaagagnnnnnnnnnncgccttcctcgcgatacttcgtgtcacgttcgggagtgagtagggttctggtggcgaagaccaacgtttccgtgcgtgcccggcgcgcgctcagcgtcgcgaactgcgcatccgattgccgcatgccaagggtatcctggctcggtaatgaaaacgagttcttcaagcctggcaagcatgaagactcctggacgcggtcgcctcgaacagaagactcgccgcatggaatgacaggcggctgcagcacatccggatccagctccactgctagatcagctggcatggccaacggagacaagcgccaagataaaccggagacagggtccttcggacttcccattgatgctggccaccgtcgcacaaggtgcgcgcagccgttgcggcccccttgcaatggccgccgtgagctaggacagctggataatccgcccagccaggggagtaggaagtcgtccttcaggagctcgactcaccttcccgcctcgacgcctcaaagaactagcagcagctctgtggagagtatcaattccaaaggatctatcaagggggcaggctactgtttgagaatgtatgactggcaaccatctgtgacaataccatccaagcgcagaagcaacacatcctctgtccctcctcagtcgaaagcctcctggtgctggtatatggtaatgcgatatgatgcttatctctacctttgtacacctccactggtgtgcattgtagttgcnnnnnnnnnngtcgaaagcctcctggtgctgtatgcaataacctttgtgtttctgagtggtgttagaaagcaaccttga

SEQ ID NO: 7927 - DNA, 378 bp, Chlorella protothecoides
atgcagggtgtccgcgatgcctggttctccaatgacggccgcaagtttgtcaccacgggatacgacaaggtcattcggctgtgggactccgagacgggcgcggtccttgggtacccgggggtgtttttcatggagttcagggagggggaattgcgtatgcgggacaggtttgggctgtgcaagcttcctcctactttggggggagatttttcagcctctgtcggctgtgtggctgctattccatataccctgcggatcacgatcctcactctccatcacaagcctcctccacccattcccgtcacccctgcttcccccttgcagcaagtatggggagggcaagatggcatacaccgtccgcttccatccagacgatga

SEQ ID NO: 7928 - DNA, 426 bp, Chlorella protothecoides
atggtcctacgcgacgtcaccacgcgcgcactgtccagccgccgctggcaggccttcgccgagccggtgacggccgaggaggacccggactacgccgcgcgcgtgccgcggcccatggacctgtccacgctcctggcgcgcgtggacgcagggcgttacgcgaccccggggcgctacctcgccgacgtggcgctgctgcccgacgcggagcgcgcatactggggcgacagcccgcgcggcgcgcgcgccgtcagccgcgcctgcgcgctggaggacgagctgcgcgaggcgctggcggcagcgctggcagcgagatcggacctctgcgccggcctggaggccatcgccgaggcaggagggcccgcccccgcgccgcccctggggcagggtgaggggtggaggcgaggggcagtagaatggggttag

SEQ ID NO: 7929 - DNA, 285 bp, Chlorella protothecoides
ggcggcggcggcgggggcggcggcgcgggcgtccagccgccgacggcgccgcgggccgacgagtgcagcatctgcatggacgcggcggccgacacacgcatacccacctgcctgcacacgctgtgcctgggctgcgcggtgcggctggttgcggggagcgtggagaggcccatctgccctttctgcagggcggacatagatgggctggagggggtgcgggcgcgcaaggccgtggatgtgcccgcgcctgtgctcctggggctggacctgctggtgaccggctga

SEQ ID NO: 7930 - DNA, 630 bp, Chlorella protothecoides
atggacccctcccgtcctgtggccatctcactggggccgggggtgggcgcgccgcccactcagccccagcagaagcggcagcgcacgcagcagagcaagatggcccccgcgccggtggatctgacgcagcctttcactctgcgtacacggcaaccctgggcggagaaggccgctttcccagagcaggagctgaccgaggagcatcgggcatacctggagaagggctcgtacgtcccaaatctgctgtgccggcgtgcctcactggtccatggacacctgcaggcacaggaggagaaggcagagaaggacgcagggtctggcaagggggagacctccatcttccacggcaaagctctcgaggactaccagggtgggtggccgctatgggttgtctggcgtccaacgctagcacatgcatctccatacacccgagggccctgctcacatgctcccatcctccacccagccacccgccccccatgcgcgcatcgtaggccgctcttggctggaggctccccgggacctgcgggacgacagtgccacctccttcctccccaagaagcacctccacacctggtcgggccacacaaagggcgtcaatgccatcaggtgctggcggctgttctctga

SEQ ID NO: 7931 - DNA, 465 bp, Chlorella protothecoides
atggacctcatcggcgcttacagcgatgatggggccccctccccttcccgctccggggacggcaccgcagcactggcagttgtttccgctgcaccagaggtgaggtgcggcacatgccatgcgagacacttccctctctcgagttgcatctccaacggcatctacgcctcctcccaggtggatgcgagtgggtacgcgcttgtggagagcaagctggtcagccaggaggacaccaagttcttccaggggcccaacacccgtatgatccggtacaatctgcccgcagaccagatgcatgctccggtgcagggccccacgcacccttcaggccgcaaggcagatggcgggctgagcaaccaccgaacggggcatgtggaggactcccacctctcgtcctacgcctttgacgagcagtacaactcgttccacaggtcgggctgccaggggtgggggttgcggttgtaa

SEQ ID NO: 7932 - DNA, 3576 bp, Chlorella protothecoides
  modified_base (751)..(760): a, c, t, g, unknown or other
  modified_base (1041)..(1050): a, c, t, g, unknown or other
  modified_base (1387)..(1396): a, c, t, g, unknown or other
  modified_base (1892)..(1901): a, c, t, g, unknown or other
  modified_base (2480)..(2489): a, c, t, g, unknown or other
  modified_base (3007)..(3016): a, c, t, g, unknown or other
  modified_base (3196)..(3205): a, c, t, g, unknown or other
  modified_base (3345)..(3354): a, c, t, g, unknown or other
atggaccccgccgtccgccaggtggcggccatcgcctttaagaacagcgtgaaggaggggtggggcggcgaggacgaggagcgccccgccctggtcggcccagaggagaagggcgctgtgcgcgacgcgatgtttgccggcctggtggccgccccaggtgcggtgaagaggcagctgcgggagagcgccaggaccatggtctacgccgactaccccgccgcctggccaggcctactcaactccatcggcgagggcctggtgtcccaggcaaggccctcaggctggaggcatgtgcaccggggagggggggcggtggggccatgggaacggcagcatggggcggcaggaggcttgcggggccgacgggtcgcactgtggcatggcctcgcgctcccctggcccgctgcatcctgcgacagctcgcccagccgacgaccaggcgaggctggatggtgcgctgagcatgctgcgcctcatcgccaggaagtacgagttcaaggacgatgtggaccgcctgccgctggtccagatggtgcaagccaccttccccctgctcctccccatcttccaggtgccagggggattgcgttgcagggcgtggggtgggggttgcgatgcgtcgacatgcggctgcccaggcccctcaactctcgcccatcaccacatggggtcctcaccgcaccgaggcaaacaggatcccccttacccacccacccccttccccacatacaaccacctcgcagtctctgcnnnnnnnnnncccccctttcccacccacccccctcccccacatacaaccacctcgcagtctctgctctccagcgacagcgcgtccctggagctggcggagctgctcaagctcatatgcaagaccctcatcatgcggcccctccccctggtgcgttgtgcgtcggtgtggtggggaggacggacttggcatgtcagaccctgggccggacctgtacgatgaggcacacagcgctcctctttcttcttgggacggtggaccacgctgctcctgctccagactgcgagcgacannnnnnnnnnggcgctcctcttcttcttgggacggtggaccgcgctgctcctgctccagactgcgagcgacagtgcatgtgtttgacggagacagggaagtctggacggtacccctcccgccaccaaccatgtcccaggaccaaatgccgagcgaccccgactctcgggacgcatggcagtggtggaagacgaagaagtgggccctgcacattgcctaccgcatgttcaacaggtatgagggcgctgggtgtgtggtgctgggaggccgcttcgcggcaggatgtggctcggggagtgtccaactcgagggtcgcgcagcaacgagcacctgagccgcggcaggatnnnnnnnnnnccggtgatgggaggccgcttcgcggcaggacgtggcgtggggagtgtccaactcaagggtcgctcagcaacgagcacctgagccgcggcaggatgctcattccaatgcgtctctcaacactctcgggcgctcaaacctctctttttctggctgccgccctgcctcccctaggcgggcgacgtggcgttcgccaccgtgttccgccgcgactgggcgctgcccctcctccgcgcctgcctgcacgaactcagcggcgtggcagcggggcaatacatcgcgggccgcgtgtgcaacatggttctgcagtacctgacccaggccctggccttctcccacacctggaaggagctgaaggtcaccctgcccagcctgctccccaggtgcggcatgggtggaagggggtaccaggcgggcggagtcagcggttgctgcagcccgcactgtctgggttacaggcatgctcaaccctcctcaactatgcatgtgagcgtgatcnnnnnnnnnnccagcactcctcggcccatcaatggatccctctgcactctcactgcagcgtgatcttccccatgctgtgtttctccgagtcggatgccgagctctggcaggagaacccccacgagtacatccgcaaggctgccagagaggcttgccggaacctgagttttggaagggaggctggcgccctgccctactacgccgcctctgtccgccaaaaacatcctcgcactgtatccccgcccgccgcggtgtcgcaggggtacgatatcatcgaggacctgcactccaccaagactgcggccatgaacttcctgctggagctctgcaagtcccggccaaagggcaacctggatgccctcgtccaggttggtggagctggagggaggggtgtgttggaatggaacgccgctgcaaggcctggccagggagtccgggccgggggtggagccggcgagggcagctgggtcgccagccagagatcactcgctgtgcctgggagtgccaggcctcaccccaccccacccctctccattgcatccacccaccccacccccggtcacctatcccccctcacccctcccactcnnnnnnnnnnatcgctgcaaggcctggccagggagtccggggcgggggtggagccagcgagggcagctgggtcgccggccagagatcactcgctgtgcctgggagtgccaggcctcgccccaccccaccccctttccattgcatccacccaccccacccccagtcacctatcccccctcacccctcccactcaaaccgcagcacatggtgggcatcctgggggagttccgcgccgccggccccggcgccgacctggcgctggcccggcgcgccgacggcgcctgcctcgccatcggcacgctgagcgaggtgctgaagcagaaggcgcggtacgccgcctcgctggagcccatgctgctgcagcacggtgcgatttgttttctggggggggggggaaagggggaagggcctggttgtggggcaagggagagggggagcctgggtcgcgcaggcgtcgtgtggcctgggggctgccgagggcactcagggccttgaatctggtccaccatgccaacaagggaagggtgnnnnnnnnnntggcgtcgtgtggcctggggactgccgaaggcactcgggaacctggtccaccatgccaacaagggaagggtgggttgaggaatgtgccacttccttcttccgcctgcctgcctggggccccggggtctccctcggcgttccccaacatcggctctccccacccgtctgcggcgggcgccnnnnnnnnnntatgtgccacttccttctcccgcccgcctgcctgggcccccggggtctccctcggcgttccccgacatcggcgctccccacccgagcatcgcggacccggagcttcccgtgcgcatcgacgcatcggtggcggtccgcgnnnnnnnnnncgtcaggagcatcgcggacccggagctccccgtgcgcatcgacgcctcggtggcggtccgcgccttcctcgaggctgtggaaatggaggacctgcccctgttcaaggacctggttcccagtctcctcacccagttcctgcagctgtcccaggaggtgcgcgggtatcgagaggaggagaggaaggggagtgtgggagggggggggaaagggggggtgggtag

SEQ ID NO: 7933 - DNA, 1539 bp, Chlorella protothecoides
  modified_base (344)..(353): a, c, t, g, unknown or other
  modified_base (1397)..(1406): a, c, t, g, unknown or other
atgccgctggacaactatatctcccaggacaccgagaccttcctgaacacgcgcgaccccgacctgctggccctgactaaccaggttaatggcttgggtggggtcctttcctggtggcggggatgcgctgggcagctcgggtcacggaagcagccatgcctcctttccacacgtgcatacccaggacctgccatgattcctcatcagaatggcaacaattcaggtcccctttgttcccctctcttttcccccccctttctccccttctcacatcccaccgccccctcacccacccatccatcagacgctggaaaaggtgctggccggggatgggtaccccgtgnnnnnnnnnngggtagcgctgaggcagttgggagttcactgggacgaagtgatgccgcagcgacgctggagaaggtgctggccggggatgggtaccccgtggaccaggtggtctgcgccccgcggctcatgggcgtggtgctgcagacgtgccgcgggcgggtggacgcctgcgttgcgccctacctgggcctgatcctgcgtcgcctggcgcgtggcgacgctgacgaggacttgcactccgggcttctggtggccgccgccgatgcgctgtactactcgccggcgctcgcgctgcgcgcgctggcggcccagcccggcgccctggccgcactgttcggcgcactgggcaaggcggtggcggccacgcgcgccggcgggcgcatggcggccttcccctcgcgccgcgacaagaagctgctggccctgggcctgaccgcggtgctgtccacgcccgaggccgacacgccgccggagattgcgtcggccgtcgggcagctggccgccgcggtggtgcgcctgctgctggccgtcaagcggcaggaggaggaggcggcgggaggggggggcgcgcgggagcgggagggcgaggacgccggcgcggcgcgcgcctcgggcgacgaggccgacagcgagggcgccgacggcgacgaggcgaacatcgacagcgacgacgaccgcgtcggcgcgggccgtccagttgcccagagcgagtctgccaggcaccgacttgctgtggcgctcagcttcccagggcagtccccaaaccaccctcctcctgatggcccgtcttcgcttcctaaaccctggcccccttccaactctccaggcggtatggcgcgacgcggggcgactccgacgtgtcagactccgaggaggattggtggagcgacggggaggcggaggtgtccagccccgtggacgccgtggaccccttcatctactttggggaggaggggcgcaggggtcaatcacagagattctacggatgctcgtcagtttggcagcaccagcacagctccccgtccccgccaccgcagccccaggacacgtgnnnnnnnnnnagcggccatccaggccaccatggatgagggcacgcgcgccgcgatccagggcatgacggcctatgcggcccagctgcagcaggagaagctagaggctgcggctgctgcggctgctgcggctgcagcacattga

SEQ ID NO: 7934 - DNA, 1080 bp, Chlorella protothecoides
atgcagttctcgctggtacgggtggaggttgtaggtcgcagagcttccgtgcttgacactgttttggccgggagtccggtcggagggggttgcgctgggtcctgcgctggtggaggccgggcagggtgtgcccctggtggacccagcctctctggtcctgtgtgcccctgcatgccacgtggtcaagccagctactctgggtcctccttgaacccagcagctccctccctcccctatgccgaggcgaccatttccgcccactctaacccatcatcccccgcccctgcaggtgcccgcccctccctgccggcggcccgcccgtcccgccgcgtgcgccccgcccggcggtccgccccctgccccgtggcgcggaccatggggggcggtgaggagcagccctcctccgccgagggcgtggcctgggacaagatctccaccgacgagctggcggactgggcgggcgcgggcccccccacgccgctgctggacacggtggccttccccgtgcacatcaagaacttcaactcgcgccagctgcagcagctgtgcaaggagctgcgcgccgacctgattcacaccgtggccaagacgggtggtcacctggggtccagcctgggcgtggtggagctgacggtggcgctgcaccacgtgttcaacacgccggaggaccgcatcgtgtgggacgtggggcaccaggcctacatccacaagatgctgacggggcggcgcgcgcgcatgcacaccatccgccagcagggcgggctgtcgggcttcacgcggcgcgccgagtcggtgtacgacccctttggcgcggggcactccagcacctccgtctccgccgccctgggcatggcggtggggcgcgaccgcaagggccgcgccaacaactgcatcgcggtcatcggggacggggccatcacggggggcatggcttacgaggccatgaaccacgcggggttcctggacaccaacatgattgtcatcctgaacgacaaccagcaggtgtcgctgcccacccagtacaacggcaagaaccaggagcccgtgggcgcgctcagcagcgccctggctcgactccag

SEQ ID NO: 7935 - DNA, 696 bp, Chlorella protothecoides
atgcgctcggtgctggtgactgcgggcgggacgcaggtcagggtgtgggacctgtttgggggcggccgggagctggcctgcttgagcaatcaccagaagacggtgacgtgtgtcacggtgtcgcccaacgcgggccccgactccagcgctgcgcctcgcctcctcactggagccctggacggccatctcaaggcgagcgttcgtgaaggggtgggagggaggggatttcgccgtgcgcatcgtgcgctgttggctggtgggatccgacaggggtgtcgccattggattgtcttcgcctcgccgattctcctcggtgctcctcccgcggttggacccatctcgggcgagtggatgcatcagagaccagcaaccccagaggaaaatgctgcagacacccgctcgtcccagttcatgttgatgggcagccctgcaaggggtgccgcctgcattcacccccaacccgccacccactcgccccctggtcaggtgtacgagctggagaggttccaggtgacgcacatccaaaagtaccccggccccatcctgagcctggggctgtcgggcgacgccggactgctggctgtgggtctcgcagacggcaccctcaccgtgaggaagcacgccaagccacgtgcagaccctgccaaggcgggcatcctcgtcggccgacgaagcaggtgggggccgagtttgtga

SEQ ID NO: 7936 - DNA, 768 bp, Chlorella protothecoides
atgcaggccggcctagggcgcactcagcaccacctgagcctcccaccccccttgctcctcttcgtcctcatgtgttgtcagggcattgctcactcgcgctccacatcccaactgtgcaggagggccccagccctgaccgcggcgacctatcggtacttcatccgtggccagtcctcaaaggcagcagccaaggactcggtcatcgcagctgaacgcaaggtcgggatgccctggacgccgcgctctccacgcggcgagccgaggtgcgcgcccaagcgtgcccacgatagagttgcccccaggcgtgttaccgtgacctgtcccctgtttccttatcaacgtcccccgccagctgcgactccaccagcgcaaccctgcccgccccccgccacacgcgacagacgcaggccccccatcaacccccccaaaacgccccctttgacccaggtggtcgcgagtgtggtggaggagctggcggcgcgggggggcctatcctccgccctgagctccagggacgcggctggcctggcccccctcctggaccacatgcggcgcaacatcaacgacccgaggcacgcgccgcagctggcggcgctggcccaccgcctgctggacgtgtatggagggtcggaggcgctgacggggatgctgccggcgctgacgctgctgctggaaagggtggagctggagctgcgggcacaggacgggctgaccagggtacagggcatgctggggcccctgctcgcggcctcggtgggagcatgctga

SEQ ID NO: 7937 - DNA, 1869 bp, Chlorella protothecoides
  modified_base (1760)..(1769): a, c, t, g, unknown or other
atgagagcatttgcaaatccatgccggacggtcagatgctgcagtgagggaggtcatcagtccccaccccgaagccagcctccgcagattcccaggcgcctattcctagctctccctgctgctttgtggagtgtgactccacttcccagccaagcctttgacatctttaagtttcctggtaccgacgtccttgagatcatcaaggagaggcgggaggctgccctggctgctgatcagaaagcaacggaggccttcgaggggagcgacttcctgacacggctcaagatctaccttccaatactcctcccaccaacgagcaggaacaagagggccttggatctcaagtactgcaaacggcaggctgagatggggataggagattgcggcgggctaaaggctcctcaggtcatcctgccaaggattctgtacctgcctggcacacagagggttctgaagcgcaaagacgatgggagcctggacttcactgagtttgaggaggccgccaagaagctggatgcatcagacttggcagcacagagcgcgacgccaatttctcgcctccccggcttccagttcgaagaccgaacatgtcccttaaactacagaccatcaaaatttcttgatgtcgactgcgtcctagatacagggttgatctggttgcggaccatcaccatgtccgctcccacacagcagttcactgttcgcgcggctggatcagaccatgcgtacatgcagcacttcattggtcgattcccactagagctgccggatctgggaactgcgtccagcgccgcgccatggcagatggaagcagaggagattcccgcagggctcacccgtgccgggccacccccacccagaacggctgggcccaagcctcggcgcctcagactgagacgggagggggtcaggtcctataggggcatgccagagggaggcctcgggtcaaaccagttcctgctggtcaaggaaagggggagcaacgatttcgtggctatccccgttgaggaatggtacaactttcgaccagagaccggcaggcctggccaaacgctggaggctgcagaggctgcgatggcagcagccaggcagcagcacgatcgcatcaacccccggtttgtggcagccctgcaagcctccggcgccgacgtggacgcccccgccctgccctctggcgctgatcgtgatgaggatggcgccgactctgacgaggagtggaaggggatcaaggccagggcggcctcccacaccgccccacaaggtaacaccattgctgggcaggggcaggggcgtgcgggatggggcgtgcgggatggtcctgcctgcgtgtattgggagcacagattgaccggggttcaagacaaggagcctcatcagttgtctggcgagctgagggcctcgcctcaggtttgtcgtgagccggctctcatccgctccaccacaccaaccaccatgaacgtgcagcagcaagaaagcccctgggcaacacagactgaaggctgctgtgaaccaggactcgaggggctgcggcaaggcccacctttctgctacatgaccaatgcgatgctggcccctcgtggagctgctcccaaacccaccccaccttgcactgccggccttccctctctgcaggccgaggattgggaccatgaggatgaggcggccgacgacgacctcgacatggaggcggatgagggggagggcggggtggaggccagccctgttcgaaggtgggggactgcttgctgggagtcggggtnnnnnnnnnngggtggaggccagccctgttcgaaggtgggaactgtttgctgggagtcgggtcctcccagccaaggttttgtaggaagcagcattgcgcgggatgtttga

SEQ ID NO: 7938 - DNA, 1806 bp, Chlorella protothecoides
  modified_base (768)..(872): a, c, t, g, unknown or other
  modified_base (1671)..(1680): a, c, t, g, unknown or other
atggaaaagagacattacactcttaaccaccacccttgtttaagcccatggcctaccaagcatgcacgacaggtgggccatagggcggtcacacgaaacgttagtcctcgagatgctgaggtacaacgtgaggcggccatgtccaggatccgtaaagctcgcctctatcagcagaagactgctgaggcacagaatgtcaaagatagcaacaaatccactggagcaaaagaggcagcaacatatgcaaggggcaccgtcgacggtgacgcagcccagacagcggctgcacctgatgcagcacccatacaacaagctacacctagcacatctgctgcagggcagatacgctcaggaccagagaatgccgatgcagcgccagtgagggtaggtactggtgtgtgtggtgccttgagatcggccccaccaggtgcatccagctctcagcttgggcaaagtcggcctctggtcccaagcaatgcgggtgatgaggcggggtccaacccaagatcaacttcagctgcctccaccacagctgctgctaccagtgacgggagtgcgtaccagccctccgtgtcgacttggggactcttcccgcgccctgctgacatcagcaagacctatggagggtatctcggtttgccctccgctcttgcagatccttcgttctcaaccccctttgcccctccacgcagggggccggacgctgcgacccggcgccgcgctggaaagcgccgaggcggccgccgcgcgcaccgcgcgcatcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtggacagcggggccgggtacttccgggtggggcagctccaagccgcgctggccgagtgagatgacggaggatttggctcagggggatgttgcccttgagagagggtggcacggatgcagtggttgtgtgacgacagctcatgtgccatcaacagtccttgcgtctgtttccctgtcgctggcccaacccccccttgcaccctgccgacctttgatgtgccccctgccctcgagccgcccaccctcgcccgcccaggtaccaggcagcgggcctcctcgttcctatgaaaagcgcggtggggggcgacgccgccctgggcgccgcactttccctggactcgctggggcgcggcgaggaggccgcggagctgtacaaggccctgcgctcgcaccgcaaggcagaggtggccaaggtggccgcccgcatgctcttcggcttcaaggcggccgagaagctgaaggacaccgcctggggcgcggcgggcgtgccggcccccaagaaagccgccggggaggaaagcgcggggagtggcggcctgcgcacacgcctgctggggtggggtgtggcgatcgcgctcgcctccccctgcctatggctggcgtggcgagtgtactcccaccagcacggcccctgaaacccctgttcgtgcggtgctctgaggatgtttcttcccgcaggcttgcccaggttgcacgtgaccggacatggggaggactgtccctggcgctgtcatctgtgtacagagccagcacgttggtcgcatttcaacctggcaggggcaaggctgcagctggnnnnnnnnnngcggacatggggaggactgtccctggggctgtcatcggtgtacagagccagcacgtcgctcgcatatcaacctggcaggggcaaggctgcagctgggcgtcggcagctttctcgtgctggggatag

SEQ ID NO: 7939 - DNA, 1461 bp, Chlorella protothecoides
  modified_base (644)..(653): a, c, t, g, unknown or other
  modified_base (1012)..(1045): a, c, t, g, unknown or other
atgcaagccccttgcctccctgcagcctccaaagtgtgcgccgcggagatccagcagccggctgcagacccccagctcggctgccgtccagacggctgcggcggccacccagcctgcggccccggtgcgccgccccagactggccttcaccgagatggagctgggaaccggtcccgagatagaagcccccttcaccctgcgctccatcggcaagtgtgggagacgctgggggctgtgggttcttgtgacaggggcgaaggcatgactggctgtgactctcactcccaacgctgcaccctccctgaatgggtcaggtgtgacggtgtgggacctgggctgcatccaccgagccgcctgggcagacaggtactggtcctcccctggctgcttgtaccaccacgcctacccagtgggctaccgtgcctccaagacggtgtttgggcgcgagtacgagatgtccattggcctgggggaggctggaccggtgttcaaggtcggtgtgtttgggaggcggtgatggctctgcgaatgcatgctggagtggtacttgcagcccgagcctgcggtgcctgctcccccaagtgccagctgctgcactgctcaggggtgtttgaccgatccctgtcccatctgtcgcctccctnnnnnnnnnngtgttcaaggtcggtgtgtttgggaggcggcgatggccctgcgaatgcatgctggagcggtacctgcagcccgagcctgcggtgcccgctccccaaagtgccagctgctgcactgcccaggggtgttcgaccgatccctgtcccatctgtcgcctccccaccagcagatccgagccctgtcgggtcccggccaggagttcgaggggcccacccccacccagccctggacagccgtcgcgccatcgccggcctgtacgacgctcgggagctggctgcggcgctcaaggtggtggtgttcaggaggcctgcggagggctgggcgccatgggcacccatgggcgcaggcggctcgaccctgnnnnnnnnnnnnnnnnnnnnnnnnnnnnnnnnnncggaggagctgtgcggggaggagcgtgcggtgcgtgaattcgtgggcctgccaggcgtcggccgcggcgtggccacaagcctcgccctgactgaggcgctgggagggcggcggcacacgtgcctgaggagcctgcgggcctgggcccggcaggaaggtcctccggcccctcaggctttgtgtgccgaccccgcacaccatgcttggctcacctccctcgcccttcttcgactccgttcgtgtgctattcctctccctccgcaaccacacaccccaggcacagggcatgctcagcagctggaggactggctccggaccagcagcgagctgccggggtcgactctgcgctggcccgcctggcagctgcgcatcgtgccgggcctcatgcgggacatcgcgggggcccaccgctcctga

SEQ ID NO: 7940 - DNA, 840 bp, Chlorella protothecoides
atgaccctctcccagtccttcaaggacatgctggcggtggccccggcgccaacgcagcccatcagcaagaccaacggcggggtccctgtggcgcccgctcccgaggtcaaggctgcccacacttcgggaccccgccccaaggccagcgccctccttaaggagaagtacaatctgaaggtagcctgcgtggagcatgcgtgccatgatggcggtgtcgtgacccgggaggcggggtgtagcaggcccgccctgcggagctgggcacggcagtggctggcttccgggggcaccgtaccacttggtgaacgcctgcgtgcccgaggaccgcctccttgcttggccaacatccacagggagtcggagaatgaccgcgccgagatcgtgatcgtgtgcgagccggagggcacctccctgcagatgggcgggctccacccccgcgcctccctgtacgagaagcctgtgaacctggaggcggcaaagaccgcccacgccgagttccggaacgtgatgcgggagaagggggtgcgcgtgctgacggtgcgcgagatcctggcctatggcaccgaggaccacgtcggcgcgcgcgtggacctggaggactttgcggtgcaggcgctgacctaccagctggccaaggacggcaggatggaggacatcgaggaggcggaccggtactacctgtcggacgagtacaagcgcaaggtgctggagcacatgtcggtgccgcagctgatcgacaccatcctcatcaatcccaccgtgcacctggcgccctcctaccgcgacacgggtgcggtggcgttggcgtggaaggggggaaggggtccgcgatgtcactga

SEQ ID NO: 7941 - DNA, 2328 bp, Chlorella protothecoides
ccggggcggggcaggggcacccgccagaccggaaccctggaagagctcacctctggcgcgtgccagcgcgggttgttggcgaccatggaggaggccacggagacggtgtccgacaggcgggagaggttgaagtcggtgaccttgacgcgccagtgcttgtccaccagcaggttgggcgacttgaggtcgcggtggatgatgggcccgcggtgggagtggaggtgcagcatgccctttgccgcgtccagggccatgttcaggcgcttgccccagtccagcacgcgcgccgaggcgtcggggttggcggccgcgaccttcagcaggtcgtacagcgacccgcgcgcgcagaactcggtgacgatgcaggccgggtccaggcacacgcccatgaagaggatgatgttggggtggcggatggccaccatgatgcccacctcccgctccagggtgcgcaggacctccgggtccagccgcacctcgccgtcgggcccggccacggtggcccccgccgcgccgatgccgaaagcctgcaggctggtcagcaccttgatggccacatccgtctcctgccaccgccccaggtacaccttgccaaaggcgccctccccgatcacccggctcagcaccaggtcccggaagtccagcagccagggcgtggcgtccccgccctcaaacaggcccgcggccgggctggaggccgcgcgcgcggcggccgaggccgtcgccgggttggcggctgccctctgggaggcccccgaccccgcgccgcgcagcaggtcgtcgtcgctggcgtcccccgggccggcggccaggcccaggccggcgctggcctcggccatggcgtaggccagcacggcggagttgtagcagaagaggggccaggcctcgcgcggcgacagctcccccatcagcgccaggccgcgctgcgaggcggcggcgcgcagcgcggcgtcgccccacagcgagatggtgccgttcatggaggaggtgaccacgcccgcgcccgcgccctgcacgtgggccagccccgtcttgctggcctggatctcgccgtagggcatgcgcgcctggcccacgctccccgccacgtagttgatggtcagcccgccggggctcttggggtgcggcagcggccgcaccagcagccgcccatccaggtggctggtgcacacggcgcccaggctctcgcacaccgccagccccttggcgggggaggggcgctcgccgatgcgcaggatggggcgcagcaggcccgccaccatggtccagacctggaccatgcccgagtcgtgcacggtgagcagctgccagacctgctgcagctcggtggccagcgcagcgccgcccgggccggtgcccccggaccgcggcgccagcgagatgaccgaggcggtggcggcggggtgggccccgcgctccgccggcaggaggacgcgcaccagcgggctggtgatggccatggcgttcacggtgcccatggagcgcaggtcgttggaggccagcagctcgccgcgctggctccactcgcgcaggcagacgaaggcggaggagccgcccgccgtccacacccggcccaccgccgcggccagcgccgacacggggccgtagtgggcctgctcgcgcagcagctcgctgttcaccatgccatcctcgggcacgccctccagcgccgcggcgtcggcgggcgcggcggagccggaccagcgcagcgaccccaccaggctcaggcggcagccgacgggcgcgccgccgcgcaggacctcgcccaggcgcaggcagcgcacgttgccgcggctggaggcggcccagcacgcgccgcgctcgtcgcaggtcagcgccgtgaccgaggagtggaaggcgcggagggggtcgcagacgggcgcgcgcgagctgtgctcccaggcgcgcaccgtgccgttgcggtgccccgcccagaccaggcccgccgcatccaggtgcagcgcggtcaccacgccctccgcccgcacctcgctgtgcacctgggaggagaggtgcaccacgtgcagcgtgcccccgcccagagtgcgcgtgacgtagtaccaggcgtgccccagcgacccgcgcggctcgtcctcgccgggcgggatcaggagcagcgccgtcacgctctgccccgccttgccgcggtgcaggcgctcgggcggcgggatggccgtcggcgtcgcgacagccggcgcccccatgctgccgcccaggccgggcgaggaggggacggtggaggtgcgggtcggggcctcgcggtccgcccacgtgctgcgggacaggccgctgtccgccgccgccagcacgccatcgggcggcgtggag

SEQ ID NO: 7942 - DNA, 624 bp, Chlorella protothecoides
  modified_base (253)..(305): a, c, t, g, unknown or other
  modified_base (563)..(572): a, c, t, g, unknown or other
atgcaggtggagacgcccgtgctggagacggcggccgggggtgctgatgcacggcccttcctcacctaccataatgtgatgcagcgccagctgtccctgcgcattgccaccgagctgcacctcaagcgcctggtggtgagtgggtggggatgggagtgggaggggttggcactgtgcatgaggctgaccggcccctggaccctcagagccgcttgggttacaaggctgaggtcgtcatcacatgctctcgggnnnnnnnnnnnnnnnnnnnnnnnnnnnnnnnnnnnnnnnnnnnnnnnnnnnnncccccccccacctctcgcgcccccctcctgccaggtggggggcctggagagggtgtttgaggtggggcgcatcttccggaacgagggcgtgtcctcgcgccacaaccccgagttcaccagcgtggagctgtaccaggcctacaccgactaccatggcatgatggagctgacggaggagctcatacgcgcctgcgcccaggcatggactttgggggggggaggacattttgaccttcaggctgcatcgggacatgacannnnnnnnnncatacgcgcctgcgcccaggcatggacttttggggggggggagacattttga

SEQ ID NO: 7943 - DNA, 450 bp, Chlorella protothecoides
atgtctccgacgctgcggccactcatctctatccctcaggacggcgcggcggcaccctccccagtgctgctgccggccctggcctcgcccgccagcgccgccagcgaggcggactggccggggcggatggtcaccctgtggctcgacgaggagtggaccccgctgccggagcacgcagctctgggccgggcggtgtgcgagtcggtggagcggctgagctcagccgccgagggccccctggatgcctcgggcctggtcatcgacctggccggcgccctggccgcctgcgactaccacgccacctttgtgaacgcgttcgacgttgccaacaaggccgtggagctgctcatgctgcgcgcggggcacgtggtgtgctgcgtgcctgaggcggagcaggaaaggacggcgcgccacgccgcccagctcgaccggggcgggccgccgagctga

SEQ ID NO: 7944 - DNA, 1263 bp, Chlorella protothecoides
atggctggtcacgggaacacagggcggggccggaacatcgccctctgctgcgcacactggagcgattcatcgacggtacacgcctggacatggatgaaacaatatttgctgaaggtggggctgggaagcttagccgtctggcgccgtgggtcacctgtccccccgttgcaccgcttaccccccctgacagttcccacctccccggcatctcccatgcagcgagagacgatgtttgggcaggggacgcgcctggatccctcagaccatctcatcatcgtccatgtggggaagggcggtgagaaggaacgatggaagatgggcggtcccctcatccctgacctggagacctgcctggagtccttccctcacacgattgaggacttggcgggcagtatccagggcaacatccgggagttcctggacagggccaagattgacatcgtagtttttggtgcggtggggtttgcgtatagcaaggttcaggggagtgaatacgctgcactcgagcttgagcggcagttgcttttgggctcaagattgtggcgtgaccattccacatcttcaccccaaccacctcacccgcataggcaatcggtacccacagtcggtcctgaaggccctgtccctggtgtcggtgcgggactgggtcaagcagcatgtcaacacgccctacatcatcatccggccggaggatgctgcagttccaagggcggctgtcccgacacccccaaaccccatccccttgcccccgcgatgcgtccgcaggcagtgcgcaacgttcgtatgcgcttcggcagcggcccggaaacgagcgccgagtcggtggtctcgcccgggggcacttttcccccgccacgccgcattgccattgcctatcccacgctggccatagggcgagccttgctccaaatggctcgcgagagggtgctgcagccctcggacaccatcgacatcgtgcatgtcttccccagggacgacgccgacaaccccatgaaggaggtggggccttgccgagacggcgggggtgggctggaatcacaggatgcggggctgaaaatgcctgagttttgggctttgggttcaggaacttgtgacggtcccctgctgtgttgtggggtggacccacttgcccatcttcagcatgtgactttgaaggccacccccccaccccctcctctcatctaccaaactcccttggcaggtaatgaaggggacgctcaagctgatgcgggcaatgaccctgcagaaggcggggtcaaatga

SEQ ID NO: 7945 - DNA, 2046 bp, Chlorella protothecoides
  modified_base (829)..(838): a, c, t, g, unknown or other
  modified_base (1352)..(1361): a, c, t, g, unknown or other
  modified_base (1447)..(1456): a, c, t, g, unknown or other
atgatgccggttgtcgcgagaagcgctcccgcactggcatgggcccctgttatgcaggcgagacgggacggagggcttgctcgcctgcggggaggtgcaatagtgttgatcactctcatactcatgcatcgctatagtccgaggaacgtcatgcatcgccccgggctcccggtgctcagcagtgcactcccatgggcgccacgctgcgcaggtgcccgtggccgcacgatccctggcccgccgggcgcacggacgcgcgacgggtgtcaaagcctctgcaaacgcggaagcgcaggccacagtcctggccgacccacacatggccacgtcggtgaccacgccggtcacgccggcagcgacgcctgccgccatgaccactggagtgtggccatgtggcgcgatttcaaggcttcggacctgttcccagagggagggaacagctccttgacgggcaggctcggggaggcagcacgctcgctgcgagagggcgtcactgcttctggcgccttgaagaacattgatcatgcccggtactgggcgtaccatgtgtcgaggacctccttcttcctcctccaggcgattgtgggcctgttcattgcccagtcaggcgggtcggcagggagtgcctcggccactcccaccaagctggagacaattgtgacgggcgcccgtggtcctcttgccgaggtgctgctcatgtactatcaggacctgcagaacatcaaagaaggtgggaagggtcaactggcggtgctggaggcaaggagaacatggaagacaggaaagtatggcttcccctgggacatggagacggtgcgtcacaggcagnnnnnnnnnntaactggcggtgctggaggcaaggagaacagggaagacaggtctaatggttttagaaagccaagatgtattattatctcaagagtaatcctcctgccccggcccacatccaggaaagtacggcttcccatgggacatggagacggtgcgtcacaggcagttcaaccccctgttcgtgctgcagcgggcagcagccttcatgggcgaggcccgtctgaccatgcagcgcaagtgaggctcgtgttcggtgtgataattatttgtcacccagtactgcatgctctcatcagcacttgctcgctgcagggtcccagaatgaacaacacaagtcttgaacttcctgcaggaatgcccagcagccagactcagtgtggctcaagagcggcctccttccccaatgtaaggctgggtgtcttggagttgagttggagcatccatgctgccggcaagcttggttgtgaggtcctcaccgcattccatcaccaagccacccttcccttgtttactcccacagnnnnnnnnnnactggtgttcggtgtgatcttcacttgtcacccagtactgcatgctctcatcagtacttgctcgctgcagggtcccagaatgaacnnnnnnnnnnacgtggggtcgagttggaacatccatgctgccagcaagcttggttgtgaggtcctcaccgcatatcatcacaaagccacccttcccttgtttactcccacagactaccagaacaccttccactaccaggctgtgcacacacacggccatgcgtgctctccttgcggcagtttcaactctcaccttcccccttgcctcaccctttcccagaccgacggctggctgagtgccgactcggccaagatctatgagacctccaccgagacgctcttcctgggccgccaagacgctatgcagcgctgcaccctggtcccgctgcatgactacctgcagggccgggaccctgcccagctgagggcgctggaggtggcggcaggtacgggacgctttgctacctacgtcaaggacaactggcccactctgcccctgacggtgtcagacctctcgccctactacctggcggaggcgcgctccaacgccaagcactggcaccagctgagggcggggggggcctggctgggcggcgctgagggcaccggctgcgactttctgcaggtgagggcacgtttgggttctctgttggtagtttag

SEQ ID NO: 7946 - DNA, 2052 bp, Chlorella protothecoides
  modified_base (175)..(184): a, c, t, g, unknown or other
  modified_base (883)..(892): a, c, t, g, unknown or other
  modified_base (1002)..(1011): a, c, t, g, unknown or other
  modified_base (1706)..(1715): a, c, t, g, unknown or other
  modified_base (1896)..(1905): a, c, t, g, unknown or other
atgccggtcaggacggggcagccgctgcgcatccagttgggggaggagagatggcggggacccgagctgtttttttaccccggcgccttcaccaaaggtgacatggcgtgtatgggacgtgcgccgacaccacatgtctttgtgaccctgcatcggagcgcgtgtgaggtggctnnnnnnnnnncatggcgtgtatgggacggacctcacctcccctcctggcactctcgccctccagatgccacgcccagccttccagacctgatagatgatgccatccaggcctgccccattgacactcggagagccctgtatggcaacatcgtcctcagcgcattgaacccttgcgattgccacgacgcgcaccctgccttctgctcccaccctgcctccctacgccatgcagggagggagcaccctcttcaagggcctggctcggcggctggagaccgagggccgagcacctgccagtcatgcagccgccaccggggtggaagtccatgtcgtgacccaccccatgcagcactttggtgcctggtttggcggctcggtcctgggagccagcgaaggtgcgaccctggaggtgtgaggccggattggcctgcccctgctcctgtgtctgtgggcgtggggaatgaggtggctgtcgacagtttgcaggtgatttctcgtgagtatgccacacagtccgatgctgagccacggtgtgaagtgccccgcaaggatctcactctgcatggccttctcctcccctgcatgggcgacccattgagcagccttccgagaggtcgccatcacgcgcgcagcctacatggagacaggccccaccattgtgcgcaacaacgtggtgcactcagattggtagcctatctatcgtgtgcgnnnnnnnnnnggagacaggccccaccattgtgcgcaacaatgtggtgcactcagattggtagcctatctgctgtgcttccccatgatatagccgccctgctcactcgaccatttcaccannnnnnnnnnctgaggtgtggtgaacaagccgttccctgccagatgcttcaccatgatataaccgccctgctcactcgaccatttcaccgatactgtacagcccattttcttctcatagcatgggaacgtgatcgcaatctcccctcccaggacatcaagtgggtacaagggcttggcgagaggagtaccaggcgcgatcttgaagagcgtattcccacagtctcactcctcgtccatggagtccatggagaaggagcgctccagaatggctctcccctctgtcgcaggcacggtgggtttgcggaaagacagggtctttgtggaggagccctggaccttggtgtcgcagggaaagggggagtcggaaggttcatgagtgaagctagccttgcagaatgcagaacactccttggccagtctcatacagtcgtgccaatcatgagactgtcgacagtgacgagcttccactttacttgtgaggcgaaaactgcctacgctcaccaaagccggccacccacctccaaacttgtgcatctcagagttgaagacactcctatcccccagctgctgggagtctgtcaagaccacaaggccgccgggcttcacgacacgtgccatctcacgtacagcggcccgcaggatggcggggggcagctcgtggaagaggtagatgctgtagacgatgtcgaagctggcgtctggannnnnnnnnnctcacgtacagcggcccgcaggatggcgggtggcagctcgtggaagagggaacgatttggatgcatgcggactgactggaggatacatcagcatgcgcgtcttggaagacaatctgcgactgcatcttgcaaatggccaagcattgctactgttctccccagactcaacctcatgcctggnnnnnnnnnncggactgactggaggatacatcagcatgcgtgtcttggaagacaatctgcgactgcattctgcagatggccaagtattgctactgttctccccagactcaacctcctgcctgaatcaagaacgacacctttgaccagatcaccatag

SEQ ID NO: 7947 - DNA, 744 bp, Chlorella protothecoides
atgacgaccccaagagtgacagggcgtgaagacatcagcgcagcggtcaagagcacctggcaggatgccagcagggtgctgatcttcacaaactctaaagttgtccactcgacgttcgaggtggggggtcctgcagggcagggaggcttgggcgacaggtgtccaaaagctctcggaggtggttttctgagcctcacggcgatccctcctcccacatgtcccgcagaccacagaagccgagagggctgccctgacgacggtcttcgcggaccgcgagacagctctcaagcagggcttggtgctgggaggccggcggtgcaccgatttcatccccctctggtgtacggacggaccatggatggcgacgcagagacgagcacgggaattgccatcctgaaggttgacagcggcaagtatgggagccccacctatgccctcatcacctacgagatgcccaacgtctcagcgcgcatggtccaaatgctggccgactttgggaaaacatgcctggaagcatccagcaggctccatggcaagaagggacgtcaggacgcatgcaagctgtcgcttgtagacttcatctggcctggaatgcatgtgcatgggagggtcggaccacccatcaagccggctcccaaaactctcagcgggagaaggtcttctcgatctctggaggaaccaggacatcctttcgtgcctgcgagagcacagggagaggcggcagcctatgtgcactcatcctaa

SEQ ID NO: 7948 - DNA, 387 bp, Chlorella protothecoides
  modified_base (308)..(317): a, c, t, g, unknown or other
atgtccaagggactgtcggtgctcgcgcgcagtgccgggcaggcgcgccagctcatggcacgccgaggcggaggtggtggtcccctctcccgggcagcggtgcccacgcagccccttgcagagcaagacgagctcatttggcaagatggcactggcaaccccgagacggctctggacagctacgacctggtgacccctggtcaggctctcgggtggctggcagctggcatgggcgtgtttgcggcagtaggagcagcactcagcctcgacccacccgagaagcgagtcccctgggatgagtgcactcnnnnnnnnnncgagaagcgagtcccctgggtgagcatgaacttttgcaaggagggggactgcaaagatgcacctgcatga

SEQ ID NO: 7949 - DNA, 984 bp, Chlorella protothecoides
atgcctggtcccggcctgcgagctgcccagtgtgtctggaggacttcagcgcgccccctggccccggtgagggcgcggaaggcacagtgccttcatccaccgccgacgaggcaagggccagcagcagctcagccccgtccgcgccgctcctgcctgggggcgacgccggggtgggcctgcgccgccggagcgggggccaggagggcgccaaggagggctccggggacggcgacgccaagaccccggtcacgctgcgctgcggtcacaccttctgcgagccatgtgggtttgggatggggcaggtcccggggatgcacagggcactgtggtgctgggctttatgacaatggttggaccttgcctcatgtgctgctcgatggctgtctggagcagtggctggacaaccacaccaactgccccatctgccggcaggacgtgtccaccccgcctggggcccccactggcaagggacagccggccacgcagcagcagacgtcgaccgctgaggagcgggagcgcgcccagcgtgccgcccaggaggtgctcaacaccgacctcagcttccggctgctgatgctccaacgcatgtacccctggtacctcaccgacgacatgatcgggcggtggacgggggaggcgcgggagacagggaccttcgactgggcgggcacccgcgagttccagctgcgcgacccaggcgtcgcggcgcagcagcgggagtccggcgcctctggcttcggaggcgggtggggcggcgggcacagcgtcggggggggcggggacccatgcatatgccctgcacccccacctctgtattgcttttcgctgtatcagcttggaagtgtgcatttcaaatgcgaagggggatacaatggcgctgtatcagcgcaggggatggttcggtgcctcgacagcactgtctggcattgcatggtgaggtcctggccctttgcatcaagcagtgcaaagggagtgggcaagtga

SEQ ID NO: 7950 - DNA, 540 bp, Chlorella protothecoides
atgaagaggggaaatctccgcaagacgtccgccctgtccttcgatgacgaggatgaggcggatcaggaacctttgtctgcatctggaccagccaaggcgccacggcctgcagtccaggcccgacagaaggcggagcgcaagtccctgctcagcttcgaggacgatgctgaggatgggatggctgctttgcccgtcgtagtgagacccgagcgccgcaaactgaggggcgcgggcatcgctcgccctgagagcagggagttgagactggaagcccggccagccagcacacaagtgtcgtctgctggtgtgtgtctctcctgcctttcgacctcctcaccaggcgagtacagcgctgatcggctgaaggagctgcagagctcgatgctgaggaaacctgtggcctctgcacagcccgcctttgtggtggcgggcagcttcaaggccgggcctcccaagccatctgttgcgcaaactttgtcaggaggtacagctggcctggcacggcccagatccagctcctccctgccatatggtcagggc

SEQ ID NO: 7951 - DNA, 588 bp, Chlorella protothecoides
atggacggcggccttaggaacaacatgccacgctgcctgtcgcacgccctctacaccacgctcaggcacaagatcgtcccctttgtgtccctgcaccacttcgtccatcccatctggtttgagcacctgggcggcttccaaaaggaggagaacattgccttctttgtggactatgccaagctgactttcagaatacatcctgatcaccaccgaaattggcccaggctgtttggctcccgcatcaagtactggagcaccttcaacgagcccggcatcgccagctttgccggcctgatgagcggcaccttcccccccggcaagatcctgcgcatcgcggggacggcccgccacctgcttcacatgctgcaggcccacacccgtgcctacgaagccatcaaggccatgcctggcggcgatgcggtgctggtgggcatcgtgcacaatttcttctggttcgagcccaagcaggcgtggtgggtgcccagctatgtccgcaccatctgcaagttcctcaacctcatgtggggcaacgataccgtgctagagtatctgcgcacagggagattcgagtccaaggccagctggtga

SEQ ID NO: 7952 - DNA, 669 bp, Chlorella protothecoides
atggctcgacgcagttgccccgctaacctcgccgtggccagcagcctcaccctctccacagccctcgcactgtcaggcacaaacacctgcagtggcagcgtgggggccatcgccggggccatcctgggagcctccttctggaactggcactcggacatgctgagggtgcgggcccgcaagcctgcacccctgagggtggtcatcacggggtccagccgcggcatcggcaaggcgctggcgagggagttcctgagggctggggaccgtgtcgtggtcacctcccgctcgctggccgacgcccaggccgccgctgctgccctggtgggggaaggcgtgggcggggccccccgctctgtgatcgggctggcctgtgacgtcggggacgctgggagcgtggaggccttggcgggggcggccatgcatcagctcgggggcgtcgacgtctggataaacaatgctgggaccagcggcggcttccaggtccaaaggttctttcgtgtggtacggggtgtggtcgatcctgtcagccatttccgtattcgtgaagggcatgtgcgctttggagttcatgccgcagtgcctggtcttgcagagggcgacggctgccatgagcaggcgcatgtgaggccagctgtggagtctccacccccgctcatcattcccccgtaa

SEQ ID NO: 7953 - DNA, 720 bp, Chlorella protothecoides
atgtcctcccccccccaaagtccatgcctgggcgcaggcgcgtatgagctcctccgtcagctccatcatgccatggtagtcggtgtaggcctggtacagctccacgctggtgaactcggggttgtggcgcgaggacacgccctcgttccggaagatgcgccccacctcaaacaccctctccaggccccccacctggcaggaggggggcgcgagagcggctctgagggtccaggggccggtcagcctcatgcacagtgccaacccctcccactcccatccccacccactcaccaccaggcgcttgaggtgcagctcggtggcaatgcgcagggacagctggcgctgcatcacattatggtaggtgaggaagggccgtgcatcagcacccccggccgccgtctccagcacgggcgtctccacctgcatccagggctgaaccctctcccacgcccaggacctccacccaaccccaccaacctccaggaagccccggtcctccagggcgcggcgcagggcgctgatggtcttggaccgggcccgcagcgtgtcggtgacgcccggggtaacgatcatgtcgacgtaccgccggcggtaccgcgcctccacgtcagccaggccgtgccacttgtctggcaacggctggatggccttggtcagcatggtccaggatgtgaccacgacgctcagctcccctttgtcagtccgcttcatgtgccctag

SEQ ID NO: 7954 - DNA, 327 bp, Chlorella protothecoides
atggccgtcaacctgctgtccggcacggtggccgctgtctccgccacgctgctgactcagccctttgacgtggtgcggacccaggtccagctgcggctggtgccgcgggcggcgggggcggcaggggcggccgcgccgcacctctccgctctaggcatgctgcgccacatcagcgcgtcccagggcgcgaggggcctgctggcgggggcggtgccgcgcgtcgccaaacgggcgctgcagaccgcactcatctgggtgttctacgaggagctcatggggcgggcggcggtggcggcgcgcgccgccgccgcagtgccgccaaagtga

SEQ ID NO: 7955 - DNA, 342 bp, Chlorella protothecoides
atgccggaatacgatttgctgcgccatggcacagacgatccattctacgtcggcttctccatgtccgtgtaccagtcctcgggccatgaccacagcagctggggcgagtttgggcggtcgaggacctggtatgggggccacaccatccagggcaatcagcagtgtggggagtcctgcaatttctgggagctgttcgatgccgacatcgagcgagccgctagcctgggtgcgaattgcttccgcatctccctggagtggagccgcatcgagccggagaggggggagatcgattccgcagctgtgcagcgctaccatgatatcatcgacagcctggagcggtga

SEQ ID NO: 7956 - DNA, 411 bp, Chlorella protothecoides
atggacgactttgcccggcccgccctggtcatcgactgcgggtccgccttcatcaaggccggattcgcgggcgaggtcagccccgcggttcgggacccgtccaccgtgccgcgagctgcgggactggagccggggcccccgctcgtgcccgtcaagcatggcatcgtccaggactgggatgccatggagcagctctggctggatatgacgtacaggcggctgcatgtctacacctccgaccagcctgtcatcctgaccgagccgccccagaacagcccagagtccagggagcaggctgccgaagtcatgtttgagagcctggacgtgccggcgctgcacataggggtgcaggcccagctggcgctgtatgccgactatgctgcccgacaggccatgggctctcaggtctga

SEQ ID NO: 7957 - DNA, 213 bp, Chlorella protothecoides
atggcccagaggaccgagaagagcaggctggtctcggccatgtctggatccctgtcgggagcatgtgtgagcgcgatcgtgcagccgctggacgtggtgcgcacacggatgcaggtggacgtcaaccgaggggtgcacgtgagtgcctggggcaccctgcgcaccatcactaaggaggtaggagcgcctgggaaggcgggaccctcgatttaa

SEQ ID NO: 7958 - DNA, 300 bp, Chlorella protothecoides
atggcacgtgtcgtgaagcccggcggccttgtggtcttgacagactcccagcagctgggggataggagtgtcttcaactctgagatgcacaagtttggagacttcaacgagccatactacagggcctacatccagacagacctgggccagctttttgaggaggcaggcctcacctgcgacaccaaggtccagggctcctccacaaagaccctgtctttccgcaaacccaccgtgcctgcgacagaggggagagccattctggagcgctccttctccatggactccatggacgaggagtga

SEQ ID NO: 7959 - DNA, 267 bp, Chlorella protothecoides
atgaccgacatgccgtatgccctccatcccgacggcctgaagaaggcgctgcactccatcaaccgcctggatgtacccatctacatcacggagctcggggtggcggacagcggcgacgacatgcgacgcaagctgatcgagggttacatgcccaaggtggccgaagctatggaggaagggtgcgacgtgcgtggtgtgctctactggtccctgatcgacaactttgagtggcagatgggcttcaagatgaaggtgtgggacagctga

SEQ ID NO: 7960 - DNA, 228 bp, Chlorella protothecoides
atgctggacggcatcctcacctctctcgacattccgtgcacccgcatccacgccgcgatctggaagcgccagctgggcctcttcaagaaggggaagccggggagcatggcactggcacaccagctgctcccagctgcggccccctttctcaggcgagcctggaacgatggcgttgttgtcaagcgatgggaacctggggtgcggatggtccgtggatcctgctcttga

SEQ ID NO: 7961 - DNA, 690 bp, Chlorella protothecoides
atgttcaaggagcagagcctggaggtcatggaaagcgtggtgaggaccaacctggtggggtgcctgctgtgcacccgcgtcgcgctgcgcacgctgggctcccagccgacagggggccacgtcttcaacatggacggcgcgggggcaggcggcggcccgacgccgggctttgccacctacggcgccaccaaggccggcatagcccagcttctggaaagcgtggtgcgggagcgggcggggaaggccagcggaagggaaggcggcggcgccgcactgcacaacctctcccccggcatggccctgaccgacctgctgctggcgggggccacaccggggacgaaggccgccttcaacgtgctgtgcgagcagccggagacggtggccgcgcacctggtcccgcgcatgcgggcgctggcggcgcggcgctccgccggcggccattacctgcggtacctcactcccgcccgcgtgctggcctgcttcctggcggccccactgcgccgggggcgctacttcgaccccgcgggccgcgcgcggtacaagtcagaggcggagcgggtggcgctggcggaggggcggcggcgggggccgcgcgggagacccgcccccctggccctcctctactctgggtctatcgcgctttcctacctcatgctggccacgcaggcgcatgcccagcacgggatgtga

SEQ ID NO: 7962 - DNA, 951 bp, Chlorella protothecoides
atggcatcccgtcatctctggcctttgatcacgaggctgcggcagtcgggtgccagtgcctccgctcggccctgcgcacttcttgaagcctctggcgttctgtccaccgcattcgacactcggtggatcggcagctcaccctcatacagcgccagggtgcggcgaacaggaagagatctggttccccggcaagcaggggatgtggcagccgagcctggcacggctgtggagcccgccgcctccccctccctcaacctgccagccattcaggcggtgctgcagcacccagcgctggtggtcacccgccccatcgagtggggcacggtcctgctgggtttcgagcaggccaaccgatacacggtgtgcgatgaggcagggaccgtcgtggcccagctcatggaggaggagggctccatcgggcgagccatagggcggcagctgctgcgcacacgccggccattcacggccaccgtgctcagcgccgatggtgaggagctccttgtggtggcattggcacgtctcagcaggctcatgacaggccaacctgcgagacgggggacccctgagatggcgccccgatgccctgggccacactgcggccgagcacgcctcttcaatggtcgtggcacattcccgcagggtctgaggtgctgttccgcatccgccgccccttctacttcatcagctcgaccatgtacattgaggacggggctggggagaagctgggggaggttcagcagcaatggcacctatggcgacggaactacgccctctttgtcggccgcgaccctgttcgaggatggagctcctcagcctcaggctcagcgtgacgtgcctggccaaatcatgtcgacaaagtttgccggtgcacaccgctctcccttgctccgacaggcagtcgccaattttcagccattggcgggggcttcctcgcctgggactttgagctga

SEQ ID NO: 7963 - DNA, 1140 bp, Chlorella protothecoides
atgtcgagcctcccaacccgcactctcggcaagggactgaaggtctctgcaattgggtttggggccatgtctctgactgacggcttctacaagtctgatgtatccgaggagggcggcatccaggtcctgcaccgtgccgccgagctgggggtgactctcatcaacacagcggtgttctacggtgcgggggtcaacgagaccctgatcgggaaggccttccccccagagaagatcgagagcctagtattcgctacaaaatggggcctggagaatgacttcagcacagacttctctccagcagcagcccgccgtgcagtggagggctccctgaagaggacaggcaagaaagctgtggatgtattgacactgcggggacccctgccggaggattatgatctcgagtcggtcttcaagggagtcaaggtgatgatgagaggtttggggttgtccctggggattgaagaggttccaactttgctgtgcattgactctgccacctcccaaaccgcaccacaggctctggtggacgagaggctggtaaagcatgtggggctgtcagaggtgacggctgagcagatcaaggctgctcacgccatagttcccatcaccctgatcgaactcgagtggagcctcttctcacgcgaggcagaggcaagctgcgtgcttggatggaggggctctggcttgcaacgcacacttcttgcacattcatcgacccacttcctgccctcccaggacgacatcatccccaccgcccggggcctgggcatcggcttcctggcctacagccccctgggtcgcggcatcctggcagggcgcttcttcagcaccgccgagatccctgagggcgacttccgcgcggccgcgcagccccgcttccagggcgagaacttcgccaagaatctggcgctggccgaggcgctgagaggcgtggcggtgcgcaagggcgtgacccctgggcagctggcgcttgcctggctgctggcccagggcgatgacgtggtccccatcccggggacaaagagcgtcaagtatctggagcagaacgtggccgcggcgggcgtgaggctgacgcgcgaggagctggacgaaatcgaggcggcggtccctgctggggcggcggccggcggccggtattga

SEQ ID NO: 7964 - DNA, 912 bp, Chlorella protothecoides
atgtgccacgagaacatgagctccggcttcagcctgctgtacaactggaacctggggaagagcctgcgccgcatctacctgcgccacgccccgttgttcgaggcggcggcggcggcgggggaactcgcctacaagacggaccaggcggccagcgcctccaccatctctgcctttgacgacgccatcaccaccgtgacctacggctacgccagcgtggacgactactacgcggctgccagcagcgaccgcgacgtgggtgccgtgtgcgtgcccacgctcttcgtgcaggcggaggacgaccccatagcggtccagggcgccatcccgagggaggggctgctgggcaaccctaacgccatcctagccctcacccccacaggggggcacctggggtggtgcggcggcaaggacggcatcttcggtgagggttcctggggaagaggagttggagttggggaaagggggtgtggtgctggagtggttctccgccatccagaaagtggcgccgctggattttgggaaggaccagggcggggccctcccagaggacaccacctactcgattgccagcgagaccacccgcaaggtggtggcctgagtattctttttgtgtggagcatggtccctggccggcgcctcaaacaaggcgcacatgttgcaccctccgactcacagatcggtacctttgacgtagctgccaatcgaactggcctgctcactagaggctttgcaacacttgtccaccgtacctcaactgccaaggcagtgcttgaagctcgcataaacccttctaggaagtcatttagcacttacaataataagtatgattatacctgtggcattcctggggtgaggttggacaggtacgaatcattcaacagcccgaggacggcctgcaacatgaacacatga

SEQ ID NO: 7965 - DNA, 1233 bp, Chlorella protothecoides
atgttaccgccagtgtttctatgtcatagttggaaagggcaggcattgcagagactgtcgactcttgcttgcacggcaagagtgctgccacgcggttgtcagccagatggtagaatccgctacaccaaacccacacgttccagtcgcgagcatcgtgtagactcagacaatccgggccgcctgcacaaaacattatgcatcaagctttggatgaggatcgtcgatccaaatccccaacagcacctcagattgtcgactccctatgccagcggtggccgcctctacccgaagcagcagctcactcgactggcacttgtgagggtcgacagcgaatcggatggggcagcaaggagcaggctcattggctcaactgacagtagaatatacattgaaagtattacgcgcgcgatctggagtgttatatcacgatcgcacaatcatcgagtccttttagattcatgggaggaatttcttgctgatgacgacagctccatgggaggcccacccacctcgcaattgcaaccgaagatgaacgctttgcgcgtgcaaggaacttgtaatggtagattctcatttgtgagacctcgttgccgcgcggcgcgtcccgcccgtcaagccttcagggagccaggcaccgagttcctcatgtccaacccctgcgttgcggatgaatttgcgagcggagcccgtagggtggagctgatcctgtctgacgtggacggcaccctcctggaccactcccagaccctcaccccgggggtcaaggcagccgtggaggcggcctcggcagctggtgtccctctcatcctggcaaccggcaaggctttaggcccctgggtgggcccggttctggaggccctgcccctccccctgccgcgcatccacatgcaggggttgcacatagtggacccgaaggagggcgtgatcttcgatcgcaccctggacgaagccatctttcacgacacgctggccttctgcagggagcatggtgcggcagggagggctgtcagatttcctcatttgctttgggaacaaggggcatgtgttgctggatctagtgtggctggtccaccgcagtgccgtcttggaatggcgcgagtgccgtgcggtgggcagggacagtgtgtctatagtcctttgtccattgtaatggagctgcctggagccatctccgctgagcctggaacggtggctccaaacctccaccaccggacccatcaggcatcacgctga

SEQ ID NO: 7966 - DNA, 960 bp, Chlorella protothecoides
atgactggccccggcagccctggcctggtattccaccctcattccactgccgctcgcccctctcccacatcccccctccccctcctcccccccccacaccaggtcaagtccacggtgaagaagcactcggccccgctcacgctattctgcgtggagccttccatgcgcaactttgcgcacctgatcctgacgcgggacgccttcttcccgcccacctccccccccgacctgcagtggtacatcgtcaacgcagcggtgtccaacgtcacgggggtctcccacttcccccgcggctgcgtggacgagctgtgctcgctgcagggcaacagcgacggcaccaggccccgcgacttcgactatgtccccctcaccacgctggacgcgctggtgaaggactacgccatccccgccatcgacatcctgaagatcgacaccgagggcttcgacgccaccgtcatcctggggtccatggaggtgctggcgcgggggcgcgtctccctcctcacctttgagtatcacgaggtgggggtctggcgcgagtacgccctgcgcgatgtggtggagaagctggacggcctggactaccggggccagaggggggcggggttgggcctgcctgagcagtcccgcagccctgaaacggccccaggcgggggagccgctgcactcgcccaccacccagcgctccatcgcagactggtgctgagcctcttcccccttgctttccacctcctcatcgcaggcaagcagacgctgtcgcgcatgacctcgtgctgggacccggcgtacgagtactacaactggagcaacgttgtgtgcgtcaagcgcacccacttcatgtacgccgagctggaggccatgagctcccgcttcgaacgccaccgcgccgagtacttcgccgggaagcgggcggcggggcaggggaaggagccgacagtgcaggacgccgcctcaccctga

SEQ ID NO: 7967 - DNA, 504 bp, Chlorella protothecoides
atgcagttctcccgcaagtccttcaccaacctccaggccctcgcggccggggactttggtggatcgatgtcagagcttgctggaggggggcccttgtctgcctttcatgccggcggcaagaaggggtccaccacctcgatggatagcgactccataaacaggaggtcgcagaggctggctggcggtgggtcccggccttgggacagattgcccagcactgacgacttcgaaacccagtctggacccctggtgcaccgcaggctgatcttcgtgtgcaaccagctcccactacgggtgaagggccagggcaagggggcctggagcttcgagtgggatgaggatgccctcattgcccaggctcgagaggggcttcctgaggacatggaggcagtgtatgtagggtgcctgcccatggaagtggatggcgcagaccaggatgtgagtgcagtggtcttgggggacggggctggagggacgactagagttgaggaagtgccaacctga

SEQ ID NO: 7968 - DNA, 1167 bp, Chlorella protothecoides
atgtttgttcccccaacctgcctaaaccccttcccccctgcagctgagggacgcgatctacacggccatccgcctgccgctggaggaccgtgccgcgcggcacgagaagcactggaagtatgtgagcagccacaccgtgcagtactgggccaaggcgagtttggggatggaggggggaaaaaggggcctgcggctctccgcctggccatgccttgtcaggagggtagtggtgtccttcttgactcagcatgcatgcctggttatgcctcgctcccctttgcctcgctgctcagctctgttgatttcccacccatcgccctgcagtcgtacctggcggacttccagcgcttcaccaaggaccatgcccggctgcagtgcttcgacctgggctttgcactcaacaccttccgcatggtgcgcgtggccctgacctccaacttccggaagctgccgaccgacaccctgcttaagacgtacagccggtccggaaagcgcgtcttcctgctggaccacgatggcacgctggtgccccagggtgagtccagcagccgacccggcgacgcggtgctgcgggtgctgcagggcctcaccgccaaccccgccaacaccgtctacgtcatctccggccgcgcccgcaccgagctggagtccttcttcagcggcgtgtcgcgattgggcctggcggcggagcacggtttctactggcgcccccccgggtcggaggcgtggtccacccaggaccccgaggcgcgcttcgactggcgtgacattgtcctgcccatcctgcaggtttacaaggagtccacagacggctcctacattgaggccaaggagagtgcgctggtgtggcactaccacgacgccgaccccgactttggcagctggcaggccaaggagctgctggaccacctggagggggtgctcagcaacgagcccatcgaggtggtgccggggcagtctatcgtagaggtgaagccgcagggcgtgtcgaaagggcgggtggtcgagcgcgtgctccacgatgcgttggagagcggggaggctccggattttgtgctctgcatcggcaacgaccgatccggtgaggggactggggagagggggagaggggggggagggggggaccctggggagaggagacactggtggagagcctcctggtcatga

SEQ ID NO: 7969 - DNA, 654 bp, Chlorella protothecoides
atgcccgcgcacagccccttcaagaccatacacattccccagcaccttcaagctccttcccgcttccaccaccacatcccctcccccccccccaaacataggtatggcctgtactttggcatcctgacccgtgacgcggccgaggtggccagcgaccgaatggcagtgggactgggccagcgccgccgcctggcggtgtcggtgcgcagctgcggcatctgcgccggcgagctagaggacgcgctcggcccggcggcggcgccgacggctgcggcggctggcagcggcgccctgggcgtcgcgggggcaggacgcagcacggtgcagctgtcctgcaagcacctcttccactccgactgcatccgggggtggaccatcgtggggaagaaagacacctgccccacctgccacgagaaggtggacctgaggaaactgtacgcctccaggccctgggagagcaccaacatgacgcagatgctggacctcatccgcttcttcgtggtgtggaaccccgtcatcctcaccggcctgcactttgtcttccactggacggggctggaggacagcctggaccagcccggtttcgaccccgcccagccctggaacggcacggcggtgggtctcaatgccacggccaacgtgacgctgggatga

SEQ ID NO: 7970 - DNA, 384 bp, Chlorella protothecoides
atggccgtcttcctgctgatcggcaagacctccgccctgaccatgaacatcggtggtgtggtcaaggactggatgctgatcgggctgagctactgggtgtacgcgtcggcggtgacccagctcaacctcatcggctacctgctcgccttcctggcagtttgctggtacaactacaccaagttccaatcggaaaggggtgggaaagacgtaccatatgctcagcagccagagaatgcgatcccgctcgccctcccttcccatgacgcacagatgaaggccaaggctgcgatggacatcagcaagccggagcccccaatcccggaaacggtgccgctcaagtcgatcggcatgcgctcgcccaccagcgcacaccgtgctgcctga

SEQ ID NO: 7971 - DNA, 258 bp, Chlorella protothecoides
atggcggaagcggctggtgctacggtggcggcacgcatcatcacggcctacagctatgtgggcctctggatcggcctcagcggggcggtcatcatgttcaacaagtacctcctggcgtacgccgggctgcccgggtgtccctcagccccacctcgagcccacacaacacccctggcacaggcacatgttcttctgcgccaccctggccatcggcctggtcaagtctggaaaggtggccgccatcaacatggatcgtga

SEQ ID NO: 7972 - DNA, 687 bp, Chlorella protothecoides
atgtcccccaacccaccaccctcccaggtatttgccaacaagctggtggaggtgctgggctcgctggaggatgacttcgtgtggatccacgactaccacctgctggtgctgccctccctgcttcgcaagcgcttccaccgcatcaagtgcggcatcttcctgcactcccccttcccctcctcggagatcttccgtactttcccgcgccgcgaggaggtcatgcgcgccatgctcaacgccgacatcatcggcttccacacctttgactatgcgcggcacttcctctcctgctgctcgcggatgctggggctggagcacaagaccaaccgcggcgccatcctcatcgactactatggccgcgacgtttgcataaagatcatgcccaccggcatcaagccggagcgactcctcgccgccttcgactggtcggataccctgtggcgccgcggagagctctgcgcgcagtttgagggcaagacagtgctcatgggcatcgacgacatggatgtcttcaagggcatcgagctgaagctgcaggccttcgagcaggtgctgatccaccacgccgagtggcgcggccgcctggtcctcgtccaggtcacctccgctgccaggttagcattctgcctgttggtgggagaagggaatgggggaaggtgtggtgtttatccacaacaggtcccctga

SEQ ID NO: 7973 - DNA, 810 bp, Chlorella protothecoides
  modified_base (291)..(300): a, c, t, g, unknown or other
  modified_base (357)..(366): a, c, t, g, unknown or other
gctgccgccaccgcgcgcgcggcggccgcgggcggcggcctcagcgcgctcgcgcggtcggggccggagggcgcgggcctcatggagctgtaccgcctgagcgcggaggtgaaggggccggcggtgcaggagtacgtcggcacactgctggacggcggcaccaagttcctggcctttgcgcaccacacctgcatgctggatgccatcgagcatgaatgcaaccgccgcaaggggctcaggggatcgcgtacacgaagaacgagcaaggagaaacgtccaagggcatgttgnnnnnnnnnngtgaacaagagagaatgcatgagggcgggcacccaaccgcttgggatccaccgtgcnnnnnnnnnntgcctttctagcgctcaggagggtttccgcaaaaaggcacccaaccgcttgggatccaccgtgccctttccgcaccacgctgagatgatttgtgaggcaaggcacggtatcagtcatgcgcctgccctctacagatatcatcaaagcacatccccagccgcccgcgctgcccgcaggttcatccggatcgacgggtccactcagacctcggaccggcagcgcctggtaaattctttccaggagaacgctgacgtgcaggtcgccatcctttccatcaaggccgccggcgtgggcctgacgctcacggtgaggggtggcgaggggctgggaggcaacgtcatcatggccaaggattggttggggaggagccagagacgtccccggacaccaggagcgccggcgcctcccttcggtgtccggtgggcgcttgtgccggagccatga

SEQ ID NO: 7974 - DNA, 486 bp, Chlorella protothecoides
atgagatttgcagtgagcggggccgacgccgccgccgcacgcgtggggaccgccagtgtggctcccctggattgggcggacgctgctgcctacgcgtcactggggcccccattcccgttcctactggcggctgactgcatctatgccgagggcgcagtgccccacttcctcgcgacgctcctggccctgacggtaccctcctcccgtatcctcgtcaccaacgaattccggtcggcctcagtccacgccgcgtttctggcggggtgcgagggtgtgttcaccctgcgcagagtccccgtctccaagctggaccctgcctatgagcaccccgccatccacatctacgctctgtcgagggcacggcaggcgtcgcgcgacatcagcttctggcaaagcgtgggtgcgtacatcgggagtgcgagaggcaccggctgggcggagtggccgtcatggtgcgacggccatgacggcgtgacaggacaatga

SEQ ID NO: 7975 - DNA, 738 bp, Chlorella protothecoides
atgcctctcgaggaacggtggaacactcacttcagcaccagtgttgagcaagagctgtttggccaaaagtctggactctttcactttcatgttctcgccctgtcatcatccggacttctacgctcgccaccccgccagcaactgaaggaggtcctccctcctctcagggtcagattgacctttgcacaggacccaaactccgaaaaccttggcaccaccgtctgggatgcctccatcgtactagcaaaattccttgaaaagcaggcatgcctgtggagcagagcatgggtccatttcttgccgcaccccgatcctgctcccagcttggtgctgagaagtgttcacaatctgccttctgctgtgtgtcactccacccctccctggcaagcgctgcctggagctgggggccggcatgggcctcgcaggcgcggcgatggctctgatgggggcccatgtgaccttcacggacttggagtcggtgctgccactcctgcgccagaacgtgcagaacaacctgacgccatcggccttgagacgtgggtcctggaggggtgcagtggggatgggacaatagctgcccagcatggaatagtgctgctgggaaagtgcgggaacagctgggcgaggcgatgctacgagtcagccgggcgccttgggcaggcactcggtcccgctcatgcccttgtggatgcaagggcgcattgctgcccccccatgccccgcaaagaccatgtgtga

SEQ ID NO: 7976 - DNA, 1347 bp, Chlorella protothecoides
atgcagctccaaagggcatgtgcatgggtgcatttcgaggactgctccatcgggaagaaagaagagaggagcttgaggttgccctccgttacccagtgcgatcggcgaaggcagcacccaacgagagctaccaccatctccgtggtcactttgttccaagactcgtcacatcaagccacttcgggtacatcgccctgcgtcctctgtctggagaccccagctcggaccccaggatccatcacgctggagagcggcgccccatttcccggcgggcgaggcccgccgggccctgctggctatggtcctcctccaggcggtgcccccccgcccggacattaccaccccccgggtcccccccaccatggaggaccgggctaccccccaccaggtggctatgggcccgggcccgggtatgggtacgacggccctcctgcctatgaaccaggcccaccccccttcaggggcatgggagggatgccatctagctttttcgcctgcgtcaaactgcgggggttgccgtttggggtgcaagaggctgaagtgggaatgttcctgcgccgcatggatgcattgctgggaggcttggctgctggtctttgcagtgtgatcagcgagagtgccggtctgccctcgcatccgtccgcacttggcccagccacgggcctggacaccattgacatcctgctggtgcgcaacaacggccgcgccacgggcgaggcctttgtcgtgctggtgcaccccgcggaaatggagggcgctatgcgcaagcacaaggcctacatgggctcgcgctacatcgaggtgctggaggcgcgcaagcccgactactacaacgcggtgtgcagcacgtttggcggcggcggtggcggctacggcggccaccacggtggcggcggcggcttccgcgggaggagcaggagcaggtcccccccacccggctcggagcgccccgccccgccgcccaccaccatcgtgaagctgcgcggcctgcccttctccgcctccgtcgacgacatcgccgccttcttcgccgatcccaccatcggcctgctggcacccaaccccgaaaagtgcgcgcaaggggtggacaggttacctgcatgggcgaaagatgcgtgcgctgggtgccggaggggcggagcaggattgcactgtgccctcttaggcgcttgggtcactattgctgtggcggccgacggccggcccaatgggatgggcttcgtggagtttgagagccccgaggcggcggcggcggcccagaccaagcaccgccagatgatgggcacgaggtacgtggagatcttcgcttcatctgccgaggagcgggcccggtatgtacctctttga

SEQ ID NO: 7977 - DNA, 1884 bp, Chlorella protothecoides
atgcaactctgcgcacccctccctgcacagttgagggcggtgtgcaggctggtggccttcacaccgcgacacatctcgagcttccactccagctcccggtgccaccgaccacgagagggcccggtagccgatgccaaaggtcgcaggggaatggctgagctcatgaggatggagaaggaagaggaggagcaggcaattccaggtgatggatcggggggtgagctaggaggcaagctctttctgacttcaagctacgacccaccgtcgccaccccctctcaccgaccagcagacgcacccctgctgtggaatgcgccactccaagtcatcaagtaccccgacccgcgcctcagggctggcaacgccacgatcacgaggtttgacgatacactccgtgcctttgccaaggacatgttcgacgctatgtatgagtgagtcggcgcgggtcgggcatggggttgcagtagaacgcttcagagcgaatcagtcccattgctggattgcgagggggcggctcactgttggcccgcatggaacgggagcgagcgggccccccccttcctccccttcctgcagtgatgaaggcgtgggtttggctgcgcctcaagtgggggtgaacatccgcctcatggtgttcaacgaaatgggcaagagaggtgcgacctcgccggcattaggggttgggagttgggttgttgtagtaggggcacggaggcccctttcactgaggaggttgggctggcaagcccgacttcttccactattcctttcttccccaacccctcgtttttcaatcttaggcgaaggtgaggaggtggtgctggttaaccccgagatcattagctatggcaagacgcaggacctgtttgaagagggctgcctctccttccccgaactctatggcaacgtggaggtgcgcggggccaaacgatacgtgatccctggagcttggggggagcgaccgacaaaggtgaccatccgtgcgcacgacgagtttggcaagcgcttcaagctgacgctgtccggctggccggcgcgcatcttccagcacgagtacgaccatctccaggtgagtggggccagccggcacagaagcatcccgtggagggcaggctgcgcacctgctgacagccgagcgcccagcctgtccacgacccaccccaccacgaaggtccattcactcgttcgccccccgcccccgttcacgcccccttgccaccagggcaccctgctgccggaccgcatgcagccagaggtacgggaaaacattgccgccgggctggaggctctgccacagccggctgggtcgtgttcagccgggagcgaaaaggcaaagagccgccagtcagcggggggcggtggtgatttggtggtgtgggaatggggaagaagagggggtaaaagagggaagggagtggagagggggcctttcagggttgcgggtgagggggctcaggttgtgcgttcccgggccgtcgcacgggggacggcaggcagggaaaaaagagagaggggtagtatccggaatgagcgagcccttggggctgtcgaaaagcatgggctggagttggggtggcatgtctggtcttgggccggccccgcggcaatgcccacccagattgtgcagacaggaagacattgcagtgggcgggctgtcagtgcggcaggcgagcagacagccaggccgtcagggtcgacactggggctggatctgtcggcatccaggcttctgcacacaggccgcgcacatcgggagcaatgttggccgcgccggcgcaggcgacccggccgtcgacgccgctcaggcggccgagctgttggtcagcccgctgccggccggcgcggcgcccacgctgagcgcgcggcgcgcatccaggcccgcccc

SEQ ID NO: 7978 - DNA, 360 bp, Chlorella protothecoides
atgcacaccacaggctccctgagcttctattcggagaggtacgcggtctcacagcccgttcgccaacccctgccgcccagggtgcagagcacgcagggcagccccatcgcgtccggcttcctggtggctgccgcctttgcagcgggcctctgggcggtgctgagtgcgctcctggtgcgcaaccatggccgcacggcgtacgcgcccgagagccgcctcacgctcctcgccctgtggcccctcctgctcctcacctcaccgtccttccgtggccagtttgcgagggcggtgggatggacagatgtgggcagccccactgcctccacacatgacagccctctccgcgaggatgaggcctga

SEQ ID NO: 7979 - DNA, 240 bp, Chlorella protothecoides
atgtgcggctacgcgctcctggtctacctctggcgtaccaaccagatcgccagcagggccctcagctacatcgacgaccggaggggcccccgcgccctggcttggctggtggtggcggccctcggcgccatcatgaccctgggcatcgtcgacctggtggaggagatcgaggcctcgcggggcggctcgccgccgcccctcgctgccgccgccgccgtgcggcggctgctgggcgcctag

SEQ ID NO: 7980 - DNA, 699 bp, Chlorella protothecoides
atgcgggtgacctggctgacacagttcgagggcgctccctttgtgaggtacggtctggccgaggacgagctggatgcccaggtgcccgccaacgtgaccacctacaccgcggccgacctgtgcggtgccccggccaactccaccggctggaaggcaccgggaacgatcaacagcggcgtgatggccgacctggagcccaacacccgctactactacgtcgtcggggacgaggagcgctgcgcaggcacgtcctccctgcggcctcccgagcactatctccaggggcgtcggagtgtggtctctgggagagtgacgcgcctgttcttgtgggagttgttggcccgagccaatccttggactcggccgagcagcccctcaccctgcaaccctcctcaccccctcccgcaggctgccaacacgaccagcaccgtcagctccttcatcagcgccccaggccccgatgacaccgtgaagctgctggcctttgcggatgtggggcagtacaacgaggacgggaccaagggctttgggtactggtatgacacctacggcctgtttgacgaggtctatgccatcggcaccctgcagtacactgtgagtgctgctgtggcgagaccagggttggtcatgaggggggaggctggtatggggagacaggtgccccaggggagtaggatcgacccggggccatgggtgtga

SEQ ID NO: 7981 - DNA, 372 bp, Chlorella protothecoides
atggcgggccccggcggcggcgcgagcgcggagcgcgagctgcgccacccgctgctcggcgacgcccccacgctgcgcctgatgcccggcggatcggggcggcgtctcgacgaccccgagccctctggcctgctggactggtggttccgcaagccgcccatggcggagcacaaggcgctgccccccggcacgctgccggagaggatggagcccaagacctactttgccaatgagcgcaccttcctcgcctggctgcacatggcggtgaccatcgggtccatcgccaccgccctgctggggtactcgggagccacgcagagcgcgaagcaccccgaggagggcagccagattgctttccaggcggggcattga

SEQ ID NO: 7982 - DNA, 1464 bp, Chlorella protothecoides
  modified_base (22)..(31): a, c, t, g, unknown or other
  modified_base (339)..(348): a, c, t, g, unknown or other
  modified_base (1196)..(1205): a, c, t, g, unknown or other
atggctccgcaacgcctgtcgnnnnnnnnnnggtttccagaagatgaaagccggggagattttgagggaataaatggctccgcaacgcctatctgccatgcagaattgcgcggtcaagtacacaattacggcatattatgtcagaaagatgatctgctggttctcctgcctgtaatattgcctcatctgacgacacgtggtcgtgacatccggcggaaaacctacaacgcaggctccaaccaaacttccgagaacgatggactgtccgtcagaggagaccgcattagccgcaggtggataccggatggcacttgctgtgctttcccttctcgacgtatnnnnnnnnnnggaaaacctacaacgcaggctccaaccaaatttccgagaacgatggacggtctgtcagaggagaccgcatttgccgcaggtggataccggataacacttgttgtgctttcccttctcgacgtacaaggggcaagtgcattcggagctggggaagaccgcggcggcccagggcccacccacgtgcgattttcatccgtgggatatagagttccagggtcgaagagaaggccaggtcagggttgcccaagtatgctccggccggggttctcggggcctttccattgcaaaccgaaacatcggtttgggtcaccatggcgcaaaacgtggctgtcaggggttgcagactcgtccaaagggcgtcaaccctaccgcggacggcgcgtatccgtccgcggagaatcaaggtgcacgcatgtctctcactcccccaccacgcggtactgtgcaggggaggtaggcgtaaaggtagcagatggcggggctgaggaccaggaggtcgacttcaagaaagtcagccaggtggaggctttcgagatcctcaaggtacgcagggcacacatgccgtcctcgatgatgggaccgaggttcacccggtgcgcatccagttctccacccagctccgccaacccccggcggaccccgcacatcccaccccgcgtccccccgcctcgccctcccgcagtgcaccccccacggcatcacctccgcggagtgcccagacgcgcacaccccggcagcgggtgggggtccttgggaggtctacctgtcctacatgtggaaccccctgtcctgggccatggaggcagctgccatcatcgccatcgccctgctcgactatgccgattttnnnnnnnnnngaaccccctgtcctgggccatggaggcagcggccatcatcgctatcgccctgctggactatgccgatttcgcgctgatcgtcgcgctcctgctggtcaactccaccatctcctacgtggaggaggccaatgccgacaaggccatcaaggccctcgccagtggtgagcttttgtggttttgggggagggatagagagggacgaggggccagcccatgccctcccacatggcaaccacccgcccttgccttgatgccctag

SEQ ID NO: 7983 - DNA, 330 bp, Chlorella protothecoides
atggtcctgagcctgtatgttgagcagggcaccacccttactcctcgctggcttcacacccgtgcaacactgcccccgacatgtcgccaggacccgcacttcaaggccgccaaccaccgccgacgcatcatccagacaaccctcctggcggagtacgccttcatcatggcaccgggtggcatcctctacaccatcacggatgtggaggaactgggcatctggatggtgggccggctgggtgatggagcccttgggtggggtaggagttgcatgcatgagggaggcctccttggtggagacggcccccggagatcctcatgcacatcgtag

SEQ ID NO: 7984 - DNA, 291 bp, Chlorella protothecoides
atgcgtgagggaggcctccttggcggagacggccccccggagatcctcatgcccatcatggcagccggaagcggcacgaaggagaagctggatgcgcacccgctcttcgaggcggtgcccgagaaggagaagctggatgtgcacccgctcttcgaggcggtgcctgaggaggaggtggagcgggaccccgcggcagccctgctcctccaaggcacggaggagggtcagaaggtggctcgcaatggcgggaagacctggcgagccgtgtaccggcggatacaggacacgtga

SEQ ID NO: 7985 - DNA, 1107 bp, Chlorella protothecoides
atggcgctgctggagaagctgctgaataggttactacctgcggggcacaagacgctgatcttctcccagatgacgtccatgctggacgtgctttccagctacctggaggcgcgcgacatcaagcactgccgcctggatgggtccgtgtcctggcaggaccgccaggaggccatgaagggggccagacattgtctgatcaccctgatcgtcccatgtgctacctgcgatgcacctaccccacccactcatccgccccaaccccccaacacacagctcttcacgtccgaccccgagcacaaggtgttcctgctttccacccgcgccggcggcctgggcatcaacctgacggcggcggacacctgcatcatctatgactcggactggaacccgcagcaggacctgcaggccatggaccgctgccaccgcatcggccagcgctcgccggtgctggtcctgcgcctggccagcgcgcgcagcgtggagggcaagctgctggagcgcgccgcgcgcaagctgcagctggagcgcatggtgatcaagtcgggcgccttcctgcacgccgacgacgctgcggcggggagcatgagcaaggaggagctgctggacgtcatctcgggcgccgggagcggcgagcacgacctggcgcagtcgggtgacatcagcaacgaggtcagtgggtggggatgggggagtgtggtgctgaatcatcaagaaaggtgggggggtcctaggtggggtagggtgtggtgcgccgggtgctgcgccggggctcgcatgtgggaggttggagagctgccccggattccctggtgccctgcgcagcagcaagcaatctccctccgccatgtgcatcgcaatggccgcccccccccccatgcccctggtttgccatcatgcacccctcaccctccatcacatctattcatgcctggccttacacagaggaagcgcacctccccttccccattctgctgccaggtgctggaccagctgctggaccggagccacctggaggcaggatcaaagcggccgtaccccgaccggggggtcggatacgaggtcgtgcaccagctgagtggcagcgggctgctggcgggcgtggagtag

SEQ ID NO: 7986 - DNA, 579 bp, Chlorella protothecoides
atgtcggttgccacgaagagtaaaacacgatcgcctggccatccccatccctccccaggctgtagaaccccggccaggaccgacctcccggtctgggactgcaagatgaagaaggtgtgcgccgtggccgacaacgagaacgtgctgtacggctggggcaagaacgcgccggcggtgaccctgcccgagggcaccggcttcgcggtgggccccggctctgccatccgctccttcgtcctgcaggtgcactaccgcctgccccgccccgcacatgacgcctcgggcctgcgcatgcagttcagccggcaggcgaccccgcgcagcgcgggcatgctggcctacgccgcgcgcttcaccatcccgccgcgtcagcaaagtcacctggtgcccaactcctgctgctattccgggttcgagcccatgcgcggcatcgccgcgcgcgtccacacccacaccatgggcaggtgtgtggggagccgtgttggggcacatgccatggcagcgtggcggcacgggcctgcgagccccttggcagagtgcaggcgcaccagccggccgcatgtcgtgacgccactctga

SEQ ID NO: 7987 - DNA, 432 bp, Chlorella protothecoides
gcggcggcgggcgcggcgctggccgccgaccctgacaacgaccacgctcaccacctgctggggcgctggcactacgagatggcgcgggtgaaccccacgctgcgtgcgctggggcgcatggcctacggctcggcgctggtggccggcagccgcgaggccgcgctggaggcctacctgcgtgcggcggcgctgcacccgggccgcctgatccaccgcgtggagtgcgggcgcgtgctgctggacctggggcggcgggaggaggcacggggccaccttcgcgccgctctggcctgcgaggcggaggacctgaacgcgtggcactcgctcaaggacgcgcggcgcatgttggcgcagctggatggcgcggcgccggctcccgagggagggttggcgctgggtgccggccccgcggccgtcccggtgcaggcatag

SEQ ID NO: 7988 - DNA, 1455 bp, Chlorella protothecoides
atgtgcaacctctacctgctggtcgacgcgcacgtgcccgccttccagtggtgcgccgacagctccagctacgtcgcggcctctccccccggcgcgctccccgtcggcgcggaggcggtggccgaggaggcacactggcgcccgcccgccgacctgggccagggcgccggcgtggcggccgacgggcgcgggcgcgtgtacgcctttggccgcgtggggcgcgtctgggacgccgacgcctttgaccccgccacgcacctgctgcggaggggcgacgtgcctatccccggagcccccctggccatcctggacgccgactccggcgcagcgtcagcccccggctggggcgccggcgccttcctcatgccgcacggcgccagcctggcgccggacggcacgctgtggctcaccgacgtcggcgcgcaccaggcgctgcacttcacgccggagggcgcgcggctgggcgcgctgggcgagcgcggcgtgccgggcgacggcaccggcgcggcgctgtgccagcccacgcacgtcgccgtttcgcgcgacggcaccgtctactgctccggcgccgtgcacgtcgccgaccgcgaggccggcgcgggccccggcgccgccacctggctgctggcgctggcagccgctccggggcgcgtcgccgccgcctggcgcctgccgggcctgcgcgcgccgcatgactttgcgctgctcccgctcccgcttgcggtcacgctgccgggggagcgcagcctgggcgtcgtggtcgccgaggccgcggcggagggctcccgcctggtcaagtttgccttccgcgccgcgccggacaacggcacggagcctgtggttcacgacgcccggcccctgcccactgcgctcgaggtggccagccactccggcgccgccgcgggccacgcccagggcaccgacgccgacggcatgatcatcatccccccggccgtcgcccagccgcctgtccggggcgcaaacggcacggcgggcgcggatccttctgagcgacgccgcgacaacccctttctgaagaggtctgagccgcagcgcgacggcatcgtgctgctccccgaccaggccgcagcgggcgtggacaagccggtgatggtgacggcacaggcggcacgtgaccggggtggcttcgaggcggatgccgaagagcagggggcagaggtggcggatgccaaaacccaagccgcaggcgtcgacccagaggccttggcgcacagcaaaactggagcccagagggcggcgtccacaactggagcccagagggcggcgtcgtggctcgccctaccgcccgctccagccctgggcggcggcagcctgctggccttcatcgccggggcctctattgcagtggtgggggtgctgggctggcagtcggggtgctggggcgccgccttccgccggcgatcgtcctccccacgccgctacgtcgccgtatag

SEQ ID NO: 7989 - DNA, 1071 bp, Chlorella protothecoides
atgtccatgtcggtaatgagtcccatgctgaccaccagcctctcctccaccatgatgcccaagacagccgcgttccggcccgcgacacagatgcctcgcggcttgaggtgtcctagtcgctccatccgcgctcaggcgagcggagaggagaagaagtcgtggatcgaccgacttgcagtcccgtctgctgcgctgctcggcgctgccttgctgctcacggcgacgcccgacgccgcggaggctgccaggagtggtggaagagtgggaggcagcagcttctcgtcccgccgggccgccccggctccgagcaggcctagccccggccccagccggcagtacaatagctataacacgtatgtcgcaccacccctgggtggcggcatcggcatgggcatgcccttctttggtggcggctatggcatgcccttctatggaggcggcatcggcgtcttccctagctttgggatctctggcatcttcaacatcttcctcatcttcatgctggcaaacgtggccatctccgtgatcaggaacttcacgaatggcaacggcggcaacaacaactccaagggagacgaggactcctgggatgataagtgatatccaggtttggatgtaaaatctcacaaatggaggcagggaggtgcgtccctgtcgtgggatgagtgtaacacagtacgctcggtggctgggaagcatgctgaacctgacggggtgccatcggggcgctttcagcagagtacatcgtgcgatgcgcccattctcttctatatcgaaagaatcgtacgagtctcaggtagctttcattgtggaggccacggctggaaagaggtgtggcccaaagacaagcctcaaccatgcttcattgatttcgctccagcagcggtgctttacacttgtaactcgcggatccgcctctctccacaggtggatgccctgaatgagaagtttgcagaggcacgggacgagatcgagtacgcccaggaggatgcagagacggtgcgccatgggtccctccccacccctgactggtctacccgatcaggatcaccaccgttccacgtcaaatga

SEQ ID NO: 7990 - DNA, 2217 bp, Chlorella protothecoides
  modified_base (839)..(848): a, c, t, g, unknown or other
atgcgggtctcacacagtttcgttgaacgatttggctcggaagcctctggcaggatttgtgcgcctcataaaaatcttgtttgtagtcacgtgggtagccctcgaccctggatccattctgaacgctaccaaactccggtcagctccctgtttgcccagcctgcgagtcacagtagggtgtgcatggattacacagcagcacaatgctgccgatcagatgcatgccgtaggttgtactcggtcattggcatcactcaggtgcaggtacaccaccagaaccctgctctcgacgccacaccttgcgcaggcagcaatgtgggtcaccgccttggccttcgtcgcctgccatggatctggtggccattgttgcatcacgcaatactaagcgaccgtttgatacttcatgacaaggactggaaaggaatgggcgtcatacatgcccatacaggatcaatgcagtgtctagtttctgagggtgattgtgatgggcaggtgcctgtctgctggcttgagcaagggtccccggcaggtcggatgtggtccagcacgcgccctcacgaagacgcccgcatggccccggaacgcatcgccttcgtgctcatagatggcctgggtgacgtcaacgaagcagggctggggggccggacaccattgcaagcagcccacaccccattcctcgatgccatcgccggtgcccgtttgctggcttcagcaagggtcgccggcaggttggatgtggtccagcacgcgccctcacgaagccgcccgataatatatcgaggacgcactgcatctcgatgtcactcatcgtacaattcccactttcccaccccacaatnnnnnnnnnngacaccacaccaccctccacccacccagcatggtggcccctgctcttggccgcctcgccccatcccccggctgcatcccactcccccctccctttccatcaacgcagcggcggggctgaatggcttgatggacccggtggccccgggcctggcatgcggctccgacaccgcccacctttccctgctaggtcatgatccccgcgcctgctaccgcggtcgcggcgcgttcgaaagcctgggggccggcctgctcatggaccccggggacatcgccttcaaggccaattttgcgacgctggacccggccagcggcatcgtgctgcgccgccgcgccgaccgccgcttcgaggccgaggggcctgtcctctgcgccgcgctggacggcttgcccatccccggcttcccggagctcggcctgcgcgtgcgctacgccaccgagcaccgggcgggggtggtcatcgccgggccgggcctgacggacgccatcaccggcaccgacccgcttcgggacggtctgcccctgctggacccggcccctgtggaggaggagcgaggggggtatggcgagcaaggaaacggggcggcagacggctctggagtggaggccggtggcggccagggcaccgatgcagagggcaacatgggggggccgcccggcgatgagccggcaggccctcggaaggagaggccccctcccagcgctcgcagcgccgcgcgctacagcgcggcagccaccagagccgccagcgatgcgatgcgtgcggcgctggcccgccacccggtcaacgcggagcgtgtctcacgcggcctccctcccgccaacgtcgtgctcctgcgcggctgcggggcgcgcctggcgctgccggccttccccgcgcggcacggcctgcgcggcggcgtggcggcgcccacgcgcatcatccgcggcctggccctgaccctgggcatggccgcgctggacgtgccggggggcaccggggactaccacaccgcgctgcacgccaaggcgcaggcggtcgccgccgcgctttccgcccaccgcctggacttgggcttcctgcatgtgaaggcggtggacgacgcggggcacgacggcagcgccgcacacaaagccgcgctgctgggcgccgtggacgccatggtcgggcagctgctggcgcgcctggcgcgcgcccggctggacagcggggaggaaggaggtgtcggcggtgcgtgggcgtgtgtgcgggagggctgcagattagaccagctcaagggggaccgcatgccttactgcttgtctatgtccttccctgccgccgcctccctgccatccgatgttccccccgtccaacggcaccctgcccagcagagtataccatcgtggtga

SEQ ID NO: 7991 - DNA, 489 bp, Chlorella protothecoides
atggatcactcctgcgagccggtgccggtcgccatcgcccaccttcgacacgtgggttcaacgaccgtttccagctgctcctacatcagtcgctcagtgcttctagggcgtgtgcctggacacatgcaggtgcaaagactgggaggagcagaggcgctgctggacatcccgctggagcccatcaccctgccacccgttccgggagaagagagcggggaggagagcgccggcccgactctcccagcctcccttgaacccaggctgcaagcccagccacaaaaaccgccatcctccccacaccaggagatgggaaagccctcatctgcgcagaccttcggggacagcgtctcctcgtttgatgagtcggccgctggcgctggaggcctgggccgtttccctgggtcacagctcatgcccctcatcaagcactttgctgggtggggcccttccccccaggacacggcgagggcaagacgacgggaggagtga

SEQ ID NO: 7992 - DNA, 1050 bp, Chlorella protothecoides
  modified_base (853)..(862): a, c, t, g, unknown or other
atggaggggagttcgtcggggctgtatggagggtgggaccgaccatcgctgctttcctcagctctttatgaagtcgcggatgtatgtgcggtcaggcctgtgatgctcggatcatgtaacgtggaagtaagtcgcagcgacgtggcgaggtgtctagaaatgtcgagcatgtacggacacattctagaacttcccggccccagcgagtatataggagagcgcactcggacattcttgtcaagccaaaaagcgatcgatattcccattgccaagccccccaaccgagcattttcaagagcaatcgcgcacagcaccatgagcctgatcccattcgccctggaccccttcttcggggacgacttcttccaccccctgcgcagcagccgtgctctgactacatctggaccccagctggctcgcggcgtggccatcgatgtctcggaggacaagagcaagttcttgatcaaggccgacatccctggagtgaacaaggaggatatcaaggtcacaaccgagggcgataccctgtcactgagtgtagagaagacagaggagaagaaggaggaggaccctgagaccaagttccacagattcgagcgctcgacctcctttgtctctcgatctgtacgcctgcccaagaatgcagacctggcagccatcaaggcgaactacaaggatggtgtgctcagccttgagccatgcgcagttgtccacatgatcaggccttttccacctcttggcggaagttgtccctccctggttaaggcgagcaagcctgcgggcgagcctcagggtgcgagcggaggtgacgaaagcatgcatggctcacctgagcagtgcaccgacaaaagannnnnnnnnncagagccctccatggttaagacgagcaagcctgcgggcgaggcccagagcgcgagcggggctgatgaaagcatgcagggctcacctgagcagtgcaccgacaaaagactccagcaagagtcgaaattgttctcaataaactttaattaccctgtgatctccgccatctacaagcgaatagaatcttga

SEQ ID NO: 7993 - DNA, 1530 bp, Chlorella protothecoides
atgcagatctgggtgggatggactgcgtccatattcgcggggtactacatcttcaaacttcgactcgcagacggggcgacgtggtgtggttggatcacccttaagcaagcattatctctgaacattagctctgaagtcggcctgactggaggcattgaatcatgccatcctgccctctcgatgcctgccaagccttcgcgactgttgcaggccgagttcttgcgcctcgtcggaaaaggtcgcggaaacctggtcctcccagatctcctccgcctccgatgctatgatgccgggtctctgtgtgggcactccttcgcggggttggagctgcaggtctggggaaggggggttcacccactcgaggaggagatgcaagacccccctccagtctcatgcaagcaaggcatgatccttcctgccaccccttgccactccgcgtccagcaatcggagcggcaagttcagcttggagaaattggcccgctttgctgccttgtgccgggagaagagctcccaattccaccattatgagctggaggcacagctgctggggtattgctgcctgcgcatgtggatggacctcacgcagtgccctggaggccagaaacgcttcacgcagtgggccaacccatctctcctccacctccaccccacctggcagggtctcaaacctgacgctggaggccagcagcgaaaggaaacgtttctggaggcacggagcggcccagtatgtgagtctgcatgccatcgaggcactgcatggcttgctccagctccaggtgaggaggagatgcattggggggggggaggggttcctcttggccctgcgtgccggtctgccgacgcaaacagcgagccggcgccgcgcctgcaaccacagcaccgcgccgtccctcctcacccgcttcgccccttgaattggcgctgtacatttgtgctgggccaggtccagcactctaaggcctcgcctcgcctcatccagcaatctaaggcctcgcctcgccttgtcaccccaccctctgctgttcaaaccacaagcacaccaaaacccacacaaggacatgcacatcaacatatttacacccaccgcacgctgcagtcgcaccaggagacctcgctgcagtcctttgtggacctgttgcagcgggtgggggaggacaagcggctgatggagctggcggaggcggggcaggacgactggatcccgctggaggtggtcagggactttgcggcgggactgtacaccggcttcgcggagctcatggccgatgtgtgccctgcccttgttgcttgcgcagcatccagaagatctctggcaccaaggataacacacacagaagacggcatatatcaaaagggcgacgtcaagacagcagagccgaaacatggtgatcaggccagtcacatatgctggcctcactcatctgcctcccgcgtgtccagaggcttctctgaatctgcggccccgactcctgcactggacgctgcagtagatgtgggtgggaggggtcagggagaatctttgtgctga

SEQ ID NO: 7994 - DNA, 939 bp, Chlorella protothecoides
  modified_base (902)..(911): a, c, t, g, unknown or other
atgagcctggcgatgacaaacgcaggacgggccatgcccggtccttcgaccacaccgcgattgaggcatgccgggctcaatgtcgcctccagacctcacccggccttccacaggtccatgccagccagatcccgtcatgtggtgcgcggcatgttcatccagtgggagggcctgatccagagtctgagggaccagggcatcgactccctgcctccccgggaggctgagcaggccgtgaagtcagggaaggccgttctcgtggatgttcgccccgccaagttccacgagcaggcccacatcccggggtccaagaacgtgcccctgttcgagtacctcacgctgtccaacctcaacggcgtgggctccgtcctcaaattcatcgccatgaaggccaatggcgtgcagcccacagtgttcaaccccgagttcctgcaaggcatcaaggccgctgcgggggaggacacgaccctgatcctgtactgcgaggccggtgggacgatggaggcctccacctccttcccctacggcaaggactcccgctccctgaaggccatttggaaggttggagccctccctcctgaggctctcgagatcaagaattggaccctgcctgtggcgcttgcccacccatcaggcccagactcaagcgcagcatcgactgataccacctcgcaggtgaccaacgacagcgtcctgccctcgcagcgggtgcagcacctggcgggcgggctctacggctggtggagggacgggcgggatgtggagggcgagtacaccggtgctgaggctggccggacccctaatgctgtgggtgagacgagggggagggtgagaggcgggcgagtgggtcgtgcttgcctagggtatgatccagccacatatggtgtagctatgcctctcgnnnnnnnnnnggcgggcgagtgggtcgtgcttgcctag

SEQ ID NO: 7995 - DNA, 3069 bp, Chlorella protothecoides
  modified_base (148)..(157): a, c, t, g, unknown or other
  modified_base (1705)..(1714): a, c, t, g, unknown or other
  modified_base (1783)..(1871): a, c, t, g, unknown or other
  modified_base (3017)..(3026): a, c, t, g, unknown or other
atgttcaacccactgccagcaaggctggatctcatgatggcgaccagagctgagatttgtggtgtcaagcaagtggcatttgattgctccggtagctttctgagccgaacctcacagggcagaggtgtgtggggctgtagttccacgnnnnnnnnnnttgtcaagcaagtggtagttgtggcgccgccaccaggcctgaccctgacatggcttgtgcgttgctggaagagacagcattgcggaccatgcagcttagtcgtggacaacctcagccttaatcacctaatatgtgctgaaagtcatgcatgtgacaatcaagaccgttgggtgtggtttgatgctcaagcacgatcccggttcaggcgtttgattgctttggtaggttttggagccgagcctcacatggcagaggctacagtgcacattgaagggctagttatggtcgaagtcctcgacaaactacggctgagactgcttagatatccgatagtatctctgagggtccaggacgaagcactgatgaagcacagtagaagattgccttttgtctccagtgaatctacattgttttcagcgaaagtttatcgcgctctccacagccacagcatatttgggtatcggtgtgattgcatgactcgtcatgaattccagattcctccatggcaggccaggctgtctcctggtgcaccctggctcccatacaagaaaagaggcgagactgctcaaggccgcacccatcaaccggcgacgtcaggtttcgtgtacggccggcctagcctcccagctccttccttgggccatatttttcagtcctggagcaggcatcttggcgtatgcggccgtgaggggcggggggaatatcaaggacggcttgagccatgtgctcacccaagtcagccaggggtactttcaaccccagggttctgggcttgggcgagcatgctcacagtggtgaccataatgcccagcatgcatgaggctgacccgagccttcaacttttccccaggtacatggacgagtttgaggcactcaaagccagcaacaatgccgtgctgcggctgagcctctgcatgcctgtgctgcctcgctgggaagtgcggattggacatgtatgcactgctgtgattgctgttggagacatcctggaaccgttcatgggcaagggcctcataccagctgactgggacacatggaaagtgaggcgcaagaagatcgttccgggtgagccgacgcccggcgaggcttgggagtggttggggtggggtgacttgacatttttggagtcttgtaatccgggtctgattcatctgagcacacctgctccccctatctgcccccacaacccgcaaggctttcacaaggcgtacctcaacgcttccatggccatgtttggacgttgcacggagcgcatgatcggcaagctggatgcccacaccgcttcggcaaatagcaacgacacggtggacatggagactgagtttctgaacctgggccttgacatcattgggttgggagtcttcaactacgagttcgggagtatcacccgcgagtcacctgtcatcaaggaaaagtcccatgacactaagcctgtgcatacatgctccgctgcaggctgtttacagtgtcttgaaggaggcggagcatcgcagcacattttatttgccgtactgggacttgcccctggcgtccctggtcgtgccccgnnnnnnnnnnaaagtcccatgacactgagcctgtgcatacatgctccactgcaggctgtttacagtgtcttgaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccaagagcgatccaagtcgcctccacatccgcaagatgtgccaacgtcgctctggacccccccccccgcagacatccaggtactgaatgagtgtctggatgagctcattgagcaggcccgcaggatcagcgagcccgaagagatcgaagcgctgcagcagcgggactacagcaaggtgttttgttgcgcgtgtcgtgcagggcatggagcgccatcgcctgatttgggaatgctccagtgtcaagcgtgcaagggggccacatgcgcgacagggttgccgaggctcctcgacgttaatccaatgccagtgcagctgcatggcgtcccatcctgcacccaccgcccaggtcaaggatgccagcctgctgcgcttccttgccgaggtggatgccgcgctgggggacagccacccaggcaagttgacatggaggtcaactgtgcgagtggcgtgaagtcaggcatggggtctttaaacgagcagtgtggttctcctgcccatgctcctggcagcgagctgggagaggagctgcctcactttaagtacacacctcaccaacccacccatccatcgtgcagacctggacgacatcgggcgtctccccaaaacacgagcagcgctggcagagtccttgcggctctacccccagccgccgattctcatcaggagcgtgacgggaagcgaaggagtatgaccccggccccgtcatccctcgcagagccctggcccctgatgtcctgccgggcggcctgtatggcgacgcagccggctaccctatcggcaagggcgccgaccttttcatctccacctggaatctgcaccgctccccccacctctgggacgaccccgaggacttcaagcccgagcgctggagcgccaagcgtgccagccccatcccggagaagtgggcgggctacgccccccttcaggcagcctccgccctgtaccccaacgaggtggcgtccgactttgccttcatcccctttggtgcggttgtttcgggggaaatgcactctggactgggtgtcatggacctggcaaaggggatttgcagcactgacaaagccgttggctgacagctgggacaggggtggcgtggtgctacccagacgttggggtggaagagtgtccctgtctagtttcannnnnnnnnnactggcaaaggggatttgcagcaacgacaaagccgttggctag

SEQ ID NO: 7996 - DNA, 1692 bp, Chlorella protothecoides
atggttgctgtgtgtcctctgactggaccagcgcgagcgacagatctccagtcactccgcccccagcccctgcccccctgccctggccagcctggggcaggggttctccttgtaccaaagtccctgaacaccagacaacacagcggcatcccaacccactcaccccaggacccagagcgcctggcccaggagcgccaggcggccgagaagaaagcgcgggagggcgggtaccgcggctactcggcggccgaggcgcgcgccggggcgggcactccccggccttcccccccgagctgggagggtccggcgtcgcccgggcgcgagggggtggaaggcggtgccggcgaggccacccccggataccccgctccggcctcctccaccccaccgcccagtgtcgcgcgggcgggggagaccaagggcgtgagcatggaggccaacgtggccaacctggaggccctgcgcgcgttgctggcccggcccgagaacgcgcggtgcggcgactgcggcgccggcggcgcgcgcccctcctgggcctccatcaacacgggcgtcttcctgtgcatgcgctgcgcaggcgtgcaccgcggccttggggtccacgtctcccaggtccggtcctgcacgctggacacatggctggcgccgcaggtggccttcatggccgccacgggcaacgccgtggccaacgcctattgggaggcgcggctggcggaccggccgccctgccactcgctcaccgacctggaggcctttgtgcggcgcaagtatgccaaaaaggagtgggcggagggggagtggccgcccgccgcggcgggggccgccgggggaggggaaggggtggacggcggcgagcgggcggcgggggccgcccccggcgggcgcgcgcccacgaagatcggcgccctgcctgggccgagcccgcggcctggcacggcgccgcgacagggtgtgcctccgcaagacctcgcccccgccgccccgccgcccgccgccgtcgtcgacctgatggactttagcgtggaaccggagccgctcggcgccgcgacaaccagcggcgaggccgattcgtcgagcgccgaccccctggccgccctgaggcagctggacttcagcgctctacccacgaccagcagcggcaccacgcctccacccagcgcctttgccgcccccttcccgggccacacccctgcgccggcgccagacctgtttgaccagctggccagcggcggcaagtcgggccgcctgggcggggtggcgggggcgacgtcctgggacttcagctcggcccagggtctgacgcgcccgccgcccgagcagcgccagcccgagggccaatcgagctcaatgagggctggggctctgaacggaagccccgcccctcaagtgaacggcgcatctcctgcggcacgccgacagcaggacgccgacggctccgtgccggcgcagcagcccacacccgcgcccggcgggcaggctcggcggccgcggctggagctgccgcaggcgggctgctcgccagcgcccaagcccgcacgtgacgcccggatcgaggcgatgctgcagtctgggctggacgacttcctgctggcttccgcgagggtggcggcccagccgtgtgcggcgctgacgccggggggcagggccgacccgtccccggccatgagggccccgcgcacgcagtggcagtga

SEQ ID NO: 7997 - DNA, 498 bp, Chlorella protothecoides
atgccgtcacgcgcagtgtgcgacccggtgcagggtgacaacggccagctgtacgtgtctccagacctcccacccgcattccggagcgagttgacgcccatcgccaccatcatgacgcccaaccagctggaggcagagctgctgacggagcgcagcatcggcagcgtgcaggaggccctggacgcctgtgcccagctccaccgcctggggccccatacgggacctcagagcctctcccaccagctgcaactggggttgccccagcacccggctggcagccagaaccaacccttccacccagcactccccttcccttgcacccacgaccaggtgataaccagcttggacttggaaccagaccacgtgaccgtgctcgcgagcacgacgcagcctcaggcagagggcgcgctttccacctttcgtatcctggtgccgcgggtgcaggcctacgtcaccggcacaggcgagctggggggggatgagtacagggtgaagtga

SEQ ID NO: 7998 - DNA, 420 bp, Chlorella protothecoides
atggttacatctcccggccccggcgcctcattgtccggcacggtgaccgaggcggccaaggacgctggtgcctggctgagggactacgtgacggccatcaagaatgggaggtgggtgcccgcctcgcgcaacctgtccctacgcgtcggggggggttggctcgtcgggcccctgaccagctcactcactccctcgcacccctccatcaggtggcaccccttcaatgccacggagagggcggctagagcagctactcgcaatgagccatggggccccacaggcacccagatgacgggtctggcccggctctcacacaacagtgccaccgacgaggccatcatcctggcagtgctggagctgcgcctccggtaccccgccgaacgatggaggaatgtgtacaaggtacatgcccagggatga

SEQ ID NO: 7999 - DNA, 567 bp, Chlorella protothecoides
gggggagagcgagggagagggatgcggggtccggcggcccgcagcgctcgaagtgcatgatcgcttgccctggtcgccgtgccacccctgcgttccatctcgccataatcactaccctgcactccctgggcccctgggaatcccctctgcctctcgtttgcctactcaagttccccgcgtccggagtccaccctgtgcccccgctcccccccctcctaggggggccccacagtcctcagcatgccgattcctccctttcctccttccctctcatcaggagcggcgcgtgccataccgccgcggcgccgagctggacgcgctgacggggacgcgctttgccctgagcctgctcctggaggcgctagacgtgggcctgccgctcggccgccgtgcggcagctgcggccggccgggcgctgtcctggatcctggtggacctggtgggggcggtgttggcgctgctggcacggggcgtgcgcggcggcctgtcccgcggcaggcgggcggggggggccgcgcgcggggcacgtggcggagtgtggcgaggtggcgcgccggaggctgcatg

SEQ ID NO: 8000 - DNA, 459 bp, Chlorella protothecoides
atggaggacgcacgaggcatggacgggagggcggatggtctggacaccgcctcgtctatggagtcgggcaccttctccgagacgccacacagcgagagcgggtcatcggggaggttcagcgtcaagtgccctcattacaatccggatgaggatgtcatcacccgcaccgagtggatccaggagcggggcatgaaggtcagcatcgtaggagttcagatgggcaacatagcgagcctggtggtcctgtcggtggcgctgtactggaaggtcaagaaggatccaagcttctacctagagggaaatgacgtgccaaagatgaacctggggtttggctgcgcctgtttactggcagttggcggcaccttggtggggttccttcgacgcgtgtaccgctcctacaagtgcaaaaagcgatggtgggagggggatggtgaagctgctacactctttgctgattag

SEQ ID NO: 8001 - DNA, 1446 bp, Chlorella protothecoides
  modified_base (708)..(717): a, c, t, g, unknown or other
  modified_base (1387)..(1396): a, c, t, g, unknown or other
atgctacgcgttcttcaactcccagccctacaacctttaccagattggcaatcagatcctgcgactgaacgtgcgtggagcaagctgtgtgctgcggccaccggccacccgaatgcgccctcactgtctgctttgcatggatttaagctcaaatttccacccccccccaacccctttgcagacaaggctcaggtccctgtttgtcgtagtcatcctcctcaccctcatcgtgtactcgtgcgtggggaaggcgtgttagggggcccagtgtccatgatgtcacatgggctgtgagcaatggcaatgagcctgggtgaactccatgtccctcgcaaggctcacccatgcttggccccctcctttcccccctggtcacaccagattgcaatgtcggtcgtggtggtcgtgcaagcgtaccatgcaacccccaaacgtcccagtgacgcctccatcctcagagtgtggctccaggagttctcgtggactgaggggtccctggaggccaacaagaaggagcggagctcgtccctccctgccagcgcagccggtcaggctcgtgagctggatgcagagcccatgtggtgctttgagtacggacggttgagtttgggagaactctgtcgccaggtcagacctgtcgtttgtcatgcgaatccacatgagatttgtgcctcccccatcttcacctcacttccagactacaaggannnnnnnnnngggcagcaccgtgagcgggttggctgggtgctgtacggacgcttgagtttgggagaaccctgtcgcttggtcagacctgtcggttgtcatgtgaatccacatgaagtttgtgcctccctcatcttcacctcacttccagactacaaggagttgaactccaaggcagcatacaatgttgacactgcgctgtccctgtacgacctgcactccttcgagatgctttgggagaagagcctggtgggtggaatgtcgcttgacgagcaggagggcgtcgggacactggcagcgttgattgcgtggtgtggggaggaggggcgggaacgttgtccgtcccttctggtcccagccaggcagaccagaacgacagccacacatggggtgtctctgttggtcccgctgcccacccctcgacctgccccccttgtccaggacacaaagtgcctcatagggtggagcgaccgcaccctggtggtggcattccgtggcactgccagcatagccaatgttgcctctgacctccaggtgctccctctggtctgtgagatgtgggtgtgggtcagggcatcactcacccgcgacaagccagctgtgcaagaggcccgctcacgcgccgctgccatgcacaccccgagctccctcacgcccacccctcgcaggtgtggcgcacccnnnnnnnnnntttctggtctgggagatgtgggtgcgggtcagggcatcactcacccgtga

SEQ ID NO: 8002 - DNA, 672 bp, Chlorella protothecoides
  modified_base (620)..(629): a, c, t, g, unknown or other
atggctttgatgcgcgcatcaaggagtgcatcgccggggtgctggctgggctccagccagactgcgccggtcggcccatcaaggtctacgtcactggccacaggtgaggtgcggggcaactttggctgctctgggatctgccagaccctgtgcatggctggaagtgggggtggggcatcgccgccggatgcacagggccgatggccctgccaggatgtggcgaaattcaagggtgcctcgcacattcgatgccaggctccattgcctttggcacccttcctccggcccccctttccactgcttcacagtctcggtggggcgctggccacgctgtgtgcgtacgacattgcagtctgcgagaggctgtccgggtcggtggacgtcagctgctacacctttggcgcgccacgcaccggaaaccatgtctttgcggagctgtacacgcgtgctgtgccagacacgtggcacatcatcaacaacgatgtggggactggagctgccagcgtgtttgtggggaggggggtgatgcattgctcatgggtgaagccagtcctcgaggtgcccctgcctcacctccaccctgtgaccgctgaggagggcgacgggtcgcctcgtgctcnnnnnnnnnncccccgaggtgcccctgccacacctccaccctgtgaccactga

SEQ ID NO: 8003 - DNA, 192 bp, Chlorella protothecoides
atggtgctctgtagcgtggggatcctgttgtatcagattgtctggatctggaacatccgccaggggttcatcttcctggctgggcagccctacaacgaattccgcatgggtaatcagatcattcggctgcaggtccggcttcgaggcctggccattgttgtcttcatggcttccatgatcatctacacgtag

SEQ ID NO: 8004 - DNA, 420 bp, Chlorella protothecoides
atgaacacggtccccttgatcaacctggccattggggcgcccttcctgctcgccctcttcctcgcctgtctgggcttcatgcgccgggtcatacgctcgaatcgctccggcaagagatggtgcgcgactgctgggcctctcttggccaccgccctcgtcttgagtccccaccttccaaaagcagcccagggcttgggcacccgctgtcttgaccagagaggcctttgcaatccctgcgctgagcccatcgcccccccatccaggtcgcggcgacggcgacggggcgtgaccaacgccggaattgagcaggtcgtgcagatcatcaacctgctggcctttgtggtgtgcagcgcgtacgtggttgacaaggactgtgccgtcctttcctacaccgtgatctggggcggcttcgtgcagtga

SEQ ID NO: 8005 - DNA, 384 bp, Chlorella protothecoides
atgacggccatcgtcctcgccaataccattctcatgacgccaaagcggcctgacgcaggggccatcctcggggagtttgcctggaccgagcgggagatcgagaacaagaaggaggagcgcagctcctccctgccacctggcacggacactgagcagctgaatgcagagcccatatggtgctttgaggcatgtgtcgactctggtcgccacctctcgcttcagctgcaccgaccgcatccttcccctgcacatctccatgctgaaacagactacgaggagaacaagtccaaggcagcgtacagcgtagacacggcgctgtcgctctacgacctccattcgtttgagatgctgtgggaggaggagatggtgagaccctggggatga

SEQ ID NO: 8006 - DNA, 609 bp, Chlorella protothecoides
  modified_base (234)..(355): a, c, t, g, unknown or other
  modified_base (438)..(447): a, c, t, g, unknown or other
cgcgccggcggcgcgcgcgtggccgtggtgggcgacggcgtgaacgacgctgccgcgctggccgccgccgacgttggcgtggccatggcgggcggggtgggcgctgccgccgacgtcgccggcgtcgtcctgctgggggacagccccgcccaggtggtggatgtggtgcgggtgggccgtgccacgctgcgcaagatcaggcagaacctggcctgggccttcggctacaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagagtatattgtgttctttggggcggggggggcggggggccgggcggggaacaaggggtttcagtccctgatggaagcnnnnnnnnnnaaagagagtattttgtgttctttggggcggggggggcgccggggggccgggggtgaacaaggggtttcagtccctgatggaagctcgtcgtggggagtggtggccttggatgccggaagacagggcgccctgaatttctggacgcaatgggattcttcatga

SEQ ID NO: 8007 - DNA, 1218 bp, Chlorella protothecoides
  modified_base (423)..(432): a, c, t, g, unknown or other
  modified_base (678)..(687): a, c, t, g, unknown or other
atgtatgggctgggtgttggagtctgcattgccgatatggatagcgtaatgttggcacgcacaagaacttttccccacctcactctcaaatttacaggaacttcgagcctcagcacaggagctgagtcaaaagagcatcgggcaagcagcgttgtcaagtatggaaggtctagcgggaagtataggcacagagcaataggtgttgtcaagcgatacacgcaggcctacaactatgagggagcgcagaactataccagccctcacatccattcggcaatagccaatggactcgaccctggaactcggtactactaccgagttggaggcgttgggaggaatctctggagcgagcatgcattgaccagttcaaaacatgtctccagctccctgtcctccttccccgcacccaggagtactcatttnnnnnnnnnnctagcatgcattgcccagttcaacacatgtctccagctgcctgttctccttccccgcacccaggagtactcatttgagacgctgccggcaggcaaaagctacccactccggctcggcctcattgctgatactgggcagacctacaactcttccaccacgtatgagcggctgaaggaggatcgtccccaggtgctcaccctgatgcttacttgtcttttcagaggccatctgcgtgcagcgtccatnnnnnnnnnnatccccaggtacctggatggggccaactactatggactccttgaacttgttgagcagattatttatgcagcaggtgctcaccctgatgcttacttgtcgtttcagaggccatctgcgtgcagcgtccatgagctccgcccaggggctcccaatattgagggatctcattccctactccacatccctccccttcccaccaaggtaatcttccatatgggtgacctctcctactctgatgactacctcaccactggaaccctgttcccctgggtcctcaacgtcacgccccctgtgtggacccccccccaaacctaccagcctcgctgcgacagtggattggcgatccacaatgccatgtggtttggcaccttctcgtaccctttcctggatcaagctgctgctgggcatgcagcggaacatgctttgtcacctgtactgagcgaccacctggccctgcagggacatgtggggaaggctggtgacacccctcgtctcacacgtgccattcctggccacgcccggcaaccatga

SEQ ID NO: 8008 - DNA, 2013 bp, Chlorella protothecoides
  modified_base (1019)..(1028): a, c, t, g, unknown or other
  modified_base (1391)..(1400): a, c, t, g, unknown or other
  modified_base (1750)..(1759): a, c, t, g, unknown or other
atgatcctttcctggtcagcgcgggcaccactctcccccgtccctccccacagagagccctcgtttgggcatgcaaccctggacatcctgaacgacacgcacgccctgttccaatggaagcgcaatgccgaccccctgtcgggtgcgggcatggaggttgaggctgcaccgaaagctggcctgatggcgtgctcgatgctgttcttctgcgtgccccagatcagaacagctcacgtgcgtggaagctgcactcgtgcatgttcaaggtccatagctgactcccagcccttcaatcattccatgcagtggtggcagacgaggtcgtcttcaggaggcgtcccgacaagtttgatccaacgagccgaggcgctcggacgctggaaatcgagggtgccgacgcagtacagtctcagcgttcggtgggggtcacctccacatcacagatctccaagagataaccttgtacagcaggaatataggatcctctccacgaagctgacgcccgtacatagttccaagagtcgaatcattaccaaggatgcccttatggcacgcagccaaactgaagatgcccgggatcttgatcatcctgttcgaatattctacctcagcgaagcagcgatcacgatgggtcgtgctggtatcatcggcgcggtgctgtgtgccattgtgctgccctttgcggcggcccgctccatgatcgagctgaccacggtagacggtggcccagtcagtctgatcccatctactgttcagtacaattggtctgacacctcgcccagcggcatcgcgagggggactcccgacatccccgcatccgaccctcgcctgcaacctgccccggagggctacccggagcaggtcagcgtcatctactacggccccacttctagtccctgtcgaagggatgcggcacctggccggagcggcctgcggagtgcccacctccacctgatgcagccaaccatgggggtcgcacacaaacatgaatgggtgtggtacatgaccgctccagcgannnnnnnnnncgcggcacttggccggagcggcccgcggagtgccaacctccacctgatgcagccaaccgtgggggtcgcacacaaacataaatgggtgtggtacatgaccgctccagcgatgcatccacatgccctttacacacaggccaagctcagaccggatacggagccctggaggggttccatgacagcaccgggagcaatgtgcagctgggactctcgcccagcgcatacacggacgtactggaaggtgtggagctggtgtgtgcacgtgcacagtgtgcaaagcttgttcagacattgcagtggcgagcaagcttcggccattaggctcgacagcctccaggccctttgaacctcatcccactacgnnnnnnnnnntgccattaggctcgacagcctccaggcgctttgaacctcatcccactacgaccagatctactacggcttctctaacgcgctcaactacacgagccccaaactgcactctgtgattgtcgaggacctcacccccaacaccacctacttctatcgtgtgggggatcttaagacccagtactggagcgaggacctcacccccaacaccagctacttctatcgtgtgggggatcttaagacccagtactggagcgaggtatctatgtgttgcatgtggaaccctggtcagaccgacaactcgtccgacaccttcaaccacctggcagccagcgagccccaggtgctgcggtttnnnnnnnnnncgcctggcatgcaggagtacaacttcaccacccctccagctgggccaagctaccccctccgatttggtctcgttgctgatgtgggccagacctacaactcgtccgacaccttccaccaccttgcagccagcgagccccaggtgctgcggtttgttcagtgtttccttggggtcagctcgcgggatggtaccaaaaaccatgtgcgcatgagtgggtatgccgaatctgggtacgcatattcaagagctgtatga

SEQ ID NO: 8009 - DNA, 966 bp, Chlorella protothecoides
  modified_base (584)..(593): a, c, t, g, unknown or other
  modified_base (666)..(675): a, c, t, g, unknown or other
  modified_base (765)..(887): a, c, t, g, unknown or other
atgccgacttctccgtgcctgtccacatctgtctccaaaccgaaattgcgctcgggaaccacttcccgtcgtgctcttggatcgggggatgaagtgagggtcccgaggatggtgggacgtggagatgtgatccgccgtgctgtcgtggattgggacgcggtggatgccgagctccagggcatcccttcatccttcaaggagcccaggttcgactctgtgaagcacgtcctctccctcctcagcgatgagcgggccgagcaggagctcgccaggtcaaggtgtagtacatgcagggctttcatcccacaacaccccctctacctccgccacgatcagctgcgggcccaaagtgctgcagtggatgcgctggtgacggacgtggtggacacctactacgccggcttcaaccgtgccatccagaattactcccacatcctgaagctcttcagcgatgcccgagtccaggtacctttggagagcgggcgtgcccctgcggtggcggggctagtccggcaggcatcgagggggtgcggcgctcactaccatgcaccacagcgccgtgcctctccatgctcactgcgtcnnnnnnnnnnggcaggcatcgagggggtgcggcgctcactgccatgcaccacaccgccgtgcctctccatgctcgctgtgttnnnnnnnnnnccccccccccccccccccccccccccagctgagcacgctgcgccagaccctgtgcacatccctgcagcagttcgacatccgcctggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagacgctgcgcctgctgggcgacgtggaggccgtgctggccgtcccgtcccgtctcgctgacctgcagcagtccaag

SEQ ID NO: 8010 - DNA, 774 bp, Chlorella protothecoides
atggcctcgactaccggttatccgaggaaacaggtaggagcaagagaatgggggatgcagcaagaaacatgcgcccactggcaggcacagcagctcgtgtgtagggaagtattcagtcctttcactccgtctaaaacctatcgaggcccaggacacagcaagcggaccccccctgaggttattcgcttggacttgtctgacgatggagccgacagtcccgagcactggctcatttccgtccccaggaaggggccgaccaggcggctgattgacagcgggagcgacgaggacacaccggcaaaggcgagtccttcgtcatccatcccaggcgccaccgtcagcgacactccttctaacgttgactctgaacagacggtggatgaggatgagggagtgtcagaagatgactggacacccagcagcccggaaagcctcccgccaggagaaagctgcagcccttcgacatcaaaacctgagcagcagagcccagcctggggcccagaccgggcagtgccccattcatctgtgttcagcactcctcgggggccctgccccgtcatcccctcaggagcgttcaaacgccgtcgtgcagagctggcggtgaccctgtaccaggagtacaatgcattgatatttgacaaccgcctcccggcggacctggcgatcacctggaatccacggctgtccacaacggccgggctcacccactacagccaatcccccgacgggttggggggacgaacgtgcgccagagtgattggggtttggggctga

SEQ ID NO: 8011 - DNA, 651 bp, Chlorella protothecoides
  modified_base (130)..(139): a, c, t, g, unknown or other
atgacagatgatggagtagctccagagctgctttacagagcttatcactcaggatgctactccactgctgcagcttcctcttttgctatttgcagaggtcctgcaactggccaggcgtctccccttgctnnnnnnnnnngtgatggagtagctccagagctgcttcacagagcttaccactcaggatgctacttcactgctgcagcttcctcttttgctatttggagagggcctgcaactggccaggcgtctccccttgctgtgcagtgtcgctccaggatctggaaacctacactcctcctgcatgactgcaagacgcccaaacacttgcccaggaactccgcttcaatacccaatgacaggtacacggcgcgcgtagagctcagcatcaaggtggtggacggcctgcccaaactgaagcgcacgctctgccacgagctctgccacgtcgccgcctggctgctggatcactgtgccaggccgccgcacggcaacgtgtggcgagggtgggctgaccgcgcccagcgagcctacccggagctggagatcaccacctgccactcttacgacatcttcttcccccaccgctggcagtgcacgaacgcagagtgcgcagttgattgtggtggtggtggccatggggcagagtag

SEQ ID NO: 8012 - DNA, 636 bp, Chlorella protothecoides
  modified_base (109)..(118): a, c, t, g, unknown or other
atgccccttccctccattcccccccatctttgcgactccccctgctgcctccagcaccccaccccggcccctccccttcaggtgtggagccaccctggggcgccacagnnnnnnnnnnatgcgatgaccagcatggacccatgccccttccctccatttcccccctttgcaactccacctgctgcctccagcacacccccccggcccctcccctccaggtgtggagccaccctggggcgccacagtaacagcatcgacgtcaaccgaaaggtctgtgggcgttgcagggcaccactggagtatctgggcaggttccaggctgacaacacgcctgccaagcccagggaagcgacaggcttcagcctcttcgtcaagcagcactttgcagcaggtgggtggagctggactgggcgcgcaggacatgccatgaacccagtccacctatgctcattcgcatttatacctctcaacacagagaggaagcagcttccgccaggaacacctcatggggaggtcatgaagcagctctcgctgcggtggggagagcagcagagggccactgcggctgcgtctactgatgcggcagtgcctgccaccgatgctgcctgcgatgcattgaggaggctcttgttgtga

SEQ ID NO: 8013 - DNA, 891 bp, Chlorella protothecoides
  modified_base (784)..(793): a, c, t, g, unknown or other
atgcatggcgcacttgctgtgtgccaagtgccacctgccctgatcgaagagtacgagtgggtatcgtggccattcgaggggcatcttcggcatcttccggcgtttcggaagcacaggcactggtgccgcgaccggggaatgaccacgaattccaagggcattctgtatgccctggtggcccgtggccccgtcatcctctgcgagtacaatcttgtgagaggcaatgcccctcttgttgccttgaacctgcttgaaaagtgggtgcctcgcccagacgccaaggcctcctatgtggccgacaagcatgtcttccacctcctcagcgatggggagctcacctacctctgcatgtctgatgagagcttggggcggcgagtggcctttgccttccttgctgacgtccagtctaccttcctggcggcacacggagcctccacacggtctgccctcgcgtacgagctgaacacggccttcgagccggagctgcgcagccggatgctgcgcctgaacgccgacccccgggctgatgccctcaccaggatacatggtgatgtggcggagctcaagtccatcatggtagacaacattgacaaggtgggtttggctcatcatggggttgtttggggaggccggaagaggaggggatcaggagtggtggtgaggctctacctcctggccctgccagctcttcaatcagacctacaacaagactggggtgcaggccttgcgacaccccctgcaccacaagccctgtctcaccaccattcatcctacaggcggctgnnnnnnnnnnttacgtcctggggtgtgaaaaattccagtggttggatgatgactcgggatggctgctgtgcccctgtgcgatcgcaaccctgcaagctcttcaattag

SEQ ID NO: 8014 - DNA, 1434 bp, Chlorella protothecoides
  modified_base (317)..(326): a, c, t, g, unknown or other
  modified_base (622)..(631): a, c, t, g, unknown or other
  modified_base (694)..(703): a, c, t, g, unknown or other
atgccctgtctgatcgccatttccccttgtcccgccacagcctcgcagcagatggtggagctggcgccgagccatgcagacctggtgttcgactgcgtacgtgtcacatgggtggccatgatcgtctctatcctcttctttgacgtgaggcgcaggggaggggaggtggagtcctcaaagggctcgggtagtgaacatttggctctgagaagcgcacgacctatctggcgcttgctctgcgcttggacgtctctcctttcgtggtgcaccggatacgttctcccagtcgtttgccatacaacctctcccctcctgtnnnnnnnnnngcttggacgtctctcctttcgtggtgcaccagatacgttctcccagtcgtttgccacacaacccctccccccctggcatcctgcagatgaacctggcgtcggcgctgtggaccggcctggtcgccggcctcgcgtattccttcatggtgcgcctcatgtaccgccagcactttgcagcgatgcagcggctggcggaggcccatgcggcgggagcaggcagcctcgcccgcggacccgtccacattcccatcgtcacggtggtgtgaccagcttagcatgcccgcgtcacatcagannnnnnnnnnaccatcgctcatcagttttgtgtattgctgcaacgccccagagctgcttccgacccctgcccnnnnnnnnnngcgcctcatgtaccgccagcactttgcagcaatgcagcggctggcggaggcccatgcagcgggagcaggcagcctcgcccgcgggcccgtccacatccccatcgtcacggtggtgtgaccagcttatcttgcccgcgtcacatcagacaccccccaccccccacccccccttgtccgctgtcaaggcccctgctgtaccctacccgcttgacccccgggtcctctcccaccatcgctcatcagttttgtgtattgctgaaataccccagagctgcttccgacccctgcctcaacgggcgtgcgccgcatggcgcagacccccgtatgcccagtcgctgccccctctcacttcccccacccaacacactgtaaagcttgatgaacacccaatgagcgcaacaggacagcgagggggagtgaggaggagagttcgtgcacaggatcacgcgcgagggtgtccgcggccgtcagcagtgcagggtcgggctgcacaccacggccagcaggacgtagaggcacagtgcgcagagagcgaggatgcagacgcgcaggcgcacgctgcgccaccacagcgcgccatgcaccctcctcgcctcccgcttgaaggtgaaggtggaggaggcgaggtcgtctgtgcgctccacgagcaggtccagccgctcgccccgatccaggatctgagcgggggcaggagggggcaggaggggagtgggcagccgcctgtaggatga

SEQ ID NO: 8015 - DNA, 780 bp, Chlorella protothecoides
atgaacagcctctcctgggtgagcacattcccgtgggagcttggggagacacggttcgcatggggtggaggacaacgtgggggtgacgcctcgtgctcactctcccgtgaggctcctccggcgcgcagacgcggagcggcaggccccggtggaagagactgccggagccaagcccggggttgcaagcagtctgtcgtcatggtggcgtcgcgtgctgaggcgcgaggaggtctcgccctccgtcccgccccccgttccggagggcggccccccctcctccagcgatacagctccagccaccttgacggtggtggaggagcagtgcagcagcagcacaggggatatcgcaaggctgtcggtgtcccggccgggcggcgagcgcagcaagggcgacaagggggttcatcggaccgggtcccagggcagcatgggtcgaagatccgaccccgtctgcctcatctgcctggaaaccctgacctccgaggaattcaggggtgccttatcgcatggcaaggttgtctgaagcgctgcttcaaccgctctctctctccctcctttcatcagaacggtgaagccatgactttggactgccagtgccgcggcgacctggcgctgcggcaccgcgagtgtgccatcaagtgggcccaggtgaagggcgactgcatctgcgagctgtgcaagcacgaggtgaagaacctgccggcgctgccccccaggccgccgcaggaagaaggcaatgccggcatggaggacgtctactgtgagtatggcatttcatga

SEQ ID NO: 8016 - DNA, 1950 bp, Chlorella protothecoides
atggagcaagcaggcactcccactccccacctcaccatccttggtgtacaccctgtccctgtcggagaacttgaagtcatccgagagggtgttggcgagcacatcctggttgatgctgctgaagaacccctccagcagcaacttccgcttgggagccccgaaatcagggaggaactcgggcttttccagacccaatttcttcaaaaatccaaactgatagattttcaggcctgtgcgtgctgcgggccgggtccggggcggtgcagtccgaacctggagtgcggccccttcacggaatgtggaccggagcgatggtgcagcccgagggctgcaggctgcaaaggcgttaagtgcgtgcagcacgcgattgatctacagcggatcttcattcggttcccttcccgcgctcaaagtgattcaccgcctcgatttttggtgactgaacttgagcggtgttgtggtaagaccgcactcagtgacagacctgcctgcgcccatcacgttcacgaaggacagagcccatcgtcgagattccacaccttcctcaaagcgacctgtgacttcttgcgcctccatgccgattcgaaggacggtccaacatcgaacagtacaccctttttcagctctgcctttcaccagtatggtctcgctggtagtctctcgattgccctcggcaccccgaggacctcactgaggacggttccctcccgacacgctcccggcgttaacgacgccaacggggtttcggccggaccgggagagcacggagcgcggtcgggaggcaggatggtcacagcctggcaggcccccaggtgccaggggaaatcgactggccaagatgcttccctccaggatatggtgctcaaggccagccaggcatacacaagcggcaactatgaggcctgcctggagcactgcatgatcggccagtctctcctttgcgtgtcggcgccccagtcgcaccacaggcgctaccagatcgacctcctgctgctcaccgccgtggcgtactttgagctcggccagtatgccaagtcggtggcctacaacgacgcggctgtggtactggacccctcgctcccggaggctcaggccaacctcgccagtgggctgagtcggctgggccagctggacctcgcaatcatgtactaccaggtgggcgtggccaggtctggtgaacgggagcgtactggggcgcactctgggtggagggcccatcgagcatgggttgtgaaggttttggtcggccaaggtgggtggtgcgattctgacttcttatgtgcccttgattgcgtgcctgttgaaattcacaaaccctgtaacaaacgcatccgtggtcccctcgccccgggtactgcagtctgccctgcgcctgaggcccaccaccgtcgccgtccagaccagtctggccaccgtgctgcagcgtcggaatcgccgagaagctggtcgactcagccagtgggcctccggaaaccggcacctgggggacccatcacttgccacagccccgggtgccgcggccttcccaccctcttcttccctggcgccagccgttgcagcacgccgctgccagcaggacagcgaagtggaggcgggtgcggtgcaggcgtatcacttgggtgccagccagcggcctctgtcctcagaggagcggaacgacctgggcaacgccctgagggaggcggggcgcggggaggaggccgtggcacagtatgtggcctgcctccatctcctcatctcggaggccgcccaggccgaggcccagggtctgggcacccgcacccacgcgcgacgtcaggtcagcagtggttgtggtgttgtgtcgtgtggcctccccgttgtgtgcatggcgggctcgctgtggcaccagtgcgggtggcaaaccgcgcattgctcggttgcaccgtgtccaatccaccccaccgggtgatgcctcagggtttgtcttga

SEQ ID NO: 8017 - DNA, 237 bp, Chlorella protothecoides
atggcgtacccgctttcccccgacctcgccctccgcatctcctccgcctacgccgggcactgcttgagggccgcggcagccctcaatgtcgggcccctgccccacccggcgcgggagcccctggcgcctggccggcggctacgcatcgcctacgtgtcgtcggacctgggcaaccatccgctgagtcacctcatgggctccgtgtttgggatgcacgaccgaaggtggttgatttga

SEQ ID NO: 8018 - DNA, 258 bp, Chlorella protothecoides
atgctgaagctggtgggcagggccagggagggcatcatgtgctatcaaaacgccgtggccttgcagccgggggaggctgagggccatgccaacctcgctgcagccctgaaggacaacaatcagcatgaggaggccatcgcagcctaccgccaggcgctggcgctgcggcccgacttcccagacgcctttgccaacctcgtgcactccatgcagtgtgtgtgcgactggcaagaccgacccagcctcttccagaggtga

SEQ ID NO: 8019 - DNA, 2019 bp, Chlorella protothecoides
atgtacgcgcccgtgaccagcctcgtccccgcagagggcctgcgcctggaggtggaggccgcgccggcgggcgaggacaagccgcggcgcctggcggtggtcatccgccgcgcggccattgtgtctgtcgcggcgctgcaccgcttcatctccggccagcgcgacgaggaggagtacgcctaccacgcgctgcagtgcctggacatcgtgctgaagcaccgcatggccatggccgatcggtcgctgcccgtggcgcgcggcgtgttcttccgcggccccggcacgcgctcgctgggcggcggcgcggaggtctggctgggctaccagcagtccctgcgtccctgccagaccgggctggccctgaacgtggacatggccgccaccgcagtgctggaggagaagccgctgctggagctggtggccgacaaggtggggcacgtggcggggccgctgcccgacgccgcgcggcgccgcctgaaccgcgacctgcggggcgtcaaggtggtgaccagccacacaggcatgaccaaggccatccgccacctgtcccggggcagccccttccaggagacctttgagcgggagggacgccaggtcagcgtcgccgactacctggaggcccaatacggcgtgcgcctgaccaaccgcgacatgccctgcgtcgccgtcggcaacggcaccgtgctgctgcccatggagctgtgccgcgtggcaccgcgccagcgcctgattcgcctggacgagacgcagacgtcggagatcatcaagattgcggcccagcgcccgggcgaccgcctggccgccatcgaccacgccgtcaaccgccaggccgccttcccggacgaccccactgcccgcgccttcggcctgtccatctcctcgcgtaccgtcgaggtgggcgcacgcgtgctgcccaaccccatgctcgcctatggctcgcccggccgctacgaccccaagggcggcggctcctggaacctgcgcgacgtgcgattcctcaacggctccagcctgccctcctgggccgtagtctgcttcgccaaccagcgcttcgcggccgaagatctggaggcggcgcgcggccagcacgggcccaccttcatggccgagttcgtggacatgctgaacaagtgcggcgtgaccacgccccgcgagttcccccccgtcgtctaccccgaccgcaacgcgaccgtctactcggcggtggcggaggccaaggccaaggcccaggccgcctttggcgcccccgcctcgctggtcctggttgtcctgccggacacaggtgctgcgctgtaccgcgaggtgaagcaggccagcgacagcatgctgggcctgcccacgcagtgcattgtgtcgcgcaaggcgggcattggctgccccgcgcgcgggcgcccccagtactgcgccaacgtggccatgaaggtgaacgccaagctgggtggctgcaacacgcgcctgggcgacgtggagcgcctccccgtcctgggcgcgcgccggcccttcatgatcctgggcgccgacgtgacgcacccgcgccccggcgagggcggcccctccatcgccgcggtggtgggcagcatggacgccaccgccacgcgctacgcggcgcgcgtgaccatgcagcgcggcggccaggagatcgtggccgagctcaaggccatggtcaagagcctgttgctggagttttacggcgcgacgcgcggcatgcgccccgagtcgctgctcttctaccgcgatggcgtgtcggagagccagtttcaggaggtgtactacaaggagtacagcgcgctgctggaggcctgcgcggagatgggcgatgcgggggctgaataccggccccccatcacctttgtcatcgtgcagaagcggcaccacacacgcttcttcccaaagtccaccgaccagagcaaccgcgaccggtccggaaacgtcctgccaggtgtgtgtgtgcgggcgggggaggggtggaggggggggagggggtccgttgatgttgagctgggggaccggaaggggtaa

SEQ ID NO: 8020 - DNA, 240 bp, Chlorella protothecoides
atgggctccaagtctcgccaggagctcacatgcctctggctacccccccgaccatcggagcaggtgaacgtgccgaagaccaagaaggcctactgcaagggcaaggagtgcaagaagcacaccctgcacaaggtcacccagtacaagactggaaaggccagcctgtacgcacagggtgagcgaggcgtcctgcttgggagattgccggatcctgggctcgatgccgtgctcgacgagtag

SEQ ID NO: 8021 - DNA, 768 bp, Chlorella protothecoides
atgccccactcctactttgtgaacgaccaccgccgggcgcacggcgacgtgctgcgcggcgccgccccgacgcccacccgcaccgcgctgggcctgcccgaggacggcgtggtgctggcttgcgccaatcagctgtacaagatcgacccgggcgtgctggacgcgtggtgccgcgtgctgcgcgccgcgcctcgcaccgtcctctggctcctgcgcttccccgcctcaggcgagccgcggctgcgcgcgcaggcggcggcccgcggcgtgcaccccgcccgcctcgtcttctccgacgtggcgccaaagcccgcccacgtcgcgcgctgcgcgctggcggacctggtcctggacacccccgcctgcaacgcgcacaccaccgcctgcgacgtgctctgggcggggtgcccgctgctgacgctgccgctggagaggatggcgtcccgcgtggccgccagcctggcctgcgcctcgggcctggggggggacatggtcgtcgggtccatggcagagtacgaggcgcggcgggcgggggggatggggagcaggggcaccgaaaaaggatcccggcgacacaagcctgcgattgccccagcacaagaccaccctccaggagtacatgcaatgacgccagcccccactcccccacccaagcacacacccgcccgcctcacccattcaggcgctggagctggcgctggatgcgcccaagcgcctggccctgcgagccgcggtgtgccgggctcgggggtccagccccctgtttga

SEQ ID NO: 8022 - DNA, 1395 bp, Chlorella protothecoides
atggtggcaggctgcacaatcgacgagcgagcggtggaaggggctggtggtcgctttcttcccgagggagccggcgtggctgtcggcgggtgggagatcacttgtgccaaggcacccattaccgccgatgcggaggtggatgtgctgaaggagaggctgggatccctggcctggcctgagcagttctttggtgccaaccatctgaccctggtgcaccctgagaccggcacacgcctgacctttgaggcggaggacgccttacgggcgtggctgtcggggtcggaggcccccgtgcacgtgaagacggcggggaagtggatgcaagcgcacgcccaagatgtcgacacccataaggccaaggtcctgcagtatgattgcctggcatgccacatctcacactcgcacactcataggactttcacgaccgggtatcgagggagtggtgcggggccagcagggccacagtcagcccacggcagcagcggtgagctggcctgggaggcaaccgacgcgcagatggaccgcggcatgctgaccgcccgggaccccatcctgatgtatgccgacatcccgctgtttgaaagtgagctggaagacaatggcgtcgcctccctgtctgtcaaggtgaccagcgagcgcgggttggctgtgcgaccaccgctgcgcgtgatcctgccctctgtggccagggaaggtggcggtcgaagggtacttcacaggcatcccatgcttccggtgcatcgtgcagacgccccatttcccatggtatcgccccctccccaggtccgcgtgatgccgaggtgctggtacgccctcctcaggttttggctcagagtcgacggcgtgctggtccgactccgcaccactcgcgtcttctgcgccttcaaggacgccccagacgtggtgctgcgagagctgtttaggagtgtgctgtgctgcttgtggtgcaccaaagtgcgctgcaacctagcccacccctcctcctcacgtctgcaacacccgcagacgacgtatcaggagggcacctttgcggctctggcggctgcgggggcgccaagggagggcccgagctacgcagacgtggatgcagctggggccgcgctggcagccgtggcacccgtgggagtcaccctgtacgaacgacaagctctgcaattgaaagaaggcggcgcggcggataccaacatgcgtcgtttggcaaggtgcatcgtggtcagaaggttcctgcacattcatggcactgagcgggatgcggaggcattccatgcgcagggtcagggctcccccagccagctcatcaacccctgggtggcggaggggctttgggcctgcatgggagtggagaggtttggcaaggatggcgggcaacgttggttcttcacccagagtgcctga

SEQ ID NO: 8023 - DNA, 1581 bp, Chlorella protothecoides
atggaggtgactgggaggcccgacaacgcggatgtctggcttacgaagacagacaaagagcagaggctgtcgccacccttgaccagcgttaatctgcgggatctgtgtagtgtgagtgacaacatcaagccagggatgtgtgtacgctcgtcacaagtcatctcccaggaggatgcccaacgtctcggagtgaggaccgtcttggatctgcgccggtcacctgtgctgtgcaaggcgcacccaaataacacgggccagctgatgaagcacacgttcttcaagggccgcatctggttctctggcatttgctggagcgcagaccggactggctacacacggatgcctcaggctgagctgatactttgcccccactgcaggccaagtgtcacgtgcggctgcggccctccaaggagccggatcacaatcgggcgctgtcatgccagaggtgcacagccgcatccaaggaaacatacgggcaacactgctcagtgtaccatgcacaacacaaacataaagccctcttccctcgcccaatacagtggatctcctgccaacgaacgtggcgctaaacatcctgggcaggctcccccacaagctgcagttccgggtgctggtctgtgccgctcgtcagcagacccccgagcccattgtggcaggtgtgtcaggggtggcaggggacttctaggaggctacatgcggcacccaggagcagggctgggcatgcattcgctggcgtctgaatgcctgctgtgcctcagagagcttgcagcttcacaatcttgtcggtatctcccttgcactgccgcgatcgccaaccccgacgtgatgggctacttcaagttctacaagatcctgctggagaaggcccgcctgcccttggcccgcgccgtgcgcctcttcgccgacaaggactccgcgcccgtgctggtgcactgcatccacggcaaggaccgcaccggcgtggtgaccatgctcctgctcctggtctgcgatgttgaccctggcgccatcgtggaggactatgtgcggtcggagctgatcctgcgggagtcgcgggacaacaatgagctcgtcagcctgccgggtgagctttgggagcaagagaaaggggggcgacctctaggcgctgcctggtacgcaccccatcacctatcccccctcccatcctcacgaacagggcacctcacgaccaacgaggtgatcgcggcggcggcgtcggtgatagaggcgctcatggactacatgacccggcgctggggcggcgccaagcagtacctggtgcgggcggggctcacagtgcaagagctggcggccatacgggtgaactacatgctctcaaaccaggggcaggcggcggaggagcagcatgtcagcgctgcactgctggccagcagtgggtcccactctgggcggcacaggaagcgagctgccccattctgccatcatctatctgccttagggtttgcctccgacatcccggggcgcggggcgcttgacattaccaagtacatttctccacagcatagcatgatttaccgcgctgtcccagcatcaattttccatatctctcctgccgtgtaa

SEQ ID NO: 8024 - DNA, 1155 bp, Chlorella protothecoides
atgcctgtgccgccacctcactcctcactccacccaccaacccatgcagacatgcccagcctgagggagggtgcgccccaggcttcatgggactcccccctccatgtcatggcatacccctgcctcaccagcgagcgccctgccctcgcgcctgtggtcatcactcctcagcacaaggtcaagcccggcgctgagatacacaccgcgcgtctccacctggacgccctgtgttacgttcggagagacacccctggtgcccttgccgcctacaatgtgagttgggaggattggccggcacccagcacatcagcaggagaccacacatgccatcctaccacatccgaatgcgcaggctgtgaggcagtccattctggagcagattgctggggtgtcgctcctactgagcaggggggagcaggcggcgggggcagcgacgatccaggcctaccacttcctgccaccaggattccagcaccacgtctcgctggtgcgagagtgggggttccaacatctgagcttgaggctaccgggcggcgcacccttgagcacactcacaaggccctaccacccattcgcccgcgtcagctgtatccgctcgccgcgtccgcaaggaaggccgaggaggcagccctggccgagaggcgcgccgccatacacgccatgctgggcctccccagtgatcgacccctcctacggatcgcgagggctgtgcccatcgaaggtgtgtcgagcagaaaagctggctgcggtccgcctgtgtgggtgcgcggtcatatatctgacgaggcttcttgtctggagggaggggatgcctgctgcaccgcaccccacctcgctcccacctccccctgccgtgcagcacctggcgccatgctcccggcaccctccaccagacggttggcagatgtgcacgtcggcatcgcgccctccagggtcaagggcggcacccagcacttggtccagggcagctacctgtactaccactacatgcaggtgactacaggaattgggcatcatttgcgagggggatggggggagaatggcttgccatgcccctggtgctcgtcgaccgccgtgccggcaagtggtggtgagggtggcccggcgcctgagtcagtggtcctgggatcagcctccttttcccagcctgcttga

SEQ ID NO: 8025 - DNA, 1590 bp, Chlorella protothecoides
atgacatggatactccgctgcttcattggaggcagagagcgcacaggccgtgccgtgcaaaaaaagggattgagtgaggcatgtgcgggccgtcaggcaaagtccgaggggctccacatgcattgtacagggtgccatgccgcactcttggaccccgtaattcttggactcgtgcctggcaggccccaatcaatcaggccatgtctactgagcggggatggcggtggccgcggctgggagggctgcctccgtgccgtagcccttggggcggcggaacagcattatgtggggctctggcttgtggatcgcatagtggacctgtgttcggaggggcaggctctgagggtgtcaggagtgactggcagtccagctcctcccaccactacgtcgggactcgcagtagcaaacctcatgagtctgacacccatgacccgcccttgctttgctcttcaagatacgcatactactgcatcgaccgttcttacacttctttccaactccttcagatccccctgctcacccatcctcgagattgctggacgcctagggccctccattccgtctcggtcagcagcttcccctttggcagctgtgcagcgatgtctgagggcaagaccacgtgcctgtgtgtacagagtgagaggagagggaactattggagacacataccccagaatacaccaggactcacgcttctggaagcttccaaagaggaccagacctgaactcatggatctgcaagggggaagcggggaacatgtcagcaacactggcgctccaggtcatcggaaaaatcatttcaccatccctttgacctgctcacatcgtcgtagtagcgctcgctgtactggatctgactcggaggcatggttatcgaggggcaggggattcggaggattgctctctcagtacgggaccgatgagaccactttccttctcaatacgtcgatgttgagcggaaagtcggatgttcagagtatctgtatttcgtgcgcgaatggaccaacttgccttcccatagctgcctcaccgaagttcaagggacaatcacgggcaggtcgtccaccgggccatatgctcctccgcctgcgctccagagacggcctggagcgggtcaaggtggcggatgacgccaccgtggccgatcttcgacaggccattgccgctgatctctcgattcccgtggacgattttgttatctcacaagagcccacactggtgggtcgagcaggggtgtactcccttgaccatgcgaggggtaacactgcgccctgcagcttcttcatgaggtcatgggcgttcctgctgagccatcccaactcccccttcacctgctccttagctgactgccaaggatggcgagtccgtgcagaccctgtctgccctgtccaaaagcctcaagggcctgggcatccagcatggcgacaccctctttatgaagtatggcatcaagcgcagcatccccggcccaccccggtcaacgttcgaaaccaggccctttggcgcccacatggacgtgcggcgcatggtggctgcccagacccgcatcgagcgccaggagaccgcggcctgctccagcgcgtcctttga

SEQ ID NO: 8026 - DNA, 1092 bp, Chlorella protothecoides
atgatcagcatcctgcatggcgtgcttgatcctgtcaagtccccttcctctgcctcgccctccagccacgcaccccccacaaaccatgcacccctcacaacatcctccccaaaacccacagagtgggacgagggcgggcggtacctgcgcgccctggagcgcgcgcgggcggtggcggccggcgccaccatgcgcatgctgcgcggcgaccgcgcgctggcctcgggcctgggggtgctggggcgctacttcctcaccgcgcagggcgacctgttcggccacctgatggacagcgcgggcgccgagttcgggcgcatggtggccgcggtgcccctgctccagctccaggccctgctgtcggcggcggtgcgcggcagctcggcggccgccgaccccgccgccgcgcagctgcacgccgctttcgacacgcgctcagtgctcaacatgctggtcagcatcacacagaccgcggccgccaccgcgggggtggggcagccagggtccccgctgcgtagggtgcgtcgtgagggggaatgtcgagggtggggggagtgggaaggttcaggcacacccgcaggtcgagcggtgtgggggcggctgcagcgcagggtgccgccccacctcccccacgcacgatgcacatgcataccgcattcaagcacacccgacagccccacaccatgcacactctcgcgcccacacacgcagggcctgaagcccgtgacgccggcgcccatgtccgccagcgagcgccagacagtcggccggcagaagaacgcgcgcgaatcgttcatgctttcctacgcggtaccctggcctttgagcgtcgtcgcgcccgaggcctgcatggcccagtaccagatgatcttcaggtgccaggggcgggggttaggaagggggaacattaatggcagggtactggcctgcagtgggggtgatggggggggggttcctggcgagggatgcagctgggcccagggtgtttgcgggggcatgcagaggagcgggctcgccgcccggcacgccctcaccggcacgggcctctcccaaagcatggccctggcccctcccgttacgacgcgccactcctga

SEQ ID NO: 8027 - DNA, 366 bp, Chlorella protothecoides
atgcccatctacttcgctcaggatcggttcaacgactcgggatggggctgcgcctaccgctccctccagaccctctggtcctggttcctggaggcgggatacaccagcaccccaccccccgaccatgccgccatccagactatgctggtcatgctgggggacaaggagccctccttccggggcagcaagcagtggataggggcggtggagctgggcttcgtgctggacgaggggctgggcgtgcagtgcaaggtgctcccccttgcctccggcgccgacctgccagacaaggcggccgagctggcgcaccactttgacatgcaaggtgggagttgcggcctgggtcccgggaaggggcctggctga

SEQ ID NO: 8028 - DNA, 243 bp, Chlorella protothecoides
atggtgggcgggggggtgctggcctataccctgctgggtgtggactggaacgagtcgacaggggaggtggcatttttgatcctggacccacactacacggggggcgaggacctgaagaaggtccatgccggacaatgggtggcatggaagcagtacggcgacaaggcggcggctgggggtaagctgctgcatgccgacgccttctacaacatactctgcccacagagacccctgggcgtctaa

SEQ ID NO: 8029 - DNA, 411 bp, Chlorella protothecoides
atgccccccttcaccacacgccaggcgctgtggtactatgtgcagccgccgctggaggcgctgcggctggtggcggggctgtgcgccgaggcgtcggcgcgcggcctgcgcggcgcgccgctgctggacctcctgcacgatcgcgcggcgcggtccttcggcgacgcacgcgcgcacgcgctgctcacccgcctcctacgcgccgccgcggcgccctactttgccatgctggcgcgttgggtgggggagggcgagctggccgacccctgcggcgagttcctggtccaggaggacgcggtgcggctgggggctggcatttggggtgggaaatgggggggagacgtggggcaaggggtggggcaggcgagtgttgcatgtctgcgtgggggctgggtaggaccctacacttag

SEQ ID NO: 8030 - DNA, 618 bp, Chlorella protothecoides
atgccagaggggggtgcaggacgcgcgacagctgctgaggagtggctccatgccgtgcaggagagggagctgctgccaagccgcagctcggtgcctgctcgaccgaaattgctccgctgcccatgcaaactcccgaccgctgctcctcccccccataccctgcgcagggcggcctcggcggtcgcgctgtcccgctcctgcgccgtctgccagctggtcacccacttcttccggcagtacctcctgtacatcaccttcgaggtgctggagccgctgtggctcgccttccagcaccgcgttcaaaccctggacagcctggatgaggtgtgtggagaggggtgtggggggagcaggtgtccgggcaacggtcggggctctggagccggggtggctcagcagctgcacgcactgccagtgcctgccggtgctaggcaccggcctggtggcccgcactttggcggagtgcgcgtcgcaggcagcctggggtcggtgttggagcagcaccatgccttcctgcgccgggtgatgaagggctgcctgctgtcccgcaaggtcgtgctcctgcgctccctgctggcgctcaaggacctcgctctccagtttgtcaaggtggggtag

SEQ ID NO: 8031 - DNA, 1398 bp, Chlorella protothecoides
atgccttcccctgtgagaacaggctgctgccccaaggtgtgccggctgtgggcagggaggggtcctggtgcctttcgaggagcatacgtacacgcagtggagcctttgtcctgcctcagcctgggcttgtcgaacctgttctcattgccagggaaagcggagctcagggcgcacctccagaagaggagcgggaagccctttgcggagcgcctggacgacttccacctcctgctcttcctggcccgccagcccaacttcgatctcacaggtgggatgccgcgctcgaaggggacgagggagggaggcttgcgggaatgggcgctggggaatatgccgacacatcgatctcagtcgaaagcgtgcctgtcgcctggctttctgcctggtcgagtcaggggtgcgctgtacatcgaaataccctgctaccctgtcctccctgccttgtctcacagaggtcgggcacctcacggcggcggtcgccgccaaggagccggtgggggaagggtacgagctgctcatagagtccctggcggggatgtaaggcaatggtgcgcaatggcaaaggaccaggctgttgagggtagtgtagagaagaagggcaagggtggcacgaaggccatcccatcccccccacagcggagggcggtcccggtgccccagtcagcctggagcagtccccccctggagccaggctcagatgcggtggtacacggggatgaagtactggatggaccgcagcgcgtccctccctgcggtggcgtccagggtgccgagcgtctgccacactgcgtcctgcatctcgtgtcccgatccagcgatcgacgcgccggggcacctcgcatggtgcatgtacctgcatggagattgctggggagatcggggtgggcagtgggtcgatgttgggcgatgaatgcctggcagcaaagcatgtatgtggtgggcgggcaccaaggccacggcagttacctacccggcagggtgcaaggcaggcacgcacgcatgcggccccgccgtggcaacgaccccccggcctcgcctgtccaggaccggcaggaggtggcggtggtagcccagcagcgccacgccagcggcgggcgagctcagcgccagcgcgcgcagcgtgctcagcgcacgcaggacggtgcgcggccggtcggaggaaagcgccgccttcagcgggacaatgagatgggggatgcactgcgggacggcctcccctccccgggcgatgagggcggtggtgcccgcctcggccagcatgcggtacggctcctggcccgaggggtgggggcggggagggggggtcaggagtgtcaccccgcaaccagcatcaccctcacgatgggtcagggcgccaggcagcgaggcagctcaccgtttgacatgtactcatcgtaa

SEQ ID NO: 8032 - DNA, 1941 bp, Chlorella protothecoides
atgggggaccgggcctcgtgcggccataccgaaagccgcgcaccgccatcgggggcggtgtgcgaccacttttaccgagccttcggccgcgagggctcggtgcccaccaatcgctcagtagccgccgtagccgccgtcggccggggcagctgccgcgccctcctcctgcgggatctcggtgacgatgacggaggaggtgaggaaggtcttggccacggacgcggcattctccagcgcgcagcggatgaccttggcgggatcgatgatgcccgcggccagcaggtcctcgtacgcgccagttgccgcgttgtagccgaaggcgggcgacccgccgtccagcacacgctgcatgaccaccgacccgttgtcgcccgcgttggaggcgatgagcttgagcggatagggcagcgcgcggcgcaggatgtcggcgcccatgcgctgctcgtcgttgtccaggctgccgcggaaggcgtcgatgcgctgcgccagctggagcagggtgcagccgccgccggtgacgatgccctcctccaccgcggccttggtggcgttcagcgcgtcctccacgcgcagcttcttctccttcagctcagtctcggtctgggcgcccacctggatgacagccacgccgccggacaggcgcgccacgcgctcgttcagcttctccttctcgtactcggcctccgtctcggcggccatgttgcggatctggcgcacgcgcgccgcgatggcctccgcggtggagctgtcccccacgatggtcaggctctccttggagacggagatcttggccgccatgcccagcacctcctcccccgcgccgtccagggacacacccatctcctccttcaccacggtgccgccggtgaggatggcgatgtcctccaggtaggaggtcttgcgctcgccgaagccgggggccttgacggccaccaccttgagcgcgccgcgcagcttgttcaccaccagcgtggccagcgcctcctgctcgatgtcctcagccatgatgaggagcgggtagccgccgcggatggcaccctccagcacacccaccatgtcgcgcgcggtggcgatcttgcggtccaccagcagcaggcggcagccctcgtactcggccaccatgcgctccgggtcggtgacaaagtagggcgagatgtagccgcggtcgaactgcatgccctccaccacctgcaggctgtcctccgcggtcttggactcctccatggtcaccacccccgcgcgccctacgcgcgccatggccgacgcgatgagctcgccgatgacggcgttgccgccggccgacacggtggccacgtcgcgcagctcgttgtcggagacctcggtggaaagcgcggccagctcggccaccaggtgcgtcaccgtgcgctccagcccgcggatgacctggacggggttcacccccgccgctacgatcttcatgccctcctggatgatgcccgccgccaggatggtggccgtcgtggtcccgtccccagccaggtcgttggtcttggaggccgcctggcgcaccagcttggccccgatgttctccacggggtcctccagctccacctcgcgcgccacggtcacgccgtcgttcacgatcttgggggagccgtacttggtctccagcaccacgttgcgacccttggggcccagggtcacgcctaccacgctcgccagcttgtccacgcccgcctgcatgcgcttcagcgcctcgccgtcggtgttgaagtgcagctgcttggcggcgcgggtgaccgcagcgccgcgccgcgcgggccgcgtgggcacgccggagcgccgcagcgcggggcgagggcctgtggaggtgtgtgtgaggggagtgaggggtcgatgggcggatgggagtggggaggaggggtggcggttgggggatgtccaaagcaaggtccacacagccaccacgtggcagaatag

SEQ ID NO: 8033 - DNA, 1830 bp, Chlorella protothecoides
atgctattctgccacgtggtggctgtgtggaccttgctttggacatcccccaaccgccacccctcctccccactcccatccgcccatcgacccctcactcccctcacacacacctccacaggccctcgccccgcgctgcggcgctccggcgtgcccacgcggcccgcgcggcgcggcgctgcggtcacccgcgccgccaagcagctgcacttcaacaccgacggcgaggcgctgaagcgcatgcaggcgggcgtggacaagctggcgagcgtggtaggcgtgaccctgggccccaagggtcgcaacgtggtgctggagaccaagtacggctcccccaagatcgtgaacgacggcgtgaccgtggcgcgcgaggtggagctggaggaccccgtggagaacatcggggccaagctggtgcgccaggcggcctccaagaccaacgacctggctggggacgggaccacgacggccaccatcctggcggcgggcatcatccaggagggcatgaagatcgtagcggcgggggtgaaccccgtccaggtcatccgcgggctggagcgcacggtgacgcacctggtggccgagctggccgcgctttccaccgaggtctccgacaacgagctgcgcgacgtggccaccgtgtcggccggcggcaacgccgtcatcggcgagctcatcgcgtcggccatggcgcgcgtagggcgcgcgggggtggtgaccatggaggagtccaagaccgcggaggacagcctgcaggtggtggagggcatgcagttcgaccgcggctacatctcgccctactttgtcaccgacccggagcgcatggtggccgagtacgagggctgccgcctgctgctggtggaccgcaagatcgccaccgcgcgcgacatggtgggtgtgctggagggtgccatccgcggcggctacccgctcctcatcatggctgaggacatcgagcaggaggcgctggccacgctggtggtgaacaagctgcgcggcgcgctcaaggtggtggccgtcaaggcccccggcttcggcgagcgcaagacctcctacctggaggacatcgccatcctcaccggcggcaccgtggtgaaggaggagatgggtgtgtccctggacggcgcgggggaggaggtgctgggcatggcggccaagatctccgtctccaaggagagcctgaccatcgtgggggacagctccaccgcggaggccatcgcggcgcgcgtgcgccagatccgcaacatggccgccgagacggaggccgagtacgagaaggagaagctgaacgagcgcgtggcgcgcctgtccggcggcgtggctgtcatccaggtgggcgcccagaccgagactgagctgaaggagaagaagctgcgcgtggaggacgcgctgaacgccaccaaggccgcggtggaggagggcatcgtcaccggcggcggctgcaccctgctccagctggcgcagcgcatcgacgccttccgcggcagcctggacaacgacgagcagcgcatgggcgccgacatcctgcgccgcgcgctgccctatccgctcaagctcatcgcctccaacgcgggcgacaacgggtcggtggtcatgcagcgtgtgctggacggcgggtcgcccgccttcggctacaacgcggcaactggcgcgtacgaggacctgctggccgcgggcatcatcgatcccgccaaggtcatccgctgcgcgctggagaatgccgcgtccgtggccaagaccttcctcacctcctccgtcatcgtcaccgagatcccgcaggaggagggcgcggcagctgccccggccgacggcggctacggcggctactga

SEQ ID NO: 8034 - DNA, 765 bp, Chlorella protothecoides
  modified_base (235)..(244): a, c, t, g, unknown or other
atggagtgcaaggaggcttaccaaaccctgctttcaagaagtggcagggcggggagggggagcagcagcgccaagcccccgccggcccccggtcccgacttctggaactgggacctcaaggggttcagtcccggcgaggcacaggaggaagcctacagcctgggcaaggccgatggcatgctgggaccacatctcgtgtttcgtcatcctcacgagacccggggcctggccacannnnnnnnnngatggcatgctgggaccacatctcgtgtttgtcatcatcacgagacccgggccctggccaacacacccatccctgcccccccaatcttctcccgaccagcggatgtcctgcgcgacattgaacgtgagattgctgcttacctggagaagcgaaggaagaagcagggaaagatggggccgacatccttctgggacgacctcgctggcgtgggcgaggagtttgtagagttcctggagtcggtagggggagtgagcctctgtattcttttggagggcttggggctccaagacgaggagggtgcagggaaggaccaggcagaggctggagctagggacaaggcatccgaacagcggaacgggagtggtgcccacgctgcatctggggccgaggcacggcgcaagagggaggaggacgcggctgcacagcgcaaacgggaggaggatgcggcggctgcgcagcgggcggcgtcgcctaccatcgaagatgagctcagtgagctgcgaaagaagctgggcctctga

SEQ ID NO: 8035 - DNA, 1185 bp, Chlorella protothecoides
  modified_base (98)..(107): a, c, t, g, unknown or other
  modified_base (210)..(219): a, c, t, g, unknown or other
atggccttcctgatcgagggcatgctcctggtcttccacctcaagggccctaagatcgagatcctggtgcacctcatcctcgtcatccaggtgggggnnnnnnnnnngtgtgggtttgggagattggaccacacactccttttgtgcaactgcacctgcacttctgcaggccacaagctgtctcgagatgcttcattcccccgacacctnnnnnnnnnngagccctggtttggcacgcaggggactcttcgtctgccttggtccggcccctgcatctgcgctctggtcgccagctgtctcgactgggaacaggtgatccaccagtcccccccgcgcgtcgcagatcttcctcaccgtggtggccgtggtgttcgaagccctgatgcccaccagcttcgcggccgccctggcgcgccccctgtccactgtgatccagggcgtgtggtggatccagacggcatacatcatgtaccgaggtgcggcgaggggcgctcatgcgggtttgggagattggaccacacacactttttgtgcaactgcacctgcatttctgcaggccacaagccgtctcgagatgcttcattcccccgacacctgcctgcagcaaagccgcagtgggatccggaggacatgagctccgcgatgatggcgcccgtggcgtgggtcacgcatgtgctgtggatcacagccgccatgctctcgggtaaggggtggcagcgcgcggctgcccagacgcacgcgccgtcttgcgtttggcgatcggcggcctcagcccggggtgggctggtgctgaccttgccaagtattcccaccctccgctgcagccaggagctcaaaccaactccccccttccccccccccatctccgtcagtatttctgctgatgcgctgggttacagagcggcacctgggctgggtgtacaaggaggagcgcggcgcgccggggctgggctcgcccatgcccgctgccagcgctgcccccccctcggttgtattacatgttgcgaggggatgacgtgtcaagcctgctacagagtgtacagaggagctgggcgggcaaccgcgggggtgcacggcttcagagccacgccgtgctttccatcgccgctcggcgccagggctcagctctgcaccacggccagctgggcggtggttaggcgcaggccgctgccctgcaccgagtag

SEQ ID NO: 8036 - DNA, 336 bp, Chlorella protothecoides
atggccacgaatggcgatatagtcgagggctaccttgtggtgaaggtgctcgaagttgcagggcacaataaaaacgacgaacctgtgtgggacccgtcattccaggcgggctacgtcaaaggcgagtccacaagctcttgcctgtggttggaggggttgagatccgtggaggctcccgcatcgtcaagaagagcacaagcttgcaaaaagtggtcgacaatgtcatcacctgggaagagcagctcgcactgtgagcctggttgctggtgtcagctggctgctgggtgttgtggacacggccgtgatggagcgctcactcacctgccccttccgtga

SEQ ID NO: 8037 - DNA, 717 bp, Chlorella protothecoides
  modified_base (627)..(636): a, c, t, g, unknown or other
atgaactccgcatcatgctctgccaggagaagaagtccgatgagaggcctgccagatccagcatcgtcgcggcctgcggtgagtgcaggggcttccctttgtggtgcagcgcgctccaaaacaatggcccgcgaggtgcacgcttgccccctcctgccctccagtgcagtgggcgctgatgaggtcatccatcttggctgtgccccatctgcaggcatatacattcgggacctgttggaggctgtgccggtcgacaagtactttgagctgttccagcccagtacgtggcgcgagcagtgtctggcatgttgtcacaggaggggggagcagtacagcatgcaagccaggcctacatgccctgggtcgaaggtcacgacgggaaagctgcctgccccagtcgacacgatatgtgcatgtactgacgcgcgtggcgtagatcttgcccacccttcgctccccctcaccccacctcagagctgggcaaggatggcggcttcatccgcgtctctgtcaactacctcctccccgaccaagtcaggaatggcgcaccccccctggaggcagagccggccgcaagtttgcaacctacctcctcccaatggagcctccctccctcgcctcgctcannnnnnnnnnggctgcgtggcggtgcataggttggagctggacatgcacatgtccggctgtgtgtgtgtgctggccggcacagcgctttag

SEQ ID NO: 8038 - DNA, 1992 bp, Chlorella protothecoides
  modified_base (415)..(424): a, c, t, g, unknown or other
atgcagcggtgcgacagggcagtggcaacacacgcctcatccgctgcggccggcgacgcgctgcccaccggccccacgcgcctggagaagctggcggacgtgctgaccatgatgttcccgctctgggcgctgatcagcggcgtggtggcgtaccgccacccagcctctctcaactggatcaccggcgcgcagtttgaggccggggtgggcaccctcatgctcgccatgggcctctccctgaccaaggacgacttccggaaggcacgcgggctcgggggattgtgtagagagggggaggggggagggggagggggtggcagacctccatcccctcatcaacatcgacccacccacccatccacccgccgccaaactcaccacccgccgcagtgcgtgtccaacccggtgcccatcnnnnnnnnnngggtggcagacctccatcccctcatcaacaccgacccagccacccacccaccgccaaactcaccacccgccgcagtgtgtgtccaacccggtgcccatactgtgtgggttcgcggcccagtacgccatcatgcccagcctggcgctggccatctctcgcgcgctgggcctgtctcccggcctctccgtcggcctgatcctgctcggctgctgccccggcggccaggcctccaacatcgccacctacgtggccaacggcgacgtcgcgctgtcggtcatcatgaccgccgcctccaccctggccgccacggtcatgaccccgctgctcaccagcacgctggctgggcgcttcgtcccggtcagcaccgccgcgctggcggcctccaccgtcaagctggtgcttctgcccacgctggccggcgtggtgctgaacgagacgctgccgggcctcgtcggccgcgtgcgccccgccatgcccctcctggccatcctgctcaccgtggtcctctgcgccacgcccgtcgcgcaggtcgcgcccctcctagcgtgcgtgcggggggttgtgtggatgtggggggggcactggccttgttggatccagagaccgggggggtgggaggaccccttccattgaggggtccccctgcccgtgccatggggaaaacggggtgtcacgccgtccttcaggcctccagacgagtccttgggggcgccacgctcccccctgcacacccggctgccccatgtgccgcccacccgcgtgcaccacccgagcaagccccacgttgcgccccagggtctcacacccacgatcacaaccacctgcaggctgcacggcgcctcggcctgcctgccggtcctgctgctgcacacgctgggctacttcttcggctacctcctcccgcgcgtgctggggttcggggagcgaacctcgcgcaccgtcagcatcgagacggggatgcagagcgcggccatgggctacgcgctctccaccaagcactttgccgacgtgctggtggccatgccctccgccgtctccatcctcttcatggtctggatcggggcggcgctggcggtggtctggcgcctcgtccccatcaaggacgacagacatgcggcctgagggcgcggcacaggcggtctgcaaggaagcgccgacggtccctgcctgctacgacgtgcgcgctgcccgacggtgcatggagggtggcacgccctcccacgccacccaccctgggactgcaatcccctgcatgcgtccaccatcatgtccctgccacccaggatgggtgccgcagtaaagtcaggggaggtgtacagcctgcaagcactgcagcgacgttcactgtgggatgcagacggagggaggggcaacgtcgtggcataggtgtacatggggggggccgatggcgcgggggttcagtttttcttggccagcactcgcgtggcagccaaggcggccgcggccgccagcagggccagctggacccagggcgccctgcccttctccttcttggcgggctcgctgagctccgtcctgagcgaggcgagggagggaggctccattga

SEQ ID NO: 8039 - DNA, 1044 bp, Chlorella protothecoides
atgcaggggtttggccaacctgctcaagcgttgctgcgtcagtgcaacatcactggctttatcctgcatgtctctccttacctcgcaccagcgctgctctgccccactctccacccaggcggtcaagactggtcctaccgcgggtgcgtgaccaacagccatcccagcgatgttttccccctgtcctggcctgagctgcccccatgcacggtggtggggccagggtatgctcaaataggcgtcctagccgagcccttgggtgagtcactgccctgtctagctgtaggttggggtcgggggtggagtcggagtgtggggggtagtaatgcatgcacagcgccatggagaagcaaggcagcgggagtccctcgccagcgtgagtgcccgcatgctcagcaggctcaaatgcgtagggctgatgtttcagagtcttccccactgcgccctcccaaacctggctgcagaccaagcgcgggccaaggagggcagcaagctgggcgccaaggaggagtttgccaagatggtgggcctggacctcttcaacttcatgcagagttttggcggagtgcagaacgtagggagcaacaaccttctggtgcccatgaatgtgctggatgcctggtaccagcgtctcgaacggcggctgaggaaggacccagactttctcacacgccagcgcgacaaggtgtgtgcattgcaggtgcttcttcccctgcaggtgattcatcccctgcaggtgacactgtacagcttgctctcctctgtccccttcagctccacaactttgtaagctcagctccagaagcttcagacagcagcaaacaaaaaatgacagaacgcagcagcaacaacgtacacaaccagctgcctctgggcgcagaccaggcgacgctcaggccagcctccttcagcatctccttgagcttgccgctgtcattggcagccattgtgtctgagggggagcatgggggagacatggggattgtcatgagtgtcctcacatcaatgcacctgtcatgcaaagcgatgctggcaccaccgtga

SEQ ID NO: 8040 - DNA, 615 bp, Chlorella protothecoides
atggacggcgatcatcctcatgttttgtctgaatccgggctgacaagtcattcgaaagacaacaacccaagtttcaaccaaaagcatattcaacaagcaaagatggcgtcttttgcgctcgccaccacgggtgcttccctggcctttacccgtgtgctgcgtccccagtcactgcatcgcgttgccctcgctaggccagctgctgtccggacaaagggtgcgcctcgggccctgcccaacccacgccgcgccctgagcgtgaccacccgtgccatgtcgggggatttggtggccacgctgaaggagaagaacaagaagaaccccgtgcctcacaaagtctacttgcatgacgtcattgcccgatgtccccctgctatccaccgatggccagactgtgcggaggtgaagagcctgttccagaagctcaaggtggacgccaaggtcattgagctggacagcctggccgacggcaacgacgttcagcaggcgctcttcgaggtggtgggcaagaagacggtgcctcaggtgtttgtgggtggccagcacatcggcggctgcgacggtgagtttacaaagggaagtgatgaatatccctatgcaaggccatgcacctga

SEQ ID NO: 8041 - DNA, 402 bp, Chlorella protothecoides
atggagccccccaacttcttgggcgacgacttctcccgcgtgaccaacatcgcccgcgtgacgcagtacaacatcgcctgctgctatgccgcgctgggccaggtcgactccggcctcgaggcactggagagcgcgctggactctggcttcgaggactacgccaaggtggggctggggcaggggtcgtggggagactgcgccctcgcctccccgcctcgatctgccctgccacgtcggcgtcgcccttacccccctcccccaacaccccttggccaggtccgctctgacaagaacctggagaagctgcgcacctccccccgcttcaagaccatcatcgacaagtacgacgagcccttcatcaacgaggccgccatcaggtggggtggttcttcacgctgctga

SEQ ID NO: 8042 - DNA, 1761 bp, Chlorella protothecoides
atgggggctagtgccagcaccccggcagacttttcccacaaactgaggcatggcgtgatcgcgaaggaactcgacggcggcagcctgggggagcccagcctggccgtcattccccagccagggggagcgcccctgctggcactggcataccaggtgtcgtccctgccccaccagggctccagggatcagtacattgccttcaccaccagcaaggacgggcagggatgtgtcgcgagtccccgcccctgcacatgtggggtcggagcagggccggcaagctcgcgagcttgcagcccgggagcccccgactcgcaagccgcacgatgctctccacacaaggccgaccacctgcccgcaggcggggagacgtggcagccgcaccggcccgtgcagtggggcttgaccccgctctgggcgcccgtgctgcactgggacgcggcggggcggcggctggccctgtattactccgaatcgcggaaggccccctcccccggtggcgacattcggcgcatagtctccctggacgccggcaccacgtggtcgccgcccagcctggtgtgggcgcacgaggcccacgagccggtgcccaaggtgacctccagccgccccgtgctcggcaccagcggtgagctcttcctggcggtgcacctggaaccccagggcgcgcacgccgtcttcaacaaggacacctacagcgagctgggggcggagcgggcggccgtgccatgcgtgacggcgccgccgggggcaaccccgcccagcctgctctcggctgcgggtgggtgtcgtaggttacggggcttgggagcggcgatgtgtagcgctgggggaaggcaaagcaccttcatcgtgatgcctgattcggccgggggacctagatctcaagcgaagaggcgctgtattgaccatgggcatggttccagcctggcgactcttgcgatcactacatcgacgatacgcggtcaccaactccacgtccccaccttatccacctgctgctgtgaccccctgcgtttgtcctggcccctctctcccgcagcgatcctggtttcgcgggacgggggtgacaactgggcgctggcgtccatcatcgaccaccctaagacctggctgaaccagccggcgctggaggtgctgtcggatggcacgctcgtggccctcttccgcagctgcatgggtgggcgtgggggtggcaagagggggaaatatggggtgagggttgggcatttcaccccgcaggccgggagggtggacttcatgcccctggcatctggtcgctcccatgtctgtgccctctggcggcatgcctgtttgccggcaatgcccctgctgtgtgcgtgccaggttgctgtccctccccgcgaccggacctggttgcgaagactcttggccctccggcaccaccgtcgctcaccctcatcaccacctccctctgtctacttcccctcctctctgatgccagggcaagtgttccggtccgtgggcacgcccgacggcagctcctggagcaagccgggcgcggtggcgctggccaaccccaactccaagctggcgagcctgctgctggacgaccagctgctggcggtgcacaacgtcggctccaaggaccgggccagcctgaccatctcgctgtcgctgaccgcgggcaggacctgggaggaggtggtttccctgcacaaactgccgggaggtgcggggcgctgggacggagggttggccctgggggtcggtggcctctgcttgtatgaaggggatccttga

SEQ ID NO: 8043 - DNA, 2058 bp, Chlorella protothecoides
  modified_base (855)..(864): a, c, t, g, unknown or other
  modified_base (1277)..(1286): a, c, t, g, unknown or other
  modified_base (1595)..(1604): a, c, t, g, unknown or other
  modified_base (1825)..(1834): a, c, t, g, unknown or other
  modified_base (1959)..(1968): a, c, t, g, unknown or other
atgaaggagacagaggcgtgggcccacctggatcaggtggagcagagctcggagcgggcccaggaggtgctcgaccagctggaggcggtgctgatgcagcagctggcctcggccgagcaagtgtgccccctggccgagggcgaggccgcgctggaggccctcacccgtgaggtcggcgagagcggggggcccaatctcggtgcgcgcgggggcggtgggacgccgggagaagcgaccgaccctgcagcgccagaccccaccgccgccgacccgctgtccacctgtgcgctgctggcatggctgacccagctgtccgcccgcatcgcgcggcgcgagcgggaggccggcgcggccctgggagacctccagctggaagttacgcgcggcgagcggcgcctggcggccatgcgcggcgcgcacgcccgctccgacgccatgtgctcgctgctgcgcgcaagcgcgcgagaacgcgtgaagaagctgcgccggctgcagcgcagcgtcgccacactgctggaccgccacttcggtagctacctgggcatgcgcgggcacgcagggtcggtgaccgtggactacgagacgcggcggctgcgcatggaggtgcacatcgccggcggagcacgcgtgaccgacatgaacgcgctgagcggcggggagcgcagcattgccaccgtctgcctcatcatggccatgggggatggggtgccctgggagggaagagcatggtgtggtgcaggagtttatgctagagaccactccacctggacacgggcatcaatgtatgtgtctcagtctctgagtttgccaaaatttagcgacccgcctctccctcccaacttcttcaccctctcnnnnnnnnnnggggggttgttgaaaaggggttgtttttctgcttccgagggtgagggtgggggtgagggtgggggtgaggagagaggggacggggtgcgctgggagggaagagcatggtgtggtgcaggagtttatgccagagaccgctccacctggacatgggcatcgatgtgtgtgtctcagtctctgagtttgccacgattcagcgacctgcctctccctcccaacttcttcaccctctctatacacctgcaggttatgtgggtcagggcgcgcccttcagctgcatggacgagtttgacgtcttcatggacgccatcaaccgacggtgagcgccggggatgggccggtgtggggccggtcctggaagggccaccatgtgaggagctcacctccgcagggcaagggagcacggaggcttnnnnnnnnnngtcaaccgacggtgagtgccgggggataggccggtgtggggctggtcctggaagggccaccgtagtcgccctccagttcctgctcgagtttgcctacaagttccaagaccggcagtttatctacctgacgccacaggcgagtgcagcaatgggaaaggcgttggggatacgggccagagtaggagcctggcaggagcctggcaggtgcatgcatctgcatggactgccagcacttatcagcactgcagatcctcagagtccgcggaacgactatgaaacatcggcaggattgcgcctgctctaccgtgnnnnnnnnnntagcactgcagatcctcggagtccgcggcatgactacgaagcatcggcaggattgcgcctgctctaccgtgcccgcattccatcacctgaccccgccctcctgcccctgcagctacagtatcacgctggctacaatctttcaatccttctcagcttccgtaaacccacttcaggtcgtctcaggatcactccaggagtgttgttcaggagcacactcgtcnnnnnnnnnntcttccccctggttttctccggaccgtgcgcatgcgggcccctcgctccgaagcctgatgatcatgtcagggccgaacggagtgggatcgggccgtgcaccttagtacatagtgtcccggacagnnnnnnnnnnatgtcccgagccaccagagccattgtggggaattggcaggcacatagtgtcccggacagcactgttatgaagatgtttaccagcagctga

SEQ ID NO: 8044 - DNA, 1446 bp, Chlorella protothecoides
atgtccctggctctgaagcccgatgaggaaaagatgttcgagggccagccccagggcttcccatttggcgactttgacctggaggatgtgatgctgccggagggtgatgacgacttcgggttcccaagcgaggaggaggaggaggaggaggaggacgcccagaccgagtctggcttcgccaacgtgctgggtgaggggatgtgggggtattgtgtgtgggccctcctgtgcttcgcctcctgccggtgccgatcatgcggccccgaggcccacccccttggctccacaccccctcccctcccctcattcccccccattcacatacacacagtggtggacggcgtgcccaaggtgtcccaagaaaagtaccagaagctgaccagcatcctgaccaagatcctgagcggccccggccacatccgcgagaacgggctgtggcaccccgtggacgaggccaccggcctgtccaagggctgcgtgttcgtggagtacgagacccccgaccaggcccgcgccgcgcaggccgcgctgcacggctacgcgctggacaaggcgcacaagttctccgccacgctgtacgacgaggcggagcggctggctgccgtgcccgacgagtacgtggcccccgagccgcgcgacgccccgccccccgagaaccagtggtcctggctgtcggaccggcgcgggcgcgaccagttcgtggctcgcttcggggacgagaccgagatctactggaacgacgtggccaagcagcagccggaggacgtgtacaaacgctccacctggaccgagctgttcgtgctgtggacgccgcgcggctcggcgctggccacgctgcaccgccagggggtggcgctgtggggcggcgactccttcggccgcctcatgcgcttcagccaccagctggtccagcgcgtggccttctccgccgacgagcgctacgcctacaccttctcggaggtgccgccggcggggccgcgcgacccgctccgcttcctgctcatcgtctgggacgtgcggtcggggcgcaagctgcgcgtgttcgaggggccgcaggccgagttcgccgtcggcgccgccgcgcgccccgacggcggcctggcctgggacgcgttccgctggtcggggggcgccgcgcccggcgcgccctccttcctggcccacctgaagaagggtggggtggcggtgtacgagagccccgactttggcctggtggaccgcaagtctgtcaagctggacagcgtgcagagcatcgagtggtcgcccgccgagccggtgctggccgcctaccaggtggaggagggcaacatgcccgcgcgcatcatgctcatgcgtttccccaagaaggaggagctgagggccaagaacctgcactccgtcgccggtagggagcgtgtgtgggtgtatggggggatggtggagggggaggaaggggggggccggtga

SEQ ID NO: 8045 - DNA, 1311 bp, Chlorella protothecoides
  modified_base (52)..(61): a, c, t, g, unknown or other
  modified_base (645)..(654): a, c, t, g, unknown or other
  modified_base (1061)..(1070): a, c, t, g, unknown or other
atgatcctaccagacgcacacacggaccgggaccggccacaccccagtcagnnnnnnnnnnagggtagacttgttcaggcatgggtgccgcgcgtgccactgagagaacgccgtgccagtcctgctgcacagcactctggtgtgggctacattggccatgatcccatcagacgcacacacagaccgggaccggccacaccccagtcactgcgccgcggagtcacccgagttcattcctgtccatgccaccctccccggcgcaggcctcccccgaggagggcgccgacgccgccttcttcgagtacgtcgcgcagtcgtaccgctacttcatggctggggacgacgagaagtgtgaggcggtggatgcctccaaggccgccgagtttgatgagcgggccggggagatcacttcggccacgcagcggctcctggcggtgcgtgccgagtgtatggtgtgggggtgtcgagggagctcacagttgtgtgcagggtggtggcggtgagcgccttctgagtgagggggtgtcgggacacatgctgtgcaccagcgcccccggcatgctgaagcactgtcatccctcctgtcacctgccctactgctattctcatccaacctgcattccatctcctttcacatctcccctnnnnnnnnnngtcatccctcctgccaacgagtctctggagcaggagattgccactgcacgggacagcccgtcccccctggttgcggccagggctcgcctggaggagacacaggcggacaaagagaagttcctgaagctcatcgcctccctggaggcacgacccgggcttgagattgctgcctggggcgtccctggttctcaccgcaatgccgctcatgccgataccgttcccttccctgagcacggcggtctcaatgtctctgccatgccactcgactcccctggcacccctcccacttgcatgtacactcaccaacccgccctcacacgcgcagtcccacaaggcctccctggatcgcaaggtggcggagcggcgcagcgacgtggcagcccaggcctcggagctggagggcgtgnnnnnnnnnnacacgcgcagtcccacaaggcctccctggagcgcaaggtggcagaacggcgcagcgacgtggcggcccaggcctcggagctggagggcgtagagcgcgagtgcgcctcgctgcgcgcgcggctggcggtgcagacggtgcgccccgcggatgtgcagcgcatggccgcggagcgcgtggccgcagagcgcgagctgcgtgccgcgaccgcggcgcgcgaggcgctggaggcccggctggcg

SEQ ID NO: 8046 - DNA, 420 bp, Chlorella protothecoides
atggtgcagctagtctccagccacggcaagacgctgaaggtcgtgccctccctcccgagtggcgagcccggcctccatgacggcatctccgcccggctatgggccgccacgtctgcattggctcaagaatccatgtcaacaccttttgtcaccggtatcgctgatggcactttgccaaggtcgaccttccagcactacctagcacaggatacgaactacctgatcatgtatgggaacgcgtatgcgactgccgtgaacatgtgccgaccggaccagcagcacgtggcagcagccctcttggaagtcattgacaaaatcaaccaggaggtcgccaagcataccgaggcgagtctcacagggtcttcctgcctctctgagcagattgcagggtctgagtgcatatcgggcatcgtttcttga

SEQ ID NO: 8047 - DNA, 2241 bp, Chlorella protothecoides
  modified_base (30)..(39): a, c, t, g, unknown or other
  modified_base (136)..(145): a, c, t, g, unknown or other
atgccggccggtgaaggtgccggaacccgnnnnnnnnnnatgcaagcagagcagagctttgtcattcacatgcaggtgaaaaatgggagtagtaaaggtccatctgggggttgcaagcacgaaacagggcttgaannnnnnnnnngcagcttcctccactatctgggccaggatactttctaccgcctcgcatatgccgatgctttcaaggctgcgctacgactttgtcggcctgaggacgagcatctggccctcaggctcagaacagctctcgtgcaagcagagcagagctgtgtccttcacatgcaggtgaaagatgggagtagtaaaggtccatcggggggttgcaagcacgaaacagggcttgaaataagttatgtacggatcgcatggcctgacggatgtcctcaagccacctcccaccccccttcccagagggctgctggcttcgatctctcactttgcaagcccgagcctgccaccttggcatatactgactttcttcaagcaacccacagccatccagatgcgactctggcagacatcatgtccgccaccataccctgtgcgcgtctgtatgcctggattgggcacgtactcttgcccaagcagatggactctagcaacccttacatggaatggattgaaaactacagccgcaagtatgatgaccgacgattccaagacctggaagccattctcgacgaaacctttgtcccagagtgttatggtgaggatgggaggaggaaaggcagtgggcctggtgctggatgctcaatcatccactctatagcaggatccagatcctcctccctcccaccatggacagaccgggtgtcgtacctgtactcagaggccatgcggctggagagggaattctttgccgcgcagcccctgactggtggcgaatgtcccacgacccataccctcaagcgccaccccaaaccagcaagggctgggttgaacgcccactgctcggcactgcatctgccacaggatgacgcccctggcattcatcaggtcactctctttcagcacactcttccattgcatcgtagccagacagatcagcacacaggacgctgctctgtcaatacctttgggttgtgcgatgcatgcaggaccctgcaccccgactcaggtgctgcgccctatcctgctggcatgaacgagctgtgcggcgcacaggaggtccagttcatccaggagcttcacgcgaaacgagcctgggcccctgacctgccctgcctcgtccactgcggcccgctcagcggccactctgcgcatgagggcaggaaggggtttcgaggcatgcctgagcgaaagacaacgccagagagcaggccagcagtgcatcaaggggagcttgctctggcatgcgacgcggctcctgcaagggtacaagacaggcgcacgaggggtctggatctcgattcttgtctgcaaccccaggggcaaccgcccatgcccgcggtgcctccttggcgggaccgcatggcagctgcacaccaacacccagatgccctccccgcacccaaagtaggccagagcgtgcgccgttgcttccagggcttgctcagggcctgccacggccacgaatgccgcgatgagggccgtcacggagcaccccgtcgctgtgactttttgcaggagggggtgcccattcccgaccaggagggtgctggtgccgtcggtgacgacatccactgccccgctcacagccactatgcaaccctggcgggccgcaagggcacgggccatcggggcggcggcctcagaggggtggctgctgtccacgccgcgtgtgcgttcgccgcccaagcttgccagggccatgatctcagaggcatttccgcgaatgacagttgggcccagtgccatcagatccttgcacagctacagcgagtccggtcggggcgggggtggaatgggaattgcggcggcatcttgcgttggggtaacggggctgatcgcgcagtggaagggacatctcgtctcatgcgggagtcacgtggggcaggggcggaatccggacgaaccaccacttgtcataatggtgcgaacccaccgaagttctggcaggggtggccccgcacgcgacggggtccagcacccatggctttctcaggcgccctgcagtcaaggcggccagtttcatgccgcctgcccagtcctccgacagtgtcccgacgttcaccagcagggcagaggccaactccacgaacgactccacctcgctga

SEQ ID NO: 8048 - DNA, 1599 bp, Chlorella protothecoides
atgcagctcgagaaggagttcttcgccgggcagccactcaattcgcaggtccggcagctgcgactcctggtcatcgactttgatgaaaccatcacgacccgggacacttcaggcaccattgcaaaaacggctatccaggccgtcgtgagcaagctaaaccatgagctcatcgttacgcgagtctcctgctcgggagaattgacctgcaccactaaatcagtctctggccattccgctgcactcaacagctccctgcaacgtgcgcaggtgtctgaggcatcaaagtccgagcatctggtgcaggagctggcagacaagcacagctggctcatcaggaactacaccgaccggcgcacctccctcctcgaggatgccctgcccccacgcacacccaccatgcacctgctgcaggagggggaggtcaggacggagtttgacatgggttggctcggtgactttgtggatcgcctggctgattttgaccgggagatgaacaccgtggtcgtcgactctgcaaaccgccggccccctcggacatgcaggcatcctgaagggtgtccgccgcgagcagctggcgcaggccggggcggctgtggagatgcagcccgggagcctggcggtgatgcagaaggcagtcaaggcgggcatccctgtgtgagttgcgcggggttggaattttgggggcaggccgagagtgtgacgcccacccactgtgatgtctcaggggagtgggtgcacggtgcgcaaggggggtgtcccatgctttttgccaggtcacatacagatgcaggcatggatgggttggggctgctccttttgtcaccatgctcgaatcccagattggaagccaggtccgctctgggcctgtgtagtgttcaatcgcaccaaccactcatccccaaccccctcctgcagggccgtggtgtcggtgagctggtcggcagagtttgtgcgggcggcgctggcgcagcaggggctgccggtggtcgtcagcgacagcgacggccaaggggccgacgtcccctccgtcagcgccgtcaccgtctacgccaacgagctggagtactttggggacgagtccaccggcaacatccgcaggcgagatggaaggggtttttcttgggatgttcaggattggaagcgggcggaggggtcagagtgggtttggatgccgggggccggtcgcgcgatgcgtccagaccgttggtgcctgcaccgtgcccggcccgtgcccggccttgccagccagcgccggggtcgcaccccatgcgcacgcctcaggcccccgatccggtgcgcatgaagagacccgcccacctcgccggggtgcccgtcaccgtcctccgcaggcggtgcgagtgcggcgcggacaaggcccgcctgctggacgacctgctgctgggcctggccgcggaggccggctccggcggcgacgcggtgtacgtcggcgactccatgaccgacgtgccgcccctcatctccgccgacgtggggctggtggtgggccgcaacccgctggtgcgccgcgtggccgccgccggcggcgtgcgcctggcgccgctgccctgcgcgcccatggcggcgccgggcgaggactcc

SEQ ID NO: 8049 - DNA, 489 bp, Chlorella protothecoides
atggggctcacaggccgggcaacagcgctcctgttggagaagtgccgggaggagaatcccttggtgcagtgtatcaccaactttgtgagcatggatctgatggccaacaccctgctcgctgcaggggcatcgccggccatggtgcggaggggtcggctgggtgggcactgcaggttaagcctggagataccgtatccacccggcttagtcgaaacaaacatttcaagtccacaggctcactcgatcagcgaggtggagtcgttcgtggagttggcctctgccctgctggtgaacgtcgggacactgtcggaggactgggcaggcggcatgaaactggccgccttgactgcagggcgcctgagaaagccatgggtgctggaccccgtcgcgtgcggggccacccctgccagaacttcggtgggttcgcaccattatgacaagtggtggttcgtccggattccgcccctgccccacgtgactcccgcatga

SEQ ID NO: 8050 - DNA, 696 bp, Chlorella protothecoides
atggatcggcgcaaaacgctcggggctttgagccccgggtcgcttaactcccgtgcctcgctcgcacccgggcgcttcaccaaggatgcggcaaaggccacgggttgggcgtcaaaagttcccttggacaaagccatgagcaggatgtcgctcgcgggacccgtgcagcgccgctcctccgcgtacaccacgacgaaggcctcggggctcaagtccgacccccgccccgttggcgacaaacagtaccaggccaactgcgcccgcaccatcatcacatacctcgctacgcacaactacgagtaccagatcaaccccaaagtgcgtggtgcccgggatgatggtccatggttcggtgcaaccacctgcccgccggactccccctctccccaccgtcctttccccgccccctccccgcaggtgctggccagcccgacgaccaaggacttcactaacatcatgctcttcctcctgcgccgcctggaccccttgaccgccaagggccccgtcaagctggaggaggaggttccggtgctgtacaagcgcctccgctaccctttccagatctccaagtccaacctgaccgcggtgggctccccgcacacctggccttcaatcctggccgccctggcctggctcgtggagctgctgaactaccaggaccaggccgagcacgccgtgcagatggtgcgaccttga

SEQ ID NO: 8051 - DNA, 699 bp, Chlorella protothecoides
atggccctggcaagcttgggcggcgaacgcacacgcggcgtggacagcagccacccctctgaggccgccgccccgatggcccgtgcccttgcggcccgccagggttgcatagtggctgtgagcggggcagtggatgtcgtcaccgacggcaccagcaccctcctggtcgggaatgggcaccccctcctgcaaaaagtcacagcgacggggtgctccgtgacggccctcatcgcggcattcgtggccgtggcaggccctgagcaagccctggaagcaacggcgcacgctctggcctactttgggtgcggggagggcatctgggtgttggtgtgcagctgccatgcggtcccgccaaggaggcaccgcgggcatgggcggttgcccctggggttgcagacaagaatcgagatccagacccctcgtgcgcctgtcttgtacccttgcaggagccgcgtcgcatgccagagcaagctccccttgatgcactgctggcctgctctctggcgttgtctttcgctcaggcatgcctcgaaaccccttcctgccctcatgcgcagagtggccgctgagcgggccgcagtggacgaggcagggcaggtcaggggcccaggctcgtttcgcgtgaagctcctggatgaactggacctcctgtgcgccgcacagctcgttcatgccagcaggatagggcgcagcacctga

SEQ ID NO: 8052 - DNA, 327 bp, Chlorella protothecoides
  modified_base (83)..(92): a, c, t, g, unknown or other
  modified_base (301)..(310): a, c, t, g, unknown or other
atgcgtacctgtacattactgccaggagcacatcacgatttcctcgttcctcgaccctcccagcttcatggacttcgaggacnnnnnnnnnngcctgcacatcactgccaagagcatatcatgacttcctcgttccttgaccctcccagcttcatggacttcgaggacgaggacaaggtgctgcccagcgatgctgtcatggagtatgaagagggtttcaagcttgtctgcgactcaaaatcgctcctgtacctctttggcatgtccctggactactcagatgagctcataggcggcgggnnnnnnnnnnaacaaccccaatgctga

SEQ ID NO: 8053 - DNA, 897 bp, Chlorella protothecoides
  modified_base (338)..(347): a, c, t, g, unknown or other
  modified_base (772)..(781): a, c, t, g, unknown or other
atggggggtttagaaacctggctcgccactctgcaactgcaccgggagtcgtcagagccattgagtgccaaatggcccggtgactgcaacaccggctggcaagatgcctgccccttggcttaccgccgcctgctgccccaccggtcacaccctgcactcctactctctacttgtacaacacctggggccactgcaacacccctcactccttacgtcccctgcagtgagcggcgagcacccgggcaacaggctgctggagaagcgaggcaatgcgctgacgcacgacctggagctggggaccgccacgctacgcgcgctgagctctgctgctggaaggnnnnnnnnnngctggagaagcgaggcaatgcgctgacgcatgacctggagctggggaccgccacgctgcgtgcgctgagctctgctgctggaagcgatgctcggacgcgcgtgccgcgctacgacaagtccgcgcacgccgggcgcggcgaccgcttccccgaggaccagtgggcggcggtagagggcccggtcgacctggtcctcttcgaaggctggatgctggggtttcaggccaccgatgaggaggctgcggctgcgatagacccagacctcgtgcccatcaatcgcgccctacgcaggtacaaggatgcatgggatatgtatgtgcactcctggatcgtcatccaggtggcagatgctgggtacgccgccgcttggcgtttggaagctgagcagaagcagcgccggtccggggctgaagcacatgcgcccnnnnnnnnnncccgccatgaccgatgcgcaggcgagggcaatgcttggttctcgttgggggggaaaggaatgagggttgctgggatggggaaagcgctggcacgtctgagttggcatggggcgtag

SEQ ID NO: 8054 - DNA, 657 bp, Chlorella protothecoides
atgctcccggccgcggcggcagccttcgaggagctcacggatgcggcggcgcagctcatgcgcagcgtgggagactttgggctgtacagcaagacgagggagcagattgcggccgggggtgccgcggcgctgggcccggccgcagcgggcggtctgacggccacgcccgggccaagcctcacgctcatggctggccggggggcctcaaacggcgatgcaggggcggctacattccacaacccgcccccgcctgctgatgcggagctgaacatatatggcgaggagggcgggggggggcgggccgagaccccggcgtcggagcggcctctgtcccccgccgatgcggaggcccgcgcggcgggcgagggcgactcgaaggggccacagcgcctcccttccccgctggcgcaggcccagcccctcccttcctcgccggagcccaaggtggaaggccctgcacccagcccagttccctccggcgtgggaagcgacccgctggacgggttccaattagaccccggatccgggcagtgggtgaaccactccctgggctgcacctttgaccccgcgacccagttgtacggggacgtggaaagcggcgcgtggtaccgctggcaggacgggcagtatcacccggtcgtcacaggctcctcctga

SEQ ID NO: 8055 - DNA, 1344 bp, Chlorella protothecoides
atgctctcattgtctgctcccccccaaaaccttcattctctccttctccccccccccgcatcacccccacgcagcgaggtggaggagctggagcgcgacatctgcttcctgctgggcctgctggccatcaaggtggcgcaccagcaggccatctgcaaggccggcgcgctgcgcacgctggtggcgctggtggcgcgctacgcggcgcgcggcgacccgcacctctccggctccgcggcggcggcggcgcggcgcgcggccgacgccatcaccaacctggcccatgagaacaacgcgatcaaggaccgagtgcgcggcgagggcggcgtgccccacctggttggcctgctgtcgtcggtggaccccaaggtgcagcgcgcggtggcgggcagcctgcgcacgctggcgttcaagaacgaggagaacaaggcgctgatcgtggcgctgggcgcgctgccgctgctggtccagatgctgcacgcggaggacaccacgctgcactacgaggcggtgggcgtggtgggcaacctggtgcactcctccgcgcccatcaagcgcgcggtgctggaggcgggcgcgctgcagcccatcatcaacctgctgtccagcccctgccccgactcgcagcgcgaggcagccctgctcctgggccagttcgcgacggagggcgagtacaagttcgccatcgtgcagcgcggcgcggtggcgccgctgatcgagatgctggcccacgccgacacgcagctgcgcgagatggcggccttcgcactgggtcgcctggcccagaacgcggacaaccaggcggggatcatcgcgtcggggggcctgctccccctcatggacctgctggagtcgcggctgggcaacctgcagcacaacgccgcctttgcgctgtacggcctgtccgacaacgacgacaacctgatcgagttcgtgcgggagggcgtggtccagcgcatcctggcctgcgacatgatcgtgcagcccagccgcgactgcgtggccaagacgctcaagcggctgcaggagcgtctgcgcggccgcgtgctggcccagatcctgtacaacatgcagggcgcaggcggcgcggcgcgcgcacgcatcgccgtcgcgctcgccgcgctgaccacgcccgacagcccctcccccgccgccaagcgcgtcatgttcctggagaagcgcaccgtgcatgtgctggtggacgcgctcactgacccgcacacgccgggggacctgcaggcgcaggccgccgcgtccctcatgcgcgtggccgaggcttgtggtgccacctcgcccctgcccctggaccccgagccgccggagccgcaggtgggtgggctgtga

SEQ ID NO: 8056 - DNA, 339 bp, Chlorella protothecoides
atgtgtgcatctgctgattttgctgctccttgtcctaagaaacgccactctttgtcgctcccatgcaccacactccacgctcttattccctgctctgcccctaaccctcacccccgccaggaactggccgatcgagggatcgcccactttgatctgaagtgcgacaacgtcctgctgcagccacgcgacccgccgtcctcccaaggaccaaggggcacgcctggcagcatgcaagacgccctaccctttgaggtggtcctcgccgactttggggagagcatccagtttgacagccgggccgaggccggggcgcccagcctcgctgctgcgtcggggtga

SEQ ID NO: 8057 - DNA, 1371 bp, Chlorella protothecoides
atgcggtcgctagcgcagccatgcggcacgcacctcgaaagtgggcatgctcggtcccatgctcacccctcccgatgtcacccatgtcggggtgtacccgagcatggagaatctcacatgccctcatcacagaagttgagtagcaggagtgagtggggactctctcgtcgagcccttttggcggcccttccttccatgctagccacactgccactggcgtgcggtgcagagccgtccccgagcccagccattacacaccgggtgtactttgacgtgggggtctgcgatgccggagtcaatcgggcgcgaactctgggagacacagtggcctgtgaggcaccggcctaccttggaaggatgactctgggtgcgaaagagccattcagtgtgcatgggggcaaggggttgatgccgtgtccctgcaaaatgcctcccatgcaggatgcagggatatggaggcagcgcctgccatctggactgtatggagatgtggccccggcctcaacagcctcaatcctggaaaccattcgggctggaaagtatgaccagtcgcttataaacaaggtcctgccggggcagtaccttttgctggggcatcagggccccaagaggcttgggtatgtggcgggggcgcagtgctcccagccaaacaccgatctcatgcagccagcttccttccagctgccccaccgccggcccggcaccgtcagccttgcggtcacaggtgagttgtccctggaactggtgccaaggtggtgggggggcctgggctgcatacagaggctgatgcacggctggacatgctgtggaggcaaacagtcgatagaaaacgaggatgagcagtacctgcagcgcctccccagctactgcaacgtcagcatgctcataacgacggggcccgggcctgttccaagcctggatggccagaacgtcgtcattggcgagcttctgggtgagggcatcgcccctgtttgccagacatggcagcaggctgtgtctggagcagggcactgcattgatgagctctgtgcaacgtgtgcccacgttctatccaagcagcaaccgccgtgccttcaacgagctgggccaggttttcggagacaagagggccaacctcgccgccaagcggtggggccggcccttgaaacccatcgtggtgatggcagctggcgagatcagggagacatgaggaaaggagggcgccacaagatgggagacatgaggaaaggagggccccacaagatggtctcactgagcccacttcgcccagccgagtgtaattgttcatgcagactcatgccgattcggatcgtggactggggatggtgggcatcgctcgaagcatcaatctccgctcttttgttgatttag

SEQ ID NO: 8058 - DNA, 1458 bp, Chlorella protothecoides
  modified_base (204)..(213): a, c, t, g, unknown or other
atgagaggtattcgatgtgtttggggctgcacagagcgctggtggtgcctgggcggcggggagttcgttcatcgctctgcaatcttcagttctgccttacggaagaccaatcaacatcccacatcacacagccgtcccatgccgcatcccagatggctccaggaagcattgccgggcgtgattcgagccagggatccccctgannnnnnnnnngccacccctcccagatggctccaggaagcattggggggcgtgattcgagccagggatccccctgaactgcatcatgaggagcttgtgcgtttggtcgactggaagctttctcgaggaaagtggcggcccaggctccaagcctttgccaaagagctggctcctgcgagtgtagctgatgccagccggtctgcctttgcctcttcatacaaggacagctcgtctggagcagaaccaggaccctctgcgctgaagtcggcattcttggagctcaccaagctcaagaattgccctggaatgtcacatgtaggtggatccttatttttaagtaggaaaacagccagagtcattcgagcagtctggcaagacacgacggcactgtgcataatcgctccttgtgcaaccttgccctctccggcccagggagtgggtcctgccacggcctccgctgttctgcaggcgtttcatcccagcattcccttcatgagtgatgaggccatgatggcagcgcttggggaaaaggcatacaccatccccatcgccttggaattcatcaagactcttcgcgagaaggctgctgagctcaacaaactagatgcagaacgacctgtgacaatcttgccattgccaccgaccctgtcctctttgcctgggatgtgccagggagaaggagctggactgccaaggacgtggaacattgcctctttgcagatcaccttgccaggatggttgttgaacgtggggcgaggccgcctgcagccaggggcaagaggaagcgttaggaatcgaggcatgtatggtgttcaatgaccccctggaggggggagactccgttacccacccggtctgccactacgcttcgattccggcgcgatggtggtccatgccacgcaccggccctccacccgccaccacgggcctccgccagcttcgagggcgcatttgttacaaggttccagatttgcgcttgtgcgtcggcgtcttgtctcgcatccttgctcctcgggctttgcacgcaggcgccatcgaggttcaaacgagaacgcgccgatcaagtggcgacttgaccagcgtgcaagcgcgcaggggctcgaccgcgcattgggatccccaagcagtgaacaggcgccgaactcgttcgccgggggacacccgatgtcaataacagagtgcgtggaggtgttgccaggtgggacggagaccctctgcgcccctgcaggccggccgatcagacccggcacgccctga

SEQ ID NO: 8059 - DNA, 993 bp, Chlorella protothecoides
  modified_base (856)..(865): a, c, t, g, unknown or other
atggtgagctcagagaaaggggaggggcctggcaagcttggcggcgagagctgcctttgtgcccctcagtggtcggaaggctggagcccccagcagtggcagaggcgcgcctcgcccatgaccaacagggttcactgcagtggaaacaacatggtcccccggcaatgctcaggagcactgctgacctggaaccaaagcaagcggccatcacctgacccccctctccgctcggccctccctgcagccgacatcatctctgccgtggagtttgatggggatggcgagttcctggccacgggagatcatggagggcgcgtggtcctgttcgagagatgcgcgccgtcacacctggcaaacgaggtgggcggggagggatttggtggagatggcatgcagtgccgtgccggtcgacatccgtgggctgcgcaatgtgtcaatcccctcccgacggcacaccatgcttccccacacactcaacagcctgcggactcccggcccgcctcgccccgcatccccaacgcctacgagtaccgctacctgaccgagttccagtcgcacgagccggagtttgactacctcaagtcgttggagatcgaggagaagatcaacagcgtccggtggtgccggcgagactcccctgccctcgaaacccccacagcccaccacctcctcaccaccaacgacaagaccatcaagctgtggaaggtgtacgagaagcaggtgctgagcgtgagtgggctgaacatggatgctcctgggagcagcggacagaggccgagcctagagggtggcggcgcgccaccgtccctcaaagaaagggagcttcgagtccccacggtgagacgaggccatgggnnnnnnnnnnggggtggcggcgcatcaccgtccctcaaacaaagggagctccgagtccccacggtgagacgaggccatggggccccatcttggttactcatgtttggtcttgggctcagcattgaggcgggaggctag

SEQ ID NO: 8060 - DNA, 498 bp, Chlorella protothecoides
atggacgacctgacggaggtgatcacgcgcgcggccttccaccccacccacagccaccaattcgcctacagcacgagccgcgggtcgctgcgcctggccgacctgcgcgccgccgcgctgtgcgacgcgggggcgaagcattttgaagacgcgggtcctggcgggcccaagaacttcttctctgagatcatctcctccatctccgacttccgcttctcggcagacgggcgccacctcctcgcccgcgacttcatgaccgtcaagctttgggacttggccatggactcggggccgctggaggtgcaccgcgtgcacgaaagcctgaggagcagggtgaggagggaaagaaaggaggagggtggtgtttgggcgggggaacggaggaaagttgagggggtcgttgcggggccattggcgaatggtgcgggtgggtggctgaagcactggaatgcattaaaaaagggggaggggggcaatgggagccactccatgccctga

SEQ ID NO: 8061 - DNA, 1212 bp, Chlorella protothecoides
atggagggcagccccgcacgttgcggtccgggccccgcctttgtcccgcaggaggacaccctgctggccacgctcagcgtggaggagtgcgtgcgctacgcagccctgctgaagggcaccggggccggtgcgggcgcctcgcagggcgacatcgcggcgcgcgtcaccgccgtgctgcaggagctggggctggagggcgtggcgcggtcgcgcgtgggcggcgccgcgctctcccgccgcggcatctccggcggcgagcggcgccgcgtgtccatcgccatggaacttgtgcatgggccgggggtgctcatcctggatgagcccacctcgggcctggactccttcaccgcgctgaacctgatgcacagcctgaagagggtcgccagggccgggcgcatcgtcgtgctctccttccaccagccctccccggccatgttctcgctcctggaccgggcctacctcctcgcgcgggggcgcgcggtgtacggcggcgaccccgcctcggccgccgccttcttcaagtcgcgcggcgtgccctgccccgccggcgatgccatcgcggagcacatgctgcacgccgcctccgaccccgtgaccctaggcgccctgctggcgggggtgcagggaaatggggccgcgggcggcggcagccctcgagtcctgcctgccggccatggaacggttggtgctggaaaggatggagccgccgagaagggcccagcagacgcgcaggaactggctctggtggagctggaggcggggccgggaaccactcgatcaggcacggaggggtcgcacggagtggacgcagcggggcgcggcacggtctccgaccctggccccggccgctcgcgctcgctggagctggcggtcctgttctggcgggcggggctggacatcgcgaggaacccctccctcctcctcctgcactgggccatggcattgggcatgggcatcttcaccggctgcatcttcctcaacgtcggcctcgacatctccggggcccagaaccgggcgggtgagcgatcaaagatgcggaggggtggaggggaagggggcccggtctttgccattgtgcattgccgggtggtcgctgctgcccctgcggcaagcctcaatgccgcgggacgatcatcccatgaaccctttccggcctctcccgcccaggcggcctgttcttcatcctcgccttctttgccttcacgagcctga

SEQ ID NO: 8062 - DNA, 663 bp, Chlorella protothecoides
atggggctgcagtccgattccacgatcgtagctgtcttcctctttgtgctggccaccttctccctggtggtaggtgcctttgcactggcagtcacagtcggtaggtgcctcggggctggtggtgacagcgcgctgcaccggggctgcacgacagcagggaaggccagcctggtgatgaatgtcgtgctcctcatctccctcctggtgggcggctttttcgtgaacgtggcctccatcgccgcctggatcaggtggctgcactacgcctctgtattcttctacgcctacactgccctcatcaccaatgaggtggccaccctctccctcgactttgtgggacctgatgctcgcggaaaaggagagcacctcctccatcgatggctggtccccggagaggccttaacatgttgcagccgcacccatcatgacccccgcgccagccgcatcaccaccttcaaaccctggcaggtggagggctacgctgcggtaaaaaacgtgaggggggtggccttcctgaacatcatcggcgtggatgcgggggacctgacgcgcaacatcatcatcctagactgcctctatgccggcctgctgctggttgccatgcttgtgctgtggctgaggctgcccaccacagcacgcatggcacgggtgacccggcgctga

SEQ ID NO: 8063 - DNA, 1326 bp, Chlorella protothecoides
atgacgaccgcactccgggccgtgtggctgtctgccgagtccaacttccagggcagcttgccagaggcgcggtgtggacacgtggccgcgagcatcaagaaccacgccgcctggggtgacgagttcatcatcatccatggcggcatcaaccgggagcgggaggctctggactcgctggccgtgctgggtctggaccagggcagctggaactcgccctccaaccccaccggccccggcccctccgcccgcgcctttcacgccggcgcggtgctggggcgccggctctacgtcttcggcggacacgtgtacgtcaagcagcaggcgcggctgcacaccttcaatgacctctggtgcctggacaccgacacgtgggagtgggccaggctggagaccgaggcggaggcgccgacgccctgcccgcgcgaccgcgcctgcctcgtggcctccctggacggcagctcgctgctgctctacggcggcgcagacgcgtccaaccgtcggctggacgacctctggcgctacgacatcgccgcgcgcgcatgggccgaggtgggtgccgccggaggggcccggccgcggccgcgctgctcggccacgctgtgcgcactgcccaacaggctgctgctgtttgggggtgacaactacggcgtcagcggcgagctctggagcctgaatgtggtggtggagcgcgccggcgccgctgtgaaaacgtcaagggagggccccggcggggatgggaagccagccaccgggcctgccccccctgcgacggcctcctggacgctgctctccctggaaggcgccgtgcctctgcccaggagaggccacgcagccgccgcctcggggagaggcttcctcgtgtctggcggcttcaccgagcaccgctcgctcatcggcatcaagagccgcggcgtctgcctcgacggtgagtgtgtgctgagagagagggggctgcggctgcgtcctgcagagggccctgctcgcctgccagctgtgacggggccgacaggtctttgtcggcgccgcagcgggggcgtcagcaccctccttggacgctgcatggagcccccccttgatcccaccaccgcccaccctcctccaagacgtctcgatgctggaccgggaggcggagtcgctggtgtggagggccgcggtaccggggtcaaacgacgccgccacgccctgcgcacgggagaagcactcgctcactgccgtgtccgacggccgcctgctcctgtttggaggtggggtgtggagatcaggctgtggcggggtctcgggggggaagcctgtacttccgtcgttcagggatccctgagtgcgtga

SEQ ID NO: 8064 - DNA, 408 bp, Chlorella protothecoides
atgggtaagcggaagtctggtgcgtccagcacctttcccgagaccatcacccagcagccggcccagctgcggtcagccgcgggtccctatgccgtctacttcccatcgggctacgacccggcgactggcgtcaagtgggaaacatacacacatgccaagaagcggcatagcctgattgtggggcgcacggatagcgtcgacttcgtgggcgggagcatgggtggagagcacagcaccgcccctccctgcaggtgtcctggggtgggctggtggggtggaagctcacgccgcccacatcatgtcgccctgcctgttctccctccaaaacccccgaccagcccttgcggcggcaaagtccggcagcctggcccacatgctccatggccaggacgcaagttttgctgctag

SEQ ID NO: 8065 - DNA, 609 bp, Chlorella protothecoides
atggaccgggcccttgcccctcccccatcacctcctcacccccttccccctcccccatcacctcctcacccccacttcctcatcacctcctcacccccccttcctcatcacctcctctccccccctcccccattcccccatcccaaaaggtacgcgctgggcgtgttcgaccgtgccagcggcgccctgaccctggcacccctggcgcacgaccgcctgctgcggctggagccgcgggtgtgcggcgtggactacggcccctccgaagccctgaactcgtcggtggaggggttggaggagcgcaaggccgccaccctccgcctggtgggccagctgggcagccagcggcggcagcggcagctgctggcgcgggaggcggcgcgcgtcgacccccgcgccacgccccgaggcactgcgcgggcaggtggcgcgcggagcggcctcgccctccaaggaggacctggtggcggcggccattgccgggcgggcgctgcccccgcacgaccctggcgcgaccaccgcgccgcgggcctaccccacgcgcggcctggtctgggacgcgctctgggacgcgctgccggtggaggcctacctgcgctctgcgcgtga

SEQ ID NO: 8066 - DNA, 792 bp, Chlorella protothecoides
atggctgtgtttcagagccatgacctgctgatccatcgtcacgccctcctccatctgccacccaggcacggacgggaggacgacgctgggggacgcctggaggtggctgacacggcggactcggcgcccgcccaccccaccccgccccgccccggcggcccccacttgaccctggaggggccgcccgccacgagcaaccggccgctgtcccccgccccgggcgctgcctcgggccttgccgcagcggggctggcctacctccccgctgtccccctgggcctcacctcggccttctccagcctcagggacaggctgggcctacctgccaccgcccccgccgccgacctgctacccctgggtgtgctggccagcgaatttgacccagccctgctggctctaggccagcgggttctcgacctgcccagcggcacaggaggagatcggggccgggcatccacggtttcatcttatctcgggataaaagaactggtccaggggaggcacggtccattctccaccagcccactcccaagcccagcacccctcttcaatcatccccccccacggctacaggagctgcggctgggggacgtgggcgcgctggtggccgactaccggcgcctggccagggcggggtttgcggctgcgctcagagagcggcccggggacgccgcggacctgtcccgcatgccgggtcggttcatgcacctccgggccgaggacctgcgcatgcacgaggtggcgaccctgctggaggagtacagggcgctgctggcgtctcagtttggctga

SEQ ID NO: 8067 - DNA, 4035 bp, Chlorella protothecoides
  modified_base (460)..(469): a, c, t, g, unknown or other
  modified_base (1861)..(1870): a, c, t, g, unknown or other
  modified_base (2596)..(2605): a, c, t, g, unknown or other
  modified_base (4000)..(4009): a, c, t, g, unknown or other
atgcatttgtccccgcacccctcaaaccaacccccttttcttcccaaacagatcctggggtcggcggcggtgtttggcgaccccatcaggctcgtgcatcacctgggcctgggcgtgtggtcggtgctggcctcccctgccgccgggctggtggaaagcgcgcgcagcaggggcccagcccagctgctgctgggcctggcggaggggccgcgtgccgccgccgcgcactttgccttcgcgctgagcaatgctgccgggaagacgaccgccgcggcgcgcaaggccatgtcggcgctggggctggacaggtgggtgtgtttgagggaaggtgcgggggggcccgtatgtgttgcgcttgcaggcgtctgggtgtggcggcggcggcgacatgcgtccgtcaacggatgtgaccttgccgggggtggcccattcatctggcgatcgtcctggccccttgctnnnnnnnnnnttccgtcagctgatgtgaccttgccgggggtggctcgttcatctggcgatcgtcctggccccttgctacttcctcgcccctcgctcactgcctcatcccccctccgcaggtacactgctgagtacccccaccggcccaggcgggtcgagagggacgggggctcagcgctgatctggcgctcggggacttcactgctttctggtgaagaccaggggccgacaaacggacgcggcgaggccctgctccccgccaccctccgtggcctggtggggctcgtggccgagcccgcagccggcgcagaaacaggcgagcagcgggtgttgcatcatgggggcaggccacgatccaggttttgtccctccattcacagcattgcacgacatttgcaaggaacactctggcgagccctggcgcccatgcagactgcgccggctgaggtggtgcacgacaggcacacacatgcccttctgacattacacaatctcacccctctccaacaccctccccctaccaggtggcctgctgggcgcagcgcacggcctggtcaagggctcagtgggagtggtagtgctgcccctggcctccgcgctggacatgctggcgcgcactgccgccagcgtccggctggcggtggtcggtgcgccggcgctgggctggacccgacccccccgctacgtgcccgccggcgccccgctgccggcgtatgtcgccgagcaggcgctcggccgctggctgcttctggagctggaggcggcgggggagttgggaagcgcggagggaggcacgaccccggccgccgcctttgtctcctgcacccgtctcgagccggacggaggcaagcacctggtgctgactcagcgcttcgctctgctcgtggaggcgcggcggccgcgctgggcgccgcgcctgtgctggcgcgcggcgctggaggacctggaaagcgtcgcgcaggtgggggacagcggcctgcgcctggtggcgcagcgtgcacgtcgctcagctttgaccccggggcaggggcggggcgccgcgcccagccccttctccctctcagtgtgcgaaattcggtgcgccgggtcggagccggcacgggcgctgcacgacgacctcgtatgcagggcggcggcggcgcgggcggcgcgtcggggagcgtgggtggggctgtgagtgatgtgctgcgcccgcgtccgaatccagggacggaggatgtgttggacccagggtctgtgcaccattccagttacaggtggccactccatcgtcaacacgtctgcactgcacgcttctttgggacgattcaactcatcgcaccgcttgtagagagtatattcaaacagccttggatctctaggtggtcaccatttttcgggaaagttggaaaaactgaatctnnnnnnnnnnaaaatagccttggatctataggaggtcaccattttttcgggaaagttggaaaaactgaatctgccccgcggactcttccccagcaaagttccagcagagacccacttgtgccagcatcgggatcgccgcgtaccgatccgggatccaaaacatttcgttccagtccagattgccgtaatcgtactccgtcaagagcagccatcgcagggcggtgcatccgactctccactccctcgagtcacctgtcggagatcatgacgaagacctcgagcgtgcccaccgatccccatgagcgcctggcggccatctcccgggagtttggggagtatggaggtgcgatggcgtcccgagggtgttgtggggaggtgtccatgccgcccgcggccttgtccctgtgccctgctgaggtgtacctgtcagcttctcgagtccccgcttccagcatggccccccctccgcacaggcgtcaacacctccaccgagacttcctctacatttaccggtgggcacatgggctgtcgatggtgcgtgtctcgtcctgcgtgggcggggcatcgcgccctcggacgaccgggcgcagatttgccttcgggaagtctcgggcagcggtcaagcctccggctcaccccggtcaacgtgcctgcctggctggccccccaggaacgcagctgtgttctgtttatgccgaagcatggatcccttttcaggcctcaccctcctcacctnnnnnnnnnnccccccaggaacgcagctgtgttctgttcatgcagaagcatgaatcccttttcaggcctcaccctcctcacctgggacccacccccctaacctctgacagtgctgaaggcggaaaccctgcccgacatcttctccggcaagatgggccccgaccagggcgggtgctacctgtacggccgctgcttcaaccccaccacgcgcacgctggggcgccagatcgcggcgatggagggcgcggaggccggctactgcaccgcctccggcctgtctgccatctcggccacgctgctggcgctgtgcgacaccggcgaccatatcctggcttcggacgcggtctacggcggcacccacgccctgctgcacgacttcttcccgcgcaagtttggcatcacctccacccagctccccgtggacgacctggcgcggtgggaggctgcgctcaccccccgcacccgcgtgctgtacgtggaaagcgtgtccaaccccacgctggtggtggccgacatcccagccctggcggcgctggcccgcgcccacgggctgaccctggtggtggacaacacctttgcgcccatgatcatctcgcccatcgcgcacggcgccgacgtggtggtgcactccgtcaccaagttcatctccggcgcctcggacgtcgtggccggcgccgtggtcggccgcgcggccttcatccaagggctcatgcacccatgctccggcccgctcatgctgctggggcccaccatggacccaaaggtggcggcggagctcaccctgcgcctgccccacctggcgctgcgcctgcgcgagcacggcgcgcgcgcggagctcttctcgcgtcgcctggaggccctgggcgcggcggtgcgctatccgggcctgcccagccacccgcaggcggagctcttcgcgcggctggccaacccgggctatggcgcgggcggcatcatgaccgtggacctgcgcactccggggcgggcgggggccttcatggagcgcctgcagaacaagcacggcttcggcctgctcgccgtcagcctgggctacttcgacaccctcatgtccgccagcgccgcctccacctccagcgagctctccgacgccgacctggaggcggcgggcatctcgcgcggactcgtgcgcctgtccgtcggcatcacaggcggcgcggaggcgcgctgggcggcgctggaggaggcctggcgcgccgtcgcctcggtgccggaccacgtcgtcaaagcgccctacaaggcagcccaggtgtgtatggaagttttgggctggagggaatggggggagcagaaacttgttggagcagtggagggatctggtgtgggatttggaggtttggttgcggacttccggcaagtcttcgtctgaaggagaatagagggggannnnnnnnnncaggtttggatgcggacttccggtga

SEQ ID NO: 8068 - DNA, 783 bp, Chlorella protothecoides
  modified_base (50)..(59): a, c, t, g, unknown or other
atgttaaaccctgatcccgtacgagggtatttccgcttttacatcgaggnnnnnnnnnnaggatcagttcgccgcgccgcgctcagcggccgatctgagcatccagcagctccgggcgtgggcctcccccccccagcccccccttgcccgagcgcccgcctactccttggaggcctggctctgcacgcgcagggccctcttcttggcgagggactcgctgcggcgctcgcgctcctccttcagcctggagaccagcagcttgtggtactccgcctgctgcgtcttcttggactcgatgcggcgcgccttgagcgcggcgcggtgccgcttgtgctgcagggtgcggggggtgaccaggcgctggatcttgggcgccttgatggtggtcttgccgttcttcttctcgatcttgcgcccgtagatcttgacgtagtgccgcacatcgtcgtccttggtcaggttgaacatcttcctgatcttggaggcgcgcttgggcccacgctggcgtggcttctcctcgtcggtcaggccgggcagctccgccacgcccttcctcacgatcaccaggttcaggacggagaggtcggaggagacgatgcagccgcggaccgacttgcggcgacgctcgccgtcgcggcggccgtgcccgcggaagcaggagtcgccgggggacatgagcacgcgcacgcggccgggggtcagcacaccctgcttcatggggaagccctgcttgtcctggccacccttgatcttgaagatgtagcccttgaactcctggggggg

SEQ ID NO: 8069 - DNA, 606 bp, Chlorella protothecoides
ggctacatcttcaagatcaagggtggccaggacaagcagggcttccccatgaagcagggtgtgctgacccccggccgcgtgcgcgtgctcatgtcccccggcgactcctgcttccgcgggcacggccgccgcgacggcgagcgtcgccgcaagtcggtccgcggctgcatcgtctcctccgacctctccgtcctgaacctggtgatcgtgaggaagggcgtggcggagctgcccggcctgaccgacgaggagaagccacgccagcgtgggcccaagcgcgcctccaagatcaggaagatgttcaacctgaccaaggacgacgatgtgcggcactacgtcaagatctacgggcgcaagatcgagaagaagaacggcaagaccaccatcaaggcgcccaagatccagcgcctggtcaccccccgcaccctgcagcacaagcggcaccgcgccgcgctcaaggcgcgccgcatcgagtccaagaagacgcagcaggcggagtaccacaagctgctggtctccaggctgaaggaggagcgcgagcgccgcagcgagtccctcgccaagaagagggccctgcgcgtgcagagccaggcctccaaggagtag

SEQ ID NO: 8070 - DNA, 1290 bp, Chlorella protothecoides
  modified_base (270)..(279): a, c, t, g, unknown or other
  modified_base (1155)..(1164): a, c, t, g, unknown or other
atgcatgagccattggttaacctgtcccttccccgcgtggcgtcatggacagcagctctgatggtggccgcctccctgcaagcatcgcctgcgcacgccggctctaaccagcgcctgccacccctcgactcaggttgggcgacgtttgattcatgggaaccccctctgcctggttcctttgcctgcctggtgtttgagtgcccgggttcgagtgcatgccttcttggccccgtgggcattctcaatggtcagcatgccgcccctgaccannnnnnnnnntctgcctggttcctttgcctgcctggtgttgagtgcccgggtttgagtgcatgccttcttggccccgtgggcatactcaatggtcagcatgccgcccctggccgctcagatccgctgcgctgcgagagggccttcaccggcaataccattggccaggccaatgcggtgtctgacaagatcctggacctccgcttctgcagcttcccaggggcggagctgaaagggaaggtgctgtcaggtatgcagaggttgtggggattgatggatttgccgaggacaagcagggctggcgaagagtgctgctggggcggggttcgtcattttgcaaggacatgctctgacaccggggtgcagctacctggggtgaagggcggtctttggtgcgtccacaacctatcatcaggcgcatcgcagcgcagtgaggtggtcatgtccaaggcctacgctgttggcacaaacttcaagggtgaggcggctgaagagggatacgatgccatggagcacacttggagggaagccaggcacgccgagggtgcctcgcaggtcgcctgcgtgcaggactctgcatcctgtgggctgggcgcgcgctcaaccctggcgcatgatgtgcatgtgaaggaaccgctcaaagtataccaagctcatcctacccttcccttgcatcgcaggcgccaccttcaagggagccaacctggacggggccagcttcgaggacgccctgatcggcaggtgggtggcggggcagggcagtgcgagccgaggtgctcctggactgccctggccatgatctgtgcaggggtcgccctcggtctccaaccacacctaacccatccgccctcccctcccccagtgaggacgtccgccgcctctgcgcannnnnnnnnntgctcctggactgccctggccatgatctgtactagggtcgccctcggtctccaaccacacctgacccatccaccctcccctctcccagtgaggacgttcgccgcctctgcgcggagcccagcctga

SEQ ID NO: 8071 - DNA, 630 bp, Chlorella protothecoides
  modified_base (553)..(562): a, c, t, g, unknown or other
atgggtggtggggggcgggcgctcatgcggcctcctatctgtacattatgggccgtctgcgatgtgcaaggcgacatgctggatagcattgctgaaagatctctgatcagtttcgaatcggtgccgaggatgtcgagggagggattatatcgtcgcgactttatgtcgggacgcaaggaaatgttgtcggattcgggaccggtggtcggaatgccctcctggaagctcccacaggtagatggtcggtggaattccactgtaaggcgaaagacaaggacccttgagaagcagggtccgccggctgattgtaccaacctcgaagccctgcacgccatcactgcaggttctgggaagacgctttcgctcctctgttcctcccttgcctggcagcagcgcgagaaaaagcggatcgaggacgggctaccctccgcctatcctccgtcggctgctccccctccagaggcgccggcccctggcctcgccacagaggtgacactcttggttggtcttggggtagggcctcatgtctttgtcacccatgcgacctgtgctnnnnnnnnnnctgctgccaagtctctgccatgcgtgactgaggtgcagccctttccctcccagcgccaacgcgattag

SEQ ID NO: 8072 - DNA, 729 bp, Chlorella protothecoides
  modified_base (296)..(305): a, c, t, g, unknown or other
atgtcagcatcgcaacatgggctggcttccccggtgccagggggcggttgtccaggtcctacgcacccttctgcaggcgtggaggggaacatgctggtcttcgacgaggcgcacaacatggaggacgttgcccgggaggcagcttccatgcaccttccagcacccgaggtcctagaggtaggtggtgggcagaggtgggggaccggcttcgcatggggcgggtgctcacggccactgcagcacagagtgcccggccggccccaagcccgctcttcgccacaaaaaccccactcacnnnnnnnnnnggaggggggggaccggcctcgcatgggggcgggtgctcgcggccactgcagcacagagtgcccggccgcccccaagcccgctccccgccacaaaacccccactcacaccccgcccgccgcgcagatacagacctccttcgcacgcgcggtcgccatgaatggcaagccagaggtttatgcgccgctggctgatgcgctgctcaggctgcacgagtggctggtggcgcgggaggcggacgtggcgcagggcgtcatccgcatccagaagcagaaccgctttgagaaggaggaggtggtgtggcaaggtccccaggcccttgccgcaccctctattaacttcaaccgctgcacatccgtgccggcggccgcctatttagggaccatcgacgatccgcagccacctgctgagactgggcaatactga

SEQ ID NO: 8073 - DNA, 1401 bp, Chlorella protothecoides
  modified_base (355)..(364): a, c, t, g, unknown or other
  modified_base (799)..(808): a, c, t, g, unknown or other
  modified_base (1176)..(1185): a, c, t, g, unknown or other
  modified_base (1250)..(1259): a, c, t, g, unknown or other
atggccctgggcgccgacgcggtggaggccctctgggtggcctaccaggcagcgcgtgcagaggaggaggcgatgcagcagagccgggggccccagggcgccagcgctccgggaccggctgcgcccggcgcccccccggtcattgctgagctggcggtgcgcgtcggggggaaggccctgggccagacctcccgcctcatccagatcctgaagctgctgcacgaggtgggggccgggaactgggcagtggccgatgcaaggcctgcctggggagggtttgggtgggtatgggaaggggttgccgaggctggcggggcaggagtacacaaagtacaccgcattgcggcctggaaannnnnnnnnntcgggaagagggcagtggccgatgcaaggcctgcctgggaagggtttgggtgggtatgggaaggggtttccgaggctggcggggcagggatgcacaaagtacaccgcattgcggcctggaaagctgcctcctgcggcgaggtaaagctcgagtgggtgccttgctcgggcagaatgcatgctctcttgctggccttgtgcctgctacccttcccctcatccacccgctccctcaggggcgacgaggcggcgccctacgcttcagacgtggagggtgagtgtggcaaggggtggtgggggatggcctatcactgcatgggcctgcaggacccttccccacatgtctttgcagcgcccagggtactcgccacccttgcgcatactttacgaaactgcatgtctccgccccttctccttccccctccctccgtccccnnnnnnnnnntgtgggggatggcctgtcactgcatgggcctgcgggaccctcccccacatgtctttgcagtgcccagagtattcgccacccttgcgcatactcttcgaaactgcacgtctcctccccttctccttccccctccctccgtccccagggacgaggctgggagccagtgggtgtctgccgtgtccctgtggtgcctgaacccagaggtggtcttcaagagcctgtcaggtacggtgaattgctggacctgtacacagctgccttcctccacctggctgccttcccagggcacctggggcccagcgcacccagcgcaagcgcttgatcccagcttcaacttgcactgcagagctggcgcactccacggtccnnnnnnnnnnaatcaaccacccgacatgatccccgacactgtgcccccttccagctgggcaccccctttgacgtnnnnnnnnnnagcgcctgatccgagcttcaactcgcactgcagagctggcgcactccacggtcctgaccagcgggacgctggcgcccctggaaggctttgcctccgaggtcagagctggcgcggtgcttcatctctgatgttgtgtgtgtga

SEQ ID NO: 8074 - DNA, 1293 bp, Chlorella protothecoides
  modified_base (639)..(648): a, c, t, g, unknown or other
  modified_base (1194)..(1203): a, c, t, g, unknown or other
atgcaggttcgattggctcccagcaattcggcacccctgatgcccacgaaagccgacccgggcccgacgcccggcacgcctctgagcgtggtggggctcgcggatggcgtctccatcccctccactgcctcggtcgaagagggaagtcttgtggcgagttctcgctcctcggacgtcccaaccggcgaggccagtgggtcgggcacgagtagcggccgggatggggatgctggccccgccagccccattggcagacccggggggtccgaggccttcggccggggttccccgccctccaccagcgaagagatcccccatgtcgacgtggactttgtggttcggcgcctgagctgcagctccctgcccctgacggggcaggtcgtggcctatgggtgggagcaggccgccatgctcgcctccacctgcaaggccatgcccaaccagctcttcacggccctctggcccgccactgcggcctgcctggacaccttctcctcccaggtacggatggggtggcaaccgatgcatggcggggccaagctagccctgcctgcagggcggcactcgatggttgtgctcttgcgaggcggctgggtcacggtgcattccccctgcacttcgccagaggctacagggcannnnnnnnnntctggacaccttctcctcccaggtacggctggggtggcaaccaatgcatggcggggccaagctagccctgcctacagggcggcactcaatagttgtgctcttgcgaggcagctgggtcacggtgctttcccctgcacttcgccagaggctacagggcagtccagatgcgggtcctgttccgtcgcttgtccaaactgctgcctcacatgtgccatcctgtctcccacaatgacagagcatcctggacatgctcaccgcctggtcgctgctgcagcagcggtgtcccagacacttccgcctctcgagtcgggtggtggacagcatggttcagagagcactgcctcccataggtgcgggggcttggtggccggtcggtggggggttgacagggttctggggtgcgaggcccatgggcgcccagggtgccgcatcccccggtgcccttggaggtgctttgtggccttggtctttggggatgtcatgcctctctcctccatgctcgctgctggcctccatgcaatgctccttgtccccctgccagccacnnnnnnnnnnctgacactctcctcgatgctcgctgctggcctccgtgcaatgctccttgtccccctgccagccactcagcacggcctcctatgtagttga

SEQ ID NO: 8075 - DNA, 1128 bp, Chlorella protothecoides
  modified_base (244)..(253): a, c, t, g, unknown or other
  modified_base (316)..(325): a, c, t, g, unknown or other
  modified_base (476)..(510): a, c, t, g, unknown or other
atggtctggtacggcaaggcctccgcggcggcgccggtgcccgcctccaagcgcgccgtcagccccgcgccgctgggtctgggcggtgatgcggagggcgccggcgggccgctgctgggccgggcgcgcagcgtgtcgggtgacggccgcatcacagtggggcccgtcgcgggcaagatgagggacgtggtcgccctgatctctggcccccccgttcctgaaaggttacacagtcaggcagtcnnnnnnnnnngctgctgcagcgccctgatctctggggcccctgttcctgaaaggttacacagtcaggcagtcnnnnnnnnnncccaagaaggcccactcccctcccgagcccacccgaggcgacggggcaccgctcttgtttcgagcggccacaccgttggtcctctcgcatgtgaggctcgccgagcccatgcgcgcctgcatgcacccggcgctctcggagcgttccctgnnnnnnnnnnnnnnnnnnnnnnnnnnnnnnnnnnngctgcagcgggccactcagaggtcgttgatggtgacctccacctccacgccgggctcgatggagacggaagtgatctgcttgaccacctccacgggggagtgcaggtcgatcaggcgcttgtggatgcgcatctcgaacctgtcccaggtcttggtaccctcaccgcaaggggacttgcgggtggtgatgcgcaggaccttggtgggcaggcgcacggggcccttgaccttgagctccttctccttggcgccacggaccaggtcggtgcagactgggaaggagggaggagagggagtcgggattgggtggggagggtcttgggcgagggatggagacgggttggtgacgttcttggaggtcagggtgatgcggatgcggtggatgggcacctcatgggcctgctccacgccgaccttggtgggcttggcaacgtcagccattctgcgatgagaaagagggaggtgagaaggggagacattacaagttcctcgcttgaaactcctgccacagcaagcactggcccttggagccgaggccagcacgcgctcctcacctgtatgtggcttgaagtcttccccgagtcagacgtcgcttgtcgacctgtcactgagggatga

SEQ ID NO: 8076 - DNA, 375 bp, Chlorella protothecoides
atggccgtctgccgaggcaaggcgagtcttgggagcagcggggctggtgtcgaatgggaagtcgagcgctgggaccacggcatccgctcgtgcccactgctgcgagcacagcgagggaaggcatcgctgggtgcagtacatctggtgtcggagggcctggactttgcggacgccaacgctcgcgctgtcattattgtaggtctaccctaccccgctgcctacgacaagcaggtgttggagaagaaggcctacaacgacgccggcagggccaggggactgctctccgggtcagcctggtactcgcagcaggccttccgcgccctgaaccaggtgggcgcgggcggcgccgaccttgttgcaggcagtttgggataa

SEQ ID NO: 8077 - DNA, 450 bp, Chlorella protothecoides
atggctgacgttgccaagcccaccaaggtcggcgtggagcaggcccatgaggtgcccatccaccgcatccgcatcaccctgacctccaagaacgtcaccaacctggagaagggctgtcggctgtacccgtctccatccctcgcccaagaccctccccacccaatcccgactccctctcctccctccttcccagtctgcaccgacctggtccgtggcgccaaggagaaggagctcaaggtcaagggccccgtgcgcctgcccaccaaggtcctgcgcatcaccacccgcaagtccccttgcggtgagggtaccaagacctgggacaggttcgagatgcgcatccacaagcgcctgatcgacctgcactcccccgtggaggtggtcaagcagatcacttccgtctccatcgagcccggcgtggaggtggaggtcaccatcaacgacctctga

SEQ ID NO: 8078 - DNA, 420 bp, Chlorella protothecoides
atgccagatgccatcaccaagttgctgagctcgttcggagtgacgttcgaccaggcgatcgcggccttgggggccggcctccttcctgctgccatccagaaccgattgaactccgtcatcctgtaccacatcattccctccggggccctgacccccacagagctgggcgccgagggcaccgtgccgaccgccctgccggaggagtccctgcagttcagcgccgacggcgctgtcatcaccacggccaccggcacctccaacgtgctggccaacggcgacagcgccggcgcatcctacctcatcgtggacgccgccctcctgccggcggacttcaacaccgttgcggagaccaccacggaggaggccaaggccatcctcgcggccctgggcagcagcacgccctcccccaccctcgagtga

SEQ ID NO: 8079 - DNA, 699 bp, Chlorella protothecoides
atgcgattgagggggaggggggcgctggcgcggggcgggcgtcgtgcggcgcggccgtcggtcaacgtcccagcctcgcctgccctgtcctctgtccgcacacacaatttcctcctcccccaaacactccttgcccggcacccaggggttcgggggtcgctcacggtgcagcccagctttgatgcggccctgggctcgctccgcgccttcttcgagcgcctggcgtcctccccccccctcacgctgcggcccaagccggagcccgcgacccccgggccgggcgcggcgaagcaggaggccggcgggtgcgccggcggggggagcgtgcaggacatgggggccgtcctcgcccgtgcgcccctggcgcgctgggtcagcgcggacaccgcgtccgcagacaccgcgtcgttcctcgctttcctggaggcctccgggtgcaccctggcggcggtaggcgcccggtacgccagcctggaagccgtggcacaggacgccgtgctggactgctttgcggccgccaggtggggcagcgcttttgtgcgcggggagtgctggctgggagacggaaagaccctggagcagctggcagctgtctggaaaccctgcctgccgcggggcctgcttgccgtgatgggggccggagatgccgacgtggctggaggccaggtaggcagcacggggtggtgcgatgcgatgtga

SEQ ID NO: 8080 - DNA, 567 bp, Chlorella protothecoides
  modified_base (440)..(449): a, c, t, g, unknown or other
gaggcggggccgggcgccgcgccggtccctgcacgagagcctggctccgcaccggttccctcggcggcgccgggtccggcacgcacggcagcgtccgcgccgccgccgccggagggcctcggcaaggccgccgctggccggatgctgccggccatggccaagctcaacctgggcaggctgatcgagggcgagggctccccggccagccaggcctcggggcgatcccccctcctcgccggcgcaggggtgtgtgggattcgcttgggaaagggggaatgggggcgggggctgagactctccgagcagtgtgcgctgctgggggcgctgcgtggtgatggcatggactgggcccaggaagtgaagagggatgcgagggcttctggacctcaccacagctctcagtcacacaccccacacaacccccctccccatgcagtccnnnnnnnnnncggcccaggaagtgaagagggacgcgagggcttctggacctcaccacaaacctcagtcacaccccccacacaacccccctccccatgcagtcccgcgtcagcaggatccccgggctga

SEQ ID NO: 8081 - DNA, 201 bp, Chlorella protothecoides
atgtgcattggcgagaagcgcaagctggtcatcccccccgagctcggctacggtgcccgaggtgccggcggggtaattccggcggtcagtcaatggcgctcaaggggcggacgtcgtttcacgcggctctgcttcaccgttattgcctccatgaatccactccttcgcatcgacaggcatgtgcattggcgagaagcgtaa

SEQ ID NO: 8082 - DNA, 534 bp, Chlorella protothecoides
  modified_base (124)..(133): a, c, t, g, unknown or other
  modified_base (521)..(530): a, c, t, g, unknown or other
atgcgagggggcgtgaaacgtttactcacccgacccgtcctgcacttgcttgtacaatctagacaagttaagtggccaagatctgatacattaagcgcaggatggcgaagatcctgcttctggnnnnnnnnnnaaccatacccactggcgccttctcttgtgggggatggcgaagatcctgcttctggccggggatttcgtggaggttctggaggtgcgcaagtgatcgagcgcaatatttctcttcacatgttcttgccgtctggccaacagaaccgacaccaggaatcttttttacattttctgcaggtgttcgtaccgttccaggccctccaggccttcgggttccaggtcgacgccgtaaccccgggcaagaaaaggggagacaccgttcgcaccgccgtgcatgacttcgagggggatcaaacgtacaccgagaagcggggccacaactttacactgaacactgatttcgacgaggccctcaccgggcttgacacctacgatggcctggtcatccnnnnnnnnnngtag

SEQ ID NO: 8083 - DNA, 498 bp, Chlorella protothecoides
atggcaggggtgaacgaccagccgcagcatgccatcgagctgacgaggctgctgcgccagcaccgcagcatgaggtgccacgtcaacctcatcccctggaacgccgtggacgatgcaggcgcgtggatgatggggccctggggtttgttgtgggatgggccggggggtgggcggaggcaaggcgtgtggggattgcgcctggggacttgtttgtcagaagcccatcgagagggaggggggctggccggctccagccctcctcgccacccagccggaaagacacatttcagcagaatggaaaccacctcttccacctccttccgcttcgatccaagcagagttcaagagccccagcagggaggccgtggagatcttcaagtccatcctggaggagcggagggtgcccgtcagcgtgcggatcacgcgaggcctggaggcggcggctgcctgcggccagctgcgcaacatgtaccagaagacgccgctgcaggagtttga

SEQ ID NO: 8084 - DNA, 264 bp, Chlorella protothecoides
atggaaccccgccccgctccacagaagctggtggcggcggccctgcgcaaggtgggcctgcggggcgtggagaacctgatgccctccgagctgtccggggggatgaagaagcgcgtggcgctggcgagggccatcatccgggacgaccagcacgcccaggcggagcaggtgagcagtgtgggcgctgcagggaaagggggagttcaggagggcctcggggatgcaggtgcatgcgcccgctgcctgcggcatggcaacccctga

SEQ ID NO: 8085 - DNA, 942 bp, Chlorella protothecoides
atgaagggcggttcacggccggtccggcccaagacctccatcgggttccgcgccgggcgcatcgccgcggacggctggtccaagctgcgccccctgcgtcccaccggcaagcccgcgtccgctgtctccacgcagcctcagggtcctgcgagcagccccgggcctgtccgccccactccagaccccccctcctcctcgagccccacccccctctcaggccccagccctctctcaggccccagcctgcgcgcgctggtgagcgcgctgggcgcgccggcctaccgcgcggcccagctgcgtgacggcgtgctggccggcgcgcggtcgctggaagaggtgcgtggcctgccggccgcgctgcgcaccgccctgcgaggggctggagtgcgcacggggcgctcgacgctgcgcggcgcggtgacggcgcgggacggcaccgccaagctcctcctccagctggccgacgggcgggtggtggagtgcgtgggcatccccgagggcccgcgcctcaccgtctgcgtcagctcccaggtgggctgccccatgcgctgcaccttctgcgccacggggaagggcggcttcgcgcgcaacctgctgccccacgagatcctggaccaagtgctggcggtgggcgagcactttggccgccgcccctccaacgtcgtcttcatgggcatgggcgagcccatgctgaacctgccctcggtgctggccgcgctgcgcgcgcttcgcgaggacctgggcttgggtgcacggcacttgaccctgagcaccgtgggcgtgccggggacgctgcgccagctggcagcgcggcgcctccaggtcacactggctgtgtcgctgcatgcgcccacccaggagctgagggagcgcatcgtgccctccgccagggtctacccgctccaggccctcatggccgactgcaccaagtactttgagtga

SEQ ID NO: 8086 - DNA, 342 bp, Chlorella protothecoides
atggtgaagacccgcctcctcctggcccccctggccatgaagggggccagcctggaggagctccggccccagcttcaggccatggtcgaggctggcgtggctgacaagtgcgctgtgctacctgggcggccgcctctgggggttctgtgggatgcaggggttcccccgcctatggaggctgacggacaggacgaatgggtgagggtcatggcgctggccgtcgggccatacgatgggcgcatccacctgggcgccgtggccgccgatttcaagctcgtgaggcgcagggagaggtctggaggtggtgggccttggtgggcaaggggagcgacggagggctga

SEQ ID NO: 8087 - DNA, 513 bp, Chlorella protothecoides
atgttcacctgccctcccctccacacccacaaacttcctcaggcaccagacccccgcctagcgcccgtccgatccgtgtccagctccctggacatccccctgctccctgcccagtccgcctctgaaaccctgatcgagttccgggacgtgtacaagtcgttcggggacaagcacatcctgcgcggcgctagcttctgcgtgcgccgcggcgaggccgtgggcatcatcggcggctccggcacgggcaagagcaccaccctgcgcatcgccgcaggcctgctgcagcccgacgcggggcaggtgctggtgcggggggtggagcgggtgggcctgatggccgaccagcccgacagcgacggcgcgctggtgatgggcctggtcttccagtcggccgccctcttcgactccctcaccgtgggcgagaacgtgggcttcctactcctggagcacagcaagctgcccaagacgcgcatcaaggtgggaaggggggatactggagagggggggggatga

SEQ ID NO: 8088 - DNA, 192 bp, Chlorella protothecoides
atggaggcttttgctgtcaacggccccacagagggccacgacctcccacccttcaactggcgggagttcaaggggcagggcctgccgcatgcgggcatgccgcagcgcttccagcaccgctttgaggccatggccgtcggaagcatgcaggagctggaggagcggtgcctgcatgccacggcggctatgtga

SEQ ID NO: 8089 - DNA, 633 bp, Chlorella protothecoides
atgagcctcgtgagctcgggcgatgtccggtatcagggagtcctgaaccatgtggacatggccaactcccgcatcacactcgtgaacggtgaggacgggcagccaggctgcgtgttggcatggctccgcttctcggaggacttgtttccgcatgtccgctgttatggctcggaaggccgccgagacccgggacctcaggtggagggcaccgacgaagcaccgttgtccctgcgatctctgcatcgcaggccccagttccctcattcacaccctcgtggtcgatctgcttgcatgcgcagggtgtctgaccggccaaccatatcgcgcaacccccacaggatcggagatcaaggagctgacggtggtccagccgccgccccccgagcccgcgcccacgccgccgatggaccgcgccatcctcacctccagcagcgtggctccgggcccgcccgcgcccagcgtgcccagcgcctggggcacgtcgaccgcctccagctactccgtgccggaggcccccgcctccgcgtcggcctttggttcctcgccctggggccagtcgacggcccagtctggccccgcggccgcgccggcgtccgcgcctgcgccggcgtccgcgcctgcgcccgcgccggc

SEQ ID NO: 8090 - DNA, 1107 bp, Chlorella protothecoides
atgcgcaacgggagcacaggcagggcggccgcgctcggtgtactaggagtggtcctcctggcagtcgcggcaatgggcgcggtgcccacccctatctcagcgtggggacccaaggctgccttcgccagcgtgggggtggaccaggaggctgtgacgacgctggaggcgctgcaggccttgctgagcaccggacgcagcgacgggcccctgggcaaggacacccccatcatcctgtatgtcagtcacagccgtgactccggcctggaggccaccctgcagccccgcctcgatagtgcagagggctggaagcagctccccagcgcttcccatgccgtgagtgccaggatagatgggggcggggcgggggaggggacacatggcaaggagccatggctccattcttccagttccctcaccctggtctgcaccatctcgcacttaattcaactcccctcgaccacgtcgcagggtggcgagggcgtgatcttcgacgctctgcagatcctggccggccagcgccgcgcgcatgtagtggggtcgtgtcagggtctagcccccggcgccccagccaccaccgccgagctccagcgcctgctggccgcgccgccctcgggcgacgtcgtggtggtctgtgccggggaggaagccgagcagcccgccttgctgaacgaggtggtccggctgtctgccgagagccagcccctcatgctggtggtcgagctccccgccggcgaggtggctgcccaggcgatccagtgccacgttggcggcataggttgcacacccacccatcgcccatgcgttgccctgaccatcctcccatgccaccctttctcccagcggcgccgcctgcaggcccagtacgtctccgctcccagcctcggctttgacaagtacgcgcgacgggagggcaccaagaactatacagtgtgcgacgccacctgccagcgacaggcgagtgctgggacgctgtactttgagggcttcatcgtcctgatcgtgattgggatggctgttgctgtgggcctgacctgcctgcacatcatcgacacccccacccacctccccagcgtcaagcccgggtcggggtcccaccaccacgactga

SEQ ID NO: 8091 - DNA, 1068 bp, Chlorella protothecoides
atgacggcctactcgatgctcagattccattgctcccacaagcccgtacgttcaacgcccttgagcaggcagcaactccacacctcactacgtcgaccagctgggggtgctgagggagcgggacctcaccaccctcagttttgtgtaagagctgcaggccatcactgtcgctcagtcgatttgcttgtgaggaggatgcttgcacatgctgctgacctgggcagaaacagctttgggatcgctgaaggacacgcagttccaaggtccatctcaccatcaagcacccaccctgtctctcccctctatcacttgcacacctcccaacccttgcatccacagacactggctgtgaacgtggcagaggcatactaccgccttgagcccttcctcaagaccgccctcgcggcctttgtgcgccagcacctggacacctatgcggagcaggaggatggctcccccaaggagttctgggtgtcgttctacaacctggaggtgcgaggaggggatggcatggagcactccattgtctcgccctaccagtacacggcaatcggccctctgcatgctcccttcaggcatgcgtgcgctcacatcctgtgcccgcccgccccgcagcaaggggacaggctgcgcgagctgcggtccaacaagatcgggaagctgagccagtttgtgggaaccgtcacaaggacaacggaggtccgccctgagctgtacaagggcaccttcaggtgcatgcagtgcatgcgcgaagtgggtggtgggtgtaatgcctggccccagcgtctcagtggtgagcgcacacttgctgaactctgggagctcgcagctgatctggcgtggcagcctgaggcctgtctgacagcttcgtcctcttcatcctgttctggaacaaacttcactcctcctccttgctggcactcctttcctgatgcacttcccatcatttgcatggctgagcaaattcgctcatgtgccccctgctcccccattcctccctccattgcatgcagtggtgagaggtgtggagcagcagttcaagtacacccagcccctgatctgtcctga

SEQ ID NO: 8092 - DNA, 477 bp, Chlorella protothecoides
atgtcattgaagagcgccgtcagcggcagctcggcagatgcctcgtcatcgtctcaacagacccaggagcggattcctcagcaggcggcagccaagaggcgggccatgcctcccggcttcctagggaactacatgcaggcgcgggcgagcatggccagcgtcggactcggcccggccgcgccagagggccacggcagagccagctccagcggcccagccggctgcagcaccaggaccagcgtcctgggcccctccgccgctggccagcgcgccgcgcccttcgtcccggccacaacgttgccatccctctttgcccatcgcaagcactacctgcgagcccagcgccgggccaaccccgatcagcagccctactgccaacatcaaggaaagcctgttgggttcttgtccctaccagaagacgtgttggtgagtggtacggatgtggcagcttgctggcctcagggtgggcctccatga

SEQ ID NO: 8093 - DNA, 1059 bp, Chlorella protothecoides
atgcattctgggagggactgcaccacgattcaggctacctcctacttgctaacaatgtcaaggaaggtcccaatctggctactgggacgcctgaattgcctcccactgctgccactggctgcctgcatgccccatgctgcacagcctcccactccacacaggggcccagcggcgcctgaccctggagtccctggagtgcctcgtccgccgcctggacggcgccagggcccagaccagcgggacgcaggtcattcctgctttccagacgcccgtgctggagtacgatcccatccgcaaacagtttcacgccagccccgccccgccgcgcttgtttccggaggccaaggtgcgttgcagttgcgccccgcccctggcgaggctgttgtgcatgcgcgacagggctgccgcggtgcgcccttgatgctggacctgctcgccaggtcggccgccagggcccttccccccagccttaccgtcgtgcatcatcacacctccccagtccaagatcgcgctgtacgtgaaccgataccacctcgtgcatcagcgcctgagacgcaaccggctgttcaggccgacgcactgggcgggtgtggcgggggtccagggccaggagtgcgaggtgggctggtcggagcgggtggggtccagacatgctggggggcagcatgtgctggggtgtgcacgcgcgggcgtgccagcccttggagctcccggcgcgagccaggatcgccgtgttcttctcgggcctgcccgggcgctcagcatgccccccctcctcctccttcctcaacccgacagctgaccgagctcaaggcgctcctggggctggtgggccagtccaagtatgtgctgggcttcctcagccagccacgggagggggagtatgcgctggaggacctctccgcccgcctcccccttgacatacaggacgcagagcgcacgcccgggctcttcacgggtgagggaggggtttggagggtttggccaaatgtctgctccttactggctggcgggccacaaccccctgactcttgggacccaggaaacggaggctcgtga

SEQ ID NO: 8094 - DNA, 414 bp, Chlorella protothecoides
atgcatggttcttgtcgccatctgacgcttgtgattggggccgacgcacttggtgatcacagcgtgcaccgcatgcactgttcgaacatccgtgctccaccaaccagagcagatgtcgacaggagtgcgaaacatcgcccctgcccgtcccctagctccgccatggcttcaggggacgagtcccgggccactcgcgtctggctgcagaagcaatttcgcacgagtggcctgcagctggatccgggagccctctcatacctggtggaggccgtgcaggggctccatgatcctgaggagtacatccaccgcatcatggacgaggcatctgctggtagggttccccactctgtccggcatgcattctgggagggactgcaccacgatcagggcttgcagctacctcttacttgctaa

SEQ ID NO: 8095 - DNA, 1440 bp, Chlorella protothecoides
  modified_base (1027)..(1036): a, c, t, g, unknown or other
cgcgccgctgctgcgcacgctcagcgcgctgcacgcgctgagctgcctggagggcgccgccgccgagctggcgctgggcggggtgctgacgcgggcgggcgccgagtcgctgcgcggcctggtcaacgacctgtgccgccgcctgggcgaggaccggggggccgcggcgcgcacgctctgcgccggctttggctgcccggaccacctcatgtgggcgcccatcgcccgcgactggaccacggccttcaagtacccggggaaggcttgaaggagcggggaaccacacagggcggcggcgtagcgatccccgctgccccttttattgtgttcaaacctctgccgctgcttgtagttagctcgcactgcatcactgccctggactccatgtatagcgttcaaattcaaggtcagttcactttccccttagggagtgtaagacggggaaggggcaggggttggggcatacatggtcaccgtgtggcgaacctccctccggtgaatcagagtcccatctccggaccgatcggagcaaggctggctgatccctggcaggccgtgcaagcaatcctcgtcactggcgaaagagatagtgacccagaattgatcacgccccgcagcccctcaaccaatgggtcaggagcaaccacgagtgggagtcggggtccttctgcatcgcgatggcaggattctcgtcgggaagaggtgaggaaaggtgccagttggaggcacctagccaagcgcggcgcagtgtggattgaccatgccaagagcctgagtcactgctttccggtccctttatcgtcctgcccttcatgcctcctggtccacaggctgggctccacaggcagcggcacatgggccttgcctggggggaagctggagtaccaggagtcatttgaggcttgtgctgcgcgagagacaacctggtttttggtgaaaattaccctcccatccagttgcgctcaatccaaaacttcctgccacaccgtccagttggaagaggagacgggcattgttgcaacgaagnnnnnnnnnngcgctcaatccaaaacttcctgccacaccgcccagttggaagaggagacgggcgttgttgcaacaaaattcacatttgcatatgctgtgaacagcgtgctccgagatggagggggtcactgggtgacgatatttatggaggccgactgtccccaggtgcgacagaggttgttttggcgttggcattgcataggactgcgagcctgcaaatctggagccagacaagtgccaaggctgggaatgggtgcctttcaatgcaattcctcagcccatctttcaacccctggcctgcctgctggacagccctttccagctcaggatacagggcatgttcggcgtgcacggtgccctgagcgcaactccggttcttcccttgacagcttgcatctcactcacagatactga

SEQ ID NO: 8096 - DNA, 2217 bp, Chlorella protothecoides
atggaggtcatcctgcgcaacgaccaggtggagagcgtgcgccctggcgacaaggcctgcttcaccggctgcctggtggtggtgcccgacgtcgccgccctcacggtggtggcggcatttggggtggtggaggtcggtgctgcaagcatgccctccggagcagggctgccagcgtgcgggccgccgtggatgctcgagactgtgcttgtggtggcggtgggtgtcacccctccgcactctacaaagcaccatcacgacacacccccctcttcttcctttctcaacgtcccgcgcagtgcgccgggggagcgcgtccaggcccggcccagcggcggcgagcgcggcggcgcggcgcccgagggcggcgtcaccggcctgaccgcgggccccgcgcgcacaggcgtgcgcgagctgagttaccgcctggccttcctggcctgcgccacgcgcccgctggacgtcgggtccggcgtggtgaacatccggggcggggaggaggaggacggccccgcggccgtcctggcggggctgacccaggagcaggcggagtcgctggaggccatgcggcgcgacgcctcgctgtacgaccgcctggcggacagcgtggcgccccacgtctggggccaccgcgacgtgaagcgcgcgctcctgctcatgctgctgggcggcgtgcggaagagcacgcgcgagggcatcgcgctgcgcggcgacatcaacgtggccatcgtgggcgaccccgcctgcgccaagagccagctgctcaagtgggtggcggggttcctgccgcgcgccgtgtacacctcgggcaaggccagcagcgcggcggggctgacggccaccgtcgtgcgcgaggccgactccggcgagttctgcatcgaggccggagcgctgatgctggcggacaacggcatctgctgcatcgacgagttcgacaagatggatgtgaaggaccaggtggccatccacgaggccatggagcagcagaccatctccatcgccaaggcgggcatccaggccacgctgaacgcgcggaccagcgtgctggcagcggccaaccccgcgggcgggcgctacgaccgctccaagccgctcaagtacaacgtggcgctgccccccgccatcctctcccgcttcgacctgctgcatgtcatgctggacgagcccgacgcggcgctggaccgcgccatcgcggggcacatcctggacgcgcaccgcgggcgcggcgcggtgctgaccccgccctacgcccaggccgacatgcaggtgtacatcaagtacgcgcggtcggtgcggccgcgcctgggcgcgcccgcgcgcgccgcgctggtggccgcctaccaagcactgcgcggggccgacgcggcgccggggacctccgccgcctaccgcatcaccgtgcgccagctggaggcgctggtgcggctgagcgaggcgctggcgcgcctgcacctgcgcgccgaggtgcgcgccgcagacgtgcgcgaggcgcaccgcctggtcaagaacagcatcgtgtcggtcgacgcgccagaccaggagctggtggggggcgggggggaggaggaggaggaggaggaggtcgcggcccaggtcatgggcctgccgggcagcgggggagagcgcggggaggcgggtgctggggcgggcggcgctgcgccggaaggggagactagtgctgccgacggcggggccgccccgcgcgccgccgcggaagaccgggcggcccggcggcgggtgcccaccgccaagtacaacaacgtcaaggggccgggagcgcgcaaccttcttggactcggtgtgcgctcgagtgggtccgtcaccttcctggacgcctgggggccgctcccttgcccgacccactccctgactcccaaatcaccgcagaacctgctggtgctgcggctgcgccaggcggacgacgaggccggcgaggcggtggacgaggagggcgcgcccgaggcgggcctcacccagcgcgacctcctgcgctggtacttcgagtacatggtggagcgcggcgcggtggcggggcaggagcaggggctggaggagctggtgctggccgagaaggtgctgggcacgctcatccggcgcgagcacgtggtcatggtggtgcagaccccggcccaggccgagggcgagtcgcccgccgagtacggccgccgtgcgcagctggagcgggtgctggccctcaaccccaactactccctggactga

SEQ ID NO: 8097 - DNA, 243 bp, Chlorella protothecoides
atggacgagtcgcagtttgtcgactggcagaaggtcaaagtgcaggagaacccggacgaggtgagcatgggctcgggtgtggggattttccccacaccacctggcgcacatggggcggttgcagtctgtcctccctgcagcagggaagcagcgtgctcttcccccgcaccgaggaaccaggggcgtcaccttggatgcagcgagaatgctgttcgccactgcgtcacctccaagaaccagtaa

SEQ ID NO: 8098 - DNA, 213 bp, Chlorella protothecoides
atgcccatcaccacccccgcccgcaggctgaggcatggcagctgcgagctggtggtgctgcgctcgaacctgcagtgcctgctgcggggcaccgcagtggtaccccccatgcccggcagtacccctttccagcatgccgtggccagcgtggcccagcagagccatctctgcccagtgcccctggaggtgcaggtgggtgtggagtgcggctag

SEQ ID NO: 8099 - DNA, 1248 bp, Chlorella protothecoides
atgaaccgcggcgcggttcgcgaccacctccccgccgagccgcggccgccctcgcccgagccctggtggacggtgcacgtggtgaacgtcagcgaggcggagcaccggcgcctgacccccgccgagctggcgctgtgccgggccagcgcgggcgcacgcggcggcgccgcgcgcctcgccgacctcggccccgaggcccccgcgctggtggcctcccttcaccgccgcggcctggtctggctggacgtgcccatcgccgcgcgcgaccagatctcggtgcccccactggagggcttcgtcagcaaccgctccggcggcggcggcgacgccgacccgctggagaccctgctctactccgtcttcgtggccgcctcggagcgcgtgaccgtggccgacctggccgccatcctgggcgtggacgtgcccacgctgcggggggggagggaaggacatccgcagcaaagggggctgaagtatgtacttgagctgggcatgggcagggctcggggattctgtgtcccaccaggaatgggtccccgcggaacgcgccaggccgtgcggtgtgtggttgtttctctacccccccacactaccttgagcccacgtgactccacccaccctcaccaaccccccgttcccaaacacaacggcaaggtggcggtgtcgatggcgtgccggctgggattctgccgcaagctggacgaggcggaggcggggctgagccgcgaggcgtcgcaggccggctccacgcccagcccctccccccgcgcctcgctgtccgagccctttgtgctgggcatgacgcccaccccccgcaccaccagcgcctgcgagggcgggcttcacacggcctcgcagggggacccggggcagggaaccctgagccgggcgccgtcgggcccagcgccgtccggccctgcgccgccggggcaggcaccccacgggcccagcaaccccgcctccgcccccggcacgcagcggggggggcgcggcgtggcgctggtggtggacagcgaggtcacgggctacctgatgatgggcgcgctgacccccgcctgcaagcgccactcggtgtcgctgttcgagggcgggcgcgtcagcggcgcggccgtggttgccgagctggcggcggagctggaggccagcgcggccgcgggggcggccttcgagggcgagatgcgcgcgctggccgggtacgcggcgggcctggcgacgctcatgcgcgcgctgatggcccccggcgcccgc

SEQ ID NO: 8100 - DNA, 672 bp, Chlorella protothecoides
atggtggctggctgggacgtggcaggccccggcctctactacgtcgactccgatggccagcggaccaagggccagcgattctcggtcgggtcgggttccctgtacgcctatggcgtcctggatgcaggggacatgtcggtggaggacgccgtggagctggggcagcgagcgatctaccacgccacggcccgcgacgcggcctcgggcggtaccgccagcggtgcgttgcgcttggtggaggctgatgcggggatgtcggcacgccggggtggcaggcgccctcatgccacggcgcggggggaacacccggcgcgaggcgccgcgctccccgccagacggcaggctgatcactcgccctgcgcccgtgcagtgtaccacgtgacggaggcggggtggaccaaggtccgcggcgagtcagtgggggagttgcactacaaggtaggcggggtggaaggggcggagggggggtgccaggtcacagagagcgaacagtttcagggaccctgtcgcggagagcatgcgacctccctcatcgccgtgctccgcctacctgtaccagcccctgtgcgcacggcagtggcctcacccctcgccccatccctcgatttccggcagtactacccggacccgctggtgcgttcctccatcgccgtggacccgctggcgacgtga

SEQ ID NO: 8101 - DNA, 297 bp, Chlorella protothecoides
atgcagctcgatctttccatgctggagcctgtcaccaggaacgccaaacagacacaggaggcgtgcctgaccgggatatccggggagggcatcgacgccttccccctcccagccgtggccgatctggactcgttcgagaaggaggttgtagagtacgtgaagccctcccacggcaccacgacattaggcttcatcttccaaggcggcgtgatcgtggcagtggactcccgagcgagtcaaggctcctacatatgtgcgtgtgttgggatgcgccgtgggactggggcgacgtgttga

SEQ ID NO: 8102 - DNA, 180 bp, Chlorella protothecoides
atggctggcggtgccgccgactgccagttctgggagaggaatttgggccgccagtgccgcctgtatgagctgaacaacggcaagcgcatcaccgtgcggggcgcctccaagctcctggccaacaccatgttttcataccgtggcatggggctctccatggtgcgaagagtggagcagtag

SEQ ID NO: 8103 - DNA, 930 bp, Chlorella protothecoides
atggggcgggaggccagggcaaggcgtggatggggcagcgcaaggggtctcgagacagggtgccacggtggggactttgcggcaggtggggcctcgaccctcctcctccctgcctgcaatagcggcgtggctttcatctgcaggctcattcacagccacagcatcccgatgagcaccagtggaaggcctgccaagactggaccacagacctccttcccacccctcgaccctctcacccccccccaacctacccatccgtaccccaggcactccccgctggccggcagcagcgacctgcagcgctggtggagcgcgggggtgggggccacgcgcgccgcgctggacgcccacctgctggcgccgctgcaggcggtgcgggacgagctgttcaccaccttccgcagccggcccagcatcgtcagcctcgctgagtacgaggcggaccgcgactcgctggcgcggatgctgggcgactttgagcgggaccgggggtctgcaggcggggccggcggtgggggcgccggtccgggggcgccccctcccacggcgggggacgccgtgctcgtccaggtgggcaggctgctggaagggcggaatgtggaggatggcgacgctcgctcgttgccagcccccagaggcggtgggccccctcccaaagtgcgatgtcagcacgtgcggcacaacgaccccacctcccccgttcctgcctcccgccggcagccagacccgccgccccgctgcccccccccgcgctcgcaggggatggacacgatgatgcggcggtacgagcatgagctgaagaagcccatccggaacctggtggcgggcgacctggcacgctgcctcctgatccaggcgagtaaggattgtggggggcgggtgggtcctcgtgagccacacggcatgtgcccctggaaggcggccccatga

SEQ ID NO: 8104 - DNA, 123 bp, Chlorella protothecoides
gccgccgcgttgcgcaaggcgctcgcacaccagcccgtgtcggtggccatctgcgccaactccgcgctccagttctattcctcgggcgtggcgggggacgagacgtgctgcacccagctcaac

SEQ ID NO: 8105 - DNA, 513 bp, Chlorella protothecoides
gtgcggcgcggcgcgctgcgccgccacccgggtctggccgccgacccggcgctgggcgacgaggcgcgcgcccccggccccgactccccccccgacgggccctttggcgaggaggtggaggcggaggccaacgccaccttccagcgcgtgtacaccgaggcgctgcccgtggccacgctggtggccgagctggcgcgcatggcgggcagcgctgagcgccgcgagcgccgcctgcacgactgcgtggtgcacaacctgtttgacgagtaccgcttcctggcgcgctacccggaccgcgagctggagctgacgggggagctgtggggccgggtcatggcggcgcgcctggtcaccggcgcgcccctggccgtggcccagcgccacctgctggacgcgctggggaccaacgcgccggggtcgcgcatgcacgccttcggcctgcgcgccgcgcgcgcgctggcgccgcgcctgcccgactggcccgagtttgccgcgcagctggccgaggcgccg

SEQ ID NO: 8106 - DNA, 972 bp, Chlorella protothecoides
ctgggcgagcacgtgctggagccgccggggcggcgccgctccgggggcggcgcgtccggacaggcgcacggcgaggccgcaccgcgcgacgcggtgaccgccgtcgcgctctccgcctgcggcaactttgcggtggtgggctcggcggacggcgccgtgcaccgctacaacatgcaatccggcctgcaccgcggcgagtaccagcgccaggcaggaggcggcgacgcggcgagcgaggccacggcgggccgaccatcgcccgcgcacgacggcgcggtggcgggcctagcgtccgacggcgccaaccgctggctggtcagcggcggggaggacggcgcgctgcgcacctgggacttcaagcgctgcggactgacgggggagctgggcgtgggggcggcggtgcagagactggcgtgccacccgtcctcggggctggtggccgtagcgccggccgacctcatgctccgcatctacgacgtcgagttcgcacagggcgctggccccctcccttccctgcgggccaccggtgatgacaacattctggcaccagtcttacgcgccaatctaactcattcctggcgcggtgtgctgatacccctttgctgactcccaagcttggcttggcttgccatggacacttgtctcctctcggcacacgactcacaatctccacaccaacacacccatccacaggcccagcggctggtgaggaggttcgagggccacctcgaccgggtcaccgatctgcagttcagcgaggactgccgctggctgctgtccagctccatggatggcacgctccgggtctgggacattccaggtgggtgcgtaggggggtcttgttcctctctcacctctccctctgtggtttcaagacccccaaagctatctgtattcctgccccgcccctgccccccatgtcacaacaccacacctcctggcgatgataagttgatagtctcgttcgtctga

SEQ ID NO: 8107 - DNA, 1476 bp, Chlorella protothecoides
atgagttcaacgactctctttctgagcggtgcagtgctgtttcccttggccccctgtgcattgttcctcgtcgcggtcacatggcatcctgtccttggacccggctcccagctgctccaggtgctggacatggggggtgtggtcacctcgctgtccctctcccccgcccaggacctgctggccaccacggggcagggctcccgtggcatcaacctctgggccaaccagctgatctacggcgcggggggggacatcgtgccggggtcgcgcgtgcgccacgcccacctgcccgcgctggcggtggaccccgagggcgaggaggagggcgccgcggcgcgcgcggccgcgcgcagccaggccatgctggcgctgacaccgcgaaaggtgggcgcgcccgacgcttcctccgactccgagctggaaatgtcggcgggggagggtgccgacgcgctggccccgctgcgcgacgcctccagctccgaggacgaggaggaggggggcggcgccgcctcgacaccagcgctgcgcctggaggacgaggtggcgggcgcagcgtgggcgaagcgcacgcccagcggcgcgccggcgcctctggcgccggccatgctcacgctgagcctgttgccgcgctcgcagtggcagagcctggcgcacctggatgtggtgaaggcgcgcaacgcgccggccgaggccccgcgcaagcccgaggccgcgcccttcttcctgccctcgctggcgggggcgcgcgcggggcgcgaccccgtctttgtccctggattggggcaggacggcggcgaggagcccagccccggcgacggcgaggagccggcgctggccgccgcggccatggccgcctggggcggctcggaggacgaggatgcggcgaacggggatgaggacgtggcggatggggatgaggacgacgaggatgcggcggacggggacgaggacgtggcggacggagatgaggacgcggaggccgacgccgatgcggatgccaacgccaagccacggcgcaagcaccacccccaatcgcgcgtgcgtgggctgggcggcgcgtccgcccccgggcgcgcgccgacgctggcggcgctgctggcggcgccgcgccccgggtcggacgaggccgtgctgggcctgctgcgcacgctgacccccgtgcaggtggacggcgaggtgcgggcgctgacgcggctggcggagccggggcaggacggcggcgagggcgagcgcctggtggacgcgctgttggccttcctggaggcccagctctgcgctggctcctgctttgacctggtgcaggcactgctgcgcctgacgctggacgtgcacgccggcgccatcctttctagcccgtcgctgcagcgccgggcggcggggctggccgcgcagctgcgcgccagctggcagcgcgtggacgacgcgctcaactccacacgctgcgtgctgggcctgctgggcaacctgcagccgtga

SEQ ID NO: 8108 - DNA, 1809 bp, Chlorella protothecoides
atgctgcgccccagcgagcgcgcggcggcgtccttcgcctcgggcgaggcgtaccgccgcggcaccgccctgcccttcacccagatggtcatcaccttccgcgacgtctgctactcggtccccctgccaaaggacctcgaccggggcaaggccgacacggggggcgagggcccgcacgccggccagctgcgcctgctgaagaacatcaacggcgccttccgcccccacgtgctgacggcgctgatgggcgcgtcgggcgcgggcaagacgacgctgatggacgtgctggcagggcgcaagacggagggcgtgattacgggcgacatccgcgtgaacgggcaccccaagcaggaccgcacctttgcgcgggtgatggggtacgtggagcagaccgacatccacatcccgcaggccaccgtgcacgaggcctgccagttcagcgcgcgcctgcgcctgcccacgacggtggacgccgccacgcgcgaggcattcgtggaggaggtcatgaccctggtagagctggaccgcctgcgcggcgcctttgtcggctcccccggcgtgtcggggctgtcggtggagcagcgcaagcgcctcaccctggcggtggagctggtggccaacccgtcggttgtcttcatggacgagccgacgtcgggcctggacgcgcgcgccgcgggcatcgtcatgggcgcggtgcgcaatacggtggacacggggcgcaccgtgccgggcgggcgcaccatctacaacggccccatgggcgacgactcggccgacctcatcgcctacttccaggccatcccgggggtggaggccatcaggccgcgctacaaccccgccaactggatgctggaggtgagcaacccggggaacgagcggcgcctggacaaggacttctccgagctgtacgacgcctcgccccaggcggaggcgctgcagaagctgctggcggcggaggcggagccgcgggagggcgtccccgacatcgactactccgcgctgcacatcgcggcgcccatggagcagttccgcgtgaacctgcgccgcaacttcctcatgtactggcggctgccggagtacaacatcacacgctttgcctccaccatcctcatcgcgctggtcttcggctccatgttctggcgcctcggctccgaccgcaccaccgtgtcgggggtgctgaacatcatgggcgtcatcttctcctccaccctcttcgtgggcatcagcaactgcctcaccgtccagcacgtcatctccacccagcgcaccgtcttctggcgcgagcgcgccgccgggctgtacggcgtcctgccctttgccgccgcgcagcagctggtggagctgccctacatcctcatccaggcggtggtctacgtctccatcgtctactggatgatctggttccagcgcgacgcgggcgccttcttctggttcctcttcctcttcttcctcaccctctgctacttcaccttcttcggggtcatggccgtgtccatcacgcccaacgttgccttcggaaacgtcttctgctccttcttcttcggcgcctggaacctgctctgcggcttcctcatccccgagcccgccatcccacgctactgggtctggttctactatatcaaccccgtggcctggagcctctactccctggtcatcgcccagctcaaggactttggggatgagtacatcgtcggtgcgttggcagtgggaaggggggggggagtgggggaagagcatgcccgaggggtctgggtggagtattccagggtggcattgcaagggatcgacggcggtgagggaagcacctga

SEQ ID NO: 8109 - DNA, 699 bp, Chlorella protothecoides
  modified_base (666)..(675): a, c, t, g, unknown or other
atgttgtatcatgcgacggcgggcctccatgtggtgtgcatggtgcatgaacccctgggctggctggcctggccggctcatgctgggcacgccatgccaccgcacacgcaggggaggaggagtgttgccgccgcccatcagcccacagcccaaaaggaggtcatagacctgaggcctcccagaggtaaaaggttgggggttgttgatggctccttgaaggttcaacatgtgaaggctgggctcgtgcaagagcatgcgaacccacatcaagcccagcggatgggcctttgggggcgtcaccaaccccatgcacacccgtccacaggcacgcgtgacttcccccccgaggacaagcggttgcaggcctggcttttcgaccacttcgccgccgtcacccagagcttcggcttcgagatggtggactaccccgtcctggagtctgaggcgctcttcatccgcaaggccggcgaggagattgtggaccagctgtacaactttgaggcatgctataagggggggcccggggttgtttttttgtttcaagtgggtgggggcttaggctccccaatgggttctcacgtgtggccagtcccttggagacctgccctacacatacacctgatctacattcccactgccactcccacccagccccccattcctccnnnnnnnnnncgtggaccagctgtacaactttga

SEQ ID NO: 8110 - DNA, 1431 bp, Chlorella protothecoides
atgcccttcaatgcacaggacaagggtgggcggcgggtggccctgcgccccgagctgacgccctccctggcgcggctggtgctctcggccggcgccgggcgcccgctccccctcaagtgggccgcggtggggcagtgctggcggtacgagcgcagtacgcgcggccgtcggcgcgagcactaccagtggaacctggacgtggtgggcgtggccggcgtggaggccgaggccgagctcctggccgcgctggtggccttcttccgccgcgtcggcctcggccccgccgacgtcggcatccgcgtgtccacgcgcgcgctgctgggcgcggtgctggagggcgcgggcgtgccggcggcggcgcacccagccatctacgtggccgtggaccgcgccgacaagctccccatcgcggcggtagaggcggagctgggcgcgctgcgcgtgcccccagccgcgatcgacgcgctgctgcgcacgctacgcattcgcgacgtgggcgccctgtccgaggtcctgcccccggactcgcccgcggcgcgcgacctggtggtcctcttcgacctggcagccgcctacggcatcgccgactggctgcactttgacgcgggcgtggtccgcggcctggcctactacacgggcatcgtgttcgaagggttcgaccgcgcgggcgcgctgcgcgccgtctgcggcggcggccgctacgatcgtctgctctcctcgctgggcggcgccgacctgccctgcgccgggttcggcttcggcgacgcagtgatcgtggagctcctgcgcgaccgcggcctgctcccggacctgggacggcgggtggacgacgtggtgcacgcgctggaagaatcgctgcggccccaggcctgcgccgccgccgccgcgctgagggccaagggcaggagcgtggagctggtgctggagcccaagcgcatgaagtgggtgctcaaggtaagggggaacggggtgacggagtgtggtggtggcagagatgggtgcgattctggggacgctgcattgaagcagccactggggattgggtggcccgggtcctgcatggcgtgtgtgcatgcccgtgagtctggcgctgtgccagcgctggtgcccagcggagctccccccttccctcttcatgactcagcatgcggagcggtgcggggcagcgaggctggtcctgctggcgcccgaggagtgggccaggggggaaatcaaggtcaaggacctgtccagccgggaggagaggacggtggtgggggtggaggggctgtgccagctggactgagtggtgcgtgcctgcctccgtgttacccctggatatcttctagtctgtttagagaggattcaccgttgaatgaagcgaggcagagaccgaacattgcatggaagggagtttcccgactttgtcatttcgaggttcgctcttggtaa

SEQ ID NO: 8111 - DNA, 501 bp, Chlorella protothecoides
gtgaagggccgccgtatccgcgagctgaccagcgtggtccagaagcgcttcaagttccctgagggcgcggtggagctgtatgccgagaaggtggccaaccgcgggctgtgcgccgtggcccaggccgagtccctgcgctacaagctgctgggcggcctggccgtgcgccgcgcctgctacggcgtgctgcgcttcgtcatggaggccggcgccaagggttgcgaggtcatcgtctccggcaagctgcgcgcgcagcgcgccaagtccatgaagttcaaggacgggtaccaggtgtccagcggcaaccctgtgcgggagtacatcgacgccgcggtgcggcacgtgctgctgcgccagggcgtgctgggcatcaaggtgaagatcatgcgcgagtgggaccccactggaaaggtcggacctcgcacaccgctgcccgacgtcgtcaccgtcctcacgcccaaggaggaggaggtggcggcgctgcccgcccccgtggaggct

SEQ ID NO: 8112 - DNA, 225 bp, Chlorella protothecoides
atgctggtgggtgcgtgcgtgcgtctggcgtcggccgtgtcccccacccgagtccagctggagctgctgcccgcgctgtgctccggcgcggacgccgacgcactggagcggcgcctgctggtggccgaggcggccgcggcgctggcgccgctctttcctcgcgcggcgttggccggcgcggcgctgggcctggccgaccacctggcgcacgacgccgaggcggtg

SEQ ID NO: 8113 - DNA, 828 bp, Chlorella protothecoides
atggaggcaggggaggcggggcgcgaggcggaggtggagaccctggagcacctcttctccgaccccaccctcttcccgccggagcagatggcggtgttcacggggcgtgaagccctggacctgcaagccacggcgcgggcccgggaggaaaggctggcggtggtggagtacgacctccgcctggccagggaggacctggaggcacacagctcggggcatcacggcgcaaacggcggcggccctgcagacggctccagggcccctgtagggcccgacggcggggccccgaacaaggacacagaccctcccctgccaggagcccccccacggccgcgctccccgaggctggaccccacgcagcggcgcgtcctgaacgacatcgtcatgcggtacctgctggaccaggggtaccgcgtgacggcgggcacgctgcgcgccgaggcggggtccggcctggcggacgcgcgcgctgagctggcggccactgccgacgcgctgggcacggcgcgcgtccagctggcggacgcgcgcgaggcggaggcggaggcccagcgccggctggaaagcgcggcggaggaggggcagcgcctgcaggctgccttagatttcgaggcgagccgggtgcgggacctggaggagcggctggcgcagaaaggggggaatggagcgggggaggaggaggacggggacggctggggcaagggccagcgggggagctcccccgcagcgctttccgccgcggccgcgcggtccgcgctggacgaggtggcggcctccctgcccgcgctgctcccgcatgtcctcatcaaccggagacaaggtgcgtga

SEQ ID NO: 8114 - DNA, 3261 bp, Chlorella protothecoides
  modified_base (790)..(799): a, c, t, g, unknown or other
  modified_base (1933)..(1942): a, c, t, g, unknown or other
  modified_base (2108)..(2117): a, c, t, g, unknown or other
atgcattgctttggtgggtctgcatggtccttagcaaccgagatctgggaagtcagtggcgtcccacctgcgccgtctgtcagtgctcagtttcagcagcttgctgatcagggtggggtccaagttaacaagaagaaaacaacacatgcatcccttacagacgcgatagatgcaagcgtgcacagcggcgttgcggatggggcatcagagccactgagtcgatctcgctgtttgaggggagttggccatggacatgtggagaaattagtcacttccccactttctttttgcacaaacgccctggtgcccccacgcctgggggctccatttgagtgccaacccctgcttccctgcgtcccctctaccacccctctatccctccagatttcttccctcaaggccgtgatagagcgcagccgcgcgatggcactcctgagggccgcgggttccctctctgggctcgcacgctccgcacagggcacctcccccgccctcgcctgcagccgtgtggtggcgcagcgtgctctgtatgccgccgaggccgcccccgaggccgcccccgagaccgatggctccgtcacccaggtgcgcaggtcccatccgatccagcatgacccctgggacccggtgcacgcggggtccggccgggtttgggcccccgcaggccccgggtcccggacacccagccgtttccaacgggccatcccgtcctgcctggacccaccctcggccccgcccgggcatgtggcgctgtctccagccccccacccccgatccccctttccccaannnnnnnnnnggccgggtttgggcccccgcaggccccgggcccgggacacccagccgtgtccaacgggccatcccgtcctgccggaccccatcctcggccccgcccgggcatgtggcgctgcctccagccccccacccccgaccccccttcccccggcctcccaggtgatcggcgccgtggtggacgtccacttcgagggcaagctgccccccatcctgtcctccctggaggtccaggaccacgacgtcaggctggtgctggaggtcgcgcagcacgtgggcgaccacaccgtgcgcaccatcgcaatggagaccaccgacgggctggtgcgtgggcagcgcgtggtggccacgggccagcccatcagcgtgcccgtgggccgtggcacgctgggccgcatcctgaacgtcatcggcgagcccgtggacgagcaggggcccatcgactccaacgtcctctggcccatccaccgcgaggcccctgagttcgtggagcaggccacggagcagcagatgctcaccaccggcatcaaggtggtggacctgctggccccctaccagaagggaggcaagatcggcctgttcggcggcgccggcgtgggcaagaccgtgctcatcatggagctgatcaacaacgtcgccaaggctcacggtgggcttgtcaagggggaggggggcgtgggattccgctgttctcctggggctctgatgtcgtcggtccgtgcgatgccagggcgaggcagggtggaggtcgtcgtcaccacggttctgatgccgtggctggggtgtggtttctccgtgtttgcgggcgtgggcgagcgcacccgcgagggcaacgacctgtaccacgagatgatccagtccggcgtcatcaagaccggcgccgcccaggccgagtccaaggtgaccctggtgtacgggcagatgaacgagcccccgggcgcgcgcgcgcgcgtggcgctgaccggcttgaccgtggccgagtacttccgcgatgaggagggccaggacgtgctgctgttcgtggacaacatcttccgcttcactcaggtgcacgaggaatggcagtgggtgcatacctgggcggtggttaagggggggggggggcactcccgatcccggtggcgccggtgtgtgttcatcnnnnnnnnnntggcagtgggtgcatacctgggcggtggttgggggggggggcactcccgatccggtggcgccggtgtgtgttcattgcaccgtggtgctcattgtctccctgtaagtttcaagtccgccatcaacagaacctcccatacccatcgcgcgcccccccccccctttcnnnnnnnnnntttcaagtccgccatcaacagaacctcccaaacccatcgcgctttcccccccctcgcaggccaactcggaggtgtctgccctgctgggccgcatcccctccgccgtggggtaccagcccacgctggccaccgacctgggccagctgcaggagcgcatcaccaccaccaccaagggctccatcacctccgtccaggcgatctatgtgcccgccgacgacctgaccgaccccgccccggccaccacctttgcacacctggacgcgaccacagtgctgtcgcgctccatcgcggagctgggcatctaccccgcggtggacccgctggactcgacctcgcgcatgctcaacccgcgcgtgctgggcgacgagcactacgccgtggcgcgcggcgtgcagaaggtgctgcaggactacaagaacctgcaggacatcatcgccatcctgggcatggacgagctgtcggaggaggacaagatggtggtggcccgcgcgcgcaagatccagcgcttcctgtcccagccctttgccgtggccgaggtgttcacggggacgccgggcaagtacgtggacctgaaggacaccatctccggcttccagggcgtgctggacggcaagcacgacgacctgccggagatggccttctacatggtgggcgacatcagcgaggtgcgggacaaggcggaccgcatggccgccgagatcgcgggcaagtgagcgcgtgtgcggcggtgtgtgtgtgtggagcggggatgggcggggcccacatggggacccctccccccccccaccctccacaagccacccaggcaccggccccacccccggccgggccgccgagcggcccggcccagcgtttcttctcttcatgcctgttacaaagtcgtgaagcgatcggtagtgaatggggtagagtgaaggggaggggcctgccagccccaggggcgatgcgcgtgtggagccatgcggaggccccccttcccgcggggagagcgacgtttcaatctcgccgtgaggaggggtcccgatcaagacgcgcagcgcgcaggcaggccagcacagatgcaaccaggagctgcactcaacaccctccttgtctacccttcgtgatctccaatcagggcgggcgctgcgtggaccagcactag

SEQ ID NO: 8115 - DNA, 186 bp, Chlorella protothecoides
atgccactcatttacagctttgtggctcggcaaacgacggtgttggctgactacacttccttcactggaaatttcagcgttgttgccatccaggcactcgagaagggagcacaagggaacaacagcaagtttacatactcctgcgacggacacagtaagccacaggggcgggcctgcatgagctag

SEQ ID NO: 8116 - DNA, 384 bp, Chlorella protothecoides
  modified_base (116)..(172): a, c, t, g, unknown or other
  modified_base (347)..(356): a, c, t, g, unknown or other
atggctatagtgagtgatactccggttccttggtatgcagctttgatacaatgggcttgtgctgacaaaagggcacactccttgagtgttaacactgtgctgacgtcaccactgcnnnnnnnnnnnnnnnnnnnnnnnnnnnnnnnnnnnnnnnnnnnnnnnnnnnnnnnnnacgatgcctttgggcgccagatcccgtttgccttcctagagaaggtgaaagaggaatggttccagaagtgggccgacaagggagcagccgcattcgcccactccctggacaagagcttcggaaggacggttgacgctctcatctgccacgctcttgctgtgtctattcccaaggnnnnnnnnnntgcgcgggggcgctctgcaacgaattag

SEQ ID NO: 8117 - DNA, 1554 bp, Chlorella protothecoides
  modified_base (865)..(874): a, c, t, g, unknown or other
atgaagcgggcgagggacatccgggatcaaatcctgggcctcatggagcgctgcgaggtggagctggtgagcaacgtgggggacctggagggcatgcgcaaggccatcaccgccggcttcttctaccacaccgcctccctgcagcgcaacggtagctaccgcaccgtcaagaaccctcaggtactcgggagtgctgtgcgtatggtgggaacccgccgcggagcatggcagctgatcagtgggttccggcgttcagctgttcctccacccctgcaaccatgcctcctccgcccggccccctgcacacagaccgtggccatccacccctccagtggcctggcggaggccctgccgcgctggctggtctaccacgagctcgtgctgacgaccaaggagtacatgcgcgtcgtgtcggagatcaagcccgaatggctggtgggtggggctggtgggggcgtgtgcgggggcgctggcacgcgctctgaagtcccgctggctcgggcatgggtggagatgcgtacggccattgccggggctccactcgtcggtcccggtggcctcgggcatgggtggagatgcgtacggcctatgctggggctccactcgtcgagaaaagtcaccccccacacaatctcgacatcgacaggtggagatcgcgccgcactactacagccgcaaggagatcatggaccaggccgcgaagaagctgcccaagcagctgggcaaggcggccgagcccacatgatggcgctgggcaggctggaccgctgctcagggagctggaccagtcatgaggccgagggcggtgtgatgagaggggtcaggggaggggaggggaggggaggggggtgcctggtggaagggnnnnnnnnnnactccgcatcgcaacccttgaataaaaaggaaggggtccagggggtgtcacagggcattttcaaggaccaagggcacaagtgtatcaggcagggtcacagaggatcagcgggcagggccgagggcggtgtgatgagagggcacaggggaggggaccgcgcagaagatgatgacagcgacgaggatgatgatgacgatgatgatcatcttcatgcggaaggactgccaccacatgcggctgcgcagctgccgccccgtcttgtgaaacttgtcggcctgaaggtgtcatggacgagcagatccccacaacacgatgcacagattccagttctccagccacccacgcgcctggaatcgcaggttgtctgtcttgtccaccagcagctcaatcttctcgccgcgctccaggacgcgctcgatgttctccaccatgatgttctttacctcgtccacctgaggggattgggcggggctgatgcatcgacgcctgcctggcaccgcgagagctggcgctcgggccatcgagcttcgtgcaagactcctcaccgcaactcacctttttctggacggaggccacctttgacagctcctctgggtgttgctcacagtaatccatccagtacttcaagcgggggctgcaaggcagagtggggcagcgtgaaggcgacgacatttgggtag

SEQ ID NO: 8118 - DNA, 237 bp, Chlorella protothecoides
atggcccgagcgccagctctcgcggtgccaggcaggcgtcgatgcatcagccccgcccaatcccctcaggtggacgaggtaaagaacatcatggtggagaacatcgagcgcgtcctggagcgcggcgagaagattgagctgctggtggacaagacagacaacctgcgattccaggcgcgtgggtggctggagaactggaatctgtgcatcgtgttgtggggatctgctcgtccatga

SEQ ID NO: 8119 - DNA, 570 bp, Chlorella protothecoides
atggcacgccaggtgtgccctctggagctggcaggaaactgcaccgtcacctgccccgccacgggcctgaccctgaccctcaagttccgggacgagcactcggtcaaggggtcaatcgtgaagcgaggcagcgaggcgcgcatcgccatcttctccggccgctgggacggggctgtgaacgtggaggtgccggacctgggggcggggggcacggtgagcaacgcgagggcgctggcgcccgccgtggtgccctgggtcaacctggcgcagcccgggccgcgccgcctgacgcggctgtggagcgccatcctgcagagcatgtacttcatggacgtgcatcaggtggaaagcaggtcgtggggcaagtgcagtgtcgcggagactgaggaggggcccaagctgggcatgcagggcgtggctggccaacagcgcacgcacaggactgctttcaaacatccaaacactgctgccaccactttccgccaccccgaaggcggcggcattcgggaagcgggcagaggcgctggcgacagacattgtgccgctgctcaaaggatccttgctgtatga

SEQ ID NO: 8120 - DNA, 324 bp, Chlorella protothecoides
atgccaggcatcctccccgtgccagctgctggtgacactgttatccagtctctctcaatatgcagagtggtcatcacctacaccctggacctcctccgtgccggccagggcatgggggagaccccggttgtcatcctgggtcagcacatcatgtcccatcgggacctaggtgcgtttcggtggggcattgtgttgctaacaaaccaggaggccttgcatgaggatgttgccgtgctgggtttcttggaagtggcctacgggatgcatcctcgacgaggctcccaggatctgctcaccattgcgcgtgcctccaaaggagcatga

SEQ ID NO: 8121 - DNA, 402 bp, Chlorella protothecoides
atgctggctgccaaggtcaacggcaagctggtgtccaatgaccaccgcctggggaacgcaggtgagcctgcggggccctggctcaggggctttaggccggcgttggcagtggctggcaagggtcctcagcccgaggatctcaatcgagttttctcgagtgcgagtcacgtgcaggcttctctgttcgccgcacctccctcccacccccatcgccactctgacactgcagaggtggtagagatcatcacctccaagggcccggtcagtgcacagctcctccggcgacaccaggcctggttgagcactgcccagaccaagacggcccggcacaagatcgcgcgcttcctgagggagcacgccatgccgacagtgttccagggcctgacgccgccatgtaagtag

SEQ ID NO: 8122 - DNA, 924 bp, Chlorella protothecoides
atggcggcatcaagtgcccagcgaaatgcatgggtcctgacggggccgcggcagtgcccgccccctatggtccgcctgcgcctcgtatgcttccccatggcgggatcgggggcatgcatgtaccacgactgggcatttccgatatctcttggtgtcgaggtgcggggacgggtcagccgcacgcattcgtgggtcgtcgtcgggaccatccctgccacctccgggccctcccatgccccagcacctcaaccaccgccatccgcggcccaggtgctgcccattgagctccccggcaccaactcccgcctgaaggagcccaaggccacgtgcctgcgggccctggcgcaggacgtggtgcagggcatcgccgcccacctgcagccaggccagccccccgtcgtgctctggggccacagcatgggcgcctggctggcgtacgaggtggcccagctcctgtcggccccgggctcgggcctgcagcgccccctgcacctcttcgcctccggcaatcgcgcaccctccctggcgggcctggagcacaaccccgactcccatgtcatgcaccgactggaggctgccgagttctggcgcgtgtacacgcaacggtacggggccaaccccgatctggaaagcagggcgctgcgtgcctacctcctgcccggcctgcaggccgacttcaagctcgtagagacgtacaccccctccagcctgagaccgctggactgtggagtgatcgcgctggggggaacgagtgaccccaggtacagccctggccagctcgaggcctgggcgggtgtagcaccgccctcgcgcttcagcgtgcagtggtttgagggcgggcacctgtttgtgcgggagcagacgacggcagtcctggagtttttggagggcaagctgcggcacctcttgcccgacagccggtga

SEQ ID NO: 8123 - DNA, 318 bp, Chlorella protothecoides
atgtatgccgacacccgcaagcccttggtcgtggcgggcagtatcaatgccgatctaatagccaaggtagcccgtctgccggcccccggcgagacgatggagtcgcaggggtttgatgtgtttcctggtggcaaggtaaagtgggtcgcaggccctaacaccccgcaccggatgcatcccaagccggcgccgtgtgagggtgattgccagcctaaactccaaatcacaatctccttgcagggagccaatcaagcggcagctgccgcgcgactgggttacaacaccttccttattgggcaggcaagcactgcgtcctag

SEQ ID NO: 8124 - DNA, 819 bp, Chlorella protothecoides
atgctccgaagctccctgtcagactgcggcgtggacacttccctggtcaccagtgcggatggctccagcggaatggccctgattctcctgcaacctggaggagaaaacagcatcatcctggtaggaggtgcaaacacttcggacaactggaagatcacggatgaggccacacaggcacgccgcagggttgtcttggccggggggctggtgcttgggatgctccttggcttgcccatggagcttggaagggagtcaggcagagtagcgggtgcagcgggagccagggcgacctctcaacattccggcagtgattgcccgtgtagggcagtccatgatgctcaaactcctactgctgcgtttccacaggcagtgcagacggctggagcgctcctcctgcagcgagagatcccggaagtcttcaacgtcatctttgccaaggtctgtgcagggttggatggaggcttgggatgcacgggagcggctcctttcccctcagatgcatctgaccacagtcgccccagcgtggcgcacctggcacggggtacagcaccggcgaacccccccggacccgccaccacatacccacccccacacacgcagatcgccgcttcggccggagttccagtcatcctggacgcggggggcgtgacacagcccatacaggtggacctgctctccaatgtcagcctcgtctcccccaacgagaccgagctggcccgactcacgagtgggtggcatggttgctggaccatggagtgggtcgatggggtacagggagattccgttgggtggccttgcgattctggagtccgatcctga

SEQ ID NO: 8125 - DNA, 384 bp, Chlorella protothecoides
atgcctaggcagtccggttcactgaacatgcctgggcggtctggctcgctgttggatgcaggcttcatcaccctcaaaagcatcactccagcacccctccccctcttccacccccccccagacatgcccacaaagaccatggcccaggtccaagcagcagccgaggcactcgtgcactctggcgtgaacaaggtcctggtcaagctgggttccaagggatcaatgctcgtcggtgaggggcgagacggggctaggcctgggggctcacggggtgggagctggccggggaactcatcgcgctgtgaggggcaggcgggccatgggcccgctgagctcagtcatgcgcctcccgtgccagcacagcatgcggcaggaaccccctga

SEQ ID NO: 8126 - DNA, 594 bp, Chlorella protothecoides
atggagcgcgacacaccgtgtgtttggcttcaggtagcgtattcctttttgaagaccatgagacatgtcgggtacatgcctgcctggagaatgctcatggggagggtggagatcagtacagtacctccagcctccgacctccagcagccgtccccatgcgcaggctcatccggctctacacccgacgacaacgacgacgacgacaagtttgaggagcggatagccgcgctgcagggcaagcgcgcctccaagcagcgtcctactagccagggcgccgcggcgcgggtgccgggcagggacatctcggcccccgcctccaagcccagccccacccctcccacccccaaggactggggccgggaggaggtgttcctggactccccgccccaccgtggcgacctggccagcaacatcgcgctgggcgccaccctcctctggctgcccctcactgccgcggccgttggccgcgcggcctttgtgcgctatctcgtcaccgacaagcgcgtcagcgtcagcacctctgcgccttggaagagtgaggggcggtgtgtcacccgcagggggccgggcgggagaacagccgctgacatttga

SEQ ID NO: 8127 - DNA, 1188 bp, Chlorella protothecoides
  modified_base (426)..(435): a, c, t, g, unknown or other
  modified_base (508)..(517): a, c, t, g, unknown or other
atggccgcacccatgtctcaacgcgtatcaagtcagggttgttccagtgagattcaccgtggtcgttcgaccttcgctcaagctggcactgtcaatgcacacaggtcttacatagttgatagacatcgcaatacccaatgctctgccaaaatacaaagaaaagaagtggcattgtacgactactgggaccggatcgttccatatgagcaggcctggagtctccagcatcggctcctagaggaagtacaggcaggcatgcacggcgtgggtgcggtcatcctacttcagcatagtccagtctacaccctaggcgccggatccacgatagaccacctgaggtttgacccttccaaccctcctcatcccctcttccgaaccgaaaggggcggtgaggcatgggtgaaccttgagaggcgcaaaggcttnnnnnnnnnngtgccctgtaaagcggcaaaatgtattgcattgctgaccaccctcgttgtgcagagtcttgcacatcgtcagnnnnnnnnnngaccgagaggggtggtgaggtgcgctgacattgggtcgtgtgtcatggtttgtgcttgtgcttctccaacgctggtcacttctccttacggcccaggtgacataccacggccccggtcagctcgtcatgtaccccatcctggacctgaagcagctgacccaggatctgcactggtacctgcgcagcctggaggaggtagccatcagagtcttgcacatcgtcagtaccgaggagaaccccacgttcggccccataccagggccctggaggcggtctctggcatagagggcaagcgggagcctggacgcacaggggtctgggtggatggccggaagctggcagccataggtgtgcgagcgcggcgctgggtgacgtgccatggactcgccctcaatgtggcgccggaccttgggcccttcagctccatcgttccctgtggcatcgctggccgggaggtgggatcggtatgggaagccagccgagaggcggaggacgaccgccaggacagcagcatccaagcacagcaggcccagctgctgcgagagtatgctgtggcccttctggaggcagcagaagatgtttttgtgatgcgactcgtgccgggagaggagcccttgaaggcccttaatgcccctgtttggttggaggaatgccggatgggaaaactctga

SEQ ID NO: 8128 - DNA, 672 bp, Chlorella protothecoides
atgcagtacgtcatcctctccgagcgctgggacaaggcggcggccaagtaccgcaccgccacgctgccctttccctacgactccaaggagacctacgagcgcgcgcgccgccaacccctgggcaaggagtacaacaccgacgcctccttccgcgatctcacgcgccccgccgtggtcaaggacgcgggcgtcgtcatcgagccactgcggtacacgcccgacgcagcggctgcggcggccgcggcgcctaagcgcgctgccaagatgccggtcaacaacgtcgtgggggggaggatgagccaggggcggctggccaaatctgccggcggcatctgtgagccctggatggagacatcatcagttcagatgaacaccagagtcaccgggggcggtttgctttacagccatggtgaaaagctgtgcaggatttcaaaggtgtcaaagttagttcattcgatgcggctttgccagcacagcatgggccgtcaaactgggctcaggaccactctagatgtccttccaatgaggtccgggtcgcattcaagagtcgccaaagaccggggtgcgcttctcgatgaacgccgccatgccctccttctggtctgccaaggcaaagcagctccagaattcccgcttctcaaatcttacgccctctgcgtcggggtggcatga

SEQ ID NO: 8129 - DNA, 759 bp, Chlorella protothecoides
atggcgtcccctcaccaactcctggcgaaagtgcgttgcctttccgtcccattctcagccccgcatggaggcaggtacctgagaaatctcagtttccagaagcccctcccccgagcccatagctatgaggcgcggatcccaccccgggcccgggctcttgccaccagggcactggacggtggatccaaacccacctctgcagggcagcctgagcgtcctgccaaccctttcaccgccctcgggatcgaaccttcattcctgccggggctggaggcttgccgcatctctgagcccagcgaagtgcagacctcggccatccccgtcctcctctccggtcgcaatgcggccatccagagctacactgggagcgggaagactctggcctacctgctccccatcttgaccctgatctcgcggcggcaggccgagggttcacgggcgcctggctcccgggcgcggggaagcaaggctaccgacggccccgctgccatcgtggtcgcgccctcgcacgagctcgccatgcagatcgtgcgcgtcgcacagtccttctttgaccccgaccagcggcgccggaccgcatgttttcgtaaaagcatcccctcccgctccgccccttcgcactctgctttcctcttaggcggcgccagcacgtggcggcagcaggaggcgctgaaggagcaccgtccctggctcgtggtgggcacgccgggccgcctggcggagctctcgcgcgcgggcgccctccagacacatcagtaa

SEQ ID NO: 8130 - DNA, 519 bp, Chlorella protothecoides
atgttcgaggatggtcccagtggcgaggagggggaggagggggagacgactgacgagggctcagatgccgatggctctgacgccgacatcaatcttgacagcgacgaagaggatgctcagagcgggcacgagctcgacgatgtgtttgatgcgtcttcctccgaggaggagggcaaggagtctgatgacgacgtagaagctggcactgcccgcggcagtgggtctgggagcgggcaagaggatgaggaggatgacaccgcccacgccgccctcctggcagcagtcaccgagggcgcccccggcaagaaagggaggaaggagcgccgcgccgtcgtgactgaggcctacccggaggccgagcacaacatgcccaatgcaggtgactgtggcctaggcaacgcccagaccaagctgggcaaggcccgcaagaccctgctgcgcatggaggccaaggagtcggccgtggcgccgccgctgccgggtctcatccggcagcgtctggagcgcaaggcggggtga

SEQ ID NO: 8131 - DNA, 1152 bp, Chlorella protothecoides
atgtgtggtgtgcaatggtgctggcccaggacatcaagattcaaacatgtccctgtagcctcccactatcctttaaagtcccatccgctccaccccccccccctcatctgcaattcctgctcaccctttccgaccccacgcagcacgggcatcctggtgctggacgaggccgaccagctgctggccccccagttcagccaggacgtgggccgcctggcggaccacgtgggccggggcctggccgctgggcggcagacggtgctggtgtcggcgacgctcaaccccaccaacctggccctggcggccacctggtgccgcgacccggtgcccctgctcacgggccaaggccggacccaggtgccggaggatgacgtgatcggcgaatcatcctcagacgtcgggcaccgcgaggccacagcctccccggcgcccggctggggctgggggcggcgcgctgcggccgccagcccgggcagcagcgcgggcggcgtgggcacgggcctgggcgcgcccgcacccgcgctgccgccggggctggtgcacctcgtggcgggcaccgcgccgcaccacgcggccgacacgctgcgccgcggcatccacgcgctggacgcgcagcgcgcgctggtcttcatgaacttccaggaccggctgcgcgacgtgcagggcaagctggaggcgcgcggcatgcccgccgcctcgctgcacggcgagctgagcaagcaggagcgccaggccacgctggccgccttcaccgcggggcgcttccgcgcgctgctggtgtccgatgtcgcggcgcgcggcctggacatcccggactgcgacgcggtcttcaacctggagctgcccaccgacgccagccactacgcgcaccgcgcggggcgcaccgcgcgagccgggcgctcgggcgtggtggtgtctctcgtgtctggaggccaatcctacgtggtccagcgctttggcaagcggctgggtgtggacatccagccagtggagttccggcacggggtggtggagcgggtgagggaggaccagcttgcaccacccaggaaggccgccggtgggggtcccaaggccgagggaacaggacaggcggcgcccctcgcgctcaaggccaccaggaagacagcgaagaaggggtaccgatcgcactag

SEQ ID NO: 8132 - DNA, 471 bp, Chlorella protothecoides
atgccctcccaaccggcggtcgatgaaggctgggatgccctactgggatccttctccaaccttctcggagaggttgatgaggccggtgtggtgaccctgaccctcaatcggcccaagcagctgaatgccctgaactcagagctcatgggagagcttgtcgcggcctgccagtacctggatcgcaagcacccctccgcacgcgtcatcattgtgactgggtcaggctccaaggcgttcgccgctggcgccgacatcaaggagatgtccagcgtcacatacagcgaggcgtacaacaagggcctgctggacggctgggagaccttgcgcaccatccgcaagcccatcattgccgcagtgaacggctttgccctgggcggcggttgcgagctggccatgctggccgacatcatcattgccgcagactcagcatcttttggccaggtgggtgtcggcgtggcccgcctgctttga

SEQ ID NO: 8133 - DNA, 1983 bp, Chlorella protothecoides
atgccccccccaaccttacccgctcccaggtatgaggcggccagcaaggacgtcagcaagtggcgcccgctggtgaaggccaacgccgcggcccccaccatccacttcacgtcggacaaggccgcagtgcacaccaccaccaccgttgccgggctggtggacaagcacgcgcccgagaccggtatggaggccgaggtggcggcgatgctggcgcgcgccggcgcccactcggaccgcgcgctggccgagtcggagcaggcgctggcggcgcgggagctgaccatcgaggagctgagggagcgccagaaccggctggccaagacccgggcgctgctgtactaccacgaggccaaggccaaacggctgaagaagatcaagagcaaggagtaccggcgccagatgaaacgcgccgaccggcgcaaggccgacaagttgggggcggaggagggcggcgacgccgccgaggcgctggtcgctgccgaggaggccgaatttgcccgtgccaaggtcggtggcgggcttggtggcagtggcaagggtggtgagcggctgacgctgaagcatcggaacacctcgcgctgggcgcggcgcgcgctcaagcgcggcgccaacctgaccgacgacgcgacgcgcgcggcgctggccgaacagctccagctgggccaggagctgcggcgcaaggtggagcgccccgaccgcggcggcgccgacggcagcgatgtctccacctctgccagcgacgaggaggaggacagcgaggaggaaggcggggagggtcggccggcacggcggtccaagctgcaccgtacggcgctggacatcctggagggcggcggggacgaggcgggcgccgaggcgggcggcctgctggccctgcccttcatgaagcgggcgcgggagaagcagcgcgccgccgcgttacaggccgccgagcgcgtgctggcggaggaggagggacgcaaggccgagggccgggcgcgcacctccggccgcctgcagttcagcggcgacggcggcgcggcggcggcttccgtgcgcccggtggcagcgatcgccgccggggaggacagcgacctggagtctgacgaggatgaggacgtggaggccaaggcggcgcgcctggcccgccacctcagcgccgagcgacgcgaggagggagtggcccaggctgcggcggaggccgcggatgtgcgggagccggcgacggtccagggacgggcagggggcggcggcggcgacccgcccgccgctgggtcggcacagcccaggcaacactcctccgcggggtttgtggccgtggccgcgggcgccggccgggcatccacgcgccccgcggtggagcgcgacgacctctttgcccccagcacgtctgcggcggccaagactttcctgccgtcgggcacgtctgcgacggccgagactttcctgccgtcggggtcctttgccggcgccaggaaggggtacaccttcaagaagggcccgcagggcgtgggctactacatcgacgcagcaggagaggtgccggcacccaaagcaaagggccaggtgcagcagaagcggcagcaggggcagcagactgggcccacgaagaaagcgaggagcggcgatgcagggagggcggcgcaagaagcagagctgggggatgacagcttgaagcctgctgagcgcggggagggctggagtgtcaggtgggttgtcggaggggagcacctggcgttgctggacccgctcgcccaccccttcctcacccgcttcctatgtggattgcagagcgcggccgcctacacccaggacgacctcatccgcatggcctttgccaacgatgacgtggcggcggagtttgccgcggaaaaggcctcggaggtggaggccgagctgcctaaagtggaaggagtcgggaccctgcccggctggggcaactgggcgggggcccagcgcgagcccgcgtggatggctgccgcccggcgcaaggcagaacagtga

SEQ ID NO: 8134 - DNA, 741 bp, Chlorella protothecoides
ggccgcgctgctgcccaccacggcttccggccacctgcgctgcccggccgccatcacgcgcatgcgcggtttcgtggctggcctgggcgcggtgcgcggcctgcgcccgcaggcgctgcctgtgcgcggagcggcgctggccgccgtggccgcgctgggcaatgtcccggccggcgcagcgcgcgagcacaccgccaagttctcccccgcctggttcgcggcggtgcacgtggccgtgcccttcgtggccatgctgcgcaaggcggtcctgctccccaactgggccctgctgctgaccatcgccgggtcggtggcggggcaggccgccggcgcgcgcctcgagcgcgcgcgcctggcaggcacgctggaccttggcggcgcactggccgcgctgggcgcgctggccgcgctgccggaggcccgcgaggggcgggacgaggagagcgtctggcccgcctttgcccacgtgtcgcaggcgccccgcgcgccgcccgccgtcgcggcctgaggccacgggggggttcgcccgcgtggcacctcgtcgcaccctgtgcactcgaagaatgtatcctcggagtggttgggtcaggtattgaggcattcggggggccagggggatgcggagcagaggggcgacgccagcaggcgatggtggtacaggaaagactggctgatgggaagatgtcatggcaaggaggtgcgggagcagcgacgcaggaccacaaccgcagccttggatga

SEQ ID NO: 8135 - DNA, 489 bp, Chlorella protothecoides
atgacgcgtgggcgtgtcccttccgccacccaccgagctgtcagaccccgcagagccgagttccggcccttaacgccccacccctccccaatccactcgcaggcatcctctgaacctgttttccccgtccccatatcgctgagccctcccctcaagagcgaggcacggtcctctaacccttccccaagagccagcatcgatgcgtcggctgaggcgcaggagctcaaacgccagatctgcttcgacttcacgaaagggatgtgcacccggggagcagcctgcaagtactcccactctgtcgaccacatcattgcagtgaactccgaggagaagggcatctgcttcgacttcctcaagggcctgtgcaaccgaggcctcatgtgccggttttcccatgacctcaccaacctgcaggcaccccaggtgaggcagcccgctgcacaacatcctggaaggaacagggttgcgctctgccctgatgcccgctga

SEQ ID NO: 8136 - DNA, 966 bp, Chlorella protothecoides
gcccggccccgccgccccagctgcggcacgcagcgcggccagcgctgccacgtgccccgcgccggcggctgcgtgctggtagaacgctgcgccgtggggttcggacgctgctccgtgggggccgaacgctgcgccgtgggggccggacggtgcgccgtaggggctggacgctgcgccgtaggggccggacgctgcatcgtgggggaaggtagctgcggcgctcgagcacggagcggggccgtgcgggtaggccccccccgccggagggtagcacgggcccccctgagcaaaggccgccgcgccaggcgcggcgtgcgccgttccctggaagccgccgctcctcgcctcgggccccgccgccccaaaccgctgctgcagcagcatgctctgcaggaccgcggcctcgtacagccccgcctgtgggtgccgcccgctcggcgccgcctcctggccggccaggctcaggccctggagctgggccatgaccaggtcgtacccggggtcaaagccgggcgccggcaccgcgggctgcatcgggtaccccgccgcggcggccgcgtggggccagccggggccctgctgccagcccatccccgcgtgccctgcaaacacgcatggtgcagtgtgatgagttggacgcgggaggcgattctcgcagacaggtgtgcgcgcgaccggagagtctgcctcagagttcgggctcctccaccccacacccacaactcctggcagtggccagcccgcacagcacccaggctccaccagcacatgcatgtattactcaccgctgtgctgcccccctccaccctgcagcatgtccagctctgcgccaggcagcggccagcccgccagctcgccgttcgcccggagcgcctggctctgcagagctccgaccacggcctccagcgaagcaggcccgccatacgccgcgggggcggggtgcaggtatcggcaagcatcgccacg

SEQ ID NO: 8137 - DNA, 903 bp, Chlorella protothecoides
atgcctggaacacctcccgcagggcacgtggaggcgtacattgaggcgcatggcgacagccactccatctgggagctggagggtctggccggcgacgccggcgccgatgagccgcgcggccgcgccaacttcctccttcagctgggccttcgcgcgctggcgggcggcaacctgccctccggcgagcaccggctgacgcagtgccgcggcgtgctgcaggctcagatggccaaccgcgccgcgcggcgcgaggctgggggtgggaacggcgtggtttgcgacggcgaaagcgctgcgaatgaggtcgggatgggggtcgcagctggcgacgtgcaagaaagggccgccgccgaggcgaggagggcgagcgccagcgaagaagacgcggccgacgcgtgtgcgctggccactgtgcaaggctgcctgggcgactgcgcgcgcgcgcagggccggaccgaggcggcgctggacgcctaccttgccagcgcggcgctgctgggggacgcgggcggggcggaggcgtggcagacgctgtcggtgacgctgaacaaggtggcggagctgtaccacatgcagggccgggtgggcgaagcgctgcccttctacacacgggccctggacctgcgcgagcgcctgctgtgcgacctggaaagcgagaacgacagggtggacggggggagcacgccccccggctgggcgcccgccgcgctctctgcgctcacgggcatggtcaagacggcggacgcgcatgcggcggcgggtgacggcgccggcgcagagcgactactgggccgcgcccgggcgctgctgggtcggctggaggcggggcgcggcgacctggcgccgccgcagctgcagcggctggaggcgctgtcccagtttgtggcccagcggggtgtctga

SEQ ID NO: 8138 - DNA, 714 bp, Chlorella protothecoides
gcgctgcaggcctggatggcggcgcggggcggggatggcggcggccgcctgcccacccaggccgccctccgcgcctccagcgccaactccctcagctgggcggtcgatcggcacggcggcatggccgccgcggcgcgccgcctggacctggccatggcccggcgccggcccaacgggcactgggacatgcccgcgctggccgccgagctggcgccctacctgctgagggagccagagggaagcgccccgcgcctgcccaccgccgccgcgctggtggcggagggcaggactgacctggttcgtgccatacggctgaacggcggcttcaaggcctgtgcccgcaagctggtcatgtacgaggaggcgggcgggggcaaggaggacggggtggatgggcgactcaatctagggtcccattgggccaccaggcggatgcctcagaccccagggcaggcgcgccaggagggcaggctggaggcggcggcggcgcgggtgcgagcactccagcatgcccatgctttcgaccctagggtcatgccgacccacgcccagctgcgcgcagcgggggaaggcaagaccatcgcggcgctcctgggcgcgggcggcgcccggcgggtggccgcccacatgggcctgcgcttccaggagaccagggggaggaggcctgggaggaggaggaacgaggaggcattgcaagaggttgtcttcgtctag

SEQ ID NO: 8139 - DNA, 297 bp, Chlorella protothecoides
atggggttgtggtggctggcaatcatgtgctggttgctggcgatcacctgctgtcggcggtatggcgtcttgacgtgctgggccggctcgttcaccgagccctgctgttgctccgctctgctcatgcatgtgatccctgctcggctcatgcacgccctgtccctgcccctcccaggcgactacggctgggacacggccggtctgtctgccgaccccgagacctttgcccgctacagggtgatcgaggtcattcactgccgctgggccaccctgggtgcgttctgggagaggttgtga

SEQ ID NO: 8140 - DNA, 555 bp, Chlorella protothecoides
atacgagctcggacgccagcccgccaacaccaagttgtccagcaacgtgaccgtgcgtcgcgtgcgcgtgcgcgggggtaactccaagttccgcgccctgcgcctggactctggcaacttctcctgggggtctgaggccaccacccgcaagacgcgcatcctggacgtgtcctacaacgcgtccaacaacgagctggtgcgcacccagaccctggtgaagaacgccatcatccagatcgatgccgcgcccttcaagcagtggtaccagcagcactacggcgtggaggtgggcctgaagaagcggtccgccgccgccgcggcccccaccgaggaggtgaagcagtccgaccacgtccagcgcaagctcaagctgcgcaacaaggacaggaccctggaccccctgctggacgagcagttctccgtgggccggctgtacgcctgcatctcctcccgcccgggccagtgcggtcgcgccgacggctacatcctggagggcaaggagctggagttctacctcaagaagatgcagaagaagaagggcaagcagacggcatg

SEQ ID NO: 8141 - DNA, 378 bp, Chlorella protothecoides
atggtccgcaccaagactttcaaggaggaacacccgctcggtgcgtcagggggtagacgagcacatgtgaccccgtacatcgcgcagaatttaaaatcaaagagcctcgctccaacccctccctggcccgcagagaaacgccaggctgaggccacaaggattcgcgagaagtatcccgacaggattccggtcatcgtcgagaaggcggagaagagcgacatccctgacattgacaagaagaagtgggtacctggtgccagcagacctgaccgtgggccagttcgtgtacgtcatccggaagcgcatcaaggtcagccccgagaaggccatcttcatgtttgttcgcagcgtccttcccccaacaggcacgtgtattga

SEQ ID NO: 8142 - DNA, 570 bp, Chlorella protothecoides
atggccagcaccattcggcttcccctgccgtgccgatgcaacctccgcccactcccttccccaccttcactcgcccacacaggaacgctcggcatcgtcttccctgagatcctgcagaagtacagtggcgtgcagttccaggaggccgtgtggttcaaggccggcgcccagatcttctcccctgacgggctcaactacctgggcaacccctccctggtgcacgcccagtccatcatcgccaccctggccatccaggtgctgctcatgggcgcggtggagggctaccgcgtgagcggcgggcccttcgactggtccgacggcctcgacaacctgtaccccggcggcacctacttcgaccccctgggcctggccgacgaccccgagaccttcgccgagctgcgcgtcaaggagctgaagaacgggcgcctggccatggttgcggccctcggcttcttcgtccaggccgtggtcacgggcaagggccccatccagaacctgagcgaccacctggccgaccctggcgcgaacaatgcctgggccttcgccaccaagttcacccccagcctgtga

SEQ ID NO: 8143 - DNA, 1281 bp, Chlorella protothecoides
atgcaagcccagcaactgggccttccatttcgacatggccctcgctcggggaagttcccgcgacagcaggcttctccgcgtgcctcaaatggagagggattctgcagggataaagtggccatgccacagaagccatcaggggcccatgaaggcacatgcaccattgtcttcctcggtgcccatggtgcctctgttgaagtcgaagcccccaaggatggatacattctcgatgctgggctcaatgctgggctggaactgccgttcacctgcagaggggggatctgcggggcatgcgtcggccgcgtgaccgagggcgaggtggacgccagtgattgccatgcagagcccgaacacccctgcttatggagcttccctcctgagggatccccctctgccctcaaccttctcactacatctcccaataagtggccaatcgcggatgtcaccttcaccctcaacgaggaggaggtggagggaggcatgaccctgctctgcatgtccaggcccatctcagaccgactagtggtggagacgcagagcgactggggttatagcatcggcgacctgagcgagtggaagggtccgacgggggagatcttgggaaagcgcgttcagccactcatgggcaaggcctgggagacagccaagcaggagagggtgtgtggtgcagaggagggcaggtcaccaaaagttggggcttggaagcgggggcaggggatggtgcagcttacccggggcattcccgacaagttgaggaacgatgcagcgcttcaagcagcttggacagggcttcgggtttcaggagctgggccacagtctggcccagctccctttccttctttgtttgatacagcaggtacagatcagcccaacggcggggcctcccactctgccgggatcttcctggcggtcgtgtccctcggcccgggactcagcaggatgttcagctcgtgcgctcgtggctcctgtgcaggcgccgggggggctcatggatgccggggcaagaccttcggggttctcgcagcaccattcatccaacctgctgctgtggcagaacagcgcactgaagggtggcaccagcccacctgcagtgccctgacgagtgccacactacccttcccgaaacgcaccttgggcaggccaccctgcagcgaccacttgagctccttcagtgtccgtgcacccttcttggcgttgcagcgactgcagcaggtgacgatgttgtcccaggtgaagccgccgccctgcaggtgggaggggggccgggaagtgggacggtga

SEQ ID NO: 8144 - DNA, 417 bp, Chlorella protothecoides
atagtgtccgacatctgtggctgcgcgcccatccccgcccaggcctcggccacggcactggagctggagcgcttcgtgcgcggctggtctcggcgcgtgaccctggcctggccctacggcggcgccagcgtggaggtggtgggcgacctggtgggcggctggcactgccgcgtcccgctgcagtacaactcctggcgccgcgagtggcgcctgcagctgctgggcctggcccccggcctgcaccgcttcaagttcatcgtggacgggcggtggtgcgcggacgtgcacgcgccgctggagcacgacttctggggcaacgccaacaatgtgctacgcgtgggcgaggggggccggggcggcgacgccgtcgcgacgctcggcgcggcgctcctctccttctactgcaagctgcgctga

SEQ ID NO: 8145 - DNA, 1848 bp, Chlorella protothecoides
  modified_base (391)..(400): a, c, t, g, unknown or other
  modified_base (441)..(450): a, c, t, g, unknown or other
  modified_base (1021)..(1030): a, c, t, g, unknown or other
atgccccaagccattcccgtggccccacttccaggacaacccagatcaggtggacgacatcctgaaaggaggcctggcgatggacgtgtcggggatcagccagcagaggtgaggcggtgtggccttgaggttcagtctttggcgcatggtcggtcatggcctgcccctcctgccatacaccctcgcgccatcgcccgcctggaccgcccctgcagactttggctcgcccgcgccgacaccgcggccgagtggtcggactggcggcagtcggccgcgcacgccgccgcggcctacgccgcgccagccccctccgacgcgcctggggccacggatggcaagtcgatggcggtgtactctggcgtcgccgcgttgctggccgacggccaggacnnnnnnnnnnattcggtctctggcgcatgactttggctcgcccgcgccgannnnnnnnnntgcgccgggggccacggagggcaagtctatggcggtgtactctggtgtcgccgcgttgctggccgacggccaggacgtggaggcgggggaggcgctggagcggcccggcgttgggaggctggcgggtccctcccacgcggcgctgctggccatgctgggcaccaccttccgcgcctgcaccgcggaggacatcgccttcttccagtcatgcagcgcggcccagccgccagaggcgcgtgcggccctggaccgggaggtcgcggcggcgcagctgacacaggtgggaggtgggaacgagccgtatcgccgtgcccagcttcccaggcggggcgtgcatgcgagggcgtcgagacatgtcggatgcgaggggagcgaggccacgccagtcagacacccctcttctccctcccgtgtctcattcccccaaatcattcgctctcccccaccgaaaaaggcctggaccgcgggtgcatacgtgcccgcctacctggacggcagtacggtggtggaaagcacggcgcgcgcggtggacacggccatggcggcggccacggcgcagggctcccacgcnnnnnnnnnncctccctcccgtgtctcattcccccacatcattcgctttccccccccccgaaaaaggcctggaccgcgggtgcatacgcgcccgcctgcctggacggcagtacggtgatggaaagcacggcacgcgcggtggacacggccacggcggcggccacggcgcagggctcccacgccgcgctgggccctctgtccagccccctgcgctgcggcgaggcgctggcggatgcacacctgctgcgggcgcaggtgcatggcctgcaggggcggtgggaggaaagcgaggagagcctggccgcggcgctgagtgtggtggagggcgtgagcgcgggaggtcacccgcgcctcgctttcccgctggccctcctcgcacacgtgtacagccgcaccgcgcgcgtcaccctggcggagggcctgtacagagccacccagccctcttgcatcgctcccttatctttccccacaaacctacagggaggcgaccaagctgctgcagctggatccccggcgggaggcgccctcggtctcggcgccggcggcgcccgcgccggcgcactggaccgtgggcgccatgctgagctggcggtacggccagctgctgacggcgctgccgcgccgaagcacggaggcggcggcctggcaggcgctgggtctgcgcctggccgagcccctgtctgccatcatgcccatgcagaccctgctggggcccctggatgtgctgacgcaaaagggggcccagcctgtgccggggatgctgctcagcctccccttccggagagccgtgcccctggtctcctgcaccatggaccccccgtgatctga

SEQ ID NO: 8146 - DNA, 1116 bp, Chlorella protothecoides
  modified_base (835)..(844): a, c, t, g, unknown or other
  modified_base (902)..(911): a, c, t, g, unknown or other
  modified_base (976)..(985): a, c, t, g, unknown or other
atgctgcaggacgtcaacacgggcatctcctgggtgatcaacaacgtggcgctgtacggcggcgacccgaccaacctctttgtcgtcggccagtcggcaggcggccacctgggcagcctggccctgctggcgcaggcccggcacgctgcgcgcgctgacctggcggcagagggcgctggggatcgtgggaggggggatgtcggggagcgcgaaccggcatcgtccgagggcgctggggatcgcgggaggggggatgtcagggagcgcgaaccggcatcgtccggcaagggcggcgctgcagggatcgcgcagccggggtcaaagagcggcaccaccagttcagctgttctcccagaagtggagattgggggcaccccgcgctgggacgtggaccgggtgaagggcttcgtgggcgtgtctggcgcctacgacctggaggccctggcggcgcacctggacgggcggggtctcaaccgcgacatgtttggcagcatcatgtcgctgcacggcacgcccgcgctgcgcgcgctgtcgcccacgcacgtcgcggcggggctggggcccggggtcgcacgccacctgccccccgtcctcctcctgcacggcaccgccgaccgctccgtgcccgtggacaacgcgctgggctacgcggcggcgctggaaagcgcaggcgcgcgtgtgcgcctgaagctgtaccgcggcaagacacacacacagccgatcgtggaggaccccatgcgcggcggccgcgacgagctcatggacgacgtgctggagctggtgaggaccgggctgctcttgtgtgtcactgtgtgcatgtttgtgggcggggaannnnnnnnnnctggtgaggaccgggctgctcttgtgtgtcggtgtgcacatgtttgcgggcagggagnnnnnnnnnngctgcgcgcgctgtcgcccacgcacgtcgcagcggggctggcgcccggggtcgcgtgccacttannnnnnnnnnggctgttcagccaggcagttgaggcagcgaccatgtgggggaggggactggggcccgccaaggcggcagggccaagggtgtgcatccgcgtgattcccctccatgctctcccgatcaaactttccaggtga

SEQ ID NO: 8147 - DNA, 864 bp, Chlorella protothecoides
atgtcgacagggcaatcttgtccctcaagactcagcggcgcaagcttgatgaccagcggaagaggacacactaatagagagggaggcagtggtggcaaggacacttgtggctcaaggaaagcgggaccgagccctcttggcgctccgcaagaaacgattgcatggtcagcagctggaatttttggacaagctcgtgctcaatgtggaggaaacggtgagggactggcggggctgatgggtgattggaatcttattgacagtctcgcgtcccaagttgtatcctattcttcacactcattcttccagttggcgaatgtcgagggggcagctaggcagaaacgacttttcgacacactgaagcaaggcgccgctgccctcaaacagctccaaaaggatgtttccctggaggatgtggagcagctcatgtccgacaccgcagaagccaaggagtatgagacgagggtccaatctatgtttggggagagctggaccggggtggatgaggaggcagcgcacgcagagctggcagagatggaggcgcagctgctggacgaggaggtgctggacctgcccagcgtcccccagacaaaagttgctgacgcggctgcagtgccagggccgcctgcccagggcctcaggatcctgatgccttttcatgtcctggattgtcaggacaaggcagaggctgccctgtcccccaagtcaaatatacagggaggcagcaaacatgatgtctcgtcggatggtgtcccgcgactcggcgatcttggcggccagtcctgcgtcgcccaccgccagcgcggcccgctccagctcgctcatcagctcatccagccgcctcgttgccctgtccgggatggttga

SEQ ID NO: 8148 - DNA, 822 bp, Chlorella protothecoides
atgtctaccgccgatgaaagccagaccagttcacatctctggactcctaaaattcagcgcaatgacgcatccaaacccccttcacccgccacacaggcggagcgcggggagggcgaggcctcgctgatggctcccctgcgcgagaaggcgcggctgatggctgaggccgagtcgctggcggcacgcatgcgagcctcacagctgaccagcttccgggacgaagcgcgtcaccgcggcgcggtcctgcgcaagctgggctatgtggacggggagggagtggtgacgctcaaggggcgcgtggcctgtgagatcaaccccgccgatgagctgctggcaacggaactgatgctgaacggcaccttcaatgccctggatcggcaccagctggtggccatggtgtcctgcctggtgcaggtggagaagagcaacgagcagatccggctgaaggagagcctggcgcggccgctgcaggcgctgcaagacgccgcgcggcgcattgccgaggtgtcggtggagtgcaggctggaggtgaaggtggacgagtacgtggagtcattttggcccttcctcatggacgttatctacgcctggtccaagggcgcatcctttgctgagatctgcgagatgacagacctgtttgagggcagcatcgtcagcatcgtgaggtgggtgtctggtggttttctctgtgggggcggggatgtctgtgggcgtctcgtgttgtggggatctgagtggggaccctccttggacactgggagtagctgtgcatgccatttgatgactgaccgttgccggtgtggaatgagcccttcgagatga

SEQ ID NO: 8149 - DNA, 750 bp, Chlorella protothecoides
  modified_base (712)..(721): a, c, t, g, unknown or other
atgggaattggctggatgcacgacgatgcatgcgcagcatggcgccggccctccatccccccctgtcgcactcactcctcccacaacacgacagagggtgtggactggggctggggcgtggtggtcagcgcgatgcgggaggagcgtggcaacgccccgcccgccgccgcgcctgcctaccacatggacacgctgctgtgctgcgccggggtcgtgggcggcgagcccaccccggccccactcgacgacgaacggggcagcatggaggtgatcccggtgcccctaggcctgctgcacgcgctgagcacgctgcgcatcagcatcccgcaggacctgcgcccgccggaggcgcgccgcgccgtgctgcagacgctgaaggcgctgcgcggaaggtaccccggcggcgccctgcctctccttcaccccgtcgccgacatgggcatcgaggacactggcgtggcggccgctgccgccgagcgcgaggaggttgccgccgcgctggcggccaaccccatctctaaggtgagctgggtgggcggtggcgtcgcatgtgggaagttgatcgattgggtggggtctggaatggtttgttgcgtgcttgtcgcatatgtggcacgtgacgttctcctgcgtgccaccccgatcccgatgtctaccgtcgatgaaagccagcccagttcacacctctgccctcctagaattcagcgcaagnnnnnnnnnntgcgtgcttgtcgcatatgtggcacgtga

SEQ ID NO: 8150 - DNA, 1299 bp, Chlorella protothecoides
atgacgccttgcgccaacttgcaaaccctccgtttgtccctcaggaacgctggaggacccgcagtggaaggggaagcccgccaaggagaaggaatgcgtggcattccaagtgcatcccataccgtgccaatgggaaggaaccaggcgcctttgggtgtgggaggcttgcctgggcaggtgatatcctcacaggtcatgcaccaaacaccacgcaggagcgcaaggagaatgtgctggtggccgcccacacctctgccgggaagacggcgatcgcagagtacgccatcgccaaggccttcgccatgggccagcgcgttttttacacctcccccatcaaggtctggccactgggcgctggtcatctgtgcagcgccttggggccactgcccagggctgcccaaaagccatgctggaatccaggaacaaccaagccccgctctcatctgtctcaaccctccaattacatacctacaggcgctgagcaaccagaagttccgcgaactgtcagaggagtttggcgacgtgggcctgatgacaggggacgtttccatcaatcccaacgccgcctgcatcgtcatgaccacggagatcctgcgctccatgatctacaggtttgtgtgggagggatgtgatctgccctgggccgctgggcaattgctgtgggaaagggttgggatgaaagaaggcgctttcagtcacccccaatggatgctgcagggcctgccctcgggctccgagctgctgcgcgagacggcgtggatcgtgtttgatgaggttcactacatgcaggaccgggagcgcggcgtgatctgggaggagacaatcatctttgcgcccaaggatgcgcgcatggtcttcctctccgccacgctttccaacgccactgagtttgccgactgggtggcctcggtgcaccagtccccctgccacgtggtgtacaccgagttccgacccacccccctgcgccactttgcatttccctcgggcggggacgggctgtatctggtgagtggctggggaggggggtccgggaggggcgtggagtcgggggttggggcgaggggagggcgctgtgtggggagtgggggagatggacatgggctgcagccaagcgatggattggaggatgcctttcggaagcagggcaccagggcgcatgcactatgcagcttgtcgagggcagcacgcgagatgatgcaacgctgccgggcagtggaatcgtgccgggcagcatggcaactgtggtgctttgcaaccagtgagaccgccggctggagacactcgaggcaattcacatga

SEQ ID NO: 8151 - DNA, 690 bp, Chlorella protothecoides
atgtcgagctcatcgccgatggatactatgcgggtcgagtccaggttgctgggagcctctgccagccctgcctccaagatggtcctcggtgccgccacatccagccgctggacccgaatggcggacatattcgcccgctcaggcgccttaagaccccaaaatatctatggggggccttcagcaggccgttgtaacaccacaccgctttgaaccgccctccatactcgtgtcatcgggaaattacattctgcaccgttgcagagcatcggatcgaggtactttggtttgtatgcttgcgccgtgcacctagagcaggcggggaccactcggggcggtgctcacatggaggctacagcggaggggctcgccaaagccgctgcgactcgggaagctctgaagaagaaaaagagggagttggaactggtgaggaagacggcctcttggatggcgtgggcagtggtagatttagtgactctcacccaggatggacatctcagcacgccaccctgcgatgcacccctcccgtcccagatcgaagatggccccccatccaagaagcaaacgggtgcagcaccatctgccgtgtgcacgcatgaggtagcttgcccaaagggctttgaccccagcagcatcaccctcgaccctgagcgctatggtgtgaagggcgcagagggacgtgctggaaactaa

SEQ ID NO: 8152 - DNA, 1218 bp, Chlorella protothecoides
  modified_base (4)..(13): a, c, t, g, unknown or other
  modified_base (147)..(156): a, c, t, g, unknown or other
  modified_base (803)..(812): a, c, t, g, unknown or other
atgnnnnnnnnnncggacgcgcgcggcgtgcgcggccactttggcggcgccggggacggagaggaagaggggtccgcattgcgggccgtgccggcaagtgtccaggagcggcagggggtggcgcgcgtggcgcaggcgctgcgcgcnnnnnnnnnngactgcggccgaccgggggcaatgacactgctgttgcgcgggaggtacgcaccgagcatctatttgataagatcgggagtccatctcgaactcataaaagctgggcgaggcccaacgcccggatggccagcccttgaggggggccaaggggcgatgccgaacctgaggaacttgctgcgcaagcggccctcatccagcacctcgggggcctacctcagtccccaagtactggaggccgcctcgaatgcatattacaacaatgccaacaagtgtgtgggcgactgggggcccggggtggagtgctcaaggcagggtgtcgggactcctggcgaataccccagccgcttggcgcagctggggatagaaccagagagtgtgggcgctcacgccctccccactcccctccaggtcaaacttcatggaggagatccccgagatcttccagctgcctgcgctggaccgaggcaagtggacggcgcagcaggagatggaaagggcccagcaggcaacgctcgtggaagggggcagaaactcaggccattctgtgacgatggagaagatgacattgagtctggcaatgttcactgccggttgctcgtctgggcaatcaaagcgcctgtgtgtggctggggccctcagccgtcacnnnnnnnnnnatgtgacgatggagaagatgacaatgagtctggcaacattcactgccggttgcccgtctgggcaatcaaagcgtctgtgtgtggctggggccctcagccgtcaccctcctctgacaaacccctgcaaccccatgaatccacagacttcttcatcagtgccatcaaccagaagacccacgtcatcttcggggtcgtgttcctcctgtacgtcttcctctccttcttctggtccataccctactacctcatcatgcgcttcgagccagggtgcatctacggcgccacccactacgtagagatctggatctacgccttcatcaccatggccaccattggtgagggggagttggctgtgcctgctgtcttttcaatgtctgcaagggagcagaagggtgggcttccttag

SEQ ID NO: 8153 - DNA, 1197 bp, Chlorella protothecoides
  modified_base (698)..(707): a, c, t, g, unknown or other
atgggccgacggctgatcaagggcagcagcgtcaagtacgcgccggggtccggccccgccgtgccccaggcctgccccgagacgggcgccggcttcaccatgggcggccccttctgggccgaggcgttgcacagcgccgaggcgctggccggcatcctgcaggtcctgcgctccgaccgcgccgccttcccagcctacgccaaggtgcacagcatcctcaccgccgccagcgaggagctgctggacgcgccgctgtatgtcaacctccacgacgtctgcaagacgctcaagtgctccgcgccgcgggcagaggccctgcgctccgccatcgtcaatgcggggtacagccatgcggcgtggcttcaatgtgtttcatggcatggggagcaatcacacatcccttgcatgcaaaccctttgcatgctgggatatcagcaacgacaacccgaaccagcagcttaccatttctcctacccgcaatcgcagggtgtcgtccacccacgcctgtgcgctgggcctgaagaccgactgcccctggaacgtcttctgggacataatgcgctgctggatcgccgaacacccggtcaagaacgtcctccccgggtcatgctaatactttactgttcggtggaccagggttggaatggtgctctgctgatccctcacacaacagtcgaaagctcaagagccacaccacnnnnnnnnnngtggaaaggtgctctgctgctccctcacgcaacagtcgaaagctcaagagccacaccacgcatggttgccgtgcacattacccaattgcccttcaagtatcctgtgtcccgaacacactttgaaagcctccccatgccccgccctcacagtggagaagatcctggccaaagcgccggagcacaaggccaactttgcgcgcgccacgtctgcgctgagcaaggcccggacctccaaggtggcgcgctacctcccgaaccccgaggccaactggggtcccaagcccaagcatgggaggggaccgaagcaggccgaggcaggggcgcagcccagccgtgcccttccgcggcaggcccacccggtcacgtgtccttgagtgccgtgtcaactgatatgctgccggacatcttactcacccactgtgttctccctgctacctgtggagcttactggccagggtctctctttttgctgacagacatctgcaattga

SEQ ID NO: 8154 - DNA, 624 bp, Chlorella protothecoides
atgggagtcggcggcacagcgggccaatacccgcgtggtcatcctgcgcaacggcatcgtgctgagcaaggagggcggcgccctggggcgcatgattcccatgttctctctctttgccgggggacccctgggcagcgggcagcagtggtgctcctggatccacagggacgacgtggttggcatcctgatggctgccctcaaggacgagcagtggtccggggtctacaacgccaccgccccctcccccgtgcgcatgggccagctgtgctcagagctgggagcggccatgggcaggcgagtggagaaggagggcgatacagctgcatgtttgatgcagggctgaagagattgcaaaagtataccagattttccctcttgcatgcggtcaggctgagctgtacaatcactgcatggccctttcctccccaagctgagcacgacacaacacacaagccctgcaggccggcgttgctccccgtccctgactttgccatccggctgctgttgggtgagggtgccacggtggtgctggacggccagagggtcctccctctccgggctcaggaggcagggtacgacttcaagttcagccaggtgatgcgagggcctggcacgggaggatga

SEQ ID NO: 8155 - DNA, 1257 bp, Chlorella protothecoides
atggccgcgccgcccgaggacctcttcgtccgcggcgtggaggcggcggtgcgctccaacgcctcctacgtcccgccccagggaaagggctcgctgtacctgcgcccgctgctcattggctctggccccatcctgggcgtgggacccgccccctcctacaccttcatcgtctacgctgcgtcggtgggcgcctacttcaagggcggccagctcagccccatcgacctgctggtggagacgcggttccaccgcgccgcgccgcgcggcaccggcggcaccaagtgcgccggcaactacagccccggcctgggctcgctggccgcggccaaggccgagggctactctgacgtgctctacctggacgccaagcacgacaacttcctggaggaggtgtcctcctgcaacgtctttgccgtgtacggcaagaccatccgcaccccgcccctcgcggggagtcggcctcggcaccatcctgccgggcgtcacgcggcggtcggtgatcgagctggcgcgggccaaggggtacaccgtggaggaggcccccgtctccgtggccgaggccctggccgccgacgaggtgttcaccacgggcacggccgtcgtgctgtgctcggtggggtcgctgacctaccagggcaacaagcagcgctacggcaccgagggtcagccggggcccgtggcgctggagctgtacgaggcgctgacggggctgcagcaggaaaggacggaggatccctttggctgggtgcaccacgtgccgctgtgaggcccctcggattcgcagggacgcgagccgcagttttcatggcgcctcgtgtgcacctctcggggaatgcaatgcgagccagcgagggggggggagccgcgcatccgcagcgcaaggagatgtgtatcagtactgtcaaacggagaccttgcaccagggtcagaaggaagccttgggaggtgactctttacagggacgggcatcgtacatcgcacaccgcacgcaggccttcacagggacctagggctctcccagcgcggctcggatggcgtgcgccaccccgtgatcgtcgtggccggggaccaccaggtccgccgcctgcagtacctctggtaccgcgttacccatggccacgcccagcccggcgccccggatcatggcaaggtcgttgccgccgtcccccacggccatcaggtgcctggcatccaactgtggggggcgaggtgggacgcgtagagcatgtgcatgggcggaagaaggctttcatatga

SEQ ID NO: 8156 - DNA, 1350 bp, Chlorella protothecoides
atgagcatctgttccggggcccagggaagggggatgggcagttgtaagcgagggccgcgaccggcttgccggggtctgctggagtggcggcatgcaggagcacatatcaccacccatgaaaagcttcaccatccccttgcaggaccggtggaggcggccgccatggcggacctggaacggcaggtgctggcggcgctgggctggcgcggccccggcctcatcggcctggctgaggccgacagacccgccggcggcgcccaggagccgtcgcccggggcactcggcgccggcaggctgtccccctccctcgcggcgccctctccccgagcgacagcgacgcctgggccccacgacatccggctgatcgcactggacatggacggcacgctcctggacggcacctcctccgtgctttcctcctccgccgacgccatccgcgcggcgctggcccgcggcgtgcacgtcgtgctggccaccgggaaggcgcggccggccgcgcaggccgcgctgcgcgccacgggcatcgccgagctggcctcggctgccgcgccgggcatcttcctgcagggcctgctggtgtacggccagggcgggctcctgctggcttctgccgccctggaccccgccgttgtccaggcggccttcgagtactctgcggcagggtgtggtatggcgtgggccggggaagtgcagccttgcactgtacattcgtgccctgggtcagagggaagaccaccaagacgcggtctcctcaccccccccaccttccaaaattatccgacaccccccagacgcacacggagggtcgctgtgtgcctttcttggggacgagtgcttgaccaccaggctcacgccggagctgatggagctgcacacgcgataccacgagccactacccttcctggtgcccacggccgcggccgccgccggccagcacggcgtccgaaagctgcttttcatggcagaccccgagcgcgtcgacacccagctgaagccgcactgggaggtgcgcagggtgtggcggcgctgggcgcccgggagtggatcgtgggagggaggtcagttcttcgcgggagtcactggcgatcacacccccacacttgcggtccagcacccactgcaaaaccccctcaggccgccctggcggggactggtgcagagaccatgcaggccctgccaaacatgctggagatcgtcccgcgcggttggaacaagtgggcctccctgcagcacctcctcgccgacctcaaggtgggtcaagccagccttgagcaggggtgggacgggtgcgaccgtttcgcccccatggaggagggaactggggttggcagcctgcggcgcatgtgttga

SEQ ID NO: 8157 - DNA, 735 bp, Chlorella protothecoides
atggaggattcggagggtccccctcctcccactgaggtttcggtgttcacggcggaggaggcctacgtctatcgcatcccaccagcgacgactgtcggccatcgggccgagacgtggaatgtgaattcctggttgcaagaggtccgggtgagggttgtcagcagagacgaagacgcctgggtccggctggaagagctcgaaaccggtaacctattcgctgagtgcccagtgcccattcacgtgcccctctcgacggggtgttgggatttccactcgcattggcgtaatcagggcatacaaggaaggaggcttgccctgcacacaccccaggcatacaaggaaaaaggcttgccctgcacacaccccatggagcccgtcattgacagttcacgttattttgtgctcaagatcgtcgacagggactctggtcgacatgcgttcattgggcttgggttcagggagcgagagaaggcttcggacttcaacgccaccctgcatgagcacatgcagtatgtgaggaggaaacacacggctgccggtttgcggactcagtacgaggaacagctggctgccaatctggccatggcagctccagactccctgcctcaggcaacggatttcagcatcccagaaggccagaacttggtcctcaaagtcccagcggtgtgtggtgtggcaatagtgaggatgcggaatgctgggcggggagggaggggaagtggagggctctattga

SEQ ID NO: 8158 - DNA, 1281 bp, Chlorella protothecoides
atgttctccacggggtccaacatcctgcgtcagcggacctactccgtgctgaaccacatcaagatggaccaccgcttcgtgcccatcgtgcggcaccccgagctgcaggccgacaagaagccggtggtgcgctgggcacgcttccacgacgtggcctccaccgaccccaaggcccgcgcgctgaggaccgccatgacgcagcgccagtcctgtgagtgccagtggtgtatgtggatggaggggcggtgggagcccattttccatgtccacaacccaatcccccaccaccacccctcctcccgcgccacagtccgccagcagagcccggacaacccctccccccccgcgcccggcgctgcgagtgcggcggcagccagcctggcccgcgcctcccctggccttggcttcagccccctggacgccgccaacgacttcaccgtctcgcccatcggcctggcgcgctacgcggccatggtgacggcggcgggggacaacacgctcacgcgcggcgcggggggacgccgcgagtttccccccattcccgacttccagtccatcgtggacgaggcgggggccgaccccgccacgcgccacgcgctgcgcatgctgccctccatcgccaagtacacgctgaccacctttgacgccgccgactccctgccccaccgcgtggcgctgcacccggccatgcccggggccagccgtttccggggcatgatggacgacgaggaggaggacatggaggaggtgggggacgacctgggcgaggacctggcgcggtacgagctggacatgcagggcagcgagggaggaaaggacggcgcgggggcgggggtggcgaccgcagacgcctgggctgagccggaggctgggccctcagacctggggccggtggcggccgccgtggaggctagcgcgtccagccagccggaggcctcgggcagcgaggcgacagaagagcgggggggcgggagccccagcgcggtccgggaggacgagctggggctggaggcgccggcatctggccgggctcccatcctgcaggcttcgtccccgagcgcaggcggggaggacgcctcctcccccgtcgccctcatcgaggaggaggtggagccgggcatgctggagacgcccggcagcggcggcagcttgcgcctcctgggctcccgcaccttcgcacccagcttccggtcccagccggagcaagacgaggcgacggctgaggaggacgccgacgaggatgctgaggaggccaacgccgggcccatccacttcaagtga

SEQ ID NO: 8159 - DNA, 597 bp, Chlorella protothecoides
atggcccgccgctcctttgtgcccaccgacatcttctggggctaccagtttgtggacatcatcgtgcgcccctcaccgggggagacccgctacagcatcgacctcaaccgcttccatgacattgtgccccaggccggcctgcccccgctccccgcctccgccctctcccgcctggtcaccaaccgcgccaagcgcaccgtgccctacccgctgctgggcgacaacacgctggtggtatcagacacgatgtgcctgtaccgcgacgaggccgggcggctgtgcctggcggcacgcgtggccgacacctacccaaaccagatgattgagatcaccgccaagatgtatctgtatcgctgggccgcccccggttcggacccgtcctttgagtgcatcccgctggagtgcgggtacaagacgggggaggacaggctctacctgcgcctgcccatggagcttacccacgtgattgacgaggcctccccgctggccgcctggctgcaaggggaggagggacgagcggcggacgccgactcggaggtcgtggtcatggttcgggaatcatcgctgtcacaacgctcctttaccgcgaatgcttga

SEQ ID NO: 8160 - DNA, 291 bp, Chlorella protothecoides
atgcagatcggggagacgctgacccgggggctgggtgcgggtggcaagcctgccatcggtcagaaggcggctcaggaaagcaaggcgcagctggaggctgcccttgccggctccgatatggtctttgtcacggccggcatgggcggtggcaccggctctggcgcagccccggtggtggcggccatcgccaagtccctgggcatcctcactgtcgccatcgtgaccacccccttttccttcgagggccgcatgcgtcggaaccaggcgcgttctgggtgcctaagggagtaa

SEQ ID NO: 8161 - DNA, 1185 bp, Chlorella protothecoides
  modified_base (31)..(40): a, c, t, g, unknown or other
  modified_base (965)..(974): a, c, t, g, unknown or other
  modified_base (1147)..(1156): a, c, t, g, unknown or other
atgcaccgaatacttccgccttcccacgcannnnnnnnnnctcgagaccctgctgcgtgcgctgagcccctcctcacgctcccgcgactccctggtgggggcagccctggcacgcaatctgccccagaccctgctggcacgcctgggggaggcaccccagcccgcagaccaggtagaggagagagggggggaggaattgtgggggtgcagctttacaaggagcctgaaggacgaccgtcagccaggagacctttcaagggactgactctgcgggatgcgcaagtggctcgcgtggtgatcatcgacgtcctgcatgccctggcgaggccggggcagcatgaggcgacagtggcagccgtgctggatgcatcggtcctgctgatgcccggcactgtgcctatgccaagccaccatgctcctcacgtgcctccaactcttttctttccatcatccctagcagaggtgtggagcatgtacgcgcaccagcagcacgacctcttcctcccctccaacaccagccggctgctgcagggtggcggcggcgcagcggccttgctgcagggagccaggacctttgccctgcccgcaccatccgcaacgccgcccgccaaccgcgcagggatgcggcgaggaggagatggcgaggagagcgctggcggcgttcaggcgatgcaatcgcctgtccagcctggtgcaggggtggaggcaagcgaaaaccctccgcaagtccattctggattcagcgacgctgcacacactacaacgaaggagagtccagaacgagctcaagactttgcgccgagtgccagcgatcctgtgccgtcactgagcgtctctgcccctccatttggcgtgcctgcgaccacaggtgctgctgagcctggcgtccacggaacacgattggcagccagtgatgatgcatgtgcggccaagcaggtcgactcggccacaagtaaagacagcgnnnnnnnnnncggtgatgcatctgcggccaaggaggtcgactcggccacaagtaaagacagcgctgctggacatctgcaggaccagcagaaggcaaccccgcaagaggcagaggccagccaggaggaagcagtgggtcctgagcagccggccggcaaacaggctccttcgccagttgcacccnnnnnnnnnncccagccaggaggaagcagcggatcctga

SEQ ID NO: 8162 - DNA, 1188 bp, Chlorella protothecoides
  modified_base (207)..(216): a, c, t, g, unknown or other
atggtctctggcctttccctgccagacgttaatcgcgaggactcgccattcgccgtgagttcgcccagcagcatcctgaacggcagttgttgccgcccgacccccgaccctgcttccgagcatggcctcctgcccaaccccgtccagcagctgttcggaggggatgttgagatcctggtagcgacgggcttgggaagggtgaggggnnnnnnnnnngttaatatggtgtttcctatagatcctggtggcgacgggcttgggaagggtgaggggccagggccaccttgtgtgcctgcaggccctgtagcctctccctgcctcgcctccccttgtcaaggagacaccacactccctggcctctgctctaatgccgctccacccattcacctttccccttccttccatgatggtaattcatacctgcgccagctgcgctgcggcgtgtcgtgcgacgccggtggccgcgcctccaacgacgaccgccacatcctcttctccacggccgtggcgggccgcccgcgctgcaccgtggtggccgtgctagacgggcaccatgcgcaccacgtcgccgcggcggtgagggacgagctgccccgcgcgttcgtcgcggcgcaggccgccgcgcgcgacctggccgccgcgctctcctccgccgtgcgcgcgctggacgagcacgtgcacgggctgtatgccgcaggggcggtgagcaccgggggcaccacgctcctggcccatgtgctgtccgacggcgtgctgtacaccgccaacgtgggcgactgcaagggcatgctcagcgttcgcggcgcgggggaggcgctgaacacctgccacaacccggacgtgcccggggagcgcgcgcgcttcgccgacgcgggcgtggcggtgtcggccgacttcatcctcgcctccgacatcaacgtctgccgctccatcggcgactgggacctgggctcacccctgaagtggcgcgacgaggcggggcgcccgcgcggcccgctggtgggcgacgccgaggtgacggtgcgcgcgctggacggccgcgacgagttcctggtggtcggctccgacggcctctgggactactactccccggagtccagcgtcgtgtccgacgcgcggcgcgcgctccgcgctttccacaatgacccccaggcctgtgcggactggctggtgagagaccctggatga

SEQ ID NO: 8163 - DNA, 1560 bp, Chlorella protothecoides
cgcgcgcggcgctggcgggcctgctcacccccacgctggcggcgcgggtggcagaggcggaccctcgaccccttctccgggacctggccgccggcgtgtgcacgcccgaggcggtgtggagcgccgagatgcgcgccgagctggagacggcgctggaaggcatgcgcgccggcgaggggggcggggatgccttcgaccccggcggcgcgcccgacgacccaggcgccagcctggggccgcaggtcgcggccgccgcggggcacgcctacgccgcgctggaccgccagctgctggtggcgggcgtgtttgtgcgcgtgtacgtcgcgtcgccggggtcgcgcctgctggtggcgggggtgtttgtgcgcgtgtacgtcgcggcgccggggtcgcgcgtctccgaccccgccgccctctgccgtggcctggtcacgcacctggcgcgcgccgacctgggtcaaatggcagaggacgcgctgctgtgcctgcgtgcgctgcgccagctgctggaaggcgcggcgcgcctgctgggcgtgctgtccacgcgcgccgcggtggagccgctcctgcgctgcctggcgtttggggtggacgccggggtcgaaggggaggggcatgccaggggagccccgggcgcgagcatcggcgcgccctcaggcgtggcgggcccccctggacccgcccctcacccctccctgcccgacccaccagccgccgccgccctggcggaggcggcactgggcgtgctggccacgctggcctcgcacgcgggctgcgtggacgcgctggcctcggaccgagcgacgcagctggcgctgtgggccgcggccgcgccgcccacgccggcctgccgagacaccgcgctgcgcgtgctgggcgcactggccagcgcgcccgtcgcggcgtgggcggccgccacgcgcggcggcgccctcttcctgctctccatcgtcctggatggcggcgcggaggcgggcaaacgccgcagcgccgccgcgctgctggccgcgttctccactcagcccacgcacggcgctcgagtgcggctgctgctgggccgcctgctccctcaggccatcctcgccagcctgctggcgtcgacggggacgctggactgggcgcccgaggagggctatgccgtcgcctaccccgggctggaggacgaggtgtttatcggcggcgtctacggtgaccccgccgagcaggccctggcgacgctggagtccagctgcgagacccccgcctgcatctggaacccggccatgctggcgagcgcgaggagcgaggtggggcacctggtccgcgctgcgcggcgtgcgcaggcgttgacggggacgctcgactgggcgcccgaggagggctatgccgtcggctaccccgggttggaggatgaggtgtttatcggcggtgtctacgtgcgcctgtacctcaaggatccgcagtacccgctcaggtgcgtggggcgcttggtgggtggtgctgcgggaggcaaccagcgcgcgacccgctcgcgaggtgcagtcgcggggacatccgtcttccaatcgaagtctccctgtt

SEQ ID NO: 8164 - DNA, 1596 bp, Chlorella protothecoides
catgcgggcgcgctggtgggggtggacctgcaatgttgcgaggccgcctgcgcgggccaccctcccggcgcggcgcccagcgcgcggcacgcgcgctgggctgcctcgctggcgctggccggcatggtggagggcgcggccagccttggcgagacggtgctcgcctggggcggggagcgctgcttcagccccgccgggctcagcgccggccagctgcagcgcctgctggccgactgcgggaggtggctgggcatggcggcgctggtgtgcgagtcagcaggctggtggctgctgggcacgctgtgcgccgagctggcgggccgcgccacggcgggggtgccggcggacctggtgcagctcatgggcgtgcgggggatgaccccggccagggcgcgggccctgcatgaggccggcggggatgggagaagaggggtgaggaatgctggatcaagacggccccaggagtccaagctgtggccaaggcccaggcctgaggtggcacccaggggtgctggagtccaccggctcgggtgcaatgccgaaaacccggcagctggccgacctgcatcaggtcctgagcggggactggcgacactcctccaacacacctcaatcgaacaccgcaccgactcgccgccttgcctccctgcacaggaccctgcggccctggccagcaggtccatccagcaggtggcgcgggtgctggcccgggccctggagcgccagttccgggcgcggcgccccgccggcggcgcgccgcccaccaaggcggcgctctgccgcgaggatggtgcggcggcggtggccgcagcgcgggcccgggcggccgccgagaagctggtggcggctgccaggctcgccgtccacacacagcaggcttctgctgggcggctgggagctggagggtgtgcaccgggggctgatggccttggggaccacggcgcgtcgctcggccgccgacacccgattgattgggtcggcgccctcggcgctcccaccagcagcggagacggggaggttggcctcgtcgcaaaagccggtgccccagctctggccgggccggcggccgacagcccctgggcctgggcggggcaaggcagggcagcctgcgtcgtgctgcgtggcggcgcaggcacgcaggaggggggcgccctgctttcctccctacaggccgccgcgcggtgcgccgtcgccctgaactgcctggagggcagggcgctgggcctggccctggcgtgggaggagggcagggcatggtacgtcagcctgaccccggccctcctggaccgggcggaggtccctggggccgccgatggagcggcggggccagccttgagcctgagacagcggctggtgcacctgctcaatgccaggcaggtcctggtgtttggaagcgctgtgctgcagggcctcagcgccgcaggctttgccttgaccgacggcccggcggacgtcgcggccgaggtttcgaggagagcgccccacaccgtggggacctgccccgcccagtgcctgcgtctggcttggggccacgtggtgagccttgtgaagtcggtgttcgaagggtttgggggacctggagttcagggtcctgaa

SEQ ID NO: 8165 - DNA, 2664 bp, Chlorella protothecoides
  modified_base (1469)..(1532): a, c, t, g, unknown or other
  modified_base (1769)..(1778): a, c, t, g, unknown or other
atgagcgctcgttgccatgtcttccagcctcgtgcgagccttgctccgcatggaaaggggaccaggctgagcctccacagaaactttgcaggcaaggaaatgggatcatgcactgagatgggggcatctcgcactggatccgtggctgtggcaacacccgcatggcctgtcatgcaccctctctcccccttcccctccaccagcaggcactcggctgccccctctccagcatgctcgggccccgcgggcttccccggtcgctgtacaggccaacctcttcggcagggtgggagggccctgttccaatcgattgcccactccaccgccgcacccctccccttcacctcttcccgcgcagtgggcgggctggaggaccccgagaagatcctggagcaggcggtctccgacatgcagaacgaccttattcggctgcgccaggcggccgcggaggtgacggccgcgcagaagcggctgcagaacaagcgggacatggcggctcagaccgcggacgagtggtaccgccgcgcagagctggcgctgagcaagggcgacgaggagctggcgcgagaggcgctgacgcggcgcaaggcccacgcggccacggccacccagctggagggccagctggcgcagcagaccaaggcggtgagcaccatcatgggcaacatgaagatgctggaaggaaagctgcaggaggctaagctgaagaaggacacgctgaaggcgcgggcgcagagcgccaagtccgctcgccagatccaggacatggtggggcaagggaagggatggggccatggcgagtcatcgtcacctgcacatacgtgtgccgcctcctcactctgtttccccatctccaaaatcctctcgcaattgcaggtggcggggctgaataccagcagcgccctcggtgcattcgagaagatggaggagaaggtgatggccatggagtccgaggccgaggcggccaccatggcatgcccaagaggcccctttaccactggtcctccatctgagggcgctgatgggatcgctcactggcatgctggctgtggcggtttcgtagtggtgctgggagtgttgaagtttaagctgtacggcgctgatgggatcgctcactggcatgctggctgcggcggttttgtagcggtgctgggggtgttgaaggttaagctgtacctggcgtcccctgacgatgggctggagtccaagttccagcagctggaggctgggaatgtggaggatgacctagcgtcagctgagggaggaatcgcagccagaggctatggtggctacagaacctgggctggggggactggagtgggagtgtacttcaatcaaggtgcttaccatgtgttcatcaccacaaacccctcctccactaagatcacatcgtcacccccacagcagctccctcctggccggcctgtgcgggatgccatcgactttgagctggatgagatgcggcgcannnnnnnnnnnnnnnnnnnnnnnnnnnnnnnnnnnnnnnnnnnnnnnnnnnnnnnnnnnnnnnncgaacctgcatgcagcactccagcaagtggcagccccgcaagcgggggctcagctccgcatcctcgccctcatttgcgcccctaaaacccttctccttgcatgtatactccaaaaaatgccagtcatgaaatcatcgggtgtcatcagtgttggggggatgctcggggccccaatatcatgctggaatcaaccaatgaaggagcttggcagatggtgcaaggggtgaatgcggtgcnnnnnnnnnnaggggccccaatgtcatgctggaatcaatcaatgaaggagctcggcagatggatgtccttccgtgcgtcttacattcaatgccaccgtgggtcgcttgacctcctgatgggattcctcatggagcataaacagatgggggcctcaagtctgtgcgacattgtgggaaggggggagcaacgcaatgcagcaggacagtggatcacctcacgcaagatagcccaggaggattgggagctcgaaatgctggaaaaattgggtgacggcataataccagtccattcagcagtgcacccaggtggactgcacaaaacgagaattgtggcgcgacgggcggctggcccacggcggtcggccgacggcctgtcctggccaaaaattgtgggacgattagctgtgacgagcaaagaatggaaagagagggggtgggggacggcagtcttcaggaagcgctgcacgcttgtccggcgccgaccccaggatcgccagaggggctcctccaaggcgccgtcaggccaccaggctgcccctgcggcgcagcgcgcgcagcacggcgccgtggtccagagtcaaaccgatgggcagggcggcggggcgctcctgcacgcactgcgccagctggcgcgagagggagggggggcagacatcgcccgtctgccccagctcccactccatgtcggtcagcgagccctcggactgaaaggccaggctgggggccatgctgggggggggggtgggcatcatcatgtagggggacgtgccggcgctgccggcgtcgtggtatgcccagccctctgcatccaggtgcggggtggagcaggagctcaccagtgcgccgcactcgcgctccctgagagtacgggggtcaggaggaggaaggtttggtga

SEQ ID NO: 8166 - DNA, 1248 bp, Chlorella protothecoides
  modified_base (495)..(504): a, c, t, g, unknown or other
atggtcggtgccatggctgcacactcgagcacggcggccggttgtaccaggcatggtgctggtcgtctggctcccagggccatgcccagacccttcaccccttccctcagcccctgtaccccgctcattgtgagtctcctatccccatcgcatgtgtgtttgatgctgcctgcatcaccgcgctgctggcagaaccctcaagaccatctccctcccaccctgccatccttcctattgcaggcccctcggcgctggcctgattgcccagtcccgcagggtgcaagaccccatcatcccgccctacatccagctcagccctcagcagggcgatgcgatagacctgtatggctacatgctccagaaccgcatcatcatggtcggcaagcgcgtcaacgacgccgtggccacccaggcaaggggaatcgtgttgataaatgtcgggctcttcactctcccctccccaccttttcatcgatccctcccatgctccacagnnnnnnnnnncagtgtcgggctcttcactctcccctcccctcctcctcatcgatccctccatgctccacaaccccaacccacccctcctcgccccaggtggtggcatccctgctggcgctggactccatcaaccccaacgaggagatccggctctacatcaacgctggcgcgggctccccctacgccatcaccggcatcctggacaccatccgggccatgcaggctcctgtctccaccattggggtgggcatggtgggtggggcggtggcggtgctgctggcaggcggcgccaaggggcggcgcttcatcatggcgaattcacgggtgatgctgcagcagcccaatgggggcgccatggggtccgcagatgaggtcaatatccaagccacggagctcaaccgcaccatgcagctcatgtacacgtgcgtgtggagcccgggatggtggtcacggacagcgactgcttctgtgtcagcttctgggcaatcctgctgggttgggaggcggatgactcgctcagatgtgctccctagcgttccctcgaatccctaccacctgcaatgccccacccacagcttcctggctgagtacactggactgcccatggacaaggtggaggaggagtgcgacagggagcatttcctgggagcagaggagagcaaggagcttggcatcgtggatggcatcatagggacccctccggccttcatgccccgcaacgggctcctgcagttcgcaaggggcaacttttga

SEQ ID NO: 8167 - DNA, 2448 bp, Chlorella protothecoides
  modified_base (980)..(989): a, c, t, g, unknown or other
  modified_base (1073)..(1082): a, c, t, g, unknown or other
  modified_base (1204)..(1213): a, c, t, g, unknown or other
  modified_base (1612)..(1801): a, c, t, g, unknown or other
  modified_base (2156)..(2165): a, c, t, g, unknown or other
  modified_base (2271)..(2325): a, c, t, g, unknown or other
atgacgagaactcgtcgaccccatgcggtggtgcgtcctgatcctcccctctcccaacaccagcatgccagctgtcactccaacccatcccacccccagacacccgactccgaccggcacgaggccctggtggccatagaaagcatggaaggcccctgggcggtggccgggctccccagcaccctgccgccagggtcgtatgcgctgcggcccggcccgggccgccaggcgccggactgggaggcgacggcctcgctggcctgggccctggagcgctactccttccttcggtacaaggacgaggcggccagaaaggcggccacagcgcctcggcggctcgtggtgcccccctcccccgcccaggaggaggctggtctcctggcggcggccatctacctggtccgggacctcatcaacacccctgccgaggacctcagtgagtgcagacttgcccagcgcagagggtcggagtcgttgctgagtggagctctgagcgcctgggtgtggttccgtcagcatgctgtccgccctgtgagcgacgcaggtcttcagatcagacggtctggctggctgggtgcggggtgctccgctcgctggggcggcatgccctccccgtctgactcaccaaacctcctcccctgcccctcccctcctgacctctgcagctccagctcacctcgcagccgaggcggaggccctggcggccaaacaccccggcgcgtccctcagcgtggtcagcggggacgacctgctgcacgccgattccttctttcccatggtgcacgcagtcggccgggccgcagcctgccccccacacctcctggacctcaggtggcagcctgcgccccagagcgcctccctccccctgctcgtgctggtgggcaagggcgtgacgttcgactccggtggcctcaacatcaagcccgccgccggcatgcggctgatgaagaaggacatgggcggcgcagcgctcgtcctgnnnnnnnnnntccctaccttgctcttcccagcgcggccagaccgcgctgcaggcctcactcattcgccgttcatcccctcgcatcccacccccnnnnnnnnnnggcctggcccacgtcatcatgcaggtggggatcaggtggaaaggaggaatccctgggggagtctggttgcacgtggaaggcgacccccccccatccacatccacaaacgcgtgctgcgcacnnnnnnnnnnggcctggcccacgtcatcatgcaggtgggggtcaggtgggaaggaggaatccctgggggagtctggttgcgcgtggaaggcggaccccccccccctccacgtccacaaacgccttttgcgcacgctgcgcatgctcacacagccccgccctcacctggcaggcccagctcccagtgcgcctgcgcgtgctcgtccccgcggtggagaatgcggtgggccccgccagcttccggccaggggacgtgctgcgctcgcgcgctgggcgcagcgtggaggtgggcaataccgacgcggaggggcggctgatcctggccgacgcgctggccgccgcgggggagggggcggcgggcggcgccggcgccgccccggatctggtgctggacgcggcgacgctcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgacgaggccgcggcggcggggctggccgccgccgcggcagcgacgggggacccgctctggcgcctgccgctgcacgcgccctacgcccacgcgctgcgctcgccggtggcggacctgctgtcctgccccgagggcggtggcctgggcggcgccatcaccgccgcgctgttcctgaaagagtttgcgccggcggagtccccctgggtgcacttggacaccatgggttggaacctgaagccgcggccggggcggcccgagggcggggaggcgctggccttgcgcgcgatctgggccttcctcaaggcgcggtatggcggcgcggacggcggccgcggcgccgagggcgggcgannnnnnnnnngggcggcccgagggcggggaggcgctggccctgcgcgcgatctgggccttcctcaagacgcggtattgcggcgcggacggtggccgcggcgccgagggcgggcggnnnnnnnnnnnnnnnnnnnnnnnnnnnnnnnnnnnnnnnnnnnnnnnnnnnnnnnggggggcggctttggcgccatgtgcggcgagggatccaccccttgggtactgaagtctgctcaccagcccgcctctggctggttcacccctggacccttccatcccacttctggtttgcttaa

SEQ ID NO: 8168 - DNA, 453 bp, Chlorella protothecoides
atggatcccaagacggctaacaaagtgctgaaggcatggcgcgaggcggtgggcaaggacattgagccgggcacgctggccaccaaacatccacccgttcgtccctcccaacagctgctcacccagcaagcaggaaaggcctccttgtttgtgatcttccagatcctgctggacctggccgccgcctacggctcctttgtggcgggcagctacctgtcggccgccgccagccccggcgggatcgcaggcttcttcaccttcctgctgcaggccggcgccttcttcgtaaccgggtactacctgtcaggtacgcggtacagggtggaggaggacaatctagtcatgtccagatcaggggtggccaaatgcatggtttactccactctcggtgcctccgggcatgcttctcccgtcatggttggtggcaggctctccctgaaccatactgggtag

SEQ ID NO: 8169 - DNA, 258 bp, Chlorella protothecoides
atgcaggaggatggggcgctgtgccaggtctgctggcagggccatatggagctccaggaaggcatgctggtgtgcgacgtctgcggctctgtcgaccaggggtctcaagaagaccagagagtcgggggctgtgcaggaaagaacggcgttgcccgtgaaggagtctctgcgagcctatgtggaaatcctccagcacctgctgcaggtgctggggtcctggcaagagcgtacggggttaggagccgagcgtgtggctga

SEQ ID NO: 8170 - DNA, 234 bp, Chlorella protothecoides
atgcgcgagtggcttttagaacatgtgtctttcaaagaggaatcgcggctgccgcctggcgccaggggcttgggtgctttgggctcccggtatggcagcaccctgtcccaagaggaggtcaaggcggccctggacctgcttgacaccaacaaggacggtcgcatccagttcggggagtttgtggactggtgggttgagaagtcgggggtggagaccaaggcaactgcggcctag

SEQ ID NO: 8171 - DNA, 822 bp, Chlorella protothecoides
atggcgacgctggggtctgttagccccgtgggggtcccggcagcctgcaggctgccccgcctggccactgccttccggcccttcaccccgacagcagcgagggccatgcccctggtgcggcccagcactttccgagcggaggtttctctcatcgtgttgacttgctctggcacaggtgatgaccgcatgttgcgcgaccgctacccaccccgcccccctgcccaacccctgccacagatgcagcagcagcagcagagcgctcagcggctggcccggcccctcacgcgactggcggcctcctcctcccccgatgcgcttgcgacaggcagccccccccccgcggacaccgcggccaaggagcctgcactcaagggcgaggcccacctgcgcttcgtgcgtggctcccccctcaagcctcagctccctcgtcgaggttccccagtgcctggggtggatggagtgctgcaccgccacgctccccagccttggttcatggccccccttgtgccaacccctgcccaccaggtgcggcgcgtgctggaccagattcgtgggcgcagctacgaggaggccatcatgatcctggagtacatgccctaccgcgcttgcgagcccatcctggccaccctcctgtcggccgccgccaacgccaagcacaacctgggcgccaagaaggcggcgctgttcgtgcacgaggcctttgcggacggcggaccgtccatgaagcgagcaatgccgcgagcgcagggcagggccgaccgcatcctcaagcccaccttccacctgaccatccgccttcagactcgggcggggcgggcatga

SEQ ID NO: 8172 - DNA, 990 bp, Chlorella protothecoides
  modified_base (866)..(875): a, c, t, g, unknown or other
atgccttttaaaattatgcatcgcttaatgcgtatccatggccctatggtccacgagatggtcgcgcgtgggtcgcgatactttccacctcggacagaagtgatctgcatcccgggcccgctcccctgcccttcccaggcacccagtgacacaccataccttcgaaagcagtgcgccgcgctttcggtacttgggttttcctgtgcattgacgcgggacgttccctgcccctcgcactcgcggccaggtcactcgacagaccacgcaggcgggacgagccccaaacccaaacattccgggccgctcccaccagctccaaccctccaaaatccaggaatgagggcaccacccgccgggtcctgctcgggcagctggccgacactggcttccccggagccacggcagggacggacgcccggacccgaggatggggaggccgggactgatcccacgtcagagctggacacctcccccaccgagtcgagcagggtccaggccagccctcaggggcctgatgccccaggcatggaggtggatgctgcgccgcggcccaccctgcaccacctcacacggcactggctgcctgaggaggagcggggggccagcgtcctggatcgttttggtgccagcagcctggaagccgcccggcatgctgtcaggtgtgggtggctgggcgcagcgagggcgcgggttggagtcgcatgctgtgaaatcctgagggttggaatgagggcgctacaccatcatgcattgggcatcagaaccgcgcttgacctgggatgtgtaggacctgtgcacgtttctgattgcatcacacctgtatgccggtacgcaccagtgcgccagccactcttgggccagggctnnnnnnnnnnggtgtgggtggctgggcgcagcgagggcgcaggttggagtcgcatgatgtggaatcctgagggttggcatgagggcgctgcaccatcatgcattgggcatcagacccgtgcttga

SEQ ID NO: 8173 - DNA, 462 bp, Chlorella protothecoides
atggacttgtgcgacactgagcgtgctatcttaacgggcccgcaaacgcagcgcggggtggtaccggtacacgcagtacacagcagtagccacagcttcaaatgccgaggatcagcccgacgtacccatatactttcttcccagcatactcgtccggcccaggccgggataaacaagcgccgtgtgcgtgtcgcctgcaagggcccgacacaggcctgcagcgcggggctgggcccacggagccgcgcgcctggggagcgccagactgccgttcgtatggccatggaagtggatgtccccaatgccatgcctccttggggacaggctcctgccccggcggtccccgccaaggctgtcactccttctggaaacagttatcgccagcgggaggcgacccagtttaggggtgtcacgaagacctccgggactaattcggggctcgagaagtttgacgtgcagtga

SEQ ID NO: 8174 - DNA, 2175 bp, Chlorella protothecoides
gccggcgcgtgcgcccgccgccgccgcccccaccgcaggcgccggccgcggcgccacggcgcaggaggacgagtggggcaagtggtagggcgcggggcggcgcgctgctcaacccgtggccctgataacgcatggcttgccgacgagaactgtgaagcatggtgtaaggctgtcgctgtgctcagggcacggagagtgtttgggggcgcctcagcatcatccgtgctggggacgcacatgggcagcatgcagccactccagcagcgtagtccatgcgcgcatgcttgtatcacagcatcgagggccgctgcacagattttactcaacgtatcgaaagaatgttgcgtttgggaaagtaaaagtctccgatggaaggcttgcggcccttgcttggcagcatcgcggtcggtcccgctgtgggcctggtgctgcggaggacctccttgcttgaggatcaggatgtccagagcctgccctctctgcatccttcaaagccacatctgctcaatcatttacaccgtttcatgtcctgaaacactgcaatgcgccacctgcaggccgcttccaacttacccatgggtgccgacgctgtcgctttaccttggcaccaaggccatcatcgcagtcctcgcattacagcatccccacaattccccccaacccgacccccccaaacacagtgcgacacatgctcaccaacccctccgtcagcggtttgccagcgtagctctgtgtctccccaccggccctgtactcctggccattcccctgctgggcctgctagcgggaccccccgccctcgccgtcggcctgacgttggccgccctcgatgccgttctgcttcgcacgctgggttttgccgcgctttccagagctgggaacgccctgccggaggcgctgtaccacgacgatggcggcaagtataggggggagctgtccggggctctcaaggacggctttggtgtttaccggtatgcctctggggcccagtaccaaggtgaggtgcggggccgagctgaacggccagggtgggggaggggatggcctcgggagcacggcgcactcagcaccctgcacaattgggcctggggcatgttcatgcacccctgggggtcgtttggggctctggctctggcatgctcctggatctctgagcgcccagctcgcccccactccatgccccctcacctcctcccaccgtgcaggggagtggagggacaatgtcaagtcggggcgaggcatctaccgctacaacagcggggcggcgtacgccggggagtggcaggcgggcgtcccggagggcaggggcatcaggacctcggcctctgggaaggcgcagtccggcatctggaaagggggaaagctcagtcagcgcacggagcccgaggagtgtgcgctggccgtcgccacggccgcccaggccgcctccgccgccaagaaggtggaggtgggcggcttcagcccaggcgcggccctgcggtccctgctctccaccccggccctgcttgcggtgggggttgtcggcgccttctggcttgcggggaagcccctctccccatcggtgagcgccatggtgttgccgacagggctttctgtcggggtctgctgggccaagctgcctcccttgcccgtcatcatcaggtcgtgagtgctgcaggtcggctcgctaccttccaggctcccctggccttgattgtgctgggcctgaccttgggggacggaggtgtcaagcgaggtgctagggcgcctgccccagcccaggcacgtgctgggtggaggggggggagttcagaacacttcctgccactgcgcaggctctcgtccagtgattacaaacctacaagcctggagggccatgttgtggggcaggggcgcgggggctctggtcgactcggtggagtcgtcggcggggaggaagtggccaaccgaggttgccctgtccaggagccaaggggtaccgctgacctggcattccaagtccgatcgagcagttttcccgcacccccagcatcactcgctctgtttcctgaggataacgccctcaccgcatgtgcagcatacctatccctcactgcctctagcagcgtccccgttctctttcctgactctatcccgcacactcttccgctcgcccaaagctcctgtacagtgcaccttgtgtttggccccctctga

SEQ ID NO: 8175 - DNA, 783 bp, Chlorella protothecoides
atgagtgtgtatcgcgaaaactgtctacgtgttacagaacgccctgttggattagagaagttgtcggaatgcattgctattgatgtccattgcggcagtggagaagagctcgcgaccttaccgagagcactattgacaccatatttgacgacaaacactccgaaacattgcgcctccaacccctatagcaatcaggaacgtatgcaaaggggagccagtgggtctagccccagcgcgagtggcagcggggtggcacagagcagcatgacggagccttctgagaacccagagtggcccggaactactgccgatgttggagagatgatggtggatcgcgccgtgacaagaaacgcctttgtcaagttcatgatgcagaagatgcaagaggtgggcgtggtgacggagatgcatgcgtgtgaggacaccacagacatacccagtgagcactggcaggacagccacgcacagccctggcccatgggcgtcagtcctcaatcccgtgacacatccaatcgcgcaggcaggctgtgcagtcgaccggaaattcataaaggtagaacactgcgatgcgcaagtgggtgggggcttcagaccccccgacggtgtcgtggtctgtcacaaccacttggccagtcagatcgaggtgggtgccggtgccattgcggatgctgcccttggttcctgggtctctctcgggcttgtgagcttgaggccatacatgctcagatggagcacatcacttcatccctcgatcccacaggtggacaatgctctgacccatga

SEQ ID NO: 8176 - DNA, 993 bp, Chlorella protothecoides
  modified_base (601)..(610): a, c, t, g, unknown or other
cgaggcggggccgccggcgctggccaccctggacctggaggccctgaccgccgccagcggcagcgaggagcacggaccgccgggcgccgtgccggacgtggccacggccgccgcgctgtccagccaggcgctgacggtggcctgcgccgcggacggcggctgcctgctgctcgcggccggtacccctgtgccggaggccgtggcagccatgcgccggggcgggcacaccgtgtcggtggtggtggggcccggcggcgaggtggtgggcgtggtgagtttggtcaccctggagcgcctgctgctcgccgaggcggcgaccgcaggcggggaggaggcgcacgacctggtaaaccaccttcggcgtggggctgggagctctgggtcgacgactccgaacacaccaccaaaggctcgccaccatgggtgttcggatacgcctggctcgcttcggacgcaagaacctgcccttctaccgcatcttcgtggccgactcgaggagcccccgggacggcagacacttggaaatcgtgggccactacgaccctcttccaggtcgatgggttgcctctacctctgacttgccttttaactccattgctcnnnnnnnnnngtgcatggacttttccggcgcaggctggaaggcaggagtcgacgacaacccttgcacttgccgagctttggtttgggctcgcaaccgtgccgcccaccgacggtgtagccctcattcgtggcatgcacaaccccagcattgagagtcagcatgggtcgtcagtgctctttgccatacatgcagtgccttacagaggtcaggacgggaacaagcagctgggcctgcacattgaccgtataaagtattggctgtcggtgggcgctcagccatcgaacaccgtgggtaggctgctgggtcaggccgggatcatcccgaagccgccggcagccctgcatgctggagtcgtcaagaagcccgagaaggagcggaacaagaaggcctga

SEQ ID NO: 8177 - DNA, 732 bp, Chlorella protothecoides
  modified_base (676)..(685): a, c, t, g, unknown or other
atgagtggccgcaaggacccgaccgaccgattttgcccaaccgaccaattttgcccgaccgaccttgtacaccctcatggctaccaccatgtttttcttgcgcaggatgaagtcaacatcatgcctgctgatcatctcgctggtcgggctcgtcctcgtccagggcctcccctccaaccggaagctactcgcgggtgcgccacgcgcaagggttttatcgtgggcgggactcgtcagccccagcattgcctccgttcatgcagcagtcatgctcacaaggctgtgccacagaccaaatctgccctccttttatgttgggctagaaatgaactcaattcgaccttgcattgcagacaggcaccaatgcgaggcttgcatacgttgtcgagagctgcgacgcattccttccatgcctttcagaaggagctaagcattacctggatggaggggactccctatgcaccactggaaattgcagtgggcgacaccgtaacctggacctggtccatgggatccccccatgacgtctccaccgcgactgcagcagacagctgcactgacctgacgcccatcagcggggatcctgtagaggaggggacgtacagccagacctttgacacggcaggaacctacttctttgcgtgctcggttggcgaccactgcgatgagggtcagnnnnnnnnnnacctggcgcccatggaagtgtttgtgatccggatggcgcaagtgtag

SEQ ID NO: 8178 - DNA, 477 bp, Chlorella protothecoides
atgcgtgagctgctggactccattctgtactccttcctgccggccgccttcgagaggctcggggcctccgctccaaccggcgagctctctgcagacgattgccgggccgtggcgtgcgccgcgctggtagcggcggcactggtcgctgcgccggccggcttcctggagttcctgctctgcgtgccgtggctgcagctgggggcccagctggccgcgagtggcggcgccccgcccccagagctgggtccctggggcgatgcccccccgctcctccgcccctccctggccgaggcctcgctcctggtcaacgtcaggctggacgcacggctgctggactgcacgctggacttcctgggacgcggactcgcgctgcacgcactgccgcccctcctcgccgccgcgctgggtgcaggcggcgaagtgggggtggccgacgaccgcaccgcgggaggatccgccgccgccgccgccgccagc

SEQ ID NO: 8179 - DNA, 807 bp, Chlorella protothecoides
atgcgcgcattcaccttgtctcgagtccctagcaatgcctctttgctgagggcgttgtggcaaactcgaccccgtcgtcgatggccgcaatatgcggacgctggccccttcacgacatcagccatggactcggctgcccatgcagcagacgagacgcccgtcacgaataaaggggtgcgctgcgatcatttggcgtgggttcctggagctgttcctcgtggcgttactgaatgtgattgggtccttgctcacccacaccctgatcacgcatgcctcctcctcatgtttctgactgcagcaaggaaccaaaccggcccctcctccgccatccatgcaggcctggtcacagtgaatgggcagcctgtcctgaaggcgggcaccggagtggaccccgcctcctctcgcatagacctgctggccgaccctcccaggtacgtctgccgggccgggctcaagctggaggctgccctggaccacttcagcctcgaccccaaaggatggaccacactggatgccggcctctccaccggcggcttcacggactgcctactccagcgcggggccaggcgcgtggtgggcgtggatgtggggtatggccaggtggcagagcgcgtgcgtcagcaccctgccgtcaccgtgatggagcggacaaacgtgcggcacctgcgccgcgcggccctgcctggcggtgagccggtggacctcgtcaccctggacctctccttcatctcaggcaagcctgtgtgttggatggtggagaggccgaggcgtgtgctgcagggtcagttccggagggacggcgcctga

SEQ ID NO: 8180 - DNA, 669 bp, Chlorella protothecoides
atgtcatcgatctccggtgctgccgagggccaaacatcactcccgcccgtttcgcgcctcatggaggacgtgagggcaccatgcagcacagagagcatcacagtcgaacttgctctcacatcgaacgaacatcgatactgatgccacagcggcctcatgagaacgccaatgcagcaatgttgcccagtccctatggcccatgcgtccattcgagctggagctctgagacacaggcaacatatgggaatgaaaaacatccctcgagcagtcccgagtggaggtgacctcatgctcctggccatctctccagccgacgctgggctcctgctgggaatactgaagcccattctcacagtgctgagcctgggcatgattggcaggataatcctggcgtggtatcccgagatagacatgcagaagcttccttggtcgtttgtgtactggccaacaggtgatgactggatggacttggaagccgctggctcgggcattgtgcctgccggtcatgacgtgtgcccctccaagcaccagccgagcatcgccgacaacacaaagcctcacactgccctcccacagaaccggtgctggcgcccacgaggaagatcatcaaacctttcaatggtctggatgtgtcccccatcgcctggtttgcgatcctgtcgttcctga

SEQ ID NO: 8181 - DNA, 369 bp, Chlorella protothecoides
atggcgcgacggagcttggaccttgtgaagcacgtcaagttcctcgcccaggcgggtgccatcaccaagccaaagtggctcgacgtcgtggagaagatccaccctgccgtccctgctaagagcagtaagaagccagccgtgctcaggttcccagaggatgacctgctacaggcctactatgccaagcaccccgaggtagaaggctgtgcctggcatgggcaggcgaagatggaaccagttgacttgagctcctttgagcccaccagtgctcggaagtttgtgttccgacagctcgaggtgatgcagacgggcgtgccacgaaaggaggcctacgacattgtctccaaggaggtggctgaggcagcgtga

SEQ ID NO: 8182 - DNA, 1302 bp, Chlorella protothecoides
atggctgaggatgggaaatttgatgcaagtggtgattcaatgggccgctccgagcgggttctccaactcaatgggcggattttggagctccctggaatgtgtcacatggaacaggctctcgcctcctgccgctgctgccttggattgacagcattcccaaaagtccggccattcacctgtggccatgatgatcgacggcgtcgccagcactcccctccctccctttcctcatacagggtgatgccgccccccacctccatagagaagaccatcggcgagcagcgtgtggtcaaccatgcgggcgtaggtatctcagtcgggcccgagctggatgtggacagcctgttggccgccgtcccggcggacgacaaggccgcacggcaggcggcgctctcctctgcggccttcgacggcgtcaccaccgagtacaccgccctgtggcgtgctgtgcacgctgcacccgaggacgtggcgcccgagtacacccagccgtggaaggctgagccggctagtacagcctggaggggttcattgcgagacctggcgtggcacgagcggtggggtgcagtattcactgttcttccaagggattgtcttataggaggcgaggggtacgtttcctggtcaatgcattcttcggggtccagtgagcagagcatagttggtagcctcctcagtcagcactggacgactgcctggctctcagtacaggtcctcctccttgtgggtctggatgacgcagtcggtggttgggtaggccacgcagagcagcgcataccccttctccatctgagagggcaaagcgacgatgtgagtaccattccacgcgcaggacaggagtgcatcatacaggctgttcacccccggtcgatgcaggcgatgccctcccccccttccaacccccaccctccatggcgcacctgggtatcgtccaggaagctctggtcgctctggtctacttcaccagtgatcacctttcccacgcaggtcgagcaagtgcctgtggtgcaaggctggttgacattcacccagcgccactgcagcagcgcgactcagttctcccagaggcacacgagatgcaaaacggacctcgatggtctcctcctcgccattctcaagctggaaggtcactttgtaggtattgcaagccaaagaagctctacggtgagccagcgtgcagaggaagaatggggcacgagcgggagctgcagtgctggcgccaggggtttgcaccctgccgaccctcgcagccagcacggggggacggcttgccagagcgtttgccattctgtctatgcttaa

SEQ ID NO: 8183 - DNA, 1011 bp, Chlorella protothecoides
atggaattcctggccggctacgggagtgaggatggaagcgaaccatcctcgcccgagcacgtggcacaattagcacccgtcacaagcgctccagccgtcgagagtgaacatcctggtcccagcttcaggctgcccccacccaaagcgtcccaggtccccctcttctctggcgtggcgccacccaagcgtcagcacaaacttcccaaggcccgctttggcgtccccatagactttggtggagtgactccagacgtcctggagaagatgcaggaagcaccggcaaagcttgctccagctgcaccacgcagcggtcgcctggcagacctcctcccatcacccaagaacgcggtgctccccccacgcagtggaagggtgagcgatgcagaacgctgccctggtggcccgtcccactgcgggtgcatggagaccgggcagggttatgttacggccagtactttctacatgccccagtccatggcgcagggcacagcgtacactgcgggtggggcctctgatgacgaggacgagctgaaggctctgggtgccaatgatggcaccgccatgacccttgggccaggtgagacctggcgtctctccctgcaaggggctcgtggtggtgatcctgaggtctcggagcagctcggtgacggggttcacgccagcaccagcggccggcagctggagggcacaggtgcccaagcaccccacgcagactactatgcatcacagggcatgccagcccctgctggtccagacgttgctgccttcactgcagccggcatacagttcaaggagaccgagggcatacaagaggcctgctttcatcaaactgtacccattctgcatccaattcgtacacaggtgaatggagcagtcctgcggtacatggatccaggacagagagctgagctgaatgccatgcgatctgcattaggctcagactacgaggcacgcctccgcaaggaagcaggtagggaggaaggcttccgcatgctggctgcactcgtctga

SEQ ID NO: 8184 - DNA, 852 bp, Chlorella protothecoides
atgctctcggaaggtgtgatccctctgctgctgggccatcagcccgtaaatgatgttgcaggtggccgccacatcgtcgggatcggtggaaagaaggttgagctcgtgcccaaatccttgacctgacggaggaggggagggtacctcggcctggttggtgaggacagagtggatgtgagtcgggatcagagcgctctcaggcccagcatagctctactactccacatcaacttactcccaaggccgtttcttttcccattttgcgctacgagtgcggttgggctgtgctcaagccagatggcgcatgctgtctctgagcccagcgtcctgatagtgtccggcactcgactcctcgctcaacagcgctcgacagtgtcaagtacagcacttgatatccttttgggagtgggagaaagtcttcgtccccagagaagcgacacctgtttgtgcacagttcgaatggcgtgcttgttcgggagagagctttgccgacagatgtttcccgccaaaacatcaggcagacccaggaagggccgcctcccgtgtggcgagtgctatgtccctcccgcccccagcccgactcctcccctttcgcatccggtcgtcgctgcttacctcctggctgccctgggcggcaacgccaccccctccgctgaggacatctccaagatcctgtcctctggtgaggaactcctgaaatccggctgtaccatgatgctgtatgttgagggaagtcggcgcatctgctccttgtctcgtcgacgtgtcgacgacgagcccccaccccccctttccccgacctcctcgcagttgggatcgaggccgacagcgagcgtgtcgctactctgctga

SEQ ID NO: 8185 - DNA, 210 bp, Chlorella protothecoides
atgacctcaccctggccccatgcacacaaccagcaactggcggatggggaggggctgagggctgacctgcgagccgccaagcagggcgccgaggatgccgggcgcaagctggtgggagccgagcgacgggtcgtgcagctgcagcacgaatccaagcggaaggagctggagtacgaacgactccaggaaaagtgggtggaaagcggatga

SEQ ID NO: 8186 - DNA, 447 bp, Chlorella protothecoides
atggtgctggatgtcttgaagccaggcgggcacctgatcgtgctcatcaagccccagttcgaggccgggaaggcgcaggcaagtcgcccggggcagttcctgacccctgcaggttgtggcatgccgatgaatgtcgatgccaggcgtcgcacaccgtgggaccccagctcatttaagagtggcgaccacagtctctctcccccacgcaatcaggtgtcagcgggcgggctggttcgggatcccgccgtgcacgcagacgtcatccgacgggtgcaggaggcctgcatggcgcgcgggctggtgccccagggccacatgccctcacccatcaagggcgcgaatgcggggaacacagaattcctggcccactttgtctttcaggcgacaggtgcaggggtggaggaggagctggaggatggggaacctgaagaacctgccaagtcatga

SEQ ID NO: 8187 - DNA, 516 bp, Chlorella protothecoides
atgaacccctccccccctcctccccccgcctcggtcgccaggtcggcgcgcgaggtggagacccagatccacagcctgcgcgccgagctcctgcgcaaggagcaggacaacgagcgcatgcagctggacctggcgctggagaaggaggagagggagcgcgcgcagcgcaagatcgacagcatgacgcgcatgatgctggacggcgcgcgcggcggcgacgcggagaagcccaagtcgaagcgcgagaaccggcgggagacgtggtgcccgggggccggtcagcgcaagcggcccctcctccccgccctggccggggcggtggaggagggcgaggaggagggtggggtggaggacgagctgggcgaggcaggggcggagcgccccgcgctcccgccctccaggaggtccgagggcgccgccctgctcctgccgggccaggcgtcgccgccgcacaagctcagccgcggcagcggtgggtcctctggtgtaggtgtgtggggtgaaaggcagggttga

SEQ ID NO: 8188 - DNA, 429 bp, Chlorella protothecoides
atgacctctgctgtggctgcactgctgcgagaggtcccatgcccaaactgcatcgtttgggggaagtttgatgagctggcactggcgcttcgccaggctgtcccaggtcagagcgtgggctacgtcgtcatgaatgagaccgccgaggtgcgctgggcaagggaggggtgggatgtccccctccgctcccccgaggctcaagtgacggcgctgcactatgccatggcctccacccagctcctggacctcctccatgccgctgcaaagcgggtgatcgtgtggaccgccaatgcgccgcacatggtgcgactggctctggacgcgggggcggacggtgtcgtgaccagctacccaaagatggtgcagaaggcgctgatgcagcggcgagacgcatgtctccggctgtatggacatgcgcccgtgggctga

SEQ ID NO: 8189 - DNA, 486 bp, Chlorella protothecoides
atgccgagcatggacctggaggccctgtgcgacgaggtctcgcagcgccagtccctgctccagcgccgcctgcacggagcggcggggggcggtgacgagccggccctgctgcgaggggtggtctgcgaccagagggccctgctgacgggcatgctggcggccgtcaggtcctccagaatggtgaggcacgcgcggtcggggagggcaccctcggcggtgtgtggtcttccgcgtgcgtgcccgcccagcgccgagcgtgcgctcagcatgcccagcgccccgctgcccaccacgcaggcgcaggaggcgctgcaccaggccgacatgcgccggctggtgcacgaccaccagacgcagcttgcggccgccaagacggagtgggagcgggcccgtgtggacaaggtgggtcaggggacgggggtggtgctgggatcgaagaacggaggatcggcacgctcatgcgtatgcctcggcgacatgtcttga

SEQ ID NO: 8190 - DNA, 876 bp, Chlorella protothecoides
atgtcaccaccccttgtcaccacctcttgtcatcaccaccacagggatgccctggctgctgccgaggctgccacccagcaggccctcatgcaggctgcagaagaggcagcacgtctggcgcaggagcacgaggcggccgtctcagctgccctggcggcgcacgaggaggagttgggagcggcgctggtggagaggcaggagctggtggccaagcgacgggagctgcaggacaccgtcaagtccctggaagagaagctggccgccgccgcggcggggctggccgccacggaggagctcaaggacctgcgccggcgacataaggaggacgtggcgaggctgagcctggcgctgaagaacgcaacgcaggggtccaagggcacggagaaggccagcgatcgcgcccagaaggaggccgagaagctgaggtcaaaggtgaccgagctggaggccaaactgcgggccgccgtccaggacaagaactctgcgcagaacgagaaggctgcggcggagagggagctcaaggcgatgcgctcccaggccgagcgcctgaccaagaacatggacaaggtgggtttgggaaaagttgacgctggtctgcaagtaggcgtgaacagaacaatactcggtgggcgcggccggtctgtgcgcactgtgaatggggatgtgctgggccaggcagcgtcagcagctcgatgtaagtgcgtggtaatcccaccctgcctcctgcagatcactggcgtggaggagaagaagcgcgagtccatcatggtgggattcaatcagacaaagagccggctgcaggtaaatggagcaggggttggccgtgtgctgatggacggggctgtcgaggagaggagtgccctcgtttcgaagtga

SEQ ID NO: 8191 - DNA, 519 bp, Chlorella protothecoides
atggcaaacgctctggcaagccgtccccccgtgctggctgcgagggtcggcagggtgcaaacccctggcgccagcactgcagctcccgctcgtgccccattcttcctctgcacgctggctcaccgtagagcttctttggcttgcaatacctacaaagtgaccttccagcttgagaatggcgaggaggagaccatcgaggtccctgaggaccagtacattctggatgctgccgacgatgcgggcctggacctgccctactcctgccgctcagagcgaccagagcttcctggacgatacccaggtgcgccatggagggtgggggttggaagggggggagggcatcgcctgcatcgaccgggggtgaacagcctgtatgatgcactcctgtcctgcgcgtggaatggtactcacatcgtcgctttgccctctcagatggagaaggggtatgcgctgctctgcgtggcctacccaaccaccgactgcgtcatccagacccacaaggaggaggacctgtactga

SEQ ID NO: 8192 - DNA, 858 bp, Chlorella protothecoides
atgggtgaccgcgccctgcgcgacgagctgatgacgctgatggtggcggggcaggagaccagcgccatcgccctggggtggacctgcgcccagctggccggacacccccatgcccaggaggtggtggcagccgaggcgattgctgctgcgcgccaccacacctcggactccgccgccgcgccccccgcccctggtctcgccgccgcgcccctcccgcgtgccacggaggcggcgctggaggccatgcgcctgcaccccccggcctacatggtgggccgctgcgcggcgcgcgacgccgacctggcgcagtaccgcctgccgcgcgggaccaccgtcctcctggcgacgtatttgctgcaccgcgacccggcggtctggcgcgcgggtcgaggcagcgaggcggaagctcgcacgaacatgaatgcagggacaggcggtgcggccttgcctccgcagggccatggccggccggcggccttcgtccccgggcggtgggcggaggccctgtgcgccgcagggagcgccaccgcgcttctctcagaccagggtgcggcggggagctacgtgccctttggcgcggggccgcgcgtctgcatcggcacggggtttgccatgctggaggtgccgctggtgctgagcatgctgctcgccaggttcaggctggagccggagggaggggcgcgcccgcctgcggcgcgggcgcgcatcaccctgcggccggaggagggtggcgaaccgacaacgtccgggagcgctggcaaggaactgatgcaagcctccagcgatctgcctgtcaccgccaggctgcgctccctcttcgcaaacgctctcaaaccttgtctgatggcattggaataa

SEQ ID NO: 8193 - DNA, 1092 bp, Chlorella protothecoides
  modified_base (493)..(502): a, c, t, g, unknown or other
atgggacaagaggggggggacaaggagggggttgatagggaggacctgcctgcacttcgcaattcgaccagtgaccctctttcgcccttaatcctctggaaggttctcctgctggagaacgtccgcttctacaaggaggaggagaagaacgatccgggccatgccaaggagctggccaaattcgccgacgtgttcgtcaacgatgcctttgggacggcgcaccgcgcgcactcctccaccgagggggtcaccaagcacgtcaaggagtctgtggctgggctgctgctgcagaaggagctggactacttgggtgagtcatggtggtcactgggtggtcagagtatggccggaggcagtgcccacatgtttgatggagtgatcccgcatggtttttgggatgaactaccagactttgccgctgtgagtcggccacagaatgcattgcatggaaactctgcccgtgaggcccaccagcaacggcaccacggtctcnnnnnnnnnnagcagaatgcattgcatgaaaacactgcccgcgaggcccaccagcaacggcaccacgacggcgcggtgaaggagcccaagcgcccctttgtcgccattgtgggcggttccaaggtctcctccaagattggtgtgatcgagagcctgctgcagaaggtggacaagatcgtgctgggcggtggcatgatcttcaccttctacaaggccaaggggctgggcgtgggctcctccctggtggaggatgacaaggtggagctggcccgcagtctgatccaggaggcggaaaagcgcggcgtggaactcctgctgcccaccgacgtggtggtggccgacaagtttgacgccaatgccaactccaaggtcgtgcccgtggaggagatccccgacggctggatgcacgaggatgagcgccggggtgggctgaagcaggccttgactacagcaatggggctggacatcggacccgactccgtggagctggtgaccaaggcgctcgacggcgccaagaccatcatctggaacgggcccatgggtgagtcttgggggagactgtggatggtttccgtggaatggggtcacacagcagactga

SEQ ID NO: 8194 - DNA, 510 bp, Chlorella protothecoides
atggttcatctgttgacatcccagcagaccgcgcaaagactcttcagttgtcgaatgtgcgctcctgctggtgtggattgtgaatccttggatggccctccccctgattcaagactccgtcccttcacttctcttttctcaaaccgctttccctcaacccccctcccccccccacataatcaaggtgtgttcgagtttgacaagttttcgcacgggacatttgcggtggcgaacactctggccaccaagacggacgccatcaccatcatcggcggcggcgactccgtggcggccgtggagaaggcgggtgtggcctccaagatgagccacatctccacgggtggcggcgcctccctggagctgctggagggcaagagtgggcagcgtggctgggatgacttgacgactagaaaaccccctccccatgcctcgcccagcctctctaagccccgcccacccttgcacaatgtactccatgcgccaggtgtggcggctctcgacgacgcttga

SEQ ID NO: 8195 - DNA, 1113 bp, Chlorella protothecoides
  modified_base (438)..(447): a, c, t, g, unknown or other
  modified_base (871)..(880): a, c, t, g, unknown or other
atggcaggacgtgggcgtgctgctgtgctgccggcatggatgaaaggtgaggcgcgtagatctcgcttgcctgagtggcacggtcctgtaatgctgctccaggagctcccggtgccagcgtggctgtctcggctcctgctcctccctgccggctccctgcatcgccaccatcccatccctgcaccaccacagcggccaacccccgctgctgctcccagcctcgcccaggctgcgcccagggcggccatgcccagcgccgcaccctccggccctggctcagcctggaccgagcacaccgccccagatggacgcaagtactactacaacgccgggaccaagcagagcgtctggaccaagcctgtggagctgcagacgccagagggcaggcagggcacgctgtggcaggtagggtacgctgaggtccaatgctgcatgctnnnnnnnnnngggcttgccccaagcgcttgctttgtattgtggggacatcagggcaggcagggcgcgctgtggcaggcagggtacgctgaggagcgagctgccgccggggctgccgcggccgccgccgccgccgccgccgcagggccaggctcagccgtcgctgcggcacagcccgccgcagcgcccgctgcgactgtgaacgaatggaaggagttcaccgcccccgacggtcgcaagtactactacaacaagaccaccaaggagtcgcgctggaccatgccagacgagatgaagcccgccgcagcggtcgctgccactcccgccaccgctccctcgggcaacagcctggccgcccccgcggccaccctggtggggacggccggccctaccgcggccgcggcacaggccgcgctcaaggcggtggaggccgccnnnnnnnnnngcggccggccccaccgcgtccgcggcgcaggccgcgctcaaggcggtggaggccgcccgctcgggcgccaaggccggcgtgtttgtggcccagccggggtccatccagacgggccccaccccccactacgccaccaccgcggaggccaaggacgccttcaaggcgctgctcaacgagacgggggtgtccagcaccaacagctgggacgaggtgtcgcgggccatcatggctga

SEQ ID NO: 8196 - DNA, 786 bp, Chlorella protothecoides
  modified_base (32)..(41): a, c, t, g, unknown or other
  modified_base (708)..(717): a, c, t, g, unknown or other
atgccccttaccaggtgcctgtggcgcgggannnnnnnnnntccattctcccgttccaacccccttgccccttaccaggtgcctgtggcgcgggagcccgacaggatcgatgtgtcagaccttccccccaatcttgctcgcaaggagctggggcagtatcggatgatagacgaagggtttgacctgacactggtactgcaactggaggagccagtgaccaaggaccaggtgctgcgggtagagaggggttcatgcgggacgcctgtgagcctcaaggcacctgcagaagagccctgccacctccaactaggtccggagaatgaaattttgaaagaaagtgaggctgccccttgcctctgcctccaaacagtctcctcatgcccgcacctccaccctacccgtgcaggctttccacctgcacgttcccaagctttggggccgcatcctgccgggcaagtgcggcataaaggtgaatgtgcggaccaagaagctgtttgtgtgcctgtacaaggagaccgacgccgagtggcggtacctcaagggcttttagcttgctttggtcctgatatgaacgtccaacctcttctcctcatgatcactgtgctatgtatgcttgctggcttttgtgatgagatgctcctgtggggtgcattcaacgcaagcaacctcattgccttgtcccatgtcggaagatgcccacgtgggagnnnnnnnnnnttaatccttcttcacatgatcactgtgttctgtatgcttgctggcttttgtaatgagatgctcctgtga

SEQ ID NO: 8197 - DNA, 309 bp, Chlorella protothecoides
atgggccgtgctggcggtacacctgttggggtcggaaacctctactttgtggagcagcaggggctggcgcgggacgagatcgcgaagagggagaaggagcaccggtaccagcgcgaggacttctctcgccttctacgccacgagcgccggatagaggcggagacgccctgggaggatgccgtgcagctgctggaaaaggagccggagtggaaggagcttgagagcctggaggagaagcgggagctcttcgatgccttcatcgccaagctgaaggtgcgtgtggtgtgttgcgagagggcggcagcgtga

SEQ ID NO: 8198 - DNA, 831 bp, Chlorella protothecoides
atgcccgaagcggggcccaggcatggacccaattacagggcaggaatactgcgccggtctgcagcaaccgccatacaagtcagggcatccagcgcgaggaccggccctgatctgggcagcttcctgggcgccgggttatctcgcctccagaccatgatgacccccgcgccgccgggctttccaccaggccccggcggcgactgcgcgctgcgcctgctcagcgatccgctggccttcctgaccgatgtggcgcgggaccacggcccggtggtgggcctgaccctggccgggtcgcgcgtggtgctggtctccgaccccgccgccgcgcgtgacgtgctgcaggaccggtccgacacctgggtcaagtccggcaccgccttcttccccggctccagcctgacaggggacgggctgctggtcagcgacggcgccacctggcgccgccagcgccagctgtgcacgcccgctttccgcgccgcggcggtggccgcctacgcgggcagcatggcgcgctgcacgctgcgcacgctgcgcgagcttgacgccgccgtggcggcggcgggagacgacggtgcggccctggacctctaccccgcgctcaaccgcctgaccctggacattgcgctggaggcgctgtttggctcggcgctggagggcgagcgcgcggcgggggtcacggctgccatccaggaggccttcgaccagttctccgcgcgcgtggcgctgccgctgccagagtacctgcccacgccggggaacgcagcactggcgcgcgccgtggaacggctggacgatgcggtgtatggcctcattgcgcggcggcgggagtga

SEQ ID NO: 8199 - DNA, 909 bp, Chlorella protothecoides
atgggcggcgtcttcctcgccccggcccagatcgccggccactcggtgtactccgccttccacctgcagctggctggcgcagcgatcgtccccggcggccgccggtccctgcacatcgggctgggcgccggcaccgccgtccgaggcatgcagcgcgccggcgtggtggcagacagagagcggggacaaggtcgtggcccgatcaactccttcatcatgctccttctctcctcctcctcagatgtgctggaactgcaccccgagatcctgacggcggccagcgccgcctttggcctgatcccaaagggcctgggctccacagacgcgggactcttcctggcgggcgatgcgctggcgacggcgtcctccctgcccaatggcacgtatgactacatcatccacgatgtctttgcgggcggggaggtggctgggccactggtggcgaccccattcctgcgcctgctggcctccaagctccgcaggccgcggggcatcctcgccgtgaacttttatggggaggctgacgaggggctgctgcgcctggcgtgcagcctgcgctcggtgctgccccacttggcggtgctggcggacgaggaggaggcggcggtgaggaaccatgtgctcctggcctcgtggtcggccgtggaccccggcgccgcaactcccgccgccgcggcagcgctgtgcgaggaccagggctgcgccaaggtgctcgccggcctaccttcccgccaccttcccctgccagatctcgagcagcgatgtgcagcactggatcaggggagggcgggaggcggaggcggccgcagccccagcttccggggctgggtggcggcggggcggcaggcggcggaccactggtccgtcatgaggatgcagatcccagatcccgtctggcgatgctactga

SEQ ID NO: 8200 - DNA, 2991 bp, Chlorella protothecoides
  modified_base (1136)..(1145): a, c, t, g, unknown or other
  modified_base (1226)..(1235): a, c, t, g, unknown or other
  modified_base (1265)..(1274): a, c, t, g, unknown or other
  modified_base (2905)..(2914): a, c, t, g, unknown or other
atgcagtgtggcaaggtgtgtccccaaggttgtggggatgagagttccgggtccaggggtccatgcgcacaggcaggaaagcgctgcggggttgagggtgaacagggtgcatgggagtttgtttcttcggggggaggggggaaggagggaggcgccactgtcatctgcgccgccggtcacgggacgcaggccccggcgcgctcactgcacgacgtgcatgaggggcgggtgcgtgatgacggccgcggcctcgaacatggcgtcggtgccgatgcgcgcggcgtcgaccaggaggctggcctcctgcgcgtgtccacgcatgcgtcggtgctgggtgaggtagtaggagaaggtggaggagccgaagccgacgaaacgcacggcgcgggccaggatcaggaagtccagcagcgcctgctgctctgtgttgagctccgccagttcgaaggcggggacaaactggttcttgatgaccacgcgcgaggccaggcccttgctgagcaggacgcgctgcgcgtaggcccactccttggaggcgccgtaggtgagcaggcccgtggcgacgtacagcggcgtgcgcgcatccaggcccgcacggcgcatggtctgggtgtacaggtgccacatgcgccccaccccgcccatgatgatggtccagtcgcccgcgtctttctccacgcgcaggtgcacgccgttgaaggcgggcacgccggcggccgccatggccgcaaccgtgcgcgccgccagcgcctccagcgcggcattgaaggggagcagcgccgccacgcgcgtggcaagggccgggatgcgcgcggtgcgcagcgcgaagaaggtgcagggcaagtccagcaccaggtagtcggtggaggcagccaggccgggatccaggtcgcgcaggtgccgcgccagcgtggcgcggctgcgcgccaccagcgccgccagcgggctgcgggccaggtacacgtcgggcaggcgcaggatgaggcgggggtccacgtcacgctgaatgaaggcggggaaggccgtggagggctgcgtcaggttgggggcgggctgcaagccgggcgtctgtgtggggtggtggaggaaggaggttttgggagggggggggaaatcagagctgggggaggggagcnnnnnnnnnncaagccgggcgtctgtgtggggtggtggagaaaggaggtttggggaggggggaggcaaatcagagctgggggaggggagtnnnnnnnnnncaagaggctgccgactcagtgcaaggctgnnnnnnnnnnacatgtgccgggttgtgggtgtgagactcccaaagttcctggggaaggtgcactgcctggcaggctccacagcacaattaggagcgggcaggcaccaagaggctgccgactcagtgcaagtgcaggccaaaggagttgcggaagcaggccggcggtagcaccacctggcgggacgaggcagggccgaggatggggctcagggcatctgcgcgggtgctgccccgggcaggcgcgtgcgtgtggcacagctcaaagtgcgcgcccgcttgggtccccgacgcaggcacgacctcagtgcaggggaggccctcacctctgccctcagggctgtggccaggatgaaggcggacaagtggctgtactgctgattgatgagcccgccgcaggcgctgtacctcagcaccaccctcctgcccaggctgcgcgtccctcgaagccactccctgagctcataatcgtcaccagccgccccagtgttgttcaaaaggttcttggagacgagcgtactcaacaggctgcgctgcacggtcccagagcggcttgtcaggatggggtaccctatcaagccgtgtatgagcaggagcacacctgctgcactcaagagcaagagcaccgccgatctcgggaagctgcacctcaggacagccgcgagacccgtcgattgatcatgcacagtccaagatctgtttgcacggtcgaacgtaaagttcctttccgctggaggaagcaacgcgttgcggcggtgaggttcatctaccggaggtccgagctaggtactgtgggtgatggcactcactgccgcgctcctggccaccttgctggctctcagtgcggtcgttctgggagcggatggcctctcctggcggctatttgccgggagggaggagtgcatctcagagtacataccggagcaccagtactcacacctgtcgtgccatactcttggcagggaggagtgcatctcagaatacataccggagcaccaggtgcgtcgggtcctgcgttgagctcatggcctggcattgaagctttgggatgcggtgaagagccatgcaacagatgtgtcactcgcacaaggcatcgtcgacattggagtgctggtgagctgggacctggccctcccactctgcaaagccctggaagctcatggtgcctccccctcctccaccccccacccccccagatcagcagccgttacggtactgaggccaccaaagccacggtagacttcacgctgtacgaccccgcggggcgcatcatccacagcgaggtcgcggtgtcctccgccgaggccactgtcacggggcacggcgggcagggtccctggcgcgcctgcttcaaggtcagcaggcagcagatcctgcgcccctctgtcatcgtgcgcctctcctacttcaccgtaaactcgcccacgctggtgggcacgcactttgagtggcagcgcacgccgcccgaggcggggggcatccagctgagcccgggcggcgtgacggcgggggagctgggagcagggagaggcacgaggggctgggctctcgaggcgcgaggcggcagggacggggcggacgactgtgagccgccaggtgcccaccccttcccagagcatgatcccaccgggcagcgccctgccnnnnnnnnnnggggcggacgactgcaccaacgaccaggtccagagcctggccgacgggctgcagcgcctggactactacctgcataa

SEQ ID NO: 8201 - DNA, 1215 bp, Chlorella protothecoides
  modified_base (139)..(148): a, c, t, g, unknown or other
  modified_base (446)..(464): a, c, t, g, unknown or other
  modified_base (526)..(535): a, c, t, g, unknown or other
  modified_base (784)..(793): a, c, t, g, unknown or other
  modified_base (875)..(884): a, c, t, g, unknown or other
  modified_base (966)..(975): a, c, t, g, unknown or other
atggctgctgagccccctgccaatgtctccactgcaggtggtcctgggccatctgcacagacacatgtgccatttgccggaataacctttacgagcctagcattgagtatcaggccaatccctcaggtgaccctgaccnnnnnnnnnnaggtttgtgaggtgtggccacccaaggtccacctccctcaaatgatgccgctgttatgcctccctgcccttaccgtgccattctgtgcaggtgaccctgaccaccctggcctgagcattgcgtggggatcttgcgggcatgtcttccacctcgactgcatccagcgatggctcaaaacaaggagtgcatgcccgctctgcaataaagagtgcgtgggtgggtggtggcgtgcaggccaagatggtactgaggacttcgttatctttttcagaacgcgagttgctgatcggggtgtggnnnnnnnnnnnnnnnnnnnaccctcaaatagtccttctggtgcacctctcccctgcctcgcctctccagctctgctctgcnnnnnnnnnncactgaggactttgttatctttctcagaacgcgagttgctgatcggggtgtgggagtgttgtgccatttgcacggtctctattccctcagattgtccttgtggtgcaccccttccctgcctcgcctctccagctctgctctgcatgctgtcctgggatttgggatcctttcccctcaccataatgtgtttcaaccaattcaatacgctcatccccttactcgcaccatgcataggtgggagttctcaannnnnnnnnnccctgccaggcattctgccctctttgcacaggcacgcatgtacccctgtcatggtgatcctgccccaccctccttgcgcccnnnnnnnnnntcctgccaggcattctgccctctttgcaaaggcacgcatgcacccttgtcgtggtgatcctgccccaccctccttgcgcccnnnnnnnnnncttcccctcaccatgatgtgtttcaagcatttcaatgagctcatccccttcctcgcaccatgcataggtgggagttctcaaagattgagaaaatcctcccgggaggcactgccggcacagactgagggtgccatcgccaatgacccgccggcacggaaagccgccggaatggctgctggtgcaataatcggcggggggtgcgcctcgacaatgtgggaccatgggtctcaaaccggatga

SEQ ID NO: 8202 - DNA, 459 bp, Chlorella protothecoides
gctccggtgcgttgggcggccttcgtgcgcgccggcgcggcgctggtcaccgcctcgcccgaccgcggcgtgggcgtctgggacgcggccaccggcgcgcgcctgggcgggctggagccgggccagggcagccgcctcaagtcctttgctgtggatgccgaggcgcggcgcgcggtgacctgcctatgggacagcaccgtcgtggtgtgggacctggagcgcgcccaacccctgcacaccctgcagcgctggggaggccccagccaggacctgcagggacacaccgcaggtaatggtgggggagtgcgtggggtgggtgtgaagaggagctgtgtctgtgggtgcgtgcggggaggaggggaaacccaacgtgccgtggcaatgcgagagggtgtgggtatggggccttgccagggaagcacatgctgggcatcggcgcgcacagatcctatacattag

SEQ ID NO: 8203 - DNA, 612 bp, Chlorella protothecoides
atggccacgaccagctactccagccaggctctggccggtgccagcaacgctacactttcaagaaccatcacccccgttctacctccccgccacaagcccgccccccgcttccgaagttcggtggtcccggcccaggaggtctctgccgtgtatgcagcccctgcagctcccacccccggcttgcggccgttgccccgcgaggacgagaattcggtcgataatgtgaacctgggcaaccctctgcaacgcgccgagcgactgagccccggctggctgggagtgttagcggacctcgagggggtggtcctggactacgataccgcggaggtctcagaccgatcctggcagcagctggccgaggaggaaggacgcaagcctcttcccgcatgggcgttgcgcaaggcggagcacatgaagaatgagcaggctggaggtcgctcggctcgccgcaaggcgggaggagctgtatgcggaggccctggcgtcgacgtccctgagggtcagcccgggtctcccggtcttcctggacaccctggcgcggctccaggtgcggtcctcttgtggctggctggggtgggctcagcctaccgcagggttccctgggatccgtga

SEQ ID NO: 8204 - DNA, 372 bp, Chlorella protothecoides
atggactcacctgccctcttcccctacctctctcagcacctcaaacctcatcatcccccgaaatccaaaccctcgcagtccatcggccggccgccgctgcgctgcgtcgtgctggcctccagcaacctgagcatcgaggcggcgcgggaagccgggatgaaggtggtagccctggccgcgcgccggcccgcgtacgagctgaccgccgccgactcggtggtgcgccaggtggatggcctgagcttcatggacctaaagcgcctgtttgcgcgggaagccggcgcgcagctagtccccctggccgagcccgaggcccagccggcgtcgcgctgggcccagcccacccccttctccgacgccgaccccgagtga

SEQ ID NO: 8205 - DNA, 963 bp, Chlorella protothecoides
atggacatcaagcgcaacaagatggagtggttcaccacgcctgtgaataccctgctggatgtccctagggttatcgagaactggaaggcattgggcatcaaagtttacgagcccgcccccaacctgacgcagccctccacggccttccccgccttcattcagcgtgacgtggacccccgcctcatcctgcgcctgcccgacgtgtacctggcccgcagcccgctggcggcgctggtggcgcgcagccgcgccacgctggcgcggcacctgcgcgacctggatcccggcctggctgcctccaccgactacctggtgctggacttgccctgcaccttcttcgcgctgcgcaccgcgcgcatcccggcccttgccacgcgcgtggcggcgctgctccccttcaatgccgcgctggaggcgctggcggcgcgcacggttgcggccatggcggccgccggcgtgcccgccttcaacggcgtgcacctgcgcgtggagaaagacgcgggcgactggaccatcatcatgggcggggtggggcgcatgtggcacctgtacacccagaccatgcgccgtgcgggcctggatgcgcgcacgccgctgtacgtcgccacgggcctgctcacctacggcgcctccaaggagtgggcctacgcgcagcgcgtcctgctcagcaagggcctggcctcgcgcgtggtcatcaagaaccagtttgtccccgccttcgaactggcggagctcaacacagagcagcaggcgctgctggacttcctgatcctggcccgcgccgtgcgtttcgtcggcttcggctcctccaccttctcctactacctcacccagcaccgacgcatgcgtggacacgcgcaggaggccagcctcctggtcgacgccgcgcgcatcggcaccgacgccatgttcgaggccgcggccgtcatcacgcacccgcccctcatgcacgtcgtgcagtga

SEQ ID NO: 8206 - DNA, 621 bp, Chlorella protothecoides
atgcctcccaccccgctggggcctgccctgcccccgcacctcgccgcggagccctccgagcactttcccacatcggcaagctacgagctgaagggtcatgaaggacccgtgtacgccgtgcgcttcaacagtcaaggcacctactgcatgtcctgtggcaagggtcatgaaggccccgtgtacgctgtgcgcttcaacagtcaaggcacctactgcttgtcctgtggcaaggtgcttggggtcgatcggagggcggatcgtacgcttcgtctgtggaacccacacaccggcagactcgtgaagacgtacactgggcatggatatgatgtccgggatgtgactgttaccaaggacaatagcaactgccatcctcagcctccatgtgccctcctcggccaagctgccagcgtgcgcctccacctacttctcctcccgccaggcatccctactattttccctctcaacctcacacaccacccatatctccctcctggccaggtttgcgtcctgcggcggagacaagcaggtctttgtctgggacgtcgggtccggaaaaataatccggaagctgcgaggccacgatgcgcccatcaatgcggtatgtgctgtctggagtcatga

SEQ ID NO: 8207 - DNA, 2757 bp, Chlorella protothecoides
  modified_base (881)..(890): a, c, t, g, unknown or other
  modified_base (2288)..(2297): a, c, t, g, unknown or other
atgcctgacctgagccagatcttattgaggccacatgcacaatgtagaacccttatcgtagctattgctttgatattgctcgttgaaggcgcgcttgcgctgcagatctctcctgtgcagcgtgcactggctcagtatctgaccaatgaggagctgagcacctacctccaggattatcagagacgctgccgggacatcgcaaaactgcacgtcatcgggaccagcgttcagggcaggcagctacgactggatgcaaactccatcaatggggcgatctacgcgcaatggggacatgccgcagtgctgaaaaaccctggcagtcatcatgtaacgacaggaggaagaccacattcacacagtccccaaacacaggcagctgctggcactggagctggctgcatcgcccgggtcaacgaatgcgctgcctcacttcagatacgtgggcaacctccacggcaacgagcccaccggccgcgtgctgactctggctctggccgacgccaaccccgacgggttcgaccagcggacccgggaaaacatgtgcgtgtctttaccataaccagtgactgggaggcaaatgcctgggaggatgagtttggtgcctgcgcgaagatcgaccccgtccgagtcgggtgcctagagatgtgggagcagggtgattgggatagctcttcccaccaacacagccattcctggccgagatccactcctgaggggttctcaaagccgccgagcttgatgccaactggcagcgagcaagcagaggtccgggctctgatggactggagccgccgcattggcttcactgcctcggctgcgatgcatgaggtgggcatgcaggggctgatggacggagggcggccgggattgaatccaccagnnnnnnnnnnatttgagcaacaagggtgggtatatgcactgacatgctggcattcaggtctcgcgagggaggcggccgggattgaatccaccagcacctcccaactgtcgagtcagaccaggtccctcgggcctgaccagatgaactgtaaagggagcatgtacacgtacaatgaagaggtgctgcttacgcacatacgctctcacacatccacatgtatcacacacccactgcagggggcgctggtggccaactaccccatggatggcacgccagacaggtcgacccagtacgccgccagccccgacgacggcacgttccgccacctggcgaccaagtacgcgcaggcgcacacgaggatggccttgcccacgaacaaggtgggcgcgtgggtgcacgcatgcggcgctgcatcagtcgtcctgcccttcccagccccaggaatcgacagagtgcacggtcaccatcccatcacaggagtttccgaatggcggcatcaccaatggcgcggcgtggtatcccatctacggcagcatgcaggactgggtctacctcgcgacaggctgcttcgagctgacgctggaggtgtcggagtccaagtggccacccgtggccagcctgggggcgttgtggaaggagaacaaggcatccctcctgggtctgcccctgctggctgtgctgggagggtgcgtacgatttgggggggttggtcagaggggctggcatgcaccagggtgtggagcaggggatgtcatcctggagcagcagccgcggctcaattcggcattgtggctgcagctagtgcacaagaacagagagtcaccgcatcgatgcttgtggcctccaacccactacgccagggcgggattgacacccctctccgcgccaacgtcacgggtgcgaggatgggttggggctgcctgcctgggaagcatgaggagaagcttgtcggtggtttaatggcgggatcgacacccctctccgcgcaaacgtcacgggtgcgaggatgggtcggggttgactccctgggaagcatgaggaagcttgtcggtgtggcgggcatcgagaccgtggtgcagagccgggagggcaccggcgtgtttgcacggcccctggcaccggggacttacgagctgcaggcgagggcacatggctacaccactgctacccagcagaccacggtgcccgacgacgggacgggcgtggaggtgctctttgagctcaagcgggtggcatccagcggcagggccaggcgggcgggcggcgaggaagccgccgacggcgccgcggcgctcgactccgtggcagcctggggtgtaaaccccggcggcgctctcaggttggaacccctgcgtcacaacgtgctcctcgtctctgccggcatcgtcttgctcctcgtggtgtggtnnnnnnnnnnacgactccgtggcagcttggggtgtgaacccgggcggcgccctcaggttggagcccctgcgtcgcaacgtgctcctcgtctcttccggcatcgtcttgctcctcgtggtgtggtttggtggatggcggctggcggccacccggagggggaggagtctccagccccgcacagtcatctccatccccctgagcagagttgcggcgagtccaaacaagccggtcgtctgctgccccagaaggcggtctgtcttgggccaaggggtcggccacgtgctgccatgatcctctttgttcccctccaccggagtcttaacccatactgcacagcagttccaagggaaatgccggcgatggaactggctgcatctatgcttcatggccgccagccatctttcgatcatagatatgcactgttcaccccactagtggaactaggaagtggcgggagacttccagcatag

SEQ ID NO: 8208 - DNA, 1260 bp, Chlorella protothecoides
atgccccgcgcctctcccctggacccccggtatggggcgtccaaggcggcggacgcctcgacgcagcaagccaagttctcggtggtcatcgatgccgggtccacgggtagccgcgtgcacatcttcaagtttctgacctccgccgcgggggcgcaggacctgcagttcgacaagttcgagcagctgaagccgggactcagctcctacgccgcggaccccaaggctgcggcagcctcgctcaagcctctcctggccctggccctggagaccatcccagaggcgctgcacgcccaaacccacgtcagcgtgggggccaccgcggggctcaggatgctgccggggaccaaggccgacgacatcctggccgaggtgcgggccctgctcaagacctaccccttccagtcagcagcgtcggacgtgtccatcctgaccggggtcaacgagggcgccttcgcctggctgaccctcaactacctgctgggccggctgggtgagcacgaggaccgcaccgtggcggccatcgacctgggcggggggagcgtgcaggaggcctttgccatgacggcgaaggaggcggcgggcgcgccgcacgccaactacaccaccacgctcagcggcggcgggcggcggtacagcgtgtacgtctacagctacctgggctacggcctgatggcggggcgggcgggggttctggccgcgcccgccgacccggccgcgccccacccctgcgtccccgtgggctacgcgggcgagtacgagtacgccggggtcaagcacccgatgcgcggcggcgaggcggggtcggccgccgcctgcgccgccgtggcggccagcagcctcaatgcggcgctggagtgcgccgcgccccagctgcagtgcagcttcaatggggcctggggcgggggccgcgtgccctccgtcttctacatatcctcctacttctgggacagggccgtggacgcaggcctggtccccgaaaccgccgcaatcgaggccagggtcaagccggccgagttcaagaagctggcggacaaggcctgctccgccaagctggcagacctgggcaccctcttccccaacgtgcaagaggcggcccgccctttcttctgcatggacctgtgctacgtgcacaccttgctgctggagggcttccgcgtgccggaggagacggaggtgaccatcgtaaagaaggtccagtacaagaaggagcaggtggaggcggcgtggccgctgggcgcggccatcaacagcctgggctga

SEQ ID NO: 8209 - DNA, 1044 bp, Chlorella protothecoides
  modified_base (658)..(667): a, c, t, g, unknown or other
atgcatgcacacagaagcactccttcgagaccacaatcccgtcgcgccctacgaaacccctgcactgccagccgtgcaggtggacgccaagaatggaatattcctcgacatgaattcgcagatcgcgcattgctagtagccgtctgggcgtgggcagtgcactgcagagtcgcatggagttgctgtagtggtggggttgggcgacggttgcagaccttcgacctgccccgcagcatcagcttggcggtggccctgccctttgcgcaggagcgagggaggcttcgcaccatgttcaccaggggtcagttcgcgaccatcgcggccgcgaccgtgacgacgcttttgttggaaatcaacaaggccatgcccactccgtacatggtgagatcggtggagggcggtcggagaatccatggtggatcccatgcggacgaggtcttccatgttggccagacccagcgatactgtcgcggtgaattctgggagtgggaccccaagatcacgactttccctggcctgtacctgatcgggagcgccgtcggggtgctggcagacgcattgcaaataggcccacaggtatgtgttcaagtggccagtccctgcctctgtttcgcgaatagacacccttgttgtcttttggcacaccggcgagcagcannnnnnnnnntgttcaagtggccagtccctgcctctgttttgcgaatggacacccttgtcgtcctttggcacaccggcgagcagcgtccaccccttcagtgtcactgcccccttcatcaagcacaggggtccatctgcagcgtggccgcgctccgcaccgtgaccgtcctcctcgcagtggcctgcgtacccgtcttctttgccacggctaagctggcggtgcctgcacgcaccgaaacccaagccctcctcatcgtgagcgctggcgtcagcaatgttgatcaagtggtggggtgtggtcttgcatcatggcctcgcaggcctggcgggagcgtgtcagcagcgaggcagtgggcgtcgctgccaatgccagggccgcgccgctga

SEQ ID NO: 8210 - DNA, 819 bp, Chlorella protothecoides
  modified_base (114)..(123): a, c, t, g, unknown or other
  modified_base (181)..(190): a, c, t, g, unknown or other
atgtgccgatggccggagggaattggcccagagtgtcttgtcccgcgagcgagagcctcggagcctccctcaccccccttcccagcccacctgcccaagctcctcggccttgannnnnnnnnngccctgcaggaggaaagagagggagtggtgtgtgtgtgtgtgtatgcagggcatgcgnnnnnnnnnnagcgagtgagagccttggagcctccctcaccccccttcctagcccacctgcccaagctcctcggccttgagcccggcgtaggcgccgggcgtgtcgacaaaggtgatgatagggaagccaaacttgtcggccatgcgcatgaagcgcagggccttccggtagccgttgggctggggcatgccaaagttgcggtagatattctccttggtgttgcgccccttctggtgcccgatgaacatgaaggaggtctcgtccatggaagcaatgccgcagaccagggccgggtcgtccaggcccatgcggtcgccgtgcagctccacaaacttgtcggtgatgttcagcgcgatgtccaggaaggtggggcggttggggtggcgtgccacctgcagccgctggatgggcgtcagcttggcgtacgtctccttgcgcagctgcgggtgattcagggcaggagcacagagcagggctgccgtccgtccaggccgaccatgggcgctgaagcgagaatgaaaagcagtcggcagggccatgcaccagcaccgcctcagcaacgcattgtaaaaccctgcactaaactacagaacaagcctgactgctcacctggcgggccctggcctccagctccttga

SEQ ID NO: 8211 - DNA, 672 bp, Chlorella protothecoides
atgcccactccctcaggccgccgcccaatccgcgtctacatggacgggtgctttgacttgatgcattacggccacgctaatgccctgcggcaagccaaggcatgcctctgggcaaaccctgtggactttggcatgtccctgggcgatcagctggtcctggggctgattcccgactccgagatccggcggtgcaagggtccccccatcctgaacgaggaggagcgccgcaagctggttgagtcggtcaagtgggtggacgaggtgatcaccgacgtcccttacgacctcacccccgccttcctcgatgagctgatcaccaagcacaagattgactatgtgatccatggcgacgacccctgcctcctgccagacggaaccgacgcgtacgagcatgccaagaagctgggccgcttcctcatggtcggggtcgccgtggatcgtgctgctgcagagcccaggccctggagcgcggctggaggcctcgcaaggcctgcacgggtactggcgggctcggggcctgcaacctcagggctccagcccacccccatccccaccccccctgcaacagatcaagaggaccgagggcgtgagcaccaccgacatcgtgggccgcatgcttatctgctcccgggtgaatgccctcaacgagagcgacgagaagcaggcaagtag

SEQ ID NO: 8212 - DNA, 411 bp, Chlorella protothecoides
atgggcaacaccggcactcgcaacaatggcaccggcaacgtcggcaccgagaacgacggcattggcaacaagggtaaccacaacgacggcactgacaacgagggtaacagtaacatcggctttgccaacgacggcaacaacaacattggtacagagaacaacggcaacaacaacaccggcaccgacaacgttggcctgaacaacctgggcaccaacaactttggcaagaacaacgttggtaccaacaacaccggctccaacaactttggctgggccaacaccggcgccaacaacagcggcttgaacaacactggcgtgagcaacagcggcaccaacaacattggcgcctacaacagcggcttcggcaacgtcggtacctacctcaagggcaccaaccagaccaacatctag

SEQ ID NO: 8213 - DNA, 468 bp, Chlorella protothecoides
atgaagaccttcgcgctcacagtcctgctcctcgggacggcctacggggccgcggccgttaagcccggcgagtggtgggtgtaccccttcctcagcaccgcggtggaccaccagaagagggtgctgcaggtggagggcgatggccgtctcggcgcagacatgttctgcaagtccaagggctacttgaagtctggtgacttcctggagctggaggaggccggcaacatctggcccatcggcaccaccaacctcgccaacgaccagttctggactggcgccaacgcgactgcctacctctacatcacctgcctgtccctggagacccagagccccagcattggccagggcgagaacggcaacattggctacaagaacagtggcatcaacaacatcggcaactacaacagcggcgaagcaaatgttggcaaccacaacgctggtgacttcaacatgggcgatggccagtga

SEQ ID NO: 8214 - DNA, 492 bp, Chlorella protothecoides
atgcggaccgcccagctcacggtgggagccggcccgagccggggccccacccccccgaaccgatcatgggcgtcgcctgggcgcaccagagcccgcgcacccttctctccacgccgcaccacgcgggcaatggccacacaggaccctccggatctgcccaaggcccgtgacgcgagcgggaagcagggggactggttccaaatgctgctggcccggttcaacccaatcagcgagaaggccagcaacaccgcggtgctcgatttcgagaaacccctcgtagaactggatcacaagattagagaggtgcgggtatggggcggggcggggcactggaaagctggcatcgccgggcggggtgtcggctttgggtcgcggggcagggcggggtgggaaggcccgcagctgacgtgtgggtgcatgtgccggtgccacgagatcattgccccaccgccatgctacgcccggcatctcgcaggtgcgcaaggtggctga

SEQ ID NO: 8215 - DNA, 1719 bp, Chlorella protothecoides
atggcgtcgtggctgcagcagcgcttgaaggaggcggagggcctgctgcaggccgtggatcagacggcaaagggagttaagagcacggcaggcgccgctttggaaggctccacggacgcccgcgatgctcaccatgcccctccgatcccgcgttctgtgaggaaggaggtccccgatcgcgagaatctgggcgtgcggcgccccctgcgagtctccccggcaacctctgcctccggcagggtctccccatcaacgagggggagagcgggcggcccgccgggcccgcaggccggcccatccagcagggccgtcgaggcgagggaagagaccggcacctccccggatgcctctgggagccctgtggagcaggtgtcccaccccacctctgtggagatgacctgggagcagctgtcgcagcaatccgacggggacagcagcgtccgtcccggggtccaactggaccctcccaacccctcagagggaggagagggggtgggcgagagccccgacgccgcctcggccggcgtgccgggtgtcactgaggagcccgacagcagcgaggacagccggtctgcagagcgcgtgctgcgctccatgggtgaggaggcggacccctggggaggcccggccccggcgctgggccacctggtcggccccgagtctgacacagcggccccgacgccccacccccggctggatcggccgccctttgcagccgacgcggccaccgaggaggacgaacgaacacccccactcctgcccggatccacgggccaaggccaagaagggctggacgatgcggagccgcgccctgacattcgccaggtggccagcgatgcccgcgaggcgcatgatagtgtcagggatgtggctgagcctgatggttttgcagacgctcaccatacaccacggctgggaggctcggtaggagctggcatggccgcagtgggcaaggtaggcggggccgagagctcgggggacctccagcagccgaccgaggctgtgcctcttgcgcccggcgaagaagcagcggcagcctcgacggcgcaggcggcctctgggggcgatgaaggggaccctgtccctggaccccgggcgggaatgccatcgacactgggggccgagacgtcggcctttgaagaaggcgattcccgggatgcgcaggatgagctcggcactgcgccgctggaggatcagccagaccctggcgtgtcgggggaagcggaagacgagccggggcaggctgcttctggcacaggagacacctcggaggcgcctgcgaccgacggtgtcattccctctgaggaggcaggccaagacgtcgccgtagcgatggcggccgcggcgacgactttggcgccagcgtcagcgccgacaggcatgcctcctgccgcgacaccggtcgacgcaccagcaccgaccgctgcgacggcactgcccgcagcgccgaccgcgctgcccgcggcctcttcctccggcaccccgaacccagcgccgcagcaggcgcaggcgcgggaggcgcgcctggtgcgcatggtggagcagctgaaggcccggctggaggccgcccgctccgagaacgagcagctggaggagttgctggcgcgggccgacgcctccgcctccggccgcggcggcgaggtggcgcggctggaggacgagctcgccgcgctggcggcggccaaggtctcggccgaggcggggctgcagcggcggctg

SEQ ID NO: 8216 - DNA, 1002 bp, Chlorella protothecoides
atgaacctgcgcgagatgttcaacttccgcgtgcccatcatctccatcgtgatcggggagggcggctccggcggcgcactggccatcggctgcgccaaccgcatgctgatcatggagaacgcggtgtattacgtggcctcgcctgaggcctgcgccgcaatcctgtggaagtcgcgggacaaggcaggcgtggccaccgaggccctgaagattacgccccgcgacctcgtcggcctcggcgtcatggacgagatcgtgccggagcctctgggcgcagcgcacaccgaccccatgggcgccttccccgcagtgcgcgaggcggtgctgcgccactaccgcgactatgtgggccggtccgccaccgagatcatggccgacaggtacatgaagttccgacacatcggcgtgtacgaggagttcctggtggcggggggcgacgtcgaggccgcgcgcgcgcagcgggaggaggtgggtgcagggctggtgggccggggggttgggggagggggggagagtgtgtgtggtggctgggtggggcatgtgtgtggaatcgtggaggcaggggagtcaacaagcttggccccagggggccggtcgaggcagagggattcaacaagcttggccccagggggccgctcgaggcagagtgtgggaggcgccgggccggccctatacccatcccggcatagtgagcgcccgcccgcagcttctcaacccctttcctccccacccattccccctttccaggccccgggagcatacaccaaggcggggacgtgggcgcccacggaggctgacgcgcggtacatcgagaagtgcgccgacgccgacgagaagtgggagcagggatcgaatgtgcgcgagggtgtcgcagccacccgtggtgcggcaggcaggacggcgccggggcgtgccgggatggtgcggggtgccctgggggagggagacggggcgacgcgcgcgctgcctgcctgtgtcctggaagcctctgcaccgaagtag

SEQ ID NO: 8217 - DNA, 2445 bp, Chlorella protothecoides
atgtgcgcagggtcaaggggagggtcttggatggggtgcctcatcaccatgatcttctgccacgcagcagtcccgacccaaccaggaccgccccccatctcctggcatcaggtttttggggtaccagacgccagatacggggaggagctctgtgcatgggtcagaacatggtgcgccgggctaacgccttgcacccctcctctccactgcttgggccgcagggaccatgcctccgcgagcgaggacgacataagggcctgggctgccgcgcgagtcagccgccacaaggttccccgctacatcaagtttgtgcactccttcccccagacatgtgagcggtgcatcgcttgctggtcgggaggaccccaatcagtgtcagccctgccaggcccgtgccttccgcctgccgctacgcatgtcacccatttctttctcaccctccacagtgagcgggaaaccacagaagtatcttatgcggaagcaggccatcgcagagctgggcctggatcgggcggaggcggtggaaacggcgtgatgagcttattggatacgttctttgatgatgccatgctggcccctgctccgttcctgtggttggctgtgtggacaccgctggcattacacacatgctcacagtgtggcgagcaacaaggattgggagaggaacacctctgggacgtctgtcaacatggcctagaatgtgcacccatgcgatacaatgcaacagtcctccgtggtggaggaatatctgctggggtcaacagccgccaggcaactgtgtcgccagccaggcctccagcgcatcctggctggccgccgccggtgggcaggcccccgtcgacaggatgcccgacaggagcaccgtcatcgcggcattctgcctttccagggccgcagcctccgcctccaggccatgcactcgctgctgctgcctgcacatggggaggcgcagcgcttgaatgtggaaagccaggcccagctgggctgccagcgctcgaggacgggtgcatgcagaggagggctgtctcccggtttcgctgtcgccgggcgtcccgagcctccgcttcggaggcgaagcagtacctccgcttcgcacctcgaccccgccgcttcccggcggctgccgcacagcgtgggttttctggagcaacatggagaagtgtggagtctgcaactggtccaggcaagagagggcgccgtgcgagggcctcagagccggagcgggcctccaagctaccacaagctcatcatccaacatccccacggccctttacaagctcatccgcctctgcctcacctggcttgctgttccctgcgtggctggttgcacttgtggaggcggactggaggcaggcgctggtgtcaagcaggctgcaaagatcaccatcgtctctccacagctcctcaaggccgtccagaaagctgccacagggcgagagcccgctgctgcctgtcacgtcgctgctttgcgcctctgatcctagattaagatcccaccggaagcccgttgctggccaccccccgttccctggcgatcaagactaccttgccacgacagctgcggcacaggcaaggccagggggaacagctggccctgatcaacaaactgcagtgccactggggaggaactgcggtgcatggtgcggggacacgcgatgttggtcccaggggggccgggagacgagggctgggagggggtgccaaagggacccccctccagtctgtcaccctggcccgccccatgaagggaactgtggagagatgggtggtagggggacacgcatccccgacgcagtgctaactggtccgggtggtaacggctacggtgcaaggatcaggctgcatgcacgtgcagcccggaccgtcgcgctaccttcgaagcaaggcgcccgagtatggggagccagcccccgtggatggggggctgggatggtgcatgggcatgcaatgccccacagtcgccggctcgtggggatgcatggccagagtctcactgtagaaggaaaagcggggacggatgctggggatgggttcactgtcaggtggtgcttaggggaagcggcctttcggacatcagctgtaccttccgggggctgggtgggagggacggcatcgtcgcgtgtggcgtattgcgacaagcaaggccaatcgtttgacccgggaccatccaccgatccacacatggccctttttcggacgcaagtcgaccgttacatctcaattctgcttgtatgctccgctttagctcatcttttgatctctattgcttgcagtgacaaacgcgcattctgcaaaagagccgcacattctgcaaaagagctgcgcattctgcgaacgacccttctcataactcgatttgcctctttacggctgatgaatggttcatggacgtcaatgacaagacatgttgatcagattgatacatgtcccagacatggaagatga

SEQ ID NO: 8218 - DNA, 930 bp, Chlorella protothecoides
atgccacagcgtcctttgatccggccaggacccttgcggcagtgcaggcagagcgctgcacgtctctcctgggcgtccccaccatgttcatcagggagctggagcttgacaatcgtgaggggcgaatgcaatcagccaggcagagaccatgctgccgcgaagcaggcgtctgccttttcctgggtgcatccaggtggccccacctcccccagtgtaccctttttccgaaaattgaccccagcccgccctccacacagctttggcgagtatcgcctggatagcctacgcaccggcatcatggcaggcagcccctgccccgtggaggtcatgcggcgcgtccagtccgagatgcacatgagtccagtcaccttctcaccttcctcatcacaggaggtcaccatctgttacggcatgacagagacatccccagtgtccttccagacgagcatccaggatccaattgagcggcgggtctccacggtgggccgcatccacccccacttggaggccaaggtgatcgaccctgtgacgcagggcatccttgcccccggggaagtcggggaactctgcgtcagaggtggggcgaactcgcttttgctgcggagtttgtttgggatggacggcaggatggctggtttatcagaaatacacgacaattctgctccgcacgcaggctattcggtgatgcaggggtactatgatgacccggaggccaccgcggcggctgtggatgcagagggctggatgcattctggggatctggtgacgctggacgccgaggggtactgcaacatcgtgggcaggcgtggaggggtctgctgtctggtacctttggggcatggagcaccatgtactcaaatctgctcccctgagaaggactcccgttgggcgaaagagatcccttcctgtgcccgtcacctgacaggatga

SEQ ID NO: 8219 - DNA, 351 bp, Chlorella protothecoides
atggcctacctgggcctccaggtcgcaacgatgcatcacaagttcgacctgggcctcttcgtgacgggcgtccccctggcagtcttctcccgcgccgccaacgtctttccctgctccttcatcctcaaccagggcctgcagcaccgcatgccccgcaacctgcagctcatgctctgggcggtgggcttgcggggcgccgtcgcttatggcctggtggtgaacctcccacgcagcgacgcgcccggggagacgggcgtccccgccatcgagaccgccacgctcttcatcgtggtcgtgtccaccctggtcatggggtctgccacaggtaggagcatgcagccaatttggtag

SEQ ID NO: 8220 - DNA, 633 bp, Chlorella protothecoides
gctcggccatctcctccatagacccggtggccaccctggccgtgctgacggacaccgacgtcccccccatgctgtacaacctggtgtttggggagagtgtgctgaacgacgccgtggccatcgtcctcttccgctccctggccaagttctatgacacgcccatgggcctgagcagcctgctgggcgtgctggtcagcttcgtggccctggccctgggcagcctggccatcggtgtggcagtggccctggccgccgccttcctgctcaagcgtctggagcggccggcggcggggcgcagccacgtggatggtacgctgtacgagatcgccatcgtggtcatgggctcctacctcgcctacctcctggcggagctggctggcatgagcggcatcgtcgccctcttcttctcaggtctaggctgctatttaagttttgctttctgcgggggggagagggtggccggagggggggctggtgggtaccgctgccaggggccgagtctggagaatgaccccggtgttcccaggggtgtcattggcatcacatcccttggtccagcgactcgcatgagtaccccttgctcaacgatgctgccaccccacaacccccgagcacaacaccgtcccaccaagt

SEQ ID NO: 8221 - DNA, 2211 bp, Chlorella protothecoides
  modified_base (570)..(660): a, c, t, g, unknown or other
  modified_base (727)..(736): a, c, t, g, unknown or other
  modified_base (803)..(812): a, c, t, g, unknown or other
atgcctcccgattgcaatgatgatgcccttggtcactttgttggtgtgattcaatccccggcggctcacagcagagacgatgggctggtctatagagggggtgagcgggactgcggcaatggcgcagcgcagcagccatctcggcttcccatgagtagcatgtgctcggcttgcaatgatacaccaggcagacgccgtggcgcgacatcaatagccctcgcccgaaccctgaggagaagtcatggcaacaatcgggctgttgcaaagagctggaggttgcctgtctccatccattcgggagttcctgtgcctctcccagtcttgcccccccccttcgggcgagaatggggagcccacgtacgccgaaagcctctcattctacgtcctggacaccggatcagtcctgaagagcgtccaagatgtgagttggatggggcgatggtccgatcgcgtggatgcacatccgcatgctctgtagattcaaaagagggagtctgtacccatgccctccgtagggcaccatttcctgcccggccctgtgggctgacgcgtccagcatcgcaatcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccgcagccccgatggtggagcaccacgagctcggcagtggggcctggcccctgcgttcccagtnnnnnnnnnnatgccgcagccccgatggtggagcaccacgggctcagcagtgaggcctgggccctgcgttcccagcnnnnnnnnnncgcatgctctgtagattcaaaagagggagtatgtacccatgcactccgtagggcaccatctcctgcccggccttgtgggctgacgcgtccagcatcgcaaacggccgagctcagctcaacattgtctaccgcacagcaccacgcagtcaccctccaaatctctgcactcctctcctcctccatgcagcctggggggccctccgtgcctgcaggtcctgcccttcaagcccatccgcctgcagccccaccgccaggcctccttcaaggatggcagcaccccagcaccggccctgcgcctggcatgccgcgccttcctgccggagcgtatgcacgccaccctgtaccgcatcgtgacctgcctcttcccgcggctggagaccatggaccgggagctgcagcgcgagcgggagcgcggggcgggagagcagcgcagccccggagcaggtggagcggggcctcgcctcgcctgcacccccctgccccaggtccgctggtctcggtgctctcagggtgggcgtggcactccagggtctggtcctgccgttggcgtcccaggtgcatgccacgcgctcctgcccccaaagcctgcaccaggcctcccctctcaccgtgcaccgctcactgcgccctgcagggcgtgaggctgagcgcgcccgacggcaggcacgtgacgctgcgcctcaacttccacctggcctgcctggagctgtgtgaccccggggatggcgcccccgccggcacgatcccgccgccggcctgcctccgctccgtcacctccctggccgaggcccagacggcgctgcagcgggccccggtccacacaccgggggcggggccatcggtcgggggcccgcgttccgggggcaggagggcgagggccgtcgccgccctccccgcctcccccaccctgcccaccatcccctcgtccccgccgcgcgtgccgccacgcgctggtcccgcgccgccgcccatgtccccgctgcacccgcgctgcacgccctcccccgccaagcggccgctgccgacagccgcctccgccaccgccaccgtgcggcagggcctggctctgctggcgcaggagggctcagcgtgcgaagcctgcgcggtgctggcgcggtgtgctgcagcgccgggggcggcggcgctggccgtcgaggccggcgcactggaggctctggtccaggcatgcctgcgcggcggccaaccggggtcccggcaggcagggggcggagacgccgcgaagggtcgtgggggcatcgccgcagggggcccagagggcggcgcggagggcggtgacgcagcagcgagggtaccggatgccggggcgggaagctcgaccgacgtcgactctcctggcgccgcggccggcgccgcggagcgcgtggcgctgctggcctcc

SEQ ID NO: 8222 - DNA, 1422 bp, Chlorella protothecoides
  modified_base (672)..(770): a, c, t, g, unknown or other
  modified_base (1385)..(1394): a, c, t, g, unknown or other
atggcagcagcgacattggctgtgattcgggcccatgcgcccacattcaggtggggcgaagctgtggtgtgtcagcatggaggacacggtgtagatgttgtttcgtatcgtgccccagtgtgcagtctgagccccatgttggctgactcatatcccccacccaggaatcggcacgatcggctggcctttgcggtgcacgcatacctggagtccagaggctacacactggtgtccacgggagcggaagccgatcaagaagctggtcctggaagcaagtttgacagcgtcggtagggagcctgctcccctctctggatggacagatctggaagagcggtacgcattccgttatgtcaatgagcaagggactgcatcgtcttgcccttcccgacccaagctcccagctcgcttgcaccctggaccactcacaggtgcgcacctctatctcaaggcgatggtgctgggaggtaacctggtcctgcagtggcaggacggggggcagcaaccagggtccacaccggcctcactggacctggccctggacaaatatacccgtgccgccgagggcgtgagtgccggctactctgacctggccggcctcgtcggcgccctggccgctgctggcctgggggaaagcgcggcgcagtcggcctcgggacaggaggcgccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcggggcgaggccgagcctgcctatgtccgggatgctggcggcctgcgtgaccccgggtacgccgtgggggaccgggaccggtaccccctgggcctggcgccggccaggggaggggccatgccaggtgagcaggggtgcgagaggggggggaggggggggtgcgaaggagcaggggaaatatgggagctggaggtcagggtgtgctgccggtatcctcagatttccatgtcggcacggggtttccctggctgttgccgctgatggagggcccgccgcgcaggggcgggggcatgcacgtgggacctggcgaccccctgttcgacgacaggctggggcggggcccggcgcatgggggacccaggccaccccccggggcgaggtgggaccccatcgccccgcccggcctgccaggcttccacccagacggcaacctgccacgggggcccccggggagggggggcatccacccagacatcatgcagccaggccctgggcgcggcgggacaggggcagatttcgggttcatgtgatggtcggggatgggaggcagctgtgtggggggcccccgcccttccctcctgacgctgaccaatgcctcccgattgcaatggnnnnnnnnnngacaggggcagatttcgggttcatgtga

SEQ ID NO: 8223 - DNA, 2100 bp, Chlorella protothecoides
  modified_base (898)..(907): a, c, t, g, unknown or other
  modified_base (1490)..(1499): a, c, t, g, unknown or other
gcctgcgccgccgccgtcgtccaggtgcagcgcctcctcctcgctgtcctcgaaggacaggatgtccagcgaggcggcggtctccatggcgcccaccaccgacccctggtcgcagccgctgtaggagctgccgcggctgcgcccgccgtgcatggtggagccctcggagccggggacggcggcgggcggcggcgcggccgccgcggcgtcaaacatctccagcgcggacatgggggtggggagtggggtggcgtgctccgccgccgccagctgctggcggtactgccaggcgggcgactcctccgcggccgggggcccgccccagacgtggggcgggggggggatgggggggtactgcggcgcgtactgcggcgcgtgctggcccatgtactgcaggctgcagcaggggcaggacgcggggccgggggcgggcgcaccgtagtactggcactgatacgcggtctgggcgggggtggcggccgggcgcaggccgggcggcaggctgtactggggggcgggctcgtatgtcacgggccactggccgggggagggggcctggggcacccaggtggaggaggacagggcgcggcccaggcctgggtcctcccggtccccgtaggagctgcccagcatcgtggccgcactttccgcggagtcgttctgcagcgtgaccgcgagcgcccggcgaccccccgcaatcgccaggggggcagaggcgtggagcgggacgttggcaggggtggaggcccgcggcgcgagggcccaaggatggggctcaccggcaagtgcgccgggagggaggatagcaccccgcagaagccgaatgaggtgtggcgtgtgcacccttcgtcgcgcggggttcggcggcgtgtgaaatcacttcaaggtctactctttnnnnnnnnnngtgacagcctgccctacacattaccaatattaaggttcccggtttccctcgctctcacgcgcgcccggggtgcatacccggcaactctcacccccacaggaattgagttgttctatgtgcggttgccaacgtgcgtcccttcgatcgctggtcccgggcggggagcgcctacgcctgggggaccggcggggactgtgtgcctgtatgaatcacgtgacagcctgccctacacattaccaatatcaaggttcccggttttcctcgcccacacggggtggcgtggtgtggtgcggatctcgtgcggctccagcctcgagggcggatgcgacgatcccactcagaagcacttgcggtgcacgatggagggcccgctctcatcgtactctgcgaggggggcgagtcatcggggggacaggggtgaccagatgaccaagggggctgagcgactgggtacaggcatgccgcgccacacaccgccacgctcgcgcacgccagaggcagagcgcgcgagccccagagctcgcgagccagtcacacatgcaccctgcgctgtgcctccatcaaccccataccgacatcaacnnnnnnnnnntcgcgcacgccagaggcagagcgcgcgagctccagagctcgcgagcccgtcgcacatgcaccctgcgctgtgcccccatcaaccccataccgacatcaatagccacacgccttccagccctctcctgcacctgagtcctccctcccccccctcctccttacaactccctcttcctgcccactcaccgctcttggcgatccacatctgctggaaggtggacagggaggacaggatggagccgccaatccagacgctgtacttgcgctccgggggcgccaccaccttgatcttcatgctggagggggccaacgcggtgatttcgcgcgacatgcgatccgcgatgcctgggaacatggtggtgccgccgctcatgacaatgttgccgtacaggtccttgcggatgtccacgtcgcacttcatcaccgagttgaaggtggtctcgtggatgccggggccctccacgccaatcatgcccggctggaacaccacctccgggcagcggaagcgctcggaacccagggtgatgacctggccgtcgggcagctcgtacgtcttctccagcgtggaggagcccgccgccgtggccagctcctgctcgtag

SEQ ID NO: 8224 - DNA, 1023 bp, Chlorella protothecoides
atggcaggtgtgctaaggacggcctgtcgggcagcagctgccttcaccagccgaggggctttcgcccagcagctgcgccaggccttcacgagcgccgttgaggcacctacagtatgggtgttcctgggaccaccgggcgtgggcaaggggacctactctgtccgtgtggccaaggcttttggcatggaccacatcgcagcaggggatctggtccgtgcggagatgaagagcgggagccagctgggagcagaggtaggttcccctgggggtcctgcagcacgcgctcctcgatgcatctgtccggcagcctgccgctttgatgaccgcacgcatgcaccaagcctctgccacattgcgtgctcgcagatgaagtccatcgtggacaccggggccctcctccccgatgccctcatcctgaaggtcatgcgtgagcgcatgcgactcagttcctcccgcggcatcacctccttcctgctggacggcttccctcgcaccgcggagcaggcggatgccctggaggagataggctccaattttggccccctgcgccatgccctgcatcctgccactgtcaccgctggagggtcttggtggccccccagttgtcagcccccagccctctggcccatgctccttcctctccctccccccttctcaacaccccctcagatcctggtggagaagtgcatggggcgccgcatctgcaaaaagtgcgggtccaactacaacatcgcggacatctacctgccagccacggcggatcagcccgaaatcgtgatgccgccgctggacccgccgacggcttgcctgccgcacctggagcagcgcagcgacgacaacgagccgaccattcgccggcgcctggaggtctaccacgccgctgcgcggcccgtggaagagttttacgctgcgcgcggcacgctggtggactttgagatcacgggcggcatccccgagacgctaccacgcctgctggaggtgctcaaggggctgccgagccagcaggaggcggcggtggcctga

SEQ ID NO: 8225 - DNA, 390 bp, Chlorella protothecoides
atggcatcgtgtctccgatcacaacacattatggcgcatcatcactatcagaaggtaccgacgccgtccctcctgcagtgtaagtgtgtgcccctgccgggttacaaccctgctccggcatcgctcccccgcgcgccctgggggtgctgctccatgtccaggactttacgcgatcagggggacggtggagttccacagcacgagatggacatcatcgagtacctggaatccctcccgacagtaaaggttgcacccctgtacaccagttccatcatctgccgggtgatcctgcagcacctgcccccgctagctgctcagtatgttgcacggctgctcttggtgccggaggggacatctgaaggtgcggccagggcgcatgggcctgcatga

SEQ ID NO: 8226 - DNA, 867 bp, Chlorella protothecoides
atgtcgagagcgaggggaggacctcgcggggatggtgcgagggagccgcaccggcccaaccccagggccagccagcactgccctgccaccctcgcgcccctcccctcccactccccaccctcccctcgaccatccccagtcaagctgggcctgtcctggctgagcgaccgcgcggagtaccaccgcctggccggcaccctggtgctccatgagctggccatcgccgcccccgcggtcttcaacgtgcacgtcaaggtgtttgtggaggcgatctggaatggcatccgcgaccccaagctgcacatacgtgagacggcggtggcggcgctgcaggcctgcctggtgctgatcgagaagcgggagacgcgctaccgcgtgcagtggtactaccgcctcttcgagcagaccaaggccggcctggcccgcgccgcgcctgtggagatcgtgcacggttccctgctcgccctgggcgagctggtccggcacaccggcgagttcatgctggcgaggtaccgcgaggtgtgcgagacggtgctgcgcttccgcgacagcaaggagaaactgatccggcgcgccatcatcacgctgctcccccgcctcgccgccttcgccccggagcgcttcaccaagtcgtacctggacagcgccaccgagcacctcctggcagtcctcggctcgcccgccgaccggggggcaggtgggcagggacgccgtggttgttgtgaggaggaggggggaaggggggtgcagcaacatggagtgagagctcgttggatggccagcggccaggggcaagcgcagcacgcccatgcgccttctgcgtgctctggcacccacttccccagcgcccgcacgcgccgctggtga

SEQ ID NO: 8227 - DNA, 303 bp, Chlorella protothecoides
atgggcgggctggtggccatcgaggagctggcggggtccaagatgtacagcggctccccagcccggctggcagacctggtcaagctgctgatggaggtcttccagccggcctccgaccagcagctcatggagtttgccgcgcggacgctgggccacacagtgaaggctggcggggcgctgatggcgggggtggtggaggagcaggtggggcctgggtggccgggggcgggggttgggggtgtcgcgtgtgccgcccgcccgctggcggtgcatgcgggtggggtggcgatgccgagtgggtga

SEQ ID NO: 8228 - DNA, 1404 bp, Chlorella protothecoides
atgccccgtgtgtgctttctcactacctccctgcagcatcgcaaggagaagccatgggaccatgacggcatcaaccactgggaagtgcaacccttcaagaaggaggagaatccgagtggtcttctggaggagagcgcctttgcgaccctgttcccaaagtatagaggtgagcttgctttggggaactggctgggccgtcatgcgctgacgggatcccatcatcaggaggctcacattgccagaagcaagctcccagcacccgtacaacccctcgttgacacagaaaagtacctgcgtgaggtctggtcagccgtgacccgggccctgaaggagcatggcgtggcatgcgagctcaatctggtggagggctccatgtccgtgcgcaccacgctcaagacctacgatccctacatcatcctcaaggcccgggacgtgatcaagctgctggcccgcagcgtccccgcgccccaggtgaggatgcagcagggctgctctgggtggaggctgttgaggaggacacggagggcatccctggacctgggggagccgcttgagctgactcacctgtgcaatgccctgaaggtgttggaggatgatatgcagtgcgacatcatcaagatcgggggccttatccggaacaaggagaagttcacgaagaggcgacagcgcctcatcgggcccaacggcgcaaccctgaaggccctggagctgctcaccggctgcttcatcctggtccagggcaacacggtggcggccatggggggctggaagggtctcaagcaggtacggaagttgtcgcggagcacgactggtagaatgaggacagacatgtgcattgtggacaagcgggtgcggagcttccccgtgcgccacattgagcgcgccctccggtgcctggcgctttggctgacgctcccctcggggctgcaacttgactgcatcaagaacatccaccccatctaccacatcaagacgctgatgatcaagcgcgagctggccaaggaccccaacctggccacggagaactgggaccgcttcctgcccaacttcaagaagaagaacgtgaagcggagagcggcggtgatcaagcccaaggcgccctacacccccttcccccccgcccagcccctcagcaaggtggaccggatgctggagtcgggcgagtacttcttgaccaaggaccagcaggcagcgcgcgcgcgcatggccaagtccgcggcccaggccagcaagacggatgagcggaagcggaaacgggaggcggaatttgtcgcgcccaaggaggaggcaggggcacggggacgtgacgtggaggcggcgccgccggccgcgcaggagtcggatgcggctgagctggccaaatcgttgaaaaagaagctgaagaagaagaagcagaaggagtag

SEQ ID NO: 8229 - DNA, 228 bp, Chlorella protothecoides
atgtcgacgtcgctgtcctcggcgggcgtggccagcaagctgcgacgtggggattacctgcgccccatcgcgctgcacatccgcgatgcgctgctcggccagtccaagacgaaggcgccgtgctccgaggcgctgcactgcgcgggcacgctggcggtggcgctgggccgggactggcagccctacatccccctcctcctggagcccatgttccagaccgggctgtca

SEQ ID NO: 8230 - DNA, 303 bp, Chlorella protothecoides
atggacatcggagcatttggcgtcaggctcctgtgccgtcaccagcctttattaccttgcccatgccaggtggtgaccgaccagatccgactgtgggataaggagctgcggcgactgcaggccacgcgcagcgtcctctacagcaattttgagtcggccgacctgtttcgacgttttgcggaggcggtgcggcacctggccgtatatgtgggccaggagaagcagcaggtggtggtgcctgcggagcaccatgagcactgcaaagctgagatcaaggcgctcaagctggagctgggcatttag

SEQ ID NO: 8231 - DNA, 909 bp, Chlorella protothecoides
  modified_base (389)..(474): a, c, t, g, unknown or other
atgcagacctcagcgacgagcttttcgggtggccggttggttgccctcggtgaccgtacacggcctcactccccaggatgcttccacgccccccgctgctccagtttcattcctccccaaactgaacacacatttgggaggggtgagttgcctcctaggcatgggtccattcctctccaagctgaacacacacttgggaggggtgagttgcctcctgggcatgggtttccagctcatctcgcccgtgaccctcgcccacctggccgaccagcccctgacctgttccacctccacatcataaaaacgcagtgcttcggctacactgcaccacctctcgccgcttcctggtgggtgcaattggatgcatattctggattggggatcctggnnnnnnnnnnnnnnnnnnnnnnnnnnnnnnnnnnnnnnnnnnnnnnnnnnnnnnnnnnnnnnnnnnnnnnnnnnnnnnnnnnnnnnctcctctggccacccaccaaaagccctctccactctgcaccccagaccatggcttctgccgccagctcagagcaggcctccgccggtctgccaggcagctttgacatccccgctgcccccatcctcatcccggagggtccctggaaggtgatcgacggtggcgtgacggcgcccgctggcttcaaggcccagggcatgtatgccggcctgcgtgccaagggcgacaaggccgacctggcgctggtggtctccgacacccccgcagtcgctgccggcgccttcacgctcaacgtcatggccgccgcccccgtcacgctgtgccgcgaggtgcttgccgcgcacgagacggtccgcggcgtggtgatcaacgcgggccaggccaacgcggcgacgggtgcggcgggcgaccgcgacgcgcgcgcggcgacggccgcg

SEQ ID NO: 8232 - DNA, 393 bp, Chlorella protothecoides
  modified_base (62)..(71): a, c, t, g, unknown or other
atgccaagggatctgtcacgacctgcatcacccggaccccctcatcatcactcaggcccaannnnnnnnnntttgtgccggcaggctggttgccgctgcggaggatcccctcggggtctctgggtttcatgccaagggatccgtcacggcctgcttcatccggaccccctcatcatcactcaggcccaacttcgcggcctcattggagattacacggggggtgacgaggcactcttcagccaggcgtttgaggcactggacatgctgaacagctgcctcgcagacccctccgcggcccagccgggcgccgacgcgggggcgcccagcccctccgagccccaggccgcgccggcgcccagcaggagcgacgcgccgctcatcagctttgactga

SEQ ID NO: 8233 - DNA, 678 bp, Chlorella protothecoides
  modified_base (91)..(100): a, c, t, g, unknown or other
atggagcattgcgacgccgagcctggtcggcaagcgcttcgcccccccctgaggcctggggtcgggccccgccccggctgctttgcgtcgnnnnnnnnnnggtgtgcatggagcattgcgacgccgagcctcgtcggcaagcgcttcggcccccccccgaggcctggcgtcgggccccgccccggctgctttgcgtcgcgtggcaccgggcaggaaattttgtattgcatcgttgtacacgcaagctatgtggcgtggcgcatcatggcaaggaggccgcaaggtggagggtggggcagcagcgtcgaaattcgcccgcggaggaggagggtggggaaaggcgctgcttgtgacggtggggcgacccaacaggtccccctttcttttcctggagtggaggcaaggccccgcggggtcggagagccggccaccctcgcatctccctctcctagctgggcggtgtgtaagcgtcccagccctgggcggccatggcttcccgcttggccatcaccgtgtcggtcatgccgcgctggtactccaccatcctggcctggatctcggggtctgccacgcccaggatgcgggcggccagcagcccggcgttggccgcgttgccgatggccaccgtcgccaccggcacgcccttgggcatctgggggttggtgtgcgaggatgtag

SEQ ID NO: 8234 - DNA, 231 bp, Chlorella protothecoides
atgcacggctcggttccgctcatgcatgggctcaccatcttccctgctttccatcaggtggatgagatccgggagctgtcggtgcttgccaaggacgccgcaggcatcctgtgggagatggtcgccctgggggagacgggcccggctgcaaccgagatgcggagcacggccgagcagctgcaggtgcgtgcgggagggttctggtgttcctcccttgtgccggcaggctag

SEQ ID NO: 8235 - DNA, 585 bp, Chlorella protothecoides
atgggctccgactccgacctgcccaccatgcgcgccgcggcccaggtgctcgccggctttggcgtgggagtggaggtggagatcgtgtcggcgcaccgcaccccagccctcatggccgagtacgcgggcggggctgcggctcgtggcgtgcaggtgatcatcgccggggcagggggggcggcccacctgccgggcatgctggccgccatgaccccgctgccggtgatcggcgtgccggtcgtgccggcgggcgcgcgcctggacggcgtggacgccctgctttccatctgccagggtggacacccccccggcggtgaccgcctggtggggagcagtggccctgaacttacgcgatctacatcctcgcacaccaacccccagatgcccaagggcgtgccggtggcgacggtggccatcggcaacgcggccaacgccgggctgctggccgcccgcatcctgggcgtggcagaccccgagatccaggccaggatggtggagtaccagcgcggcatgaccgacacggtgatggccaagcgggaagccatggccgcccagggctgggacgcttacacaccgcccagctag

SEQ ID NO: 8236 - DNA, 255 bp, Chlorella protothecoides
atgtcgggctcggccttcaccaggagggtgaacgacttcaagaccaagttccagtctcttctgggtgccaagtcccagggatacgatgagttggatactctagaacggcccctgttttcggcgcaggacgagacggatgactacgagcgcacccatggggttgccgcaccccagtcttaccgccccccaaacacgggcggggccaccggcgccgcaagcttcactgctgccgccgctgtgccgtcccaggtgtga

SEQ ID NO: 8237 - DNA, 696 bp, Chlorella protothecoides
atgccgccacgacgacgagcccggcccctgaagggcgggccagccggccgggtgcaccacatctcatccacggatcagtgggcatccatgctcgagaaggcgggggaccgcctggtgatcgtccagtattaccagtccaccgtcctggtctgcaaacagatgcggctctacttcacacgactcagtgggcagcccaacttccagaaggtcatcttcgcggaggtggatgtggaggagctgcaggatgcatggtctgcaggcatgagctgcagggcaaacgccgacgtcgacgcacaaagaccatcctccatcacagaaactggcgctggaggcgggtctggaccggatcccgacctacatctgctacatccggggcgagcccgtcgatgccccactccacgcacccccctccctgcatccccacagaagtatgtcgggggcacgcctgctcttgtgcaaagcctggttgatcagtgcctgtcaaaatactgcaacaccagccggagcgggaaggcagagctggcagtgaaggtggccgtcgccgtcggcgccgtgaccgcaggcgagccgggcctgaactccttacggaatgtgttctggtcggggggacggggcctcaggatcgtcctcgtgcatgcgtgtcatgagcataaactctccgaggcccctgcaccttctcagtcccgcgaggcctga

SEQ ID NO: 8238 - DNA, 1146 bp, Chlorella protothecoides
atgaggaccagtgcagcgcctaagcctgccagcctcccagttctggggcgggacatcaaagtggagattaaaacggtgcagactgcctccagacccatccgcatggtggttccggatgtcgaccagggactccagggacccctactggtgtgcggtctggccctccgcggtggcgatgagcgaccacctgaccggcatggatctccgccagctcagcgtgctggagatggggtgcggcctgggcctcgccggcatatcagcggccctgcatggtgggggtgcctggctgtggggtggtatgggccgctgttccttgcaccctgctgtcctcccctcggggtcctggtgtgctgccccgcaccttcagcaggacagcctgtgcgtctaggtctgcagcacgacttgggggcctggtgttccctggcccccacccccctttccctccccccacccaccgcctatccacccctcggcacaggcgcggcctcggtcaggctgtacgaccaggagcctctggcggtgcagtgcgccctcctcagtgcccagctcaatggcgtgccggtggtgcagcaggatcccggccccccatccatcgagctgatgccagactcttggtgggactgcctcggggaaggtcccccgaggccagccgcggaggggtgtaccccggtgtgtgccgcgcagtatgactggaactccgggctgggtttggcccccgcagatctggtgctggcatgcgacgtcctctatgactcagcctttgtcgaggtgggggaaggatggcagaagggcggggaggggggcggcggggagagctgcctaggcacagcagccggcctgacgaaaagcatcttgggagcatgtgactgcagggaactgtgggcgtgggatccgctggcgcgcctgcttccaaagcttctggcgcgcccgggcagcaggctcgtgctcaccgacccgaccaagcgcacaccgggccaccgccggcagctgctggagcggctgacggggcccggcgctgacctggcgctcatgcagcggacagaggtggaggccctggcgggagacccgccggcctcagacgtccaggtccttgtgttgcaagccagacagccgggggacaccctgggagtgccactggacgactga

SEQ ID NO: 8239 - DNA, 972 bp, Chlorella protothecoides
cgggcgtgcctttttggccgggaacgctggcccccatcgccacggggatgggggcgccggcctcggcgccggcctcggctcagctgtcggcggggggcgttgggggtgggtcgccccaccacagcgtgcgctcgctgggcgatccgggccagctgcatggcctgccggggcggccgccctccttccccggcgtggcgccggcgccgggcgtcgcgtcaggcggcttgcccccctttgtgagcgcccatcctccggcggcgccctcctcccgcctgccgtcggtgggttccgtgaacgccagcgccgcgccgacggggacgaccacgggcacgtctgccacgagcgcgggcctgggctccatcccctcctggctcctgcacgctcagacggggacgatgaaggtggtggtgaccagcggcggcgcctttgcgcgcctcacctcggtcgagttcgactactccggcggcgagacgcggctggtcaccgtcccggtcggctgcgacctgtccacactgcgcgagaccctggcgcgcgtgacccgcacctcgggcgcctcggccgacaacggcgcggggcgcagcggcggcgaggccggcggcgccccgcaccgcgcccccgtgctcaagtacaagctgccgtcggacccctcggtctgggtggacatgctggacgacgaggacgtgcagatgatgttcgacgagtgggcggagttcacgggcgggcggcgcagcgcggcgcgcctgcacctctttttggagtggcagcgccgcggcacgggcgcctcggccggcgaggccggggtcacgctgtcgggctcgcgctcgctgcgcgtgtcggcgggcctgggccgcgtggagacggtgcgcgaggtggacgaggacgcgagctccgggtccatggcggccgaggcgctggcggtgcaggccgccatcgacagcgaggagggcgcggtggcggcggcggcggccgcgc

SEQ ID NO: 8240 - DNA, 1584 bp, Chlorella protothecoides
  modified_base (147)..(156): a, c, t, g, unknown or other
  modified_base (1198)..(1207): a, c, t, g, unknown or other
atgagggcgaggtggattcgggcgccgggagactggcgcaggtgtgtcctgggtgcgctcagcctgatccagcggatgcgaccccgtccctcgcctgccctcgcagatccgtggagggcagcacctctgccttcctgtaccacgccnnnnnnnnnncgtcctgggtgtgctcagcctgatctagcggatgcgatcccgtccctcgcctgcactcgcagatccgtggaaggcagcacctctgccttcctgtaccacgccgtgtgcaccctggtcttctgccgggtctggctctggcacctgaccccccaggcagccgcgctgccgggtgcccagggctttggctggttcttcaggtacctcaccttctgctcattcaccctacaaaccatcctcttcttctcgtcctgcctgtctgagctggtcaagagccaggaaaccaggacgcggctgcgcgccgccaccaacaacctgggctgcgccctcttccccatcgccaacaccgtcaccctcatgttttacgccgtcgagaatgcgacaaatgtgtgtcggcatgtgaagcgtggggttttctgggtctccggctgcgacgtcgtgtgcattttggggggtgggagcctcgctggcgctgacaggcgcacacaccctacaagcaggcacgctcctgcctactccattccctccctgagtgcccgcgtaatcacctcgacgtctcccctcctgcttacaaccccccccgccccaaccccacccgccccaacccctgccgccctccatccacacgccgcagggcctggtggagcgcggcggcttcaaccgccccgactggctcgacttctcggttcactccgggaacagcctggcggcctggggcgacatcctgctctccccccaccgcgactttgcgccccaggcgcgcagcctggccattgcgctggccctggcctactctgcctggtgcctggtagtgcgcgccgggtacggcaaggtgagcacgtgttgcttctgcggcgccccgcgggctcctgcaggggaggattggctgtgcgggggagaacctggagcaggaaattcaagcacgcccagcgctgcggccaggcggccggccatgacggtatgagcaccttggcacaagtggtgggacttggatgcaaccccctcacccatgacccccccttctcctctgcgcagttcccctacnnnnnnnnnncgggggaaggacctggagcaggaaattcaagcacgccgagcgctgtggccaggcggccggccatgacggtagagcaccttggcacatgtggtgtgatttggatgcaaccccctcacccatggaccccccttctcctctgcgcagttcccctaccccctcctgaacaagctgcccctggcatacggcttctttggcttctgcgtggccggcacctccctagtcctcttcttcttccaggtgggggccgtggcgaggtggagcctgcggcgccggcggtcgcctgcgcgcccggtgccgaccaagaagaccgactgaggggacgaggtgctgctgaggaagctgcaagaagaggcccagggcggtctgggccggcgtaa

SEQ ID NO: 8241 - DNA, 1326 bp, Chlorella protothecoides
  modified_base (442)..(451): a, c, t, g, unknown or other
  modified_base (805)..(814): a, c, t, g, unknown or other
atgctgctgcctagtagtcggcggggcaactcagcagtgggcacccccaccctgagcaggggcctgggctcgcttggagggcgtcaaccagcccaacctcctgcctcagggcagcgagatcaccccgctcatcgacccttccacttgccgtcaccctccgccactcccgggctgcacggagacgcgcatgagggacaggctgcagcacctggaaaaggacacgggaatcaaattccgcgtgctggctcagaactaccccgacaccccaggtatggagcgtatggacttcatggcttggccagggtgtgcattcccggaagccctggtagggcgtgtgaaagggagggtccgcctggcgtccctgcacacttgtttgagagggagtccctctgtgcaaaccatctggttaggggtaccctgctcgtcacgcccaccgcctctnnnnnnnnnnagggagtccctctgtgcaaaccatctggtttgggtaccctgcttgtcacgcccaccgcctcacatcgaatacctttgcgctcccttgccctccctccaggcctggccatcaaggactactggtcggtggatgacaacaccgtggtcctggtcgcagaccccacctttggcaatgtgctcaacttcaatatcggcatcaacatcgacagcttcatcccacgggtgagggcgtctttggtaatctggcttggaatgctgggcctggggggtgggacagggcttgccgcgccgggccgcccatcctgctcagcctatgtcttggcctgcctggtcggcgaagtgcttcgtggatccnnnnnnnnnncagcgccgggccgcccatcctgctcagcctctgtcttggcctgcctggtcggcggagtgcttcgtggatctacccaaagtccactttcaagcttcccacccgcaaccaccaacctgcagaacttctggtccaaggtggccggcaggtttgggaacaagttttatgtggaggagcagggtcgtgacgtggcaatcatcaacgctgtggccgccgtcgaccactgcctgcgggaacccatcgaccggacgcagtgctctgagatccggggggagctggagcaggaggaggccagggctggcacatgctggggcatgccaagaggggtgccgactcagcgaccctgcactgccacctcgcaccgctcggcacagtcggccccggcatgtggaaaggtccgcagggaaatgccagggcaaagctcgactgtggatgagcaggctgctgcagcagtcgggccggccgcctggttggcatcatgcatcgccagggaccggggcgggtgcgcagtctga

SEQ ID NO: 8242 - DNA, 1176 bp, Chlorella protothecoides
  modified_base (203)..(212): a, c, t, g, unknown or other
  modified_base (996)..(1005): a, c, t, g, unknown or other
atgcaggcgggggaggtggcgcaggcaggacccgacgccccgctggacgcggggccccctgaagcgacgccggtggtccaggcttcccatgctagcttctcttgggacgccaagtgcgagccgctgctgtacgacatctgcctggaaggtgggggggtggcagattcccccttgtcttggggacgcctcctcttcctcattgnnnnnnnnnntcttgggacgccaagtgcgagccgctgctgcacgacatctgcctggaaggtgtggggatggcagattcgcccttgtcttgggactcctcctcttcctcatttggtttgctggaccctggagcgggacatgttgtgctcaaacggcgtgaccaggtggggtgaaacctgtggtggtcattccccgtgtgcagggggccctgggcttgccttgtcatcacccctcggacctgtgtcaccgagcgggcccagtttgggtgctcgggcagtttctcctgaccctcatcgccttcaatgcctggccccctgccaagctcctccatgccatcacatgcctcaccacgctcaataccgccctcttcccccggtcctccccaccccaccccaccaggggacgtcgtcggtgcggggacgggtggcgtacacggcgcaggagccctggatccagaacgccagcctggagaagaacgtgacgctgggcgcggcgcggaccgctgcctacgacgccgcggtggctgcttgcgccctgggacaggacgtcgcggcgctgccggcgggggacgccacggagatcggcgagaagggggtgaacctgtcgggggggcagcggcaccgcgtcgccctggcacgggcctgctttgcagatgccggtggggacggtgaatgggccactgggtgcccaggcgcggtgcagcgggatccctgctcagcgcgggggcgtaacacctgcactgaagatgaccgcagtgagataatgttgcgcaggaatcatgcttcacctggaaannnnnnnnnnccctgctcagcgcgggggcgtaacacctgcgctgaagatgaccgcagtgagataatgctgcgcaggaatcatgcctcacctggaaggggccgctccaaaccatgtggaggtactgcgggagctgccacctgcaggcagggtgaggaagcagaagttcgtaagatgcattga

SEQ ID NO: 8243 - DNA, 1353 bp, Chlorella protothecoides
  modified_base (756)..(765): a, c, t, g, unknown or other
atgcgggaaaatgggtctgagggctggggacttgcactccttctgcacggccggcatggcgattgcatgctgcaggaccagtttgctggcttgccatgtccagaatccacggccaggcactccatcccgaccgacggtgacagtcccccaccgcacgctgccttgcagagcgagctggcgcagcaggaggccgagaactttgcctaccgcaaccggctgcagcagagggaggcggagctggagcagagggaggcagagctggagcagagggaggcggaggtgcaggagaagcaggcggggctgcaacagggcgtccaggtgactgcccaagggcatgaggccagcgaggcgcggctgaaggagcgggaggcggcgctgatcgagatagaggcgcgcgtgcgcgcccgtactgcccgcctgcatgactggtcgacccagctgacccagagccggtccgacctgctggggcggctggcggccatccaagactgggagcggtccaccacacgctggggcgccgcctccctggccgccagggagaactgggtcgttgcgtgcgtgggcatcctcaccaagcgcgaggacgacgtgagtaggcaggagaggggggtgggcaagcaacttgcaggggtggaagtgggaggggggccagttgagacggccatggtgtgcgggaggggcaggcatggatccaggagggcaggctccgggggaatgattgcagcgcaaggtcccagccagccagtcgcacacgannnnnnnnnngtcctcaccaagcgcgaggacgacgtgagggcaggcatggatcaaggagggcaggcttcggggggatgcttgcagtgcaaggtcccagccagccagtcgcacacgagtgggcgtggatccatgacgaccagagcgtcgggagcacctgctgagcctggcgctgtggcaccccagccgcctgcccagctggagcccctgccgtcgccccacgcgaccccaggcctcgcagcccacagccccgtgcctccctgtaccccctcaggccaaggccctgctggaatcgctgaccaacctggcgagcatgctggagagggaggtggcgagttccgatgcggtgaacccgcaggtgctggcatccctgcgcaccacctgcgtcctcctcgagcaggtgcgcctgcggtggagttcatggggcgcaggcaccgagatgcaaagcatgcaggggcagccagctctgcactgccatgcgaatggcttcgtgaggaggatggagggcagtcgaggtcggagttacgccccgttcactaccggggccgcatgcatgcgcgacgcacctggcctcgtgtgccggctcttgtacggagatga

SEQ ID NO: 8244 - DNA, 1617 bp, Chlorella protothecoides
  modified_base (736)..(745): a, c, t, g, unknown or other
  modified_base (1478)..(1487): a, c, t, g, unknown or other
atgtgggtgcccttaatgtgttggatcgtatgcaagtccgggagtgcagcgttcaattctgtctacctgtgcccagagcaaggcagtgccgctgaccctgcatcaaacactgtgtctcagggcaagctctggacccaatcacattcatacacacacttcttcccacttccattccataatcacagcctcgcacgacaatctgcaactcacggggctggcgctgatcggcagcttcatctcctttgcctactcggtgccctggatcaagctcaagcgctctggctggatcggcaactatgccctggggagcagctacattgcgctgccctggtgggctggacaggtgtgactcgggaggaaagtggggaatgggatgaggtctgtgtgtttttggaccccgccagcactgggtgtgggccgtgggcagccagcttccgcctgcatcctcccacagatcctcttcggccagctgcgactggatgtggccatcctgacgatgctgtactccattgccggcctgggcattgccatcgtcaacgacttcaaatccatcaaaggcagggtcgcaggggaggactatgtcatgctcccgccctgcaatcggcagagggcgggcgctgtatggatctgtgtgttgtcagcaggctgttcccaaagtgcttgaattgcgtgctgctctgccccactcaccaaagcatgcctgctcctccagtcatcgtaccttctgggccccaannnnnnnnnncctgggcattgccatcgtcaacgacttcaagtccatcaaaggcagggtcgcaggggaggagtgtgtcacgctcccgccctgcaatcagcagacggcggccgctgtatggacctgtgtgttgtcagcaggctgttcccaaagcgcttgagctgcgtgctgctcagccccactcaccaaaccatgcctgcccctccagtcatcgtaccttctgggctccaccccacctccccctccttccccgttcaggcgaccgcgagctgggcctgaacagcctgcccgtagcgtttggcatcgagaaggccaagtggatctgtgccgcgagcatcgacgtcacgcagctcggcgtggcagcgtacttggcatggggcctcaacgagccctactacgcagcaggcatcgccgcttgcctggcgccccaggtgaggccttgcccgggaggagtgtgcagctcgtttgttgggccctgtctgcgcagggatgaggctggccgtcataccgtgaatgcgactgctgtccaagttgggaagggccgcgctcagagctctcatgcagtccatgcctccccgacggccccctccccaatctgctccccacccacccaccccaatccatccgcaggtgtacgctcaggtgcgctactttctccccgaccccgtggccaacgacgtcaagtatcaggccacggcccagcccttcctcgtcattggcctgctggtcacggcactggccattnnnnnnnnnnctactttctccccgaccccgtggccaacgatgtcaagtaccaggcgacggcccagcccttcctcgtcatcggcctgctggtcacggcactggccatcgggcaccaggccacgccagtcgcgctggggtga

SEQ ID NO: 8245 - DNA, 1056 bp, Chlorella protothecoides
  modified_base (1027)..(1036): a, c, t, g, unknown or other
atgcaagcgctcgagtacatcagattggaatacagcggaatctcaggcggtttagatttatataaaccagggaataataaattcctgcgctgctcccatggtcgtcatggggttctctacgaccttgagcccgacgacgaaatgtgtcggtgttgcatccagggtgcaatcatccatgccggcaccaaggatctcgtttgtgccagggtcaagagccctgaatctcaagagggtcgtgtcaggtgggctgagagcttgcatgcaaagaaggtgggcaaaaccacagaggcagaggtggtgcccgatgcccctcccagcaagggcagtgccgccgaggacgaccccaaccgcgccttcttcctcggagtgaaagggaacgctcagatgctaggcatccgtggcgcagcggttgagaccgacatctggaagattcggctgcagctcaccaagcctgtgacctggattccactcatctggggtgagacttgtctcgtatcctgctgccctctgaacctggctagtggcaagaggcaggcgatccttccctcgctccgcatgcctgccatcctccctcgcatgatcccctcgacacaaccacacgactctgcaggtgtgatctgcggtgctgccgcctctggaaacttcgagtggaccttcagggactgcgcgctgagcgcgctgtgcatgctaatgtccggccctctgctcacgggcttcacacagaccatgaacgattactacgatcgcgagatggatgccatcaacgagcccaaccgcccgatcccgtctggtacggtacctgagccgggagggagggttcccaaagatcctcatgctgtgttgctgagttttagctgggttggcctggaaagggtagtcatgcgctcctcaggccaagccaattcctctactcgaaacctcctctgcacccaacaggcgccatccctgagggggatgttgtcgcgcagatctggatcctcttcttcaccagcattgcagtggcatatacgctggatcaggcatcacnnnnnnnnnngctgtgttgctgagttttag

SEQ ID NO: 8246 - DNA, 402 bp, Chlorella protothecoides
  modified_base (44)..(53): a, c, t, g, unknown or other
atgcagaccgacgttacttattccatcctcgtgcttgctcctcnnnnnnnnnncgggaatttgtgttggattctcttccgatctcctgctcatggcaagagcataggccgcagcgacaccatgcaggccgaccttacttattccatcctcgtgcttgctcctcaggagagggaggttcccttgggaaaggctggagggttgaagaaggtggcagtgacccgtccaatcggctcccccccccctgacgaggcggaggacaccagcaggctcgccgtcccccaggaggtcacagaccgcatgctgcgccgcatcctcacctttgcagggctgcccgtggctgtttccatcctcttcctccccctattctacttcctcaaggtatgtgccaagtgctcgggctga

SEQ ID NO: 8247 - DNA, 387 bp, Chlorella protothecoides
atgatcttccgaggtggacggcatggagttctgatcttgcgacctcatcacgcgccttcccaacccttgaatctgcaaaatagatcgaagaatcgcttgcttgcaaagcacgcaccaggatctgcaggggccatgcgcgtggagggcgcctatgattccctgttcatgcacctgatgaggacccgcctggcgggggacactgccgtgccaaacaaggtcaagtatgccgacgtgcgccctcgtcccaagcccaagtccaaggagcgggtgagtgggaggcatggccgagggatgttatgcaaacgcatgtattgtggaaacactcccttccttccaagtggacttggcagtatacctgtgcctcactctcctagtcatcctccttga

SEQ ID NO: 8248 - DNA, 1221 bp, Chlorella protothecoides
  modified_base (563)..(572): a, c, t, g, unknown or other
  modified_base (656)..(665): a, c, t, g, unknown or other
  modified_base (907)..(916): a, c, t, g, unknown or other
atgaaattggtctcgtgggaatggacgccctgtatgggtttctttgctgtctctgttatcccggcagacgctccggctcgttcatcattcgcagaatccaatccgagtcaatcttctcaatgcgcgcgcaacaaaccacatccaggcatgcacccttgtgtcgtgccgggacccgcatctcccattccgcgatgtacatacgcccatgcacaggccctggggtgggtacgaagtcgatttcaaaaacatgtagcatgcgcgcgtaagcctggcattctacctgatcattgccaaataataccaaagcgtgatgagtcgtcgggacagatcctgctcagtagcgttcaccgagcattgcagcgaggcatgctgggcatcgcaggcctggccagcgtcatcctgctgagcggtgccagccctgcacatgccgtgaacaagaaccagctcctctacctggaggcatggaaggccgtggatcgcgcctacgttgacaagacattcaatggccagaactggtacaaggtgaggtgccaggaaggtcgtggggggtcgtggtggaggannnnnnnnnnaagtcgatttcaaaaacatgtagcatgcgcacgtaagcctggcattctacttgatcattgccaaacaatatcaaagcgtgatannnnnnnnnncatcgactcgagcatcgcgctgcctagagatccgcattcccggagtccatcccccccatcggcatgcacgtccaacagattagggagtcgctcctgcagtcagagtcttttggtgacagggagcaggcgtatgccgccatccggaagctgctgggcaccctgggggaccccttcacgcgccacctcggccctgaccagtatgaagcactcaagtatgcggcgtgcaagcctgttggcatggnnnnnnnnnncaatggccagaactggtacaagtgtgcccatcagggaggatgttcataactcgaccccaagctcggacaggattgagcatgagtgcccaacctgggcgctgctcgacatgttaagactttcccctcattccacccgaccccccctacctgcagacgggcctccagcggccagctgtccggcatcggggtggaggtggggctccgcagcgatccggggtcggccaccagccgcgccgaggtgctcagcgtcgtgcctggcgggcccgccgaccgggccggcgtggcagcgggggacaccatcatga

SEQ ID NO: 8249 - DNA, 573 bp, Chlorella protothecoides
atgcgggtgcacgcagcagctcggcagggatcatgggcaccaaagcccatgcaccgccctcgatcacacatcggcttcgttacccaggcatcgtatggctccgggaactacggcccagtgggtggcgacgccaggatcaaggtcatcggtgtgggcggtggcggtggcaacgccgtgaatcgcatgatctccagcggcctgcagatcgagctgggctgttgtgagcccctcatggccggcaggccttgcactgaggccgcgcgatgcagtcgacctcatccccgccatgaccctcagggcgtggagttctgggctgtcaacacggacgcccaggccctggagagccatcaggcgctcaacaagctgcagatcgggaccaccctgacccgtggcctggttcagctgaaaggctgggcttgtgacatgaacgcgtcccccaacaaatcacgcaggtacgggtggcaagcccgagctgggggaggaggcggcgcaggagtctcaccaggagctggcctcggccgtccagggcgcagacatggtgggcttcaatatggaatgggttggaaattgtga

SEQ ID NO: 8250 - DNA, 414 bp, Chlorella protothecoides
atgggcggctggtggctgggcggcaagcacatgaagccgtacccaactttcctggaggaggtggaggccaaggtgcccaaggacgcctccatcattgtggcctgccagaagggattgaggtcgctggcggcgtgcgaggtgctgagccgagcggggtaccgcagcctggcctggatcaacggcggctacgacacggcgcagcccggggagttgccggtggagggcgacgtggacgtgcggctggcaggcatcggcggcctgtcgagcgtgctgggctggaccgagccgcagcgggagggccagggcggcggcttcgcgggcgggttccagaacatcctcaagggtgtggcggtgatcctgctgctggacgtcctgctgttcggctgggagctgatccaggccagcaagcagtga

SEQ ID NO: 8251 - DNA, 447 bp, Chlorella protothecoides
atgcctgcggggctggactctggcgtgagcgagggcgggggttccctctcgcagggccagcgccagctgctggccctggcgcgggccctgctgcgccacacccgcgtcctggtcctggacgaggccacctccaacgtggacaccgccaccgactcgatggtgcaggtgaggcggggtttctggggggtcgtggaggctgcgcggggccccttgactcccaccatccccggaaccacccagggcaccatcgcacgggccttcgcgagctgtaccgtgctgaccatcgcgcaccgcctgcacaccatcatgcgatcggacgccatactggtgctggatgcggggagggtcgcggaattcgggacgccgggggacctcatgaggcagccggggtccgcattccgcggactggtcaccgaaacagaacagggcggaaaggtcggcgcgtaa

SEQ ID NO: 8252 - DNA, 594 bp, Chlorella protothecoides
atgttcaaagctcaaagcctcaccctcctgtacctgtgccaggagcgacggttgttggccaagccctctgtcggcgccctgggcgaggcgctgctcttcttcgggtgccggaggcgggaccaggactatctgtatggttcccagctggaggcctgggctcaggagggcagcatccagctcttcactgccttctcccgtgaagatgtgagggaggccggtggtggtgcggatgtgcctgaggccatgtgcctcgcactgactttgcacggtggtgttacagcacttgtttttccgtgccccttgattccatgcaagagtcactgcacctccaaaccccattcactccctgtgcagccggaaaaaaaggtgtacgtccagcagcggctggtggaggcgggggccatggtgtgggccgcgctgcaagccggcggccacttctacgtgtgcggggacgcggccgccatggccgggcaggtggaggaggcgctgctcggcgtcatcgcccagcactctgccaggaccccgcaggaggccaggcaggtgctggacggtatgacgcgggaggggcggtaccagcgcgacgtctggttctga

SEQ ID NO: 8253 - DNA, 501 bp, Chlorella protothecoides
atggtttggagcggccccttccaggtgttacgcccccgcgctgagcagggatcccgctgcaccgcgcctgggcacccagtggcccattcaccgtccctacctcacatagatcctggcgacgcggtgccgctgcccccccgacaggttcacccccttctcgccgatctccgtggcgtcccccgccggcagcgccgcgacgtcctgtcccagggcgcaagcagccaccgcggcgtcgtaggcagcggtccgcgccgcgcccagcgtcacgttcttctccaggctggcgttctggatccagggctcctgcgccgtgtacgccacccgtccccgcaccgacgacgtcccctggtggggtggggtggggaggaccgggggaagagggcggtattgagcgtggtgaggcatgtgatggcatggaggagcttggcagggggccaggcattgaaggcgatgagggtcaggagaaactgcccgagcacccaaactgggcccgctcggtga

SEQ ID NO: 8254 - DNA, 693 bp, Chlorella protothecoides
atcatgatggacttccacgcctgcacgtggtcctcggtgcctggtctgagcccggccgacgactccatcgcgcggcacatggactcgctcaacgaccccggcacggcgcgcgtgctggcggcgctggacgcggcggaggccgtgtccggcgtgcggcccccgctcatcaccttctcccacttcctgccggaccagcgcctgctgccggagaagcgcatgctgcaccaccccaacctggccaaggcggtgggcagcgaccccctggccgcgcgcatcgcacgcctgcgccccgccgcccacgtctttggccacacccacttcagctgggacgctgagctggacggcgtgcgctacgtgcagtggcccttggggtacccggccgagcagcggcgccgcggccgccccgcagccgactggcgccccatgctcccactacgcggccgtgcggcgcacgccctgggatctcacgcccgcaccttgggtcgccgcctgacggcgcggcggggggcggcgcggcgccggccgggcccgggcgctcgtcccccgcgcgtcccacctgcgcctcctggcggcagccgcgctggccctgctgcacatgctgctggtcagcctgcaggcctggcgggtcgggctgctgcggggagggcgccgctgatggagtggcaggtctgcggtgcttccgcacctcgctag

SEQ ID NO: 8255 - DNA, 645 bp, Chlorella protothecoides
atgctgggtgtgggcgtgtcctctgggaagaaccgtgcagaggaggctgccatggccgccacctcggcccccctcatcgagcgcagcatcgagcgcgccacggggatcgtgtacaacatcacgggcgggcgggacctgacgctgcaggaggtcaaccgcgtcagtgaggtggtcacctcgctcgccgacccctccgccaacgtcatcttcggcgcggtcatcgacgacgcgtatgagggcgagatccacgtcaccatcattgccacggggttcaaccagacctttgaggaccagctgctcagcgggcgcagcgtgctggtgggtctttgggggatgaggattgaagtgcgggtatcagcggagattatgaggggtcaatgtggcgaggggagcagcaatggatgcgggatcgccctaggccatgtcctctcgggccagaccaccttccagcaacatcccccctctgctcctcacccacatccctccccgcccctacaccattccattctgcagcctgctcaacccgacctctcccgcgcatccaacgccaaatccggcaacggacctgcgtcgcgccaggcggccaacgggcacgcatccagcctcggcggcggcggcggcggcttcctgggccgcacctggtga

SEQ ID NO: 8256 - DNA, 756 bp, Chlorella protothecoides
atggacctgaggaacaacggcgggggggtctttgcgcagggcgtggcggtggcgcagcagctcctggccgagggcaccgaggtcgtcctgatcgccgacagcgaaggcgtgcgcgagcggtatgaggcggagggcggcgcgatgctggacgagaaggttccactcatcgtcctggtcaactcgcggacggccagcgccgccgaggcgcgtggagcgagggcgctttggggaggggtggggacaagatcgccggtgttttccgtgcccatgcgcgtgcccgcccaggtctccagatctgccgacggccagatcgccactgctcggaacatgaagagcacgtcgccgggtgcaggacggcaggggaccacggcgtcgccacccccctcctcatccccacactccccctttcctcccctccacttttgtgcccaggttctggccggcgcggtccaggactcggggcggggcaggctggccggggcgcgcacctttggaaagggcgttgtgcagacgctgacgccgctgtccgacggctccgccctggcggtcaccgtggcgcggtaccagacgccggcggggcgagacatcaaccgcgtgggcatcgcgccggatgtagaagccgacctggacggcgtgccggacaacgccgcgggcttctgcgccctggcgcgggccgggaagctgccgggggcgctgctcgacggcacgtcccgcgggggtggtgcaacaccggccctcgcccagttgccccgctga

SEQ ID NO: 8257 - DNA, 555 bp, Chlorella protothecoides
atggcccggtggaggtggctacgtcgcgaccctgcatactccgccctgggcgccgaggaggccacctcggccacaggtgcgccggggtgcgggagggctgggcatgccatgtgccaacgccagcgcctcttggtcacacatctataccaacatggatcagcccaccgatgcacaggcggtgcctggtgcccggagcagggtgctgggttggtgagcaggctcctgttcacatgggtggaccccctcctggccaagggcctgcacaagtcgctggacgccgaggacctctggggcaccatgcccgaagacgcggcgggggaggtggccgcggccttccagtggcacctggcgagcaccgcctcctccagcgcccagccacacggccgagtgcacgccgccctgtggcgctgctaccgggggcgcctcctgtggtcgggcgtggtcaagctcctgcacgactgtgtcatgctggccagccccgtcctgctgcagcgcctcctcgtccatgtccagcagaggtgggccggggggcggacgttgcacgcgggggcatga

SEQ ID NO: 8258 - DNA, 426 bp, Chlorella protothecoides
atggaggtgtggcaaaagggtggcccgcaggggcatgcgagtcctcactggcggtgcggtgccgtggatcagcatgaactccgtggagaggctgctggagtatgccagcttcgagaccgaggcgcccgctgtgatcgaggggcggcggcccctcccgggctggccgacccaggcgagtacaggggtgggaggaggggcaggctgtcacaggtgctgtcgagagccccccaccaacccccttcccatcattctgaccagggcgcactggctgtggagggtttatcggtgcgctaccgtccctctctgccccccgtcctgcacgacgtctccttctccctcccggcggggtccaaggtgggcttggcgcgtggggaagggggtggagtgggcaggcacgcaacatggcatgccgtggatgcactgtga

SEQ ID NO: 8259 - DNA, 588 bp, Chlorella protothecoides
atggtagaggctccactgtcctggctcctgagccatcggcggctgggcgccagcggctggagggccagggggcgcgcaagggatgcatgtagtgacggattgcagggcctgtgccctcacagtgctctccaagctgcctccacagcccccgcgctcctccatgacgaccgtgcagacgccctggccttcctcagccccgagctggggagtgggcagaccaagaggaaagggtggagcaggaacaggccgtacctggccacagtctcggctgtggagggtttgtgcgcgctccggggcccggatgacaagaacacaggatgcttgtgtggcacggccgcgtcggtgcgactcacagccaccccgccctccctcccagtccgtgtcgagatcagcctgggggagtcgggcctgcagtacctgcctggagacgccttgggcgtgtggccctccaacgacccgcaggcgcgtgctgacggggctggtagtttgctcagcgggcgtgcagcagctgggcgattttgtgtagtacttggccggcaggggctggccgccacggctattgcttggcatcgcgcggcgattgtatga

SEQ ID NO: 8260 - DNA, 1107 bp, Chlorella protothecoides
atgtcccctatgccagccctgctgatcctcttggaacatgtccctgttccgcagggcaaggatgccatcccctggatcgagaagctcgtggtgggcgacatcgcggggctcaaggacggcactggcactctgtccgtgctcaccaacgaatctggcgggatcatcgacgacaccatcgtcaccaggatcgcagaggatgagctgtacctggtactgaacgccggctgccgtgacaaggacctggcacacctgcgcaagcacctggacggcttctccggggacctcaccctcgaggtcatggatgacaagtccctgctggccctgcaggggcctcaggctgtggacgtcctgcagcataccttacctggtccattgccccctttcccaacaattcctccatttcccacccgcgacgccccctcctcccttcaactcctcccccccctcccccaccacacacaccaacacacacagccgctggtgaaggaggacctgagcaagctttacttcggctccctgctcaaggccgaggtcaagggcgtgccgtgctacatcgcgcgctccgggtacacgggcgaggacgggttcgagctctccatccccgccgaccgcgccgtcgacctggccaccgccttcgtctccgacgaccgcgtgcggctgtgcggactgggcccgcgcgattcgctgcgcctggaggcgggcctctgcctctacggcaacgacctgaacgagggcgtgacgcccgtggaggcgggcctgacctggaccatcggcaagcggcggcgtgaggacttctccttcctggggggggaggtgatcaagcgccagctggccgacggcgtcaagcagcgtcgcgtgggcctgctctcctcgggcccccccgcccgccagcacagccccatcctggacggggaggggcgcaccgtgggcgagatctcctccggcgcccacagcccctgcctgaagaagaacgtggcaatgggctacgtggagaaagcgctgggcaaggcggggacggagctcaaggtggtggtgcgcggcaagccctacgacgccgtagtcgccaagatgccctttgtgcccaaccgctactacaagggcgcttga

SEQ ID NO: 8261 - DNA, 465 bp, Chlorella protothecoides
atggagggacggcctgcatgggccagatcacccctggggaactcgtgcaccccccgcgtgacgccgtccacgctgaagaggagtgtctcgcgtcaggcgggcgggctcgagatggagaacgcgcagaaacgctgggagaaccaggttcgcgacggcagggtccggaatgtgcgtgccaaggaggtccccggtctcctgaaggacggctggaccctcctggacggatgcacaccccttccccctgtccctcctccacggcaggttcgcgacggcagggttcggaatgtgcgtgccaaggaggtcccgggtctcctgaaggaaggctggaccctcctggacgtccgaccatccagtgagctggacaaggtgcgtgctggagcaggctggtgtgggtgggagaaggaccagtggaggatcactgctggctgcgccatttctgtgatgaatgtgtctcgcaggcattga

SEQ ID NO: 8262 - DNA, 561 bp, Chlorella protothecoides
atggctggtgctggactgggcgcaggggcactgttgtactacctgacacgccccgcgcgccccccagtggctgggccggaggagaccggcttcggcgcctacctccgtgacctgagcgtgggggtgcccacccatggggtccccgccccacaaacctttgaagagaccagcttcgaggcgtacctgcgagctgccgccttcaagtctcaggaccatgctgaggccggcagcgcatctggcgaggcagagagcgcaccgcccaccgcccggcccgtcaccatcgtgtttggcacagagtacggcttttccaaggagatcgcagagcggctggctgacaggcttcgggaagcgggcgaggggccggtggtgctggacatggcagaccacgccgagggcgtgcccccgctgaccaagcagcaggcactggcggtggtctgctcgacgcagggagacggcgtgccgccggcagaggcgcgcggcttctgcgcatggctggcgtccctggaggccgccgaattcaaaggggttcccttctccgtctgcgccctgggcgacacgtga

SEQ ID NO: 8263 - DNA, 480 bp, Chlorella protothecoides
atgcgggtgataggcgtcgtgtctgccgtgacggggctggccgtcaccgtggcactcatccccctgctgacgctgctggggaagaagctggcgtcgatccgcaaggagagcatgactctcaccgacgcaagggtcaagctgtgcaccgaagtcttgacaggcatcaaggccatcaagctgtacgcctgggaggagccataccgtctgctcatcaccgacctacggcagcaggtgatgctggggcaggaaatggcggtattaaagcccatgggcgttgtcacaagagtgccatcccagcaccatgctgcacctttctgtcccccgccacttcaggcgctcagacaccacccacctccccaaccaggagctggcgcaaattttgtggtcggggctgctgaacaccgtgaactcgctcgtctttcagggcgctcccatcatcatcaccatcgttgtgggtggagagggggaacggtgctgtag

SEQ ID NO: 8264 - DNA, 741 bp, Chlorella protothecoides
atgacactcccctttcccccataccctcccctcctgcacctccaggggccgatcgctggacggggagctgaagcagttcaggctgctgggcgacgtgctgatggaggcgggcgctgccctggagctggccaccgcgctggcgccccgcgccttcctcccgctagcctgcaccgccaacctggccaagaacctggcggccgtcactgcctcctccacccgcgcccccatctaccgcacctttgcgcgcgtgaacaacctggccgacgtcacggccaaaggtgtgcgatccgggacgggtcgggcggtggcgggctcggcggagggggagggcaggggacggtcgccgaagggctgaccggggccagggtcccgggcgatacccaatccgtgcaggcacggcggatgcatggcgcgctcgtgccttgccatctggccgccctgcctctctgtgcactcgcccccgatgccccccccccaatcgcgtgcgctggcgcaggagagagcgtggccaacctggccgacgtcgtgggcaccgcctttggcatagcgctggcccgcgcggcctgccccatactccccgctttcctcgcgctgtcggcggggtacctgtacgcctcgcgccgtgaggtcgactcggtggtgctgccctacctcaaccgcgcgcgcctggcctacagcatgcagcactttgccgccacaggtgggtctcgctgtgcgacccggcggggaggagggggttga

SEQ ID NO: 8265 - DNA, 2523 bp, Chlorella protothecoides
atgctgcctgccccaacactagtggccaagaaatattacccgaacaaggtagtcttcactgtaattgcagcatcgtatttcccagctgtcattgacgttttccaagatggcgacaaggtctacacctggaacttcccagacgagcacacggacaccaccacctaccaggatcgcttgcgtggacttttgaatcctatcagggatgactgggctgctgaggagccggccgatgctacaagtcctcgacccgctgcccttttgaagggaagcagatgcaacgattgggagcgtccctgtcagccccttgtaactcccccacgacgatttcaggctgcctctgtccctcccgtgtcaggggcctcgaaaagaccgtaccgtacaaacgtgcaatttaacctgaatactgtcgaggaaagggccgtacagcgtagcttattgggtatcatgtccagacgagcagggggatttctgtccaagggtgtggcaagggaacaggccacgtcacatagtgtgaggtgtcgtgaggaggcagcaagttacacttcaagcaaattcataaagcactcgagaacatgcaaggatacgatgaccgagtgtggggaaattgggccaagcatgctgtgcatgacgcgcagcgtcccattacacactctgcctgcctcattgctgttgggagtgaatgcagcgtgctctgcccttgacttgcaactcgtaggcaatggtatcagccaacagaacgagcatcactggcagcacagcccccgtcaggagcttgtagcgtgcgccaagctcatttgcactcccttctccacgatcagcgagatcctcatcgccagcctctggagggctcaagtgagcccatgccggtcctctgatggcagggctgagttgccagaggttcccagcagtagcggtggtgtgccattcttgtcctcaagatacagagcgcaccatctttcccttgcgtctcaggctccatggttgttggtgccaggtggagagacgcagcgagtgacaagtctgtcattggcacaggcccctggctctgcatcctcacgatgccgcccggaaatgtgagttgggtggcttgggcatcctgtatgcactgaatagtggacagatggcccctatttttgcaagtatttcctcccaattcatcgacaggtatgcataataatatgcaagtgtgctggccaacctccgtacaaacctgcgcttgtggccaaccccccatcaggatttgtgttccttggaatgcagcaaggctctgcccaatggggagtggggtgctcctcacacttcctctatggcacccccaaaccaatgaacagccatgccatgccaccactttccatggacaggaacccacagggagccaagagggctcagcaacggagaatacctggcctaagcacagacttccacggaatactcaggcacgagctgttggggaagactcgggtctggtgccgcagcctcgagcccaatgctccacgtgacctcccgccattatgcctcctgtcgcgctgcagaggcctgtgccacccggagcttatactccaggtactcgcacttctcatacgcatggcgctcctcttcacacttccagggcaggaagaaggacgctcgtcggcacttgttcagaggcaccagcttgtccgcacaccgatcccgaaaggccatgtcgatcctggccacccgcatctcctcctgtcaaggggggtccacaaggacaggattctcagcattgcaggtcagtacagcgccactccaaccttaggccatcaacagcttcttgacacttcctcactcacttccgtcagtgggaaatcagctgccgatgtcatgccgggcctcccgttgtctcgcaagcccgaaggtgggggacaacccgacacgggtgccaacacgcgcggctcaaccaggagccgtaagatgttgcagaagatcagcgccgcgattgaactcgtggcctttggtcgactatgtgtctcaatgagtattaggtcttcccctccagcgtgcaagaagcttgtcccacagggctctgtctggcatgctttccaccaccaagggacagcgctccatgcctcggcaagttctcgctcgaggaagggaggcctgcacgatgacgtggtgttgattgaaacgattattgacctcctgacattgcgaccaactccaatccaccacgggctgctcaccgctgctatacggagtaggatgagctggcttgcccggcatgcggcacgctacatcaatcagcctggtgtgacggtgcggcagtgccttccgtctcgagaccttgccccattggctgctgcagccccttccctgggatccttcctggaaagcatgcgggccctcgtgcccagcttagcggacatgggcctcttggcagttccgaagcggaaggtgcgctgccggggccttgctttgcctgtgatggaggaggctgcgtgcatgggctcacgcagtgcctttgacggctgcatgcaaaggagttccacatctccctgttga

SEQ ID NO: 8266 - DNA, 195 bp, Chlorella protothecoides
atgcgggtggccaggatcgacatggcctttcgggatcggtgtgcggacaagctggtgcctctgaacaagtgccgacgagcgtccttcttcctgccctggaagtgtgaagaggagcgccatgcgtatgagaagtgcgagtacctggagtataagctccgggtggcacaggcctctgcagcgcgacaggaggcataa

SEQ ID NO: 8267 - DNA, 711 bp, Chlorella protothecoides
atgcccaaaaagagggtgctgtcgccgcagtccgtgtgggacgagccggcgctgcgcctggccttcgaccgggccggcgtcaaggccctgcacctgcctcccctctaccggcacctgctgcgacacccggatgccagctggtccgacgtgcctgacctcccccgagccgcggtggacctcctgacgcgcgacttcgcggcgcacaccactaccctggtccatgcccagacctccggcggcggcgatgccaccaagctgctggtgcgcctgcaggacggactgcaggtggaggcggtgatcatgcagtacgacacgacgtccgccccgcccgccgcgcccgacggcgccgcaccgcccgccgtcaccggctcccagcgctgcacactgtgcgtgtccagcgaggtgggctgcgccatggcctgcaccttttgcgccacggggacgatgggcctgtcggccgacctcaccgcgggcgagatcgtggagcagctggtgcacgcgcggcgccagcatcccatccgcaacgtcgtcttcatggtggggaagggtaggggatgggtgaagggtgggtggatggggtggggtacaggtgggcgagccactctcaagagggcagagatgctggtgcagggggctgtcgtgacagcggtgaggtccacggcagtacgccccccccccgactcctgcctggtatcaaaccgtcgagtttga

SEQ ID NO: 8268 - DNA, 594 bp, Chlorella protothecoides
atgggcgagccgctgaacaactacgtggcggtgcgcgccgccatcctgaccatggtggacccggcctccttcgcgctgcgccgctccgcggtcacgctttccacggtgggcgtggcgccgcgcatccgccagctggccgccgacctgcccggggtcagcctggccctgtccctgcacgcgcccacccaggagctgcgcgctgccatcgtgcccagcgcgcgcgcctacccgctggaccgcctcatggccgcggtggccgagtaccaggccgccagcgggcagcgcgtgttcgtcgagtacgtgctgctgggcgaggccaactgccgcgccgagcacgcgcacgcgctcggcgccctgctctccgggcgcaacgtggtggtcaacctcatcccctggaaccccatcctgtcccccgcgatggacttccgcggccccgcgccgggccaggccgcggagttcgcagccgtgctgaaggagcagtacggcctgcccaccaccatccgccaggagaaggggcaggcgagcgagggggtggaggggggccggcggctggctgaggaggtcgggaacgaggcgatggtgggaagggtgtga

SEQ ID NO: 8269 - DNA, 600 bp, Chlorella protothecoides
atggcgggcgctggtttggagacctcgctggattctgccttgagcgtcacggccccgcgctgctcctcctccgaggagggactggatttgtcttcctccacctccccccgcagcagcactgggtccgggcatggcacccccttgcagtccaacctgatcggcgacgttgttgcccccgaaaccgtgcagtgggtgcagcctagtggcccccgccagcaaggacagggcaccgaggagctggagcagggcatcgtgtccgcggagccctcccccacgggcggcatgcatctgcgcatcaccctccttgctgccggctttgtcattggcccctccggcgcctccatccgcgacgtctgccgcgccacgggcgcggaggtctggtcctggacgtcccccggcgacgcccgatgccgccgccccacgcgcaccttccgcgtggaggggcccccggcctcggtgcgcgccgcctgcgcggtggcctccgaggcggtggagcgctacaaggacttgtgcgaggggcggttcgcagggcagagcgtgccccgcatccaccgcatccgcggcgtggactttgcctaccagcccccgccccgcggccag

SEQ ID NO: 8270 - DNA, 1362 bp, Chlorella protothecoides
atggggttctcaaaggaggcggcgggcccgctgaatgcactctccttgttgagttgttgcagcacgtttgatgcgatccacgcagcgagaagcagcgcaccggcctggacagggtacagcagttcggatccctgtcagcttgagcagaccaagtgccttcatcaggagagacaggagggtaatgatgacggtaagcatgctagattggctctgggctcatgcgtccgacgcgtgcatggtcccgagagacactgggtacacgccgggctagcagggcgccttcagatctccgtctggagctctgccgttcgattcctctcatcgggcgctggactccatgccccgtgtgctgcgcacgatcaacactctaacgtccatgagcatacacaacgaggcccaggcgaggtacgcagcgcttcccttagcccgccccggtcttctttccgaggcgcgatggccgcgatgaagccagtgctgaacagagaggccgcagatcagaaagccatcggggtattgaagcgcatcgatcctgatatcgaggagctcctagccaccgtcagccacgtcgtgctctaccgattcaatccagaggggcctgcatggattaagaccgatgtggagggcaccctgtacgtggtcaagaggcgcggccagccccgcttccggtacatcgttctgaacaagaccggcaagggtgggtggggcgggcgatgtggtcagcggctggcgcagttgccacaacaatgccctccatgctcgccccccctccctgtcgcagaggacttcatggaggacattggggcggggttcacatcggagatccacaaaccatacatcatgtaccgcactgacatcgatgaggtctcctccaagctcgaagggcgcccctgcaccatgtttgagtcctgcttcacaccgacatgtggtggacgccccgcacctcctacccaccgcccctgtgtgcacgcccaggtggtgggcctctggtgtcacaccgaggaggagtgccagcgcctgggggcgctgttcagccgcatccagagcctcgtgccggggaaccacgcctccggcgcggcctcgatcctcatgggtgcggctcccgagccggaggaggtgccgacggaggtcgccgccatcctcggggcagcctcagccccagccgcagccccagccggagccccagccggagccccagccgcagccgcagcgcccaggaggccgcaagcagccgcgccccagggccgaggcgcagggccccagggccgggcaccgggcccccaaggccgtgccccagggccccaggggcgaggcgcagcgcctcaggcacgggccccggcacccgcggcccctgccgctacccct

SEQ ID NO: 8271 - DNA, 933 bp, Chlorella protothecoides
atgtggatcagagatgcatgcctgatccctgctcaagccttgcatcgtctgttcaaatactgtgtcccgtcatcttccctccccattgccctgttactggcccctgcaggagttccggctggggtcaacgctcgacgagaccttcaggtgtggcaggggcttgctgtgttgccagacagggtccccattcaccctcccccaattgccgggtgtgctggagggttctcggaatcagcctccgctcccaccaatcaacaaaaaccgctctccttgaacgcgccacgcagctacctgcagcggcgccgggatcaaagggggccctatttcacctacgaggtcattgtggtcgacgacggaagccaggatgccactgtgggcatgggtgctgactggcgtgaggccttggctgaagccctgggacctcgggacatcatcttccttggcgttgcggccggtctgggggcatgcgggcggtgtgcggccaagttcacccgcaagcatggcgtggatgcgctgcgcacgctgcgcctcccccagaatcgcggcaagggctacgccgtccgggcaggagtgctggtcgcgagaggtgatcatatgggggctcccgggggcggggagaatgggatggcatgtcaatgcaggggggtcagtctgcgtgcagaatcgctgcctgagtggcacggaggtctcaaatcgattcactctacccaccgctcagggcaaaacatcctgctcatggatgctgatggggcgacacgcgtgtctgacctggagcgtctagaaagcgcggcacaggacgtcatgcagcaaggtgacctgggatggagtgtgggcttggggttgggtcagcctgagccacttgcggttttgttgcgggctgttctccgagccagcaggagggtcactgcagtactgtcacccttgccagggtga

SEQ ID NO: 8272 - DNA, 327 bp, Chlorella protothecoides
gtgctgttctcccccgacggccgggtcatcgcctccgccagctttgacaagtcagtcaagctgtgggacggggccaagggcaccttcatcggcacgctgcgcggccacgtgggcgccgtgtatcaggtggcctggtccgccgacagccggctgttggtgtcggggtccaaggacagcacgctcaaggtgtgggacgcgcggacgcggaagctggccatggacctgccggggcacgcggacgaggtgtactgcgcggactggtcacccgacggcgcctcggtggcctcggggggaaaggaccgggtgctgaagctctggaggcagtga

SEQ ID NO: 8273 - DNA, 678 bp, Chlorella protothecoides
atgcacccctccgccccctccttccaccctgtgagcaggcatgcgggcttcagcaaggtggggtcactccgcacctcaacgctccacatcatggggctctccatgtcagctattcgcgtgagcaacttggagatcctgtcagctcgatccacggtggtccttaccgccgtggagtgcctgaagccaggacagaaggcgtgctcggcagacagcgatggcaacatcggctccggcaacaggggcaagaacaattttggcaccaagaacgttggggatgacaatattggtaactccaatgtgggcacggctaactggggaaacaataataaaggcacaagcaatcgctgctttgacaagactggtaatcgcaagattgtcaacgactgcagcctgcaggagttcagaaagcataagggcttcagcaaggcgggatctgtccgtaaatccactctcgacatcatgggtctctcagtgagtgccatccgcatgagcacgttggagatcgtgacaccacgctctacggagatcctggtagccgtggagtgcctcaaggcgggccagaaggcgtgcacggcagacagcagtggcaacatcggctccggcagtaagggcaagaacaactttggcactaggaacgtcggggatgacaacattggtgagcaaagcaggggttgttaa

SEQ ID NO: 8274 - DNA, 660 bp, Chlorella protothecoides
atgctgagtgctggacaggttggactgcgcgcctcctggacggcggccgtgcccatcgtcattcacacgccaagctccacacgccggagctggtgcccaatccgtcgggtcccccaccctcgagccgctcatacccacccctctccaccaccacaggttcgctttggcgtgctcaacgccggcaactttggcgtggcccagtcccgcaagaggactttcatctgggctgcggcgcccggagagggcctgcccgactggccccgcctgatgcacgcattccgcaccccccagctcaccatcaacctgcccaatggcgtgcagtataccgccgtaccacagacggtgagagggaacggcgtgaaggcggggggttggccggcggcgggcgcccaaaacccggttgacctgtgtcctctccatcatgcacattgcacgcccacacctcagcatgctcctcccgcacccccaagggcttcactctctaacgctcacacactcatcccgcctcgccaggtgggcgcccccctgcgccctgtcacggtgcgcgatgccatcagcgaccttcctgtcattgccaacgggcacgacgtggaggagatggagtaccagggggagccggtgaggagcaggggctcgtggggaggggcgggcgagttgtga

SEQ ID NO: 8275 - DNA, 981 bp, Chlorella protothecoides
atgcagggttcccacgtgggcctgcgtgcctggggcatcgcccagctgatcggcgtggagagcagcggcaagggcaagggcgccgcctgcaccctcaccgtccgccgcttctaccgccccgaggacatccatgaggacaaggcttacgaggcaccctccttccacgcggtgagctgggatgggggccctgcatggcgcgttggcaggggctcggcatgccgaaagctctggcccacaactcccgacccttcctctgaacctccctgtcccaaaaacaacccctctcacccaggctctgcttccgatgcctccaacgcggcccccgcctccgccaaggccgcggacaagggcaaggcggcggtggacgccttccccggtgacgacggcgtgtcgctggccagcatggacatcttcgccggctgcggcgggctgtcggagggcatgcaccaggctggggccgcccacgcgcgctgggccatcgagtacgagcgcccggcggcggaggccttccgcctgaacaacccgcgcgccgcgaccttctgcgccaactgcaatgtgctcctgcacgccgccatggtcaagggcggcggcgccgacgactgccaggccagccccgaggcggtggccgagagcgaagccctgcccgccgaccaggtggcggcgctgccgttgccgggcgaggtggacttcatctgcggcggcccgccctgccagggctactccggcatgaatcgcttcaacaagggcaactggtccatggtccagaactccatggtcatgagcttcctgtcctacgccgactactaccgcccccgctacttcctgctggagaacgtgaggaactttgtcagccacaacaagtccttcaccttccgcctcaccctgcgctgcctgctggacatggggtaccaggtgcgtgatgggggcagggtgggtggtggtctggatgcaagggggggggtggcggaccatggcagctga

SEQ ID NO: 8276 - DNA, 4638 bp, Chlorella protothecoides
  modified_base (287)..(296): a, c, t, g, unknown or other
  modified_base (417)..(426): a, c, t, g, unknown or other
  modified_base (561)..(570): a, c, t, g, unknown or other
  modified_base (2700)..(2709): a, c, t, g, unknown or other
  modified_base (3251)..(3260): a, c, t, g, unknown or other
  modified_base (4319)..(4328): a, c, t, g, unknown or other
atgcatgcatggcgcgtcgcacgtcatgtacagcgagaggatcaagtggcaaagtcagagcgcaagggagggggaagggacggcgcctgtcgttctctgtcggcggcgaacgcagggtcgatgaaggtgggaccggtgcgcggcagcatgaaccctcacgaccgggcgcccacggggagctccaggggcttcagcaccacggcctcgcgccccggtcccaccccgatccacttgacgtgcacgcccagcctcgactcgatgaagcgcacgtacctgtgcaagggggnnnnnnnnnngccatggtgcgccctgcaacccttggggccccccgcatcaactgttcaccaaacaatccggacacagccaacagggttcacaccccgacttcgacacactcacttcttggcgttctccggnnnnnnnnnntgggaggagggagtgaccaggggaacaaaggggcttgccctatctgctgccctgggcttcatccggccggatgctgcacgtcgggcgccaccggagcacatccacatccactcagcagggcctggtccttctggnnnnnnnnnnagcttcatcccgccggatactgcacgtcgggcgccaccggagcacatccgcatccactcagcagggcctggtccttctggcagcgccaccacggtcctcccaggtgcgtgccttgctgatgtcctgctgccacccgggcagcgtctcccacaccacctcggcgcgctccagggtctccaggtctgcggggacggtgggcaggtccccctccggggtccggtaccccacgcccaccctgatctccttcagcccgtccagcacgtccagcttggtgaggttgaggtgggtcaggccgttgatgcgcaccgcgtagcgcagggccaccatgtccagccagcccacgcggcgcggccgccccgtggtggtcccatattcggcgcccacctcgcgcagcgtgtcggccagctcgccgtggatctcggtggggtaagggcccgcgccgacgcgcgtggtgtaggccttggccacgccgatggtggcgcccaggcggcggggcgccaggcccagccccaccaccacgccgccgatggaggggttggaggaggtgacgtaggggtaggtgccaaagtccaggtccagcatggtggcgttggcgccctccaccaggatggaccgcccctcgtccgcccactcgttgagcgcgtgcacggtgtcggagacgtagggcgcgatgcgggccgcgatggcgcggtacgacgcgatctccgcctccacatcgtagtcaaagtcggcgaagcggcgctgcccgtccagcgccagcgcgcgcagcttggcggcaaaggcgtccgggtgggcgaggtcgcccacgcgcaggccgttgcggatggccttggaggcgtaggcggggccgatgccgcgccgcgtcgtcccgatctccttgcccgtgcccgccagctcctcctcgcgccgcccgtcgatctccttgtgcaggtcgaagagcaggtgcgcgcggctgctgatgaacagccggccctccacgcttacgccccgggcctgggagaagggatggagacgcccgccccgcagcccctccccacacagcgacatggctcgacgcacgaagtgctcccaggcccgcattccatgttaaatcccagaaccaggccccccttgcacacccacctccatgccctcaatctcctccaggagggacggcaggtgaaccaccacgccgttgccaatcacgcatttggccttggggttcaggatgccggaggggagcaggtgcagcttccacttgttgccctccgtgtcgtagatggtgtggcccgcattggctcccccctgtgcaaggtggggtgttgcaggttgaggggagttccagacccgaacacagttgcgggcaggggagtaccgcatggtaggcatggatgcgggccagaggcagtcgcagcctggacactatcgctggctggagaccgtgcagcccacaacacaggtacactcccatggggttttcaggggtcactcggtcccagcgtgacatacacagggctacaggactccattcgcccaacgcagctcccaaagcaaataccccagtacctgagcacgggccacaatctcgtacttctgggcgaggatgtccaccagcttgcccttcccctcgtccccccattgcatcccgaggaccacaacgatctgggggtcaaagggctcctccgtctccactctggcaggcgctgcactggccgcagcgcgcaggcctcgccggggggcgctgcagggcggggccctcctcgtggaagcaatactgcatgtcctcttcagctcgacagctggcctgagacagcccatacgggtgggttcggcaccaggagattattgatgaggccagacaaatctaatcagcatcctatcgtcgtccgtgctcacatattccaaatcgtgcaaacggtcggagctgggaagcaaacagcacacattggcacctggaatggctggcttagtgcaaagtatgagctgcctttagtccttcatttggacttcaactttagcacgacctggagacctgcacttggacttcaacttgaacacgatctggaagtagaacttctcaaggacagctgccaagcacatgcagcgggagaacgcgccgaaaggaaattctgcgagcgcggtaatgtgacnnnnnnnnnnggtacatgcagcaggagaacgcgccggaaggaaattctgcgagcgcgagggtgcaagcctagaattctgcccactcccctcgccggggcttggatgcttcagagcgcccgtacaagctcccatgttattatttgcatactgttgttgttagctggccccggcctggccgcggcagaggatgcggcgggttgccgcgcgacttcaccgcaggactccaagtgccagtcggttagggacctgcctgccgaccaggatcggtgtgcatacgccgagacctactgtgagacggacagcctgttcgactacaccaaggcatactactgccatgtataccccactccctggaagcaggggctcatgatcgtgagtcgtgttgctgaggccaagcatgaaacgccgacaagcacgcagagccgtcaagttctgggcaagcgtgccagaggtcagcgcactggcttggtcattgttggcgacgtattctcacctccctctcccccctcattccctcattcccccgcaaccagactgcatgtgtcctcctnnnnnnnnnnagtacctctgtggggaatgctcgtgaggatagcagacgccgacgagcatgcagagccgtcaagttctgggcaagcgtgcaagaggtcagggcactggcttggtcattgttggcgaggtattctcacttccctccccccccctccttccctcatccccccgcaaccagactgcatgtgtcctcctgctactcaccctgttccgggtgatggccctggccgcggacgagttcttctccgtcatcctgtcccagatctcccaggacctgggcctgcccccgcgcctcgctggggtcactctccttgccctgggcaatggtgcgcccgacctctcggcgagcgtcgcggccgtcaagtctggcaatgtcgagtgagtgttgtcggctcgggcatgcttgtcatttgggacatggccatgggtgacttggcatggaaagcgggacaaggctggctcagcctggacatcgcaagaaagtgccgattatccaggtctaatccactgggccagttgcaacaaaccccgtgccgcccttttcccctcccacccaggctggcactcggcgccctgaccggcgccagcatgtttgtgacgtgcatcgtcgccggcagggtcatccgaatctgcggcggcgtgtctgcccgcggggcacagattcgagacatcgccttttttgctgcagccctcgtactgatcgccatcgtgggtgagtggatggagctatgcctggcatttatggaagcgagtcttcaagtggcgcctctgttactgcccagttcaaggccacaaaccttaccgctgggacggtcttgttggcgtagcatccagatccccagggcgtctgcccagggtccctttttgtgcacagcggtggctcccagccagcagcctgcttgcatcctgatgtccttcactccagccttccgctcaaatgcacccatttccttttcctgcatcgtgtgcagtggggtccggcagggtgaatgccggcgcggtggcggccctcctcctgctctacatcacctacgtggcggtggtggcgctggccgacatcagcaagcgcnnnnnnnnnnaaatgccggcgcagtggcggccctcctcctgctctacttcacctacgtggcagtggtggcgctggccgacatcagcaagcgcgcgggcgtggcctggacccgcctcctcgacccacgagtcatgtgcgcggagggtgggacccccagcccctggaccctgtccctggtgtcccgccggctgcccccggggtcgcgcctcgcggccccagcggccctgccgctgcccgccgccgcctgggcgctgctgggctccgggcccacaggcctgagccttgctgcccgttcccgccatgcccacccccgcctcccc

SEQ ID NO: 8277 - DNA, 744 bp, Chlorella protothecoides
atgtacggcatggactacgtggcctccgagcgggccgagcagcagggcctgttgcgctccgccctcatagaccacgtgcggcgcacacccgaggcgctgatcgtggtggaggaatacgacaagctggactgcggcatgcgcggcttcttccgccagttcctggagaacggtgcggtggggaacgtcacccttaataaggccatcatcctgctggagtccaacctgggctacctgcagctgctgggcctgctcaaggccagccggagcagggcagaggtgacggcggagcaggcccagcgcgtgctcaaggacctcatcttcgagcgctgggagcggcaggcgtgcgaggaccgcaccgacaccctgaagatggtgggtctcggagggtcttgggtggaggcaggggctgccagccacctgcgcgccctgttcgaggcccggctcgagcgccgcagccaggccttggcccaggcgggcgtggggcggctgatgtgggatgcggctgtccttgatttcctgatatcccatgtggagttcgacggcgcgtacccgctggagggtgccaaggaggtggcggtggtgctgaccaagaccgtgtcccgccccgtgcgccgttgggctgaggagcagcagcgacgccaggccccggcctcgacagggaaaggggagggcgcggacgtcccgcactgcgcgctgcaggtggtgaagccgctgggccgaccccggcagctggtctgcgcctga

SEQ ID NO: 8278 - DNA, 1170 bp, Chlorella protothecoides
atgcctaccatgcggtactcccctgcccgcaactgtgttcgggtctggaactcccctcaacctgcaacaccccaccttgcacaggggggagccaatgcgggccacaccatctacgacacggagggcaacaagtggaagctgcacctgctcccctccggcatcctgaaccccaaggccaaatgcgtgattggcaacggcgtggtggttcacctgccgtccctcctggaggagattgagggcatggaggcccggggcgtaagcgtggagggccggctgttcatcagcagccgcgcgcacctgctcttcgacctgcacaaggagatcgacgggcggcgcgaggaggagctggcgggcacgggcaaggagatcgggacgacgcggcgcggcatcggccccgcctacgcctccaaggccatccgcaacggcctgcgcgtgggcgacctcgcccacccggacgcctttgccgccaagctgcgcgcgctggcgctggacgggcagcgccgcttcgccgactttgactacgatgtggaggcggagatcgcgtcgtaccgcgccatcgcggcccgcatcgcgccctacgtctccgacaccgtgcacgcgctcaacgagtgggcggacgaggggcggtccatcctggtggagggcgccaacgccaccatgctggacctggactttggcacctacccctacgtcacctcctccaacccctccatcggcggcgtggtggtggggctgggcctggcgccccgccgcctgggcgccaccatcggcgtggccaaggcctacaccacgcgcgtcggcgcgggcccttaccccaccgagatccacggcgagctggccgacacgctgcgcgaggtgggcgccgaatatgggaccaccacggggcggccgcgccgcgtgggctggctggacatggtggccctgcgctacgcggtgcgcatcaacggcctgacccacctcaacctcaccaagctggacgtgctggacgggctgaaggagatcagggtgggcgtggggtaccggaccccggagggggacctgcccaccgtccccgcagacctggagaccctggagcgcgccgaggtggtgtgggagacgctgcccgggtggcagcaggacatcagcaaggcacgcacctgggaggacctgccggagaacgccaagaagtga

SEQ ID NO: 8279 - DNA, 387 bp, Chlorella protothecoides
atggcgtcactcctgctcagccccaccgtcaccccgacgacctgcagtagacgcgggcatgcggcatgccagtactcaacccgtatgggctgtctcaggccagctgtcgagctgaagaggacatgcagtattgcttccacgaggagggccccgccctgcagcgccccccggcgaggcctgcgcgctgcggccagtgcagcgcctgccagagtggagacggaggagccctttgacccccagatcgttgtggtcctcgggatgcaatggggggacgaggggaagggcaagctggtggacatcctcgcccagaagtacgagattgtggcccgtgctcaggtactggggtatttgctttgggagctgcgttgggcgaatggagtcctgtag

SEQ ID NO: 8280 - DNA, 969 bp, Chlorella protothecoides
ggtgttgaagcgtgcaggggcttgcctgtggccctgccgtgtgccgttggacatctcggtggacgagtcggagcggctgccacgcctgttcagggagttcaccgatggcgtgctggatgcagggctggggctggggaggaaagcgcgggaggacgcggacgtgagcgcgcgggaggccctgcagcacgccacgccgtccctggccaagctcaaggcgaggagggcaggaaatggggaacgtggcccgtgatgggtgctggggaaagacatgggtggtcgggtggctggagcagccatgttcaaccgttggcttccttgcctgtccttggcatcgcactcgggtccggcacctgtcaccagggcatacatgttcatcactgcagcctccttgtcgacatccccactcatgcattcctcccacaggaggtcctggagctggtggagatcaggctgaccgagatcgcggcgcggtgggaggatggcaggctcagcgccctggggctggccccgcaggaggtggcgcacctggtacgggccctgttcgaggacacgccggctcgcagggcgctcttgacggccctgggcaaggcccggattgtgggcatgactcattctgggaagatgttcatgagcagggatcgtggtcctatgtatcctcactgcgccccggctccggcgacagcgttgccggagcgtgggagattcgcagcgccgacgcctcgagcaggtcgctcgccccgggttaccacgctcacccctcctcgaggctatacgatgcacgcccggaatagaaatgccaccacccacttgaagagaccaccagctccggcaaaggcttcgaggaaggactgcagtcaaggaaacacatctggtccctggtcgagaccccggaaccgtcctgcaaccaccccaacaagtcccgacgcactcggcctcgcagcccccggcgcgtttccgaaaggtttgtaa

SEQ ID NO: 8281 - DNA, 1593 bp, Chlorella protothecoides
  modified_base (598)..(607): a, c, t, g, unknown or other
  modified_base (854)..(863): a, c, t, g, unknown or other
  modified_base (1521)..(1530): a, c, t, g, unknown or other
atgcgtgcgactatagtcctctctgccttgttgctggcgcttggcccagtctccctggctgcggtaagtcgtctggcgaacgcgagggatgtccgggtgccgcccggagcagtgggcaatcgtactggccgaatgcaagtcttcattcttcagcctacccaccgcgaggtgtgcgatggaaacagaacgtgcagggccaccatgtccctgcatggattctgtttgcaagccctccctgactgtatggtaacatcaatctctgtacccctctcgcagtgtggatggtcagctgttcttgatctcggagaagagcggcccagcattctgccgacagtgccaggcccaacccctccgctctccattcacagcatgaagggcttcccgaggggagtcgttacatccctgcctgacacccccgatcagctgcccaagcatctcaatggcttggacatccatatccttgacatcgctgccatgagcatctgcgatggcacctgcgacctggccctcggcgtcgagtgtgtccccaagggggaggacaactgcggctttgacggcaagctcaacattggcaacaacaacacgggaatgagcaatnnnnnnnnnnagtgtgtcccggagggggaggacaactgcagctttgacggcaagctcaaaattggcaacaacaacacgggaatgagcaacgagggcaacaacaatgtcggacaacacaatcttggtgcgcgctgtgatgcagggagggctcacactctccaaaaccacagggccgcctgccaaccccctcacccctgctgtgaagcccttccccacaatgctccctgctctcccgagggacagcctgcttgcctccnnnnnnnnnntgtgatgcagggagggctcacactctccaacatcacagggccgcctgccaaccccctcaccgctgctgtgaagccctttcccacaatgttccctgccctcccgacggacagcctgctggcctctgcccttgccctgtcagatgcactgcgcgccccccctcaccttttcctccccaccacaccacccctcaggctccaacaatgtcggagacaagaatgttggcaacaacattgttggcaccaagaggttctgccacaacctgcgccgggatggagacaggtgcactctggacacgctgaggactgcagatactctggagctgaagaccgaccccaccccacctgcccccgagagctcaccatttccaccaactccaaagctctccccaggccagacagcaccacccccaccctcgcacgcgctggtcatcaccagcgcctcgtgcttcaaggccaacgacaggcagtccaggtgccaggtgctcctcacgacggcacaggcactgaaggacctcgagctgaccttccaggacgatatcaggccggacgccagcgggatggtcaacgccatggggcacacgctgtcgaatcaagtccttcaggccgacaacgccatccgcatcaccagtgtccctgcgcccccccctcctgcctagannnnnnnnnngtccttcaggccgacaacgccatccgcatcgccagtgtccctgcgccccctcctcctgcttag

SEQ ID NO: 8282 - DNA, 339 bp, Chlorella protothecoides
atgaagggcttcccgaggggagtggttacattgatgttcgacacccccgatcagctgcccaagtatctcaatggcctggacatccgcatccttaacattgcatccatgaccatctgcgatggcacctgcaacctggccctcctcgtcgagtgtgtcccggagggggaggacaactgcaaccgtgacggcaagctcaacgtcggcaacaacaacaagggcatgcgcaacactggcaacaacaacgtcggggagcacaacctcggtgcgtgctgtggtgcagatgggcgcgccgactccagtttgccgggtggcttgctctctccctggtgttccctgtga

SEQ ID NO: 8283 - DNA, 1020 bp, Chlorella protothecoides
atgacgtgccaggtgctgctgaaaaggggctccagcttccccaaggatgcgccctcccccatcatcgtctgcacccgcaacgacgctctggagggcgtaatagaaagcgtgcccaaggaccggcacggcggtggtcttgcctccgccacccagctcctcgtctactttgctgtggccaaggctggtgacactccagtggatgggaagaccgacgtcaacccggaggggctgacctcggtctgggggcctcactcggaggccgtggcgcagcggctggctgcagggggcctggcctgcaaggtgcgtgccaggctggaacagggcttgggcgggagcgtgcgaggcgcatgcggagttgagaggggctggggagagggggaagcttcacgcttctctccatgcatgcgtgggagcagagccccgggtccccgccacgctgcctcccaggtgctggatcgccctgccttcctgcaagctatgctggagaaattggtctggatctcggcattcatgctggtcggagtcacccatggcggctgcagcgtgggcgaggtggagagggggtctcatggggtgggggggaggggaggggggccatgtgatggcttccaccagtaccaggtagctgcggcagggcccccaggcccccctgtctggcgaggtcggggattggaggtgcggacgcgcagccagggtggctgcatgtcgggccggacctcgcagcttagagctcgtcgtcagccggcccacctgtggcgcaagccccccctgccgcagacggccgagctggtggaggagctggccagcgccggggccgcggcgttgggtgttcggctggaggccggcgcctgggagcgactggccgcctacgcgcgctccgtggcaaactacccgaccgcgctcaaggagtttgagtggcggaatggctggttcaaggagctgtcccgggaggcgagtgcctctggaaagcaagacccgtgccccatgcacacgcgcctcttggccgggctgggctactga

SEQ ID NO: 8284 - DNA, 417 bp, Chlorella protothecoides
atgatggcccgcgccccgagtggcgtgtccgtcgcggaggtgaagcccaaccgcccgcccacggtcttcgagtcgaggctgtatgccgtgtgcaagagcatccccgagggcaaggtgtccacctatggtgccatggccgccgtcctgaagagcgctcctcgggcagtgggccaggccctgcgtcggaacccctacgcccccgcggtgccgtgccaccgtgtcatcgccgccagcctggaactgggagggttcagcgggcagtggggactccagacccccaacgtctgcaagaagcgcgccctgctggagaaggagggcgtgctctttgacgccagggggaagctggtggacgagagccagtgccttggcgctgaggagctgggccgcgcctgccgcgccgcgggctgtgaggcctga

SEQ ID NO: 8285 - DNA, 567 bp, Chlorella protothecoides
atgtcccatggtattctcctctctacaatttccccccttccctccccccaaacacctcagctgctcgctgcctttggaggcatgcgtgaccagatgatgcaggaggatctggccgcctggatcgacatgaacgacatctaccccggcgtcgctgaggcggtgcggcggctggtggccgaccacgaggcctacattgtgaccaccaagcaggcgcgcttcgcggaggccatcctgcaccgcctggcaggcgtggacctgcccccggagcgcatcttctcccaggccgagacgggtgcgcccaagtcggagatcctgcaccttctggaggagaggcaccccggcacccagtaccactttgtagaggacaaggcgctgaccctacacaaggcacgcggtggcagaggggagggaaggaggggggtagacgagaggccgggtggtgggaggatgagccatgccgcagcttgcccactggaacctgtaccttgtggactggggctacaacacgcaagaggagagggaggtggtgcggcggcaagaccgcatcaagctcatctccctggatga

SEQ ID NO: 8286 - DNA, 1155 bp, Chlorella protothecoides
  modified_base (305)..(314): a, c, t, g, unknown or other
  modified_base (754)..(763): a, c, t, g, unknown or other
atgcatgctgcccccaaccctgtggtcatgctcaaggcgttggaggtgggctgggatggtgcagagatgggattgggaccgtcatcccggaggggcaccgtgatgactcacctttcaatcagcacgttatcgacgcctctcccctcgacgggccccgacctttgccaaagacgtcgtcccggaaccacaccccagctcgccttgccctgtgttctgggcagaagacccttggccgatccccggaagaaggcccagacccctcctcaaacacccgccggcccacccacaggacaccatctccatcnnnnnnnnnngggccctgtgttctgggcagaagaccctcggccgaccctcggaagaaggcccagatcccacctcaaacacccaccggcccacccacaggacaccatctccatcatccaggagacgcagagccagcacggcatcgccggcaactcgctgctcaacttttgtgtgtcagacggcgccacgctggtggccacgcgctacacctccagccccgacgaggagcctgcctcgctgtactacgccgagggctgcagctacgaccgcagcaaggagggggtggaggagtcgggcatcgcctcggccgccgccgccgcctccgacccgggcgggcagcgcgacagcggcacggccaacgccagctccaaggccgttgcgggaatgcccatccctgcactcaggctcatcccattccggctccccactccacttccgtccactgctcgtnnnnnnnnnnaggaggcggcagttgatcagtcctcgcgtggtacccgctgggacgcaggaatgcttatccctgcactcaggctcatcccattccgactccccactccacttccgcgagggcgactaccacctgacctactcggagctgggctcgcgcgtttgcctgatcgcatcggagccagtcacctccagcgggtcggactgggtggaggtgccgcgcaacactgcgttggtggtctgccgcgagaccagtggcgtgctgtgcgtcatgcgctcgccgctggtggccggcgcggagaacccgcgccgcgcggaggtgtaccgctgcctggaggcggtgacgctggccgccggggtcaagccgggcgcgcgagagccggtgcgcgcgcctcgcgtgggtga

SEQ ID NO: 8287 - DNA, 2130 bp, Chlorella protothecoides
  modified_base (449)..(458): a, c, t, g, unknown or other
  modified_base (960)..(969): a, c, t, g, unknown or other
  modified_base (1496)..(1505): a, c, t, g, unknown or other
  modified_base (1677)..(1686): a, c, t, g, unknown or other
cgctgggcgcgctggcgcgagcgcgtggcacgcgtggacaaggacgtgcggcgcacagaccgcggcgcggcgcccttcgcgcgcgagggcggcgcgggcgcgcgcatgctgcgccgcctgctcctgacctacgcaatgtacaactacgacctggggtactgccagggcatgtccgacctggccgcgcccatcctggcagtggcgatggcgggaagggggggcggccgcctcgcgcgggaccagcaggcggaggtggagagcgaggccttctgggggtttgccaacctgatggagggcgtgggggccaacttctccaccgactgcacggcggggcgtctgggggcggcgggagctcctcgtgtggattgcatggatggggcaccgacaccattcgtccccggcgcgcagggggatgcacgcccagctggaggccctgcggcagctgctgnnnnnnnnnnaggagctcctcgtgtggattgcatggatgggacaccaccaccatgcgtccccggcacgcaggggcatgcatgcccagctggaggccctgcggcagctgctggagctgctggacccgcccctgcacgcccacctccatcgccgcgactgcctgagcctgtacttctgctaccgctggctcctcatcctgttcaagcgcgagtttggcttcgaccaggtgctccgcctgtgggaagccctgtggacggcggtgcccacgccgcatctccacctctacctggccgtggcggcgctggcctcgcgtcgccgcgacatcctgaccgccgacgccgacttcgacggcatgctgcgcctgtgcctggagctggcggggaagctggacctggaggcgctgctgagggacgccgaggcgctgtgcgcctttgccggggacgcaggccgggcggtggtccagggcctgccggggccgcccaagcaggcgcctatgtgaggggggtagttagnnnnnnnnnngggggggcgtggggcggcagacgttgccccgggccggcgcgcgccgggcggcattgtcctcctttcacgaacatccaagaagctgtctgcccagaggtgtgccagaatctgtggggtgtcccacccaggagggggaggttttcttttcctccacacggccgcagccgcggcgcaaatttcgaaagtgatgaggtcgggctcaagggcagccgcgcacctaacactatccaagaacggtcgactttgtcgccctttgatccaagtacctgccacaaatacattagagcacaagccgctgggccttttattggccaggacctgggtttatcctgcacgatgggtatttgctggtgcttcccacgtacgcggaatggatgggaaggcgagggtgcatcggcccctgcgcagctctcggaggctctgctcaagcagccggaggcacctgccaccgacgcccccatccctgctcggatcgccgaggattcccctgccaaatcagccacagatgcattggagagcaccggcannnnnnnnnntgccgagggttccccggccaaaccagccacagatgcattggagagcaccggcacgcctggcagaagctcggcccaggtgattggtgactcgatcatgagcaggaacctggaggtggatgcgagaccatcgaattctatcacaaaggaagctgcagagccgcagccaccgagnnnnnnnnnngcttttgcttccgagccccaggagcctgctgcgcggtcagagcccttggagcctgtggttccagcagccaccgagcagacctcacggtctgaggaggtgttgccgtccacccccgctcctcctgccccgactgccgaagaggcaccagcctcaggctctctgctccctcaggggtctcccagctctgcctccattgcccccgagcccgaggctccccaggaaagggccacagctcagcagcaaggcaacaagaagaaccagcgcaagaggaagggcaagaagggcaagaaggcggtgcaaagtctccaggtaaatgggaagttggatactgggagccatgtgaacaatggcacaaatctaggtatcagtaaaggtggtatcaagatgaaatcaggccacgcaaccagattgctagctcagtgtggccctgcagaagggaggtga

SEQ ID NO: 8288 - DNA, 801 bp, Chlorella protothecoides
  modified_base (344)..(353): a, c, t, g, unknown or other
atgcctggcgctggtggaggtgcgctgactcttggtggcaaagtgtcgatggactgtcgggagctggcatttcaaaggcctgggtgtctcgggcagccgccgtgtgcgtatggagtcgacaacacccataaatatggtgcatgtccccctgcagcggaagaaagaacctgcaccaagactatggagcatcgtgctcatcatgacgacgcttgcgggtgtcacgcagaccccgctccagccagccagagcctcgatgagatggcattcgctgcctctgcatgctcggcagcacaaagcggagatctcaagggactacaaaggctgtatgaccgcgcccgatcccnnnnnnnnnngtgtgcgtatggagtcgacaacacccataactatggtgcatggacccctgtagaggaagaaagaacctgcaccaagactatggagagtcgttcatctggatacacacctttgcactttgctgctcgggctggacacgaccacattgtggcctggcttctcaaacaaggtgattatccgagtgtggcttctctggaacagcagtgcttgcctatccttgtcacatattacttccatcacatcgcaatctcaggtgtggaagtgaacgccaccacaacagctggacgcgctacccccctgcaccgggcagcctacatgggtcatgcaagcatctgcaggatgcttcatgaggcaggcgcctcctgcctgctccgagatgcagatggacacacggctgcggacaaggcagaggctcaggtgaggcaaccaggttgcagagttgtgtggtga

SEQ ID NO: 8289 - DNA, 1893 bp, Chlorella protothecoides
  modified_base (1102)..(1111): a, c, t, g, unknown or other
  modified_base (1215)..(1224): a, c, t, g, unknown or other
  modified_base (1858)..(1867): a, c, t, g, unknown or other
gatctgggactcctggagcgtaactctgccacttgttccacgaaggaaggcactgggcatggggtgcgacatggtttattgctgttatactttcaccggtttacatgcccggggaatgggccttcatggcccgggcctcggcgtggcgcggctgcctgccctcctccacaggtccggctgtacgtgtggctgggcgggactgggggttccccacgcggccccatcatggtccaggctgctgtagctcgccaacgtctcagacacggcatgtcgcctcctcgacctcgatgtggcagcaggtgggtggcgagggcaggcccccttaccccccctaagcttcctcccaggcacctgaggccgggctcctcacaggtgctggcgcccagtcccatggctacctccccgttcatgcgcgccacatgctgccccatccacctcccgcaggaccgcgtgctggcggacggggccttcgtccccgccccctccccgcccgtcgcctctcccctcggccccgcccttgggcgtgtgccctccttcgtccccgccgccccccccgtggcccccgccgcgctgcaggccttggaggacttcgtcgcggcccaccccggcgtgctggtggtcacgggggcgggggtcagcaccgaatcccgcatccctgactaccgctcgcccgccggcgcctacagcaccgggttcaagcccatgacgcaccagcagttcatgggcagcgccgcggcgcgcgcgcgctactgggcccgctctttcgccggctggtaccgctatgcgggcgtgcggccgaatgccgcgcacgaaggactggccgcgctgcagcgccgcggctggctgggcggcatcctcacccagaacgtggatcgcctgcaccacgctgcggggagcggggacgtgctggagctacacggcaccacccacgccgtacggtgcatggggtgcggggcggtgacgccgcgcgtgcagacgcagtctcgcctcgcggagctcaatcccgaggtggacgcgctggcgcgagcgctggcgggggcgggggagggcgatgaggacccgccgcggcacggggtggatggcgacaggagcatcgacgacnnnnnnnnnngctcaatcccgaggtggacgcgctggcgcgggcgctggcgggggcgggggagggggatgaggacccgccgcggcatggggtggatggcgacaggagcatcgagnnnnnnnnnnggtgtgcacatcggacgtcagcttgcacgtgcgtactcatcgaggccccgtgcgacgctcgtaccaagaccctggttcccagatgagtacccgaccatccccctccaacccccttcaccactcgcaccccatgtaggacgaagcgttccgggggcgggaggacggcagcgtccgggtgccggtgcggcggccggatggcgacgtggagctggaggatgcggggtcggggttccgagtcccgccctgccccgcctgcggcggcatcctcaagccggacgtggtgttctttggggacagtgtgcccaaggacgtcgcggcgcgggcgcaggccgccgccgccgcctgcccggccatgctggtggtgggttccagcctccaggtgtggtccgccttcaggctggcgcgcgccgccaaggcggcgggggcgcccctggccctgctgtccgtggggcccaaccgggcggacgacctcgcagacctcaaggtggaggcgcgggcgggggaggtcctggcgcggctggcgcgctccccccgcctgctcctgccccacgtcccttgactagactgcagggggtcctccgccctgtggcgtcgtaccctcttctgacttggtttttctgttgtaattctttcnnnnnnnnnngcctgctcctgccccacgtcccttga

SEQ ID NO: 8290 - DNA, 417 bp, Chlorella protothecoides
  modified_base (213)..(222): a, c, t, g, unknown or other
gctgccgccggcgggcgcgccgccgccgcccacgcgcgcctcgcccaccgtggcggcgggcacgcccgtggtcgaggccctggccgtcgcctcggtctggatggtcgccctgctcaaaggcctgtgccaggtgggttgaagggcgttcttttggccggggtgtgtgtcctttctcccccactggttgccagccgcgccatgccttcgcccggnnnnnnnnnngggcctgtgccaggtgggttgaagggtgttagtttggccggggggggggggtttccttcctccccccccccggttgccagccgcgccatgccttcgcccggcgccctcccctgccacggttccacccttcgccccaccagtcacccttccctggcgccccccgacgcgcgcaggacaagcagtaccggggcctga

SEQ ID NO: 8291 - DNA, 203 bp, Chlorella protothecoides
atgctttgccccacccctgaaccccactccccatctcagcaaatcaacggcgccaactggggctggtctgccctcaaccggctgtgctgggccattggcagcatctccggcagcatggtggaggaccaggagaacaggtgcgagggtgggtggcagggcggcaccgcgcatgggctgccagggatgggaaggtgggaggcgtg

SEQ ID NO: 8292 - DNA, 1125 bp, Chlorella protothecoides
  modified_base (128)..(137): a, c, t, g, unknown or other
  modified_base (623)..(690): a, c, t, g, unknown or other
aggggagggtgggatctaggtcgcaccgccccccgcccagcttgcgaccgaccgccccccgcccagcgcacccgcgaggccacgactgcccccctcgttcctcccgcatccctcaggcctgcagcgcnnnnnnnnnnaactggtcggcttgcgaccaaccgccccccgcccagtgcatccgcgaggccacgactccccccctccttcctcccgcatccctcaggcctgcagcgcggcgagcgcacggtgcccacagagcggccgcaggccatgctcacggccgccgacctgccacgctgcgagctgtccgactacatcgaggcgcgcctgacgcgcacgatcgcggaggagagggcggcgcgcgctacggcgctgggggtgcacccgtccaccgtccccaccgcccatgggatcacaggtgagagggcgttccgctggggtgggatcgggtatgaggcgggggtgtgcctggtggcggcagaatatcaggcgcgaggcttcggcgccggcctcgcccaggctctggagtcttggaggcgaggatccccgccgcagcaccgtgccatccctgcatccgcaaccgttctgctgcctgtacagtgccctttgttctcccatccccnnnnnnnnnnnnnnnnnnnnnnnnnnnnnnnnnnnnnnnnnnnnnnnnnnnnnnnnnnnnnnnnnnnnccatccccttcacacccaccccacacacacagtgcgtgtggtgaacaacgtgaccaagaagaacgaggtccggcagcgcttcctggacgcgttccggggggagggctaccccgaggccttcatgtaccgccagaaggtcctgctcctgttccagaaccgcgatggcgtggacctctgcgtctactgcctgtatgtgcaggagtacggcgacgaggcgccggagcccaaccgcaagtgcatctacctctcctacctcgactcggtcaagtacctggagccggaggaggtgacggcggcggggcgcggcgtggccttgcgcaccatggtctaccacgaggtcctgctgggctacctggcacacgccaagcagcgcggcttcctgcagatgtacatctgggcctgcccgcccctgcaggttggctgatctttttgtga

SEQ ID NO: 8293 - DNA, 1170 bp, Chlorella protothecoides
  modified_base (386)..(395): a, c, t, g, unknown or other
  modified_base (847)..(856): a, c, t, g, unknown or other
atgcgaagacaggtcattaaccctccacctgagccaagcgcgcgacacgactcgagacccacggacaactttcacgacactcactcctgcaatcaggccgcctccgcctcaagccttgctctgaaacagggcgaaaatgtagggcgcggcacggacggccacgaccgcggctccgaagagagtcaggttgcggcggagttccgcgtttgcagccgcggcgtcgggcttgcgcacagcgaaaggcatggtaggcggatgatgcggatgatgtcagagatggtgcaaagtgatcggggtggttgtggctcgcggcggagtgcccgagaaaggttttacccgacactgagcacctcactgggggaggctaccaccggtactgcaccttnnnnnnnnnngtgcccgagaaaggttttacccgacactgaacacctcactggggagggctaccaccggtactgcacctcgacagcgcactcgatcgcatttcaggaaccacgagcaacccgtgaagatgtcaggggcaagaccttccgctcccacggcaattctccagcgcttccttgccacttgtcccatcgcaacatggggctcctctccctccatgtcacacacagcaagccttgcgggattttgaaggggatgctgtgccccaaacagacccgttcatcccttccgcctcctggagtggaccaaagcacggatactatttcagcaagggtgcccagggcacagggtgcgcggggaattgactgtcaggtgccagtggaggcttgctacattttggccttgcgatactaccgcgatgaccagtcccatccgggcgggggaaatacgggctcagacggannnnnnnnnntgactgtcagatactaccgcgatgaccagtcccatccggccgggggaaatacgggctcagacggagtcggcccggccggcccgggcccctcctcgatgccgccccctcccccacgagtcagggcgcgggatgcggaggagctgttgcgtgaggcggaggaggcggcggggccgagcgacatcggcatagtggacgccaaagggctcaggcgcctggtgctggctctggagcgcaaggtccctttggaggggggtggggggttagggtgggggtggatgcctgaggccagtggagcggccttcacgtctgtctga

SEQ ID NO: 8294 - DNA, 1713 bp, Chlorella protothecoides
  modified_base (1327)..(1336): a, c, t, g, unknown or other
atgtctgtggatcgcgggagggtggcgcttgacgctgggtggttgcaccctgcaaccctgccagcgtccgctcccctggtcctgcatgcccggcttcctacaagccctgcagtgtcggctcgggagggcgaccggcaggcagcgctcgcagggggcagggactccgcccaggacctgaatgccgacaccctgtgggccaagatccaggaggaggccgccgagctgtcaaagtccgagcctctcatcgccagcaaggtgtgttgtggatggtgcgttatcaatggggctgcacatggggtgtttgccacgcgtggcaagcgtgctgcgagacgggctgctgatgagggcctctctcctaggaacgcgggatatctgcggcctgtttttgttcacgcctgctcccgcaccagacctccctgcagcggctccctctcccccagccctctctcctcggccctctgtcctcagcactcccccactccttcccatctcccctttcttcctccagctggggatgacggtggtgacgcaccccagcctgtccaagtcgctggcgtttctgctttccaacaagctggccaacgagacgctgctgggcacccagctggtgcacctcttcatggacgcctacgccgacgacgcgggcctgctggcgtctggcgtggcagacctgcacgccgtcatggagcgcgaccccgcctgcgacacctatgtccagtgcctgctcttctacaagggcttccaggcggtgcagagctaccgcctgggccactggctgtggaagaaggggcggcacaccctggccctggccatccagagccgcatggccgaggtgttcaccgtggacatccaccccgccgcccggctgggccagggcctcctcttcgaccacgccacgggcattgtcatcggcgagacggcggtggtgggcgacaacgtgtccatgctgcaccatgtgaccctggggggggtgaggacgatagagtggcacagtggtggagctggagtctcgtaggggaagacccagtgctgcaggggtcggccagcggagtgttggtttctgcggtagccagtgcggtgcagggtccagtcacgaccctgcccctgttcaccattgttactgttcaaaccacacctcttcagcccctccacccccctcccctttcacctccaggcaacgggacgctattgggcgccggggtctcggtcctcgggcccatcatcgtgggcgccaactgcaagattggggccggctccgtcgtcctcacagacctgccgccctccaccgtggcaggaactggcacagccgatcctccccccatccctnnnnnnnnnngtgctcctttcgtgtcgctctctcagcggtcgaagctgccgatcaaaaggcgatcagctgtgtcttgttctatttgtaggaacttggcacagccgatcctccccccaccccctcaccacgccctccacagtcggcgtgccggccaagatcatcaagcagctggactcctcagtgctccccagggcatccatggagcagtaagtaggaggcgattttgtgtccttgggtctcgaggcctcaccgtgcagcaggcgccgcccaatcgccgccgcgtcatttcccacccgactccctcgcaggattgccgatttcatcctggactggacgatctagcacctagtttgacccgccagcgccgggcgccagtccagttctag

SEQ ID NO: 8295 - DNA, 885 bp, Chlorella protothecoides
atgcaccctcctgcagcctcgttcgacgaggtggacagcacggagtcgctgtccgcgcactcgtggagcccgggccccggccaccggtcggtggtggcgctgtgggacgaggtgcggcaagaagctcgcgccctggcccggcgggaaccggtgctggcgcccgcgctgcacgcctcggtgctgcgccacgctgacttcgccgcctgcctggcgtcggtgctggcgggcaagctgggcgacgccacgctgcccgcgtcccagctggcactgctggcggcgtcgctgtacggcgccgatgcgtcgctgctggaggccgcctcggccgacctgcaggccagcgtggagcgcgacccggcctgccccggccccctccagtgcctgctctactccaagggctggcaggcggtgcaggcccaccgcctgggccacgcgctgtgggccgcggggcgccggccgctggccctggccctgcagagccgcggcagcggggcctggggtgtagatgtgcaccccgccgcgcgcctcggccgcggcgtcttcctggaccacggcacgggcgtggtgatcggcgagacctgcgtcgtgggcgacggcgtcagcctcgcgcacggcgtcaccctcggcggctcgggcacgggcaagggcgtgcggcacccggtcatcggcaatggcgctctcctgggcgccggcgcctcggtactggggcccgtcaccgtcggccactgcgcgcgcgtgggggcggggagcgtggtggtcgcagacgtccccgcgcacagcctggcggtgggcatccccgcgcgcgttattcgccggttccccgtcaccatggagccctgcaagtccatggaccagacgctggacgacgtgctggactatgtcatttaa

SEQ ID NO: 8296 - DNA, 453 bp, Chlorella protothecoides
atggacgatggcacgtggctggtccaccagtcctcggatcgcgacgacaccagccaggacagccaggacagcaacgccgagggccactttgcgcacgactacccaggtgggacagcagtgaaggaggaggctggctgggggactgtgtgtgccaagatgggccaatgctggaacttcacccgtctcttggtggtcctcagccctgcccccagggggaacactgtgcagtacacactcatcacgtcattgcctcactcacatgccttccgccagacgagtattcggcgagcacagactctggcgactacgaccccgacctggggtactttcctcccacgcggcaccgccgacgacacatgggaagcagcagcggcagcagcagcgacgaggatgcatgcaggacaggactgcgctccaaagacgatggccgtcgccacttctattgagccatga

SEQ ID NO: 8297 - DNA, 702 bp, Chlorella protothecoides
gccggcgccgacgccggcgccgcggcgggggatgcggccgccgcgccgcagcggcacgcctcggtcccgcgcggcgacttcgaccccgccagcaccaagcaccgggggcagtacgcgctgcgcaagctgtaccacgagtcgcagggcctggtcatggtgctctactctgcaccctcctgcgcgccctgccggacggtgaagcccatcctgaacaagctggtggacgagtttgagggcaaggtgtgtgcagaggtgtgggggaagtgggaggcagctgcgcggggctttcctggggatgtcctcgggccaccactgcctgggcgcagcttcaccaagtccatcacaaggtctgccttcaacccccaaacaggtcaactttgtcgagatcgacatcgaggaggactcggagattgcacaggcggcgggagtgcacagcacgcccacgctccagttcttcaagcagaaggagcgggtgctgcaccagcccggggtcaagatgaagcgcgagtaccgggcgctcatcgagtccaacctgtgacgcggcggctcgtgaatgggcggctgcctgtactggctcgcgtccctgacatcgcccctggcgttgccagccgctctgcataccacccttggactcccccttgtcttcatgttgaggtattgtatcgcaccacaagccttgctggcactcatccagggaaatga

SEQ ID NO: 8298 - DNA, 1245 bp, Chlorella protothecoides
atgacctgtcttcgcatcgatcgatgccctgcgatccttgccaagtggctgtggcatccactcggcttcgtcttcgagcggagtcaaatccgatgcccacctcctgcggccctgggtccaacattgttaccatggatcgggagccatgttgctcagggtcccttcccttacaccctccctcccccctcctccccctccccaacgcgcccagtgtgtggcatcttcgggtactacaactaccaggtgccccgcacccggctggagatcctgcacctcctgctgacggggctgcagcggcaggagtaccgcggctatgactccgccggcctggccatcgacgcggtgcccatggccccggacgcggcccccaatgcccccgcgccccccgccctggtggtcaagggccccggcaagatcgtggaccttgaggcgctggtctcccgcgagatggcggcgggcgggcacgacccgacctcgcgcttcgaggtgcacgccggcatcgcgcatacgcgctgggcgacgcacggcgtgcccagcaccgccaactcccacccgcacgcctccaacgccgccggcgacttcctggcggtgcacaacggcatcatcaccaactacaaggccctgcgcggcttcctgcagggccacggcgaggtgtttgccaccgagaccgacaccgaggtggtgcccaagctgtgcgcctacatataccgcaccgcgcggggcgcgggcggcgccccccccgccctgggcgaggtggtgtgccaggccatgcgcatgctggagggcgcctacggcctgctggtgaagtcgcggcaccacccgggcagcctcgtggcctgcaagcgcgggtcgcccctcatcctgggcctgcgtggcagccccggctgcgtcagcgtcgctagccccgccaagggtggcgaggccacgcggggcgcggccgccgcgtgcgcgccgggcgcccgccctggcgcctgggagtgcttcgtggcctccgacgccgcggcgtgctttgtggcctccgacgccgcggcggtggtggagcacaccaagcgcgtgatcgtgctggaggacaacgacctggcccacatctgggctggcgggtacgagatcctgaacgcggagcgggagggcgacggggatgggatcgaggccccccgccccgtgccccgcagcctgcagacgctggagatggaggtcagccagatcatgaaggtgggaaggcgtggtgtggatggggtgtgttaa

SEQ ID NO: 8299 - DNA, 663 bp, Chlorella protothecoides
atggagggcgtgcctgagcaggactccactgatgaggaggcgccacacacgtacaaggatgagcagcacgacgcaaagtctgcgttcctgcaggtggggcatggatctgcttggcgcagtttgttcgatccatgccagcccattgctcccagccatggtgtccctactcgtttcgccatgcatgcacacccaggcctcccctgccaaagcagcttgactcgctgcacctgctcctccaccccacaggccgtggcggaggtcgacggcgacgaggagctggattttgccgcccggaagcctgtcgctcggccggaggccgggggggatgccggcggtcaggctgaggccggtgaggacaggatcaagggcctgctggacggctactttggggcagacgagacgctggaggacgagggggaccgcttcctcaagcgctacatcctgagcaaggggtgggtggaccgggagggcggcgaggcctcgtcctcgggggatgaggcagggacggtcccggactatgaagaggaggaggagtacctgcagcaggcggagcagtacgagcacaagtacaacttcaggttcgagtacccgggttcggagaccctggtcacccatccgagacaggcgacggaggacgggcagcgggtacgccctggttcatga

SEQ ID NO: 8300 - DNA, 801 bp, Chlorella protothecoides
atgcagctgctccactgtcacccggcaacccaatctaccggtgcggcactgggcctcccccaatcctgcactcccctcctatcgcgtcacccttccaggtacaagggcgtggatgcgcaatcgttcggcctttccagcagcgagatcctggccatggccgacaaggagctgaaccaggtggtgggcctcaagctgctcgcgccctacaggtgcacatgggctggggttggaagggtggaatgccctgtttcgtggcgttgctgtctgcttgggacgcctcgacctcgcctggctcacatctggatggcagactggtccacacgtctaaaccccctcctcctcacttaccaccccagggacgagcaccgcaaggtgcggccaaactacggggccgtgaacgccctgaagcagcaggttgcggcgcaggccggcgccaagcgcaagcggggctccagtgggcatggggagaaggggccggtctggcgccacggcgacgtgcgggaaggggcctcagagggcacgcacaaggcccgcttcagccccagcagccagtcggcagccagcgcggaggagctgcgtgccgccacgtatgcagcgccccgggtgcatcggccagacaagacgggcatgtcctcgtccctcctcccgccgcggaagaagaagaagaaggtggagcgggagggggcccctacccctgcgtcaaagtatgccggacttccaaaggcccaccagaagaacctgaggcgtcacgagaagcgggcgaaggcgcgcggtaaagcccagggggaggcggcggcatga

SEQ ID NO: 8301 - DNA, 249 bp, Chlorella protothecoides
atgagacaaggggtcgctgctgcaactgggcaaccacaggaggatctatcagactccagctcggacgaggaggaggacgaggggctcatccctgatgagaaggagtctcgtatcctagaagtgctccagaagatccgtgcaaaggaccctgctgtctttgaccctacggtcaagttcttcccagacagcgagggggaggagcaggaggatcatgcaaaaggtgagccttattccccggtcagcgattga

SEQ ID NO: 8302 - DNA, 1482 bp, Chlorella protothecoides
atgcgggggcgtgttaagtttgagcgctcctcgtcagaggtgcgtggttgtggtttctttttttgtgggggggccggcggcggtggcggggagggggtgcggatgcccagcctgcgctacatgttcacctacattgaaaccatcccattcaccaatgccccccctcccgcccactggcagacggaccgttaccgcgagcgccgcatcaagctgggcgggctgacggagtggctggacaccatccgcaccggccggcgcatcatcttcgtgggctgcggcacgtcctaccacgcctgcctggccgcgcgccagacggtggaggagctggtggaggtccccgtcgcgctagagctggcctcggacctgctggaccggcgcgcgcccatcttccgggacgacacctgcgtcttcgtcagccagagcggggagacggccgacacgctgcaggcgctggagtacgccaagtcgcgcggcgcgctgtgtgtgggcctgaccaacacggtgggctcctccatcgcgcgcgccacgcactgcggtgtgcacgtgaatgctgggtgcgaggttggcgtggcctccaccaaggcctacaccagccaggtggtggcggtgaccatggtggccctggcgctgagcgaggacagcatcgccaagcgcgacgcacgcgacgccgtgatcgactcgctgggcgcgctgccgggcgcgctgcgccgcgcgctggcgctggaccccgagctggcgcgcctggcgggccggctggcgggcgagacctcgctgctcctattcggccgcggctacaactacgcgacggcgctggagggcgcgctcaaggtgaaggaggtggcgctgatgcacagcgagggcctgctggcgggggagatgaagcacggcccactggccctggtggacgagagcctgccggtgatcgtgctggccacgcgcgacgcgatgcacgccaagatgctgagcgtgatcgcacagctgcgcgcgcgccgcgcgcggctgatcgtcgtcgcctgcgaaggcgacgccgaggtggaggaggcctgcgggttggggcaaacggggcgggcgcgggcgcgaacggccacgccgcccacgccgcccacggctcaggccccttcccgtccaccgacccctccccgcccctccccatccaccgaccccctcccatccaccgacccctccccgtccaccgacccctccccgtccaccgaccccactgaccccaccaccaccaccgcgccatccctgcgcccaagcacgctgatccgcgtgccgcgggttgcagactgcctgcagcccatcgtcaacgtggtcccgctccagctgctggcctaccacctcaccctcctgcgcgggcacaacgtggaccagccgcgcaacctggccaagtcggtgacggtgtctgaggaggacggcagcctgaactgcagccgcgggaagcgcgggaaggccgtgcccaacggctttggtgcgcgctga

SEQ ID NO: 8303 - DNA, 1164 bp, Chlorella protothecoides
  modified_base (24)..(63): a, c, t, g, unknown or other
atgtttcgaccggatcgtccgcannnnnnnnnnnnnnnnnnnnnnnnnnnnnnnnnnnnnnnngtttcttgcacgtgcgtgattgctgtcactcggtgtggtttcatgaaactttcatcgaccagaagcaggcatcctgatctcgtccagtaccctactgctcttattatccttttaaaaagcaaccccgcgtgcagtgatcatctcgtagtctgcattcattgcaatcggcaaagctcagcagcatgtagaattactataccaattaggtatacacgaaaattgcaaaccactgggattgcagcccctcggcttgccagccggcatgtcgcagcagaggatcgcgacactggccacgtgcaatctggggcaatgggccatggactttactggcaacctggacaggattatcaagtccatcgaccaagccagggctggtggcgcccggtatcgggtgcgtctcggggcaggctgcaggctcaaggcattggtggggggacacccacagcgagggtcgccggcctatcagccgcaacatgccgaactcacgtttcttcacccccctcattcctctggcagctgggccctgagctggagatctccgggtacgggtgcgaggaccacttctccgaaaacgacacggtggagcactcctgggagtgcgtcgcccgcctgctggccgagggccacactgcgggtctggtggtggacgtgggcgcgcctgtggtgcaccgcggcgtgcgctacaattgccgcctcttcctgctggacggccgcgtgctgctcatccggcccaagctgcacctggccggcgacggcaactatcgcgagcctcggtacttcagcacatggaagcggggcgcgggggtggaggagcacacgttgccaggtgtggtccgcgccgccacgggccagcgcacctgcccctttggtcacgcggcactggccttctccgacgcggtgttggcctctgagtcctgcgaggagctgttcacgccgcgcgcgccccacatcgacctcgccctggcgggcgtggagatcatcaccaacggctccggcagccaccaccagatgcgcaagctgcacacggtcagggaggggagggggggtggggggttgacgggggaggaagaggagggctgggactgggaggcgcggcggtga

SEQ ID NO: 8304 - DNA, 582 bp, Chlorella protothecoides
atggcagtggcgccctgcaagcccacgtgcggtgcaaggctctctgtccccacctccttgcacccaccccactcacctccccctgttccccccccccttctttctcagcgcctggacctgatgatgagcggcacggccaaggccggcggcgtgtacctgtacgccaaccagcagggttgcgatggtggtcgcctctactacgacggctgcgcggcggcggtggtcaacggcgctctggtcgcgcagggcgcgcagttctcggtgcgtgaggtggaggtggtcctcgccaccgtcgacctggacgaggtggtgggtcatcgcggcgcagtggcctcgctgcgcgagcaggccagcgccgcgccgccgccggcgctggtgcccgtggactgggcactgtgcgacccgcgggtgcacagcacggccgcgctgtcgctgccgcgcgcgccgcgctacctggccgtggaggaggagattgcgtacgggcccgccgcctggctctgggactacctgcgcaggtgtgtgtgtgtggtaggggaagccgggggacgtatgacgcgtgggaagggggaagggggggagtga

SEQ ID NO: 8305 - DNA, 1230 bp, Chlorella protothecoides
atgggaccagcgctgactcgcccaggctgcgaccagcgcatgagtgccgactcgcacccgccatggctgggctgtgtcacagccccgagcagcatgccccgcccccaacctgtggcgcgtggaccccgatcttcacctcccacacacatgatcaccacctcattctcatcaaacaggtcgggggccacggggttcatgctgccgctgtctgggggcgccgacagctcggccactgctgccatagtagggtcaatgtgccgcatggtctgcgaggccgccgcggccggggacgctgacgtggtgcgggacctgcaaagcgtacaaggagcacccacccctcatccgcactgtacatcaggatcgcaaagtatggcgacggggagctgcccgggtcgccacaggagctggcggggcgcatcttcctcaccatgtaccttggaacagaggtgcgggtgctggactgggaggggctccgggcattcatgtgaagtgtgggggagtgtgcatgtcacttatatcacagcatggctctcgcgtgcgatgctcaggaaagggctgggttatcagatggcgaccatgcacacccagatggatgcctgccaaccccattcttcacccgcgcagaactcctcggagaccaccaggggccgggcggcggcgctggccgcagaggtggggtcccgccacctggcgatcaacatggatgcccccgtcaaggccatggttgccctctttgccgccgtcaccggcttcgtgccgcgcttcaaggtttgcatgccctggccggcagcttgggatggcaagccgtcgcctcaggccccgcatgagaatttgcagggtgggaactgcactgggtcgagcagaagggagcctggacgtgcgccctgcacatgcaggttcttggcgcttcatccatggtttacaccaatggaggggccgacactctctttccccatccttcagttctccagcaaacctcccccacccatccctcatcctgcgcaggtccagggtgggtcggtccaggagaacatcgcgctgcaaaacatccaggcccgccttcgcatggtcgtctccttcctcttcgcccagctctggccctgggtggggggccagggcgggtactacctggtactgggctccgccaacgtggacgaggcgctgcgtggctacctgaccaagtacgactgctcctccgccgacatcaaccccatcggtgcgcagagttga

SEQ ID NO: 8306 - DNA, 933 bp, Chlorella protothecoides
  modified_base (13)..(22): a, c, t, g, unknown or other
  modified_base (669)..(678): a, c, t, g, unknown or other
atgtggggaggcnnnnnnnnnnggggtggaggaggggagggaggggatgtgcgtgttggcaacacgactgagttagggtatctatcaaaggggcattccaggcaggtagggtatgaggcgggaggatgtgccctcacgcatctgttggagggtgatgtggggaggcgagggcgcagcctagcccctccctctccttctgtcccaccctgtgttggctggcgggcgtgccacccccgaaatgcggagcacctggggttcccctcgctcgccgggatcagcgccgccccgcccactgcagagctggagccgctcagggatggggagattgcgcagacggacgaggcggacatggggatgacctacgaggtgtggcctgaggagccttgggctactgcgcggtgctgccgggctgccgtggtggaggaaagtttgcatgaaagaacatgggacacaagctgagctgtccctgtttggcaacctgaggaaggtgtcgcggtgcgggccggtggccatgttccggtccctcctgagcacgtggcgaagccggtacccggcccctgtcatcgcggacaaggtcaagcatttcttcagggctgggcatactgtaaacccattcccttcctcgtctccatcacgcccccaggtactatgccatcaaccggcacaagnnnnnnnnnngaaagagagggtagggaggaagagggcttggcatactgtaaacccatttcctttctcgtctctgtcacgcccaggtactatgccatcaaccggcacaaggccactgtcctgacgccgagctaccacgccgagaactactccccggatgacaaccgctacgaccaccggcagttcctttacaacatcaggcgagtctgggggaggttgactaggctggggtcttcaatgctgagcccagtgcctgatggaagatga

SEQ ID NO: 8307 - DNA, 1380 bp, Chlorella protothecoides
atgaatctcccgatatcttgggaagatcaagtatcttggcaaacagggctgacgtgtgcccggagcggttcgttttgctatcagcaggagcacagcgcgtatgcactccaacaatccagcactcctgcatggtatgtaagtggctgctcgcagctttccctcgcagtggtggagctgtgccagcgcccggatcctgcggggccgcacgatggggccatcgatcgtgcccagcctgaagacgctgcgggtggagctgcaacacacccagaatggcgtcatagcgtggctgacgttggatcgaccccaagccctgaactccctgagcggcgagatgctccgcgagctcttcctgctcttcgacgagtggtcacacccctactccctgctcggggcggaggcctccttgccaaaggactttcctcgcgtcatcgtgctgcaggcggaggggggcagggcgttctcttcgggcatcgacatgaaggtgggcccccagacccaccttggggttgtgtgattgtgttgcgcgcacttctgcacacaggtgatgcatcacccttcccaatctcccaaacccgctccttcacttttctcattataacctcccctacacaaccactccaacatcaggcctcagcgctgagcatcgggggcgaggcctgggactaccgcgacatccgctcccagcagctgctatcccgcctgatcgaaaagatgcgggccctcccccagcccctggtggccgccgtggacggtatcgccacgggggccggcctcgctctggccctcgcctgcgacctgcgcgtggccacgagcgccagctccttctccgcagcctttgtccggctgggcctcaccggcagtgacatggccaccagcttcttcgcgccgcgggttgcgggcctaggcgtcgccgccgagctgctgctgacagggcgggcgctgggcgccgagcgcgcttttcagctgggcatgctcaacgccctggcggcggggcccgcagagctgcgcgtcgaggcggaggggctggccaaggacatgctcctctgctcctacaaggtgctccttggggtggcgagggcgagtggtggctgttccatgcgacaggggcatgtgtaccgaacaggagccggttgggaagactggggagggcaccttctccagcaagtctcacccccatgctcgtggcctgcagctgaccaaggagcagctgaatgccgcctcggatggcatgagtctccgggccacggtgaccgccgaaaacagccaccagatcctgctggtgaacgatcccgtggcgagcaagatcgggaacgactggctgaacaagattgccagcaaatcgggcaagccgcggcccaggctgtgagctcgatgtggtag

SEQ ID NO: 8308 - DNA, 741 bp, Chlorella protothecoides
atgtcagcgctgcgtgagcatgtgcccctggcgcgctcagcctcggacgccaacacctacctggtgaacgaccaggcggacccgctccagcgctcgctctccgagctgggcatgctggactcccccacaccagggccggggccggccgccggcgccgcgctgggcggtcacatgccccgggctgcgtcggaggcctggggcgcactggccgaggccgagccggaggcgggcgtcctggcccacctgaccgagctgctggacagagtccagggcctcgcgctcagcgccagggacacgggagacggcaacgatgcctgggccgaagggctgcatcgtcggcccctcacaagctgccttgcgaccggctttggggtcaggctggaggacagctgcgcgggactggtgccgctcaaactttttcaaaccccgtgcgccctcgcagcttcgtccctctttggcggcctcgccgtggacgaggggcctgggcccatagaatgcgccgcccttccacccctcgaccctggggccgcactcgagtcggacggctccggcgtcctcctggccacacccacgaccccgggctgccccacggccgtgcccggggctgtggacggcgcggcggacgcctttgagctgctggacaaggcggtgccggggtgcggcagcgtgtggggccaggtcccggggccgcccctgtccctggaggagtttcaggccatgcacgatgcggaaggtgggtag

SEQ ID NO: 8309 - DNA, 243 bp, Chlorella protothecoides
atgtacgcggtgcaccccgtcgcgctgtccgaggtcaaggcgctgcaccgccacgcccccccccttggcgcccacaggatcgtgctcaccctgttcaacggcgtgtccctgccccccctctacttccaacatgtgaggaggaagggtggtggtgtgttcactggggccacagggccaccccctcccgcccgtcgagccttggcttcccatcccatgcccgagctctcccaccccgacgaatga

SEQ ID NO: 8310 - DNA, 462 bp, Chlorella protothecoides
atggatggttggcaggaccaagccaagaagcccttattgaacttcctggctgttacaagcaagggagggcgcttcatcaagagcgtggacaccgctggcaaatgcaaaactgcagattaccttgtggagcaattggaagctgtcatcaaggagattggggtcgagaatgtgcaagttgtcatcacagacaatgctgctaactgcaagagagccggggaaattattcatgaacgatatcccaccatctggtgggtgtcatgtgcagcgcacaccgtggacctcttcctgaaagatttgggcaagatgaaatgggtgacggagattctggatccatgccaccagatctgcaagttcatgaccaaccatgcaacagctgtgcaccttttaagagagcattctgaccagggacttcttgtacctggtgaaactcgatttggttcaaagttcctgatgctggacagg

SEQ ID NO: 8311 - DNA, 954 bp, Chlorella protothecoides
atgggcgtctgggacccggcatgtgagtgcctcaccctcctgccttcgtccccaagcccaagcctccacccccacccccacctaccctcccgacagggcatctactccagcgactttgtgcagttcctgatcaactgcctgaccttctggatcctgctgtcctacctggtgcccatctccctgtttgttacgctggagattgtcaagttctggcagggcttcgtctacatcaacctggacccggccatgaaggatccggcgtcgggggagcatgcgcggtgccgcaactcgggcctgaacgaggacctgggccgcgtggagtacatcttctccgacaagacggggaccctgaccagcaacgagatgcagctgcgcgccgtcgccatcaagggtgtcgcctacggcgacacatccttcaggtgggagctgggaggaaggccggagcccgagtggtttggggcgctcactggagcgctgactgcaagcgcgcagcgctgcatggcaacgcccttggtttctcgtggagtggtcgcccgctgcctgcctggccccttggttggctctccgagttgctataactgcacgactcctcctcggccacatccaccccgctcccccttcccttcattcaggctggaggagcacgaggagctgaccgacctggcggcgctgcagcgcttcgacccccggctggccgacgccgcggcggggctggccgcctcctccaacgccctgcagcgcgtggtgagccggggcggcagctcctcgcgcgtcctgtcccaggccagctccttcaagcgcgagtcggaggaggggccccagcgcagcccgggggacgcgggggtgggcaccctgtcctcccacctcatggacttctggaccaacctctgcatctgccagtccctgatcctggaggacgatcccaagggcgacaagcccctgtaccaggtgtga

SEQ ID NO: 8312 - DNA, 408 bp, Chlorella protothecoides
ccctcggcccgcgtccagccgctgctggacgccattgcgcgcttcatcgaccagcgcgtggtgcccatggagggcgccatcgatgcacgtgcccacagcgaccagcgctggacgccgcacccgtgcctggaggggctgaaggccgaggcgcggcgccagggcctgtggaacctctggatcccggccgacatgcgcgttaagctggcgccgctgatgcgcggcgcgggggtgagcggcgccgaggccgcgctgctgctcggcccggggctgagcaacctggagtacgcacactgcgccgaggccatggcccgctccctggcgggcccggaggtgttcaactgctctgcccccgacaccggaaacatggaggtgggcaggagtcgcggtgtgtgtgtgggggggagatga

SEQ ID NO: 8313 - DNA, 810 bp, Chlorella protothecoides
gcggcccctcacaggcgcgcccgccgcagctcctccttggccacggtctccaggtgcaccacgtccggcccgtcagccaagcgcagcgtgcgtgcgttggcccagagcgcggcggcgggcgccagcaccttggccgccgcgatcttggcccgcgcctcgacgttgccgtcgcggtccagcgcgcgcgcggcctccagcaccaccaggcgtgcggcgtccagctcgaggcgggagcgggccaggtccaggcgcaccgcctggtgttcgcgcaggcggcggccaaaggcggtgcgggagcctgcgcgcacgcgcgcgcactccagcgcgcgctcgcccgcgcgctcgccgttgccgatcaggcgcatgcagtggtgcaggcggccggggcccagccgcccctgcgcgatctcgaagccgcggccctcgcccagcagcatgctctcgccggcggggacgaccacgttctcgaaccgcatctccgcgtgcccgtgcggcgcatcatcgaagccgtacaccggcagcgcgcgcaccacggtcaccccgggcgcgtcggccggcaccagcaccatgctctgctggcggtccaccacttggcgccgttgagcacgaggtcggtgccgcgccgctcgatgcgcgcctggatgttggtggcgtccgaggaggccacgtccggctccgtcatggcaaaggccgaccggatctcgccgcgcagcaggggcagcagccagcgctcctgctgctcccgcgtcccgtaccgcgccagcacctggcagggtgtggggtgtggggtcgtggtgggggtgggggagt

SEQ ID NO: 8314 - DNA, 408 bp, Chlorella protothecoides
atgccgaaacgcaagcacgagccagaggtggagcagcaggtggaggaggagcagcaggaggcggaagcggaggtagaggaggagaatggagcgggacaaggctcggagagcgttgagtcaggcagcagctccgacgacatggagggacctagcagtgcagaggaggagagcgaggatgacagcgatggggaggcctttgacagcgtcacagtcgactttgacttttcggagccacaggaagatgactttctgggtctcaaggtcctcctcaccaactacctggacggtgtcacctacgatggctccggcctggtggacctggttctgaagcatgtgcgctgtggagttgggtgtcatggtatttttactggcggggttgagatgttgggggccggggatgaggattga

SEQ ID NO: 8315 - DNA, 1533 bp, Chlorella protothecoides
  modified_base (84)..(93): a, c, t, g, unknown or other
  modified_base (345)..(354): a, c, t, g, unknown or other
  modified_base (823)..(832): a, c, t, g, unknown or other
  modified_base (1218)..(1227): a, c, t, g, unknown or other
atgagcttcaggccgggacagcaacatttttacccccacctttgtgacacctcgccccagagcaagctgggcaccgtcatcaannnnnnnnnntcgggacagcaacgattttacccccaccttcgtgacaccttgccccagagcaagctgggcaccgtcatcaagtgcgaggatgacgtcctgggggtcaccactgtccttcctttggcttctgtcgccgggaccaggtccctgtccgacctggggaagttcctgctggcgcgggtgggacccgagctcaaggacagagtgcagcaggtgcatggggtggaaggttgtggtgagcgaacggctcatcaactgccnnnnnnnnnnttgggggtcaccacagtccttcctctggcttctgtcgccggggccaggtccctgtccgacctagggaagttcctgctggcacgggtgggacccgagctcaaagacagagtgcagcaggtgcatggggtgcaaggttgtggtgagtcgctcgctgacaaggcaatgggcctgctattaagcgaacggctcatcaactgcccgccggcagtggcaccgccactccagcaagccttgagagaggatttgcaggcccaccaggggaagccgaggatgaaacatcttctactcttggcgagagcattccgggacagccggccggcagagcagcctgctgggaagaagcgagggaaaggcccatcatccagcaaggtgttcatgggagctctttatgatgagacgatgtggagttgggaaggggtgggaagccttatcattgtatttttatgccctggcaacctgcactcacatnnnnnnnnnnggggaagaagggagggaaaggctcatcatccagcaaggtgtgcatgggagctctttatgatgagacgatgtggagtttgggaagggttgggaagccttagcattgtagtgctgcttcaagcacgcggtctggacagcggagtttgcggcgagggagacgcaggagggccgcaacaagtcctgccgaccagtgcgcctcgtcctctgcataccctgcgctgccctgcacaggataggacaggacctggaggctctgcttggcagccctgcagagtgagctgtggtggaggtgttgtcgagagtgcatttggtgaaggggtttggcgaggatgcctgtcacatgtaccaggttgtcagtcatcccaaggcacgcccacgagggcattnnnnnnnnnnaaatgcgacctacagattgggctcaaaaagggggtgattgtctttatattgagattactatggctttcaagagctgggtgggaggtgttgtcaagagtgcatttggtgaaggattttggcgaggatgcctattacatgtaccaggttgtcggtcatcccaaggcacgcccacgagggcatttctgggcaaggcaatcatttggatacccttggctttaccagcaagccaggggatggcagggtggcctcggggaggagggggctggggggaggttttcatgcagggcgagcatttgctcgagctag

SEQ ID NO: 8316 - DNA, 561 bp, Chlorella protothecoides
atgactcgtccgccttgctgccccagagctgtcgaggggaagcggacggctccctgccaagaagcggcgccgaccctgctcaggaatgggtgctcacaagccatactgcaccaagattgcccacccttaccccatatgttgcaagctcaggctcgcgatgggacgggggtggtggtcaccagcattggaccggacgcagtgtgcaacgcatgcgtggcgacctgccacgcccggatatacctcgaggtgggtgtgcgcctcacccctgtgcaccctgggatgttgtattgctggtcaaggccatgtgcgaaccgtgtgcatgctcgatcgcaatccttctggtcgctgggtatgctgatgatgccgtcgagtcaccacgcacctacatgtggcggctgccccaccccccttctcggcaatcctgttccgcaggacgacaagatcgatgtgcgggcgatcccgatctttgaggaggtggagaagacgagcgtcgacgggtccatgcacaccatgacggccctgaagctgaaggtcctcattgaaggggtgcaggacagctga

SEQ ID NO: 8317 - DNA, 1140 bp, Chlorella protothecoides
  modified_base (1012)..(1021): a, c, t, g, unknown or other
atgggacccctctccaccacagcagcccctcaccaatctgccccccctcgactcccaccccatgaattaggcatctggaagagtcggcaggtgcttggggctggggcgcaggcagatcggaggagcatcacaagtctgatgggtttctttgggatcagcttgtccaagggtgctccggcttccctttggacttggccgggatcggtggagcctcacaagtctgatggttttctttgggatcagcttgtccaagggcgctccggcttccctttggacttggccggggagagactggacctgctgaagctttactgctcgtttgggctagagcattggggcagcgacgcccgtggcgtggaaagcaccaggtgcgcatgtgggagcgggtgccggcactctcccattccaccctctgaggggcattgcatgtataatggcaccctatgccccacacccttcctctccctcccattgccatgcatgcagacgcttcctgctggagtggctgtcgttccagcaccgctacatcccggtcggcctgctggatgttctgccccagcgcatggactggagggtgccggtcttcgtgggcagatccgacctggagacgctgctggcctccgaccacgccggcgactgggtgcgcatctccgagatgctgctgggccctgcacccccgggattgcatgcgtgtctctcaggaacggagtgcagcaagacatgtggacagggcggtttgagacaattccgaccccaatgatgagccagcaaccatgtcctcagtcccgcattcactctggtgcagggtttcacgttcacgccaaagcacaaggcaaatgcatactccagacggcaggaggctggcgcttccagtctcatgaaggacgaggagcaggagaatggctgaggaagcagggaggggttgtgggtggagcggcttgccctggccttgccgtaaacaggggtgcttgccgggtttccatgccaagtactcacaacggccagcaacttnnnnnnnnnngggtggagcggcttgccctggccttgccgtggacaggggtgcttgccaggtttccatgtcaagtactcacaacggccagcatttacctacccgctagatcaatgccccccggtccgtga

SEQ ID NO: 8318 - DNA, 1239 bp, Chlorella protothecoides
  modified_base (1199)..(1208): a, c, t, g, unknown or other
atgcaagcctgcatgcagtgggttccgggggggtggtgtcggagagcgagcacgcacccccccctgtccaaacgcgatactcctggtgaggggcacttacctagctgtctggtgatctcaaagccgatgccagaaccaccgcctgtgatcagggccaccttgcccttcaggatgtctgtgcggaagggagacaccggaggcgccatgttgccgagcacggagcctagtctgtggacgcctgtgtgcaacagtcactgtgacattgcggctggtctcgagagcagccgcctcacgtggtgccagaacctcaaattggagcggtgcaccgcatgccgtcctcatgtcagacactccggtgcaagctcctctacatgggccaggaacttccacaacaaaattcgactggatcttctcaagattccaccgcaccccgcctcatccggcaaaggaggtggcgaacttggccagcgaccccagggctccctcgcctgtggtccaggcctgcacgctgaaacccaggaacgcgatctgcgcgccagaggaaaggggaacaggatgtctattatggatggtgccggcaactcggaacacaagcctggggatgtggctgccaggttttgggccagctggccaaggcctgggctttgccttcagtcgaggggtttatcacccggaactgcagcccgaacttcgtccttccccggggcgagcctggcgcagtccctgccgatacatttccctgctcctccccatacatcacccccccccctttgtgccacaacccaccatggccaggcgcccgtgtttgagctcggcctccttgagcttgaaggcgcggttgtcgtcgcccgaggcgaggcgcagggggtcaaaccagccgccggggtaggcccgcttctccgtgtccagctcggtgttgcggtacacctcggcgccgcccaccagcagcgcctcgatccagaccagctgggtgagggtgaagggcagggggaagccgaggtactgtgcgccgtccagctccaccttgcccgcgtcctgccaggccacgcccgtggaggcctcggccacgatcacgcccagcgtggccagcatggcccagcgcccgtggatgacctcgttctcgcggaagcgggcgaggccgaagacctcgctgtaaggcgccagcgcgtcgggggacacttcatcggcgttggaggcgnnnnnnnnnngaagcgggcgaggccgaagacctcgctgtag

SEQ ID NO: 8319 - DNA, 294 bp, Chlorella protothecoides
atgaccttcctggagcaggcggcagacctgtttgccaccgagaactccaatgcggaggccaacaagtgcaatttgaaggtgtgcttgtggagagagatggccttctggtacttgagaatgatttggatggcactgatgtcgggtgagggttctgacaactcaccagaccgcctcaacagatcatctgcacagcatgccgcctgcccaagacacctactaactccctccctccatgcagatcgcgcaaacatccgccgagctggagcaatacccccgtgccatcgccctgtatga

SEQ ID NO: 8320 - DNA, 933 bp, Chlorella protothecoides
  modified_base (768)..(777): a, c, t, g, unknown or other
atggcaagtttccaaattcaaggacgagaatggttgagcaagggcgagaagaagctgaagtcgctgggatggtttggcaacaagtacgaggaggcagccgagtgctttgagaaggcagccaatcagttcaagctcgccaagtcatgtgcgcgtctcaggctgcgtgcaagagactgggtttcctggtgcatggcaagggcctgcctgtcgtggcagctctggagcgattccatgtgtgggatgcagcagcagtcaaggcctgagaccagaatcattctgccttgccaggggccgaagctggcgacactctctccaagttggccgagatacacatcaagctggagagtccacatgatgctgccagtgcctgggtggacgccagcaaatcctacctcaagatcgaccacaagaaacctagtgtcctgctttgtggactcgcggaatcacatgcgctgcacagagggtttggacgcgctttctgcactgtcccagtggatcattctgtctgctcgcatgaagacgcctcctccactggctgcatgcgcaagtcccgggtcaccaacccctgaccacaacacccctgctgcctccaaatccttccacagggggagtgcaggccctccaaaacgccgtcagcatctacacagacatgggccgcctggggatggcagcgcgccagctcagggtgcgaggtgcctgggtcaaggactcggagggcatggggattgcggccgcacggcgtggacccatggccttgaaaactacttnnnnnnnnnnagggtgcgaggtgcctgggtcaaggactcgaagggcatggggattgtggtcgcacggcgtggacctacggccatagaaaactactcccttgtggacgctcacccttcccaaatcctctcctgtgccccaggagatcggcgaggtgctggagcgtga

SEQ ID NO: 8321 - DNA, 741 bp, Chlorella protothecoides
  modified_base (265)..(274): a, c, t, g, unknown or other
atgcgggacctgcgggagaagatgcaggccgagatcaaccaggtgtcgcgctcggcggaggccatcaagaagcgactggcggagctggaccggaacaacgaggcggcgctgaagaagggcgtgtacacgcccgggtcgagcgcggagcgcacgcgcaccgccatcacgggggcactgaagaagaagctcaaggacctgatgggggagttccaggacctgcggacacgtgtgaatgcggaataccgggaggctcgcttggctgctnnnnnnnnnnaagggggggggcataagataattgcgggatttcataggctcgcttggctgctctttggtgatggccccagcctgaccaggcctagaggccctctgtcctctggggtagaaggatgtggagaggggtcctcgaggcctcctactcagatgaccctaccatggtgttcgcaagtgtgggaatggggcgaggtatctcacatgtctctggctttccgcgccgagtctgcctctctacccatcacagtgacgggtcagcatgctgacgaggaaaagattgaccaaatgatcgacacgggggagtccgagaccattttccagaaggccatccttgaacagggcaggggctatgtgagtggcaacatggaagggaggcgggggttgaggaggggtgtttcacgaccaaatttcatgtcttccatgcctgggagccactgcaggctgtccctcttgtgcccttgcttcacatga

SEQ ID NO: 8322 - DNA, 819 bp, Chlorella protothecoides
  modified_base (359)..(368): a, c, t, g, unknown or other
atggcatgcccgtcccctgcccaccaggtcttggacacgctggccgagatcagggagcggcgtgatgcagtcatggagctggagatgtcactgatggagctgcaccaggtttgcagtgtgtggaaggaggagtgtcggggggctcgcatacgtcaacatcccaaaagggcgccgtcgctcttggcgtgccaggcgttgcctcccatcccactgtccttctgtggtcaccctccagtggcacatcctttcacaccctttgcaccccccccactacacacttcacccaacacgccttcacccatccttccctctctcactgccccagatcttcctggacatggcggtgctggtggaggcgnnnnnnnnnntacccctccctccacacacttcacccaaaacgccttcacccatctttccctccctcactgccccagattttcctggacatggcggtgctggtggaggcgcagggggagctgctggacaacatcgaggcgcaggtggcgcggtcggtgggatacgtgcaggcgggaaccaaccacctgcaggcggccaagcagcaccagcgctccaagcgcaagtggatgtgctgcggcctcatcaccggcatcatcgtcatcctcatcgtcgtgctggtggtcatcggcaccacgcgaggcttcggctccagttgagagggggggagtggtccgccgtgggcctgcctcccccttgcccgtggccgcccgcacccctgggaaagggtctgcgacgcttgactcagggcgagacatgacgctgctgactgggcgcctgcccccgcttggccctggcttgtaa

SEQ ID NO: 8323 - DNA, 426 bp, Chlorella protothecoides
atgtgtgggttgtctgtgtgtgtgagggaggggagggcatgcaccggaagtgcgtcacctgccaccgagggggaggggtctctcctcgatactcccctcctcacctggcaggccacatacatcccggaacatcccgccgcctgcaacaagacacaccttcctccaggatacggcgggcggcccagacggcaacggcgccccccatgctgtgccccaccaggaccagcggggtcgtcagctgccgccgtgcggccaggacgtgccagagctccgccacgtcagcggccagggtctcggccgccaggtcggcatcgtccgggctcctggtctccccgtggccccgcaggtcgggagccaccacctggcacctgcgcggcggcggacacagggcccatgttgctggcggatgggcttgggcccgtgtga

SEQ ID NO: 8324 - DNA, 720 bp, Chlorella protothecoides
  modified_base (10)..(19): a, c, t, g, unknown or other
atgtccatgnnnnnnnnnngaacaaggcgtacctggttatggagtacctgggaggtgaggaggcagaggtacatggtcaagtgtgatggggttgggttcggagatgtccatggcgcccagctctcccatcacaataaaacaacaagaacacgctcctcaccgcccccaggcggcgagctgctggacgcggtgctggacatcgggcactactctgagaacgaggcgcgcatcatcttccgccagatcgtggccggcgtggggtacctccactccaagggcatcgcccaccgcgacctgaagctggagaacctgctgatggccaagcgaggggacatcatgggcgtgaagattgccgactttgggttagcaaagggccaggccgccacctcgctgtccaccatctgcggcacgccacagtacgttgcgccggaggtcatcgccaagggcgccaagagcggcttccactcctacaagctgtcgtgcgacgtctggtcgtgcggcgtcatcctctttgtgctgctgggcggctacccgcccttttacgacgagtcggagccgcgcctgtttgacaagatcaggtgggtgtggtggggtcggcgagggctcaggtgtgctgaccttcatcacccccaagccgccgcagacccccaccaacccatgcgcccatggcaggcggggcgcatactcgttcaacgaccctgtgtgggagcagatcagtga

SEQ ID NO: 8325 - DNA, 1242 bp, Chlorella protothecoides
atgaggagggcgccccggcgccgcagtccggcgccgacgccgtaccgccacgcgctgatggagaaggggcagggccaaggtccggggacgagtctacaaagccaggcgagcaacagcgagtcccggggtcggaagtgtcgccggcctctggccggcccagctccgaccgggcagaccatgccgaggagggggcggaaccatgccgaggatgaggcggagtggcaggacgaccctgccaccctcgaggcggcggcgctggcctggggcgagcgcgtcgcctctgccagcgagtcgcgcgaggtggcggcgcccggcgcgcccgcgccctccccgcccggctcgcccagcgccgccgacctgcggcagtcggagctggcgcccatcgccacgcccaccgccgccatcgagctgcacagccgcagcatggcgcgagaggacatccgcaccgcgcagatggccaccatggcagagcaggggaaaaaggtgctgggactttgccgggagaggccagccacgtccgcatcttcttccttggcacctaccaccccgtgggatctgccggccgacctgcggggcctggagcgcgctctggaggagctgccggcctccggcccccggccgggcgacgaggggcggtccaaggcggagacgccgccagacccgcgccgcgcgctcatgcactcgcgccgcgcctcggcctggcgcctgctcaccaccattgagcgcgacgccatcaccgtcctgggggccatgtgcaaggtgggcggcggccctgttgcacacgcgattatcagaaaccggacccatccccgcgcacactctctaaaccctcctccgcacactctttacacccacccccaccccctctctgtgcagctgggcgcgcgagaaacttcgtggggcgcggtggagacgctgggcgcgcgcgaaacttcgtggggcgcggtggagacggtactgcacgagggcaagctgctggccctggaactgctgacccgtgtgctctgcgacccgctgcatgactggctgggcgtgcggcctgagttcgcgggcgagctgcgcgcgccgctgtgcctggtgctcctgcgcaactgcatgtcgcccttcgacgaggccgtgcgcgccgcggtgcgcctactctgcgcgctggcggccgcgccgcgcctccgcgccgggctgcgggcggagctgggggcgctgtacccgctcctcctcctcagacccctggaggccgcgaggtga

SEQ ID NO: 8326 - DNA, 1005 bp, Chlorella protothecoides
atgtggcaaggcaaccgaccaggcatcacctgccagtgggccagcaagcattcgcaccccgaccccttgacgtcagagtacctccaacagacgcccgtggcggcatctgtcaccggtctgccagtggccccgcccttgaagactgaggacaaaaatggtgtggtgacagcagaggcgctcgctgctgccttggacggggccagtgcggcggtgatcccgctcctcacgcccgtagatccgacagcaagccaggtggaggctgtacgggcgcccgctgctgccacggggtttcccgagccctcctcacctgccgagcaagacgatgttgatggagctgcccaggccttctggcggggtgatgggacgattcccatgcgccctgtggcgctgctgccaggaagagtccgaaaacctgctcaaaggctccatcagaaccttccccaacccacacgccctcccgtcaggcatcgccgctacgacttcagtacagctgaccgtgtgctgtcgaccttggggttgcggaacagtcgggcggggcagggacaggggaagcaggaggaggagggacaggagggcaagcggccacgtacccaaggtcccgacgctggagcgctgccgggggaggccgtgctggcaaaggcagagcctgaggtcgagcttgcagcggcgcaggtgcttcccactgccaaagtggaggccgaggcacagctgtgcacagtacccgctgagactgcgccagggcctggggcggagctgggtatccctgtgacggagcccgaaacggccgctcctgcggccgcgccgcctccgcagcacccttacctggaaactgccgagcacaagcgcgaaagctcggcacgggcaatcgacttccgtggcaagctgtacctggcacctctgaccactgtgggcaacctacccttccgccgcctggccaaacggttgggggccgacatcacctgtggtgagatggcgctggccacgaacttactccaggtgaggtga

SEQ ID NO: 8327 - DNA, 252 bp, Chlorella protothecoides
atgcctgcagggttctcggtggtcaagcttgccacgcacaaggagacgggcgatgagtatgcctgcaaaatcatgagcctgcccccgcctggcgcctccaatgccgccgaggtgacgcgggaggacatcttcaaggagatcaacatcctcatctccctggaccaccccaatatcatctacctgcgggaatactttgaggagggcaacaaggcgtacctggtcatggagtacctgggaggtgaggaggcatga

SEQ ID NO: 8328 - DNA, 597 bp, Chlorella protothecoides
atgcagccagactcagctgatcctcaccttcccggtcctacagattcactgggaggttcccacgccacactgcagcctggagaccccatcctgcccccgcccctttgccaggaggcggcctgcagcagcggcgccccctccatcatggacccggccctcggcacgctgcacaagctggtcgcgcacgcttttctgcagggcgagtcgtcctcgagcgggcgtggcgatgatggcaccatcgtcacccaggcctactgtgcagccccgctgccggcctggatcgcctcccccccgcagcagaccccctgcaccctccttccgcgccgctcccccccaggtggtgaccatggtggcaaggacgggggtgtccaccacgccagccgtccagcttggcatggtccgcgcgctgctcacggccgtgacggccgagcactttgtgccgcatggcgactgcctcatgcaggctgtgcgggcggtgttcaacttggccatcggctcctccgacccaggcatccaggccaccgccaagtcggccctcctccagatgctcaacaccgtgctgaagcgggtggaccaccaagtcatggtgggctgtga

SEQ ID NO: 8329 - DNA, 432 bp, Chlorella protothecoides
atggcgcctccggtgtctcccttccgcacagacatcctgaagggcaaggtggccctgatcacaggcggtggttctggcatcggctttgagatcaccagacagctaggcttgcatggtgcgagcgtcgtgatctccggcagacgcgtggaggtgttgacccaggcttgtgctgatatgtcagcacaaggtgtcgaaacccactttgttcaggcaagcgcgggagacgtacggaagtacgaggcctgcgaggccatggtggcaggcgctgtcgccaagtttgggcgtctggacgtcctggtcaactgcgcggccggcaacttcttggcagccccagagcagctgtcgagcaacggcttccggaccgtgctggagatcgataccctgggcaccttcaacatgtgcaagtacgatggagggctgctgacaggttga

SEQ ID NO: 8330 - DNA, 549 bp, Chlorella protothecoides
atgctggccacgctgggcgtgatcgtggccgaggcctccacgggcgtggcctggcaggacgcgggcaaggtggagctggacggcgcacagtacctcggcttccccctgcccttcaccctcacccagctggtctggatcgaggcgctgctggtgggcggcgccgaggtgtaccgcaacaccgagctggacacggagaagcgggcctaccccggcggctggtttgaccccctgcgcctcgcctcgggcgacgacaaccgcgccttcaagctcaaggaggccgagctcaaacacgggcgcctggccatgggaaatgtatcggcagggactgcgccaggctcgccccggggaaggacgaagttcgggctgcagttccgggaccacatccccaggcttgtgttccgagttgccggcaccatccataatagacatcctgttcccctttcctctggcgcgcagatcgcgttcctgggtttcagcgtgcaggcctggaccacaggcgagggagccctggggtcgctggccaagttcgccacctcctttgccggatga

SEQ ID NO: 8331 - DNA, 375 bp, Chlorella protothecoides
atgggtagggtgcatcccctcacacgggcccaagcccatccgccagcaacatgggccctgtgtccgccgccgcgcaggtgccaggtggtggctcccgacctgcggggccacggggagaccaggagcccggacgatgccgacctggcggccgagaccctggccgctgacgtggcggagctctggcacgtcctggccgcacggcggcagctgacgaccccgctggtcctggtggggcacagcatggggggcgccgttgccgtctgggccgcccgccgtatcctggaggaaggcggcgggatgttccgggatgtatgtggcctgccaggtgaggaggggagtatcgaggagagacccctccccctcggtggcaggtga

SEQ ID NO: 8332 - DNA, 2682 bp, Chlorella protothecoides
  modified_base (59)..(97): a, c, t, g, unknown or other
  modified_base (798)..(807): a, c, t, g, unknown or other
  modified_base (1940)..(1949): a, c, t, g, unknown or other
atgtggagttttgagacccatgtcatggatgatcaagcagttcagcaggaagggacagnnnnnnnnnnnnnnnnnnnnnnnnnnnnnnnnnnnnnnnttgcgctcgtgggagcgcacaagggtgctgtcacggcgctgcaggtcctggggagcgaggcagcaaatggcgcagatcgcttgatcagtgcgggtgcagatggcactgtagcagtctgggagccgtcaactgctgcatatggcccaggacctcgacgtgagatctctccacgcctgtttttcaaggctcatgaggcagccgtttcaagtctctgtctggtggaggttttcccaggcgaagggagcagccgcgtgcagtaccttgccacgacaggtgaagcttccaatgtgtctggaggttgggcgctggggtatggcctcgtgggcttcatcgtgttcctacatgaatccaggcctaaagcgcatatgggatggcagtcagctaccgctttgcatcgtgctgggtcgtcatgtcgtcagcattccacccagtttgcatcactgccaccaccccacaggcgaggacaagagggttgctttgtggcagacgacagggagctggaccctgcacaagagtgtgcaaccgctgcacaagaccactttccattccgcagtccactgcccctgggcttccgctggcttgggcggctccccctcccttgttctcgcatctggtggggcctgggaaaggagaactcgggtcccactgtatggcaagctttgcgatcagcactcatggtgagtccaccgtcctcatggggnnnnnnnnnnaggtcccactgcatgacaagctttgcgatcagcactcgtggtgagtccaccgtcctcatggggctccatccagaatctggggcgtcctcacactgccttgatctggctggctggcttgatcctggccagaagaaggctgtcaaagtgtatggtgcttttggacatcccctcaggtgcgggcattgttgcttgttacatgggtgggccgcacctcctggccgtggcaaccaataccggcctggccctcctgggtttcagcgggagcggcccccctgctgtgctggcgctgccgcatcaggtgctgaccctggacgcgatcgccagcatgcccgaggccgcgcccaacgcgccgtctgcggtgcgggctgcacagggcttcacctgcctggctgcggcagggcagtcactctggacttccagcctgcgcctcgagacgacggctgggccacccggctcgtcagagaagagtgtgcgcctggaccagggtccccgggaggcgattgcaaagctggagcacagcggaccggtgctgctggcgtgcagcgccagcgggcgcagcgtgagcgtggtctggccgcagcggcagctgtactgcgtgttctgcctggcacccagcggtgtctgggaggtgctgcgtccgccctggtctggaacagcctccagtctcagtatgctctgctgtgctcgcctcctgtcgtcgtggatgcccccaagcccaagaagggcatgtttgccgcctttgggaggcgcaagcacagcacttcagcgcccaaaccggaggagagtgctgagtcggcaccagcacacggcgcgcgtcccggatcgcacgtccaggtgcacgtggtggacgaatcccgcgccgcgcaatgggttgtcaatcagggggtaagcctcgacggcctgccctcggcgttgcacggcggtccaatgctgggtgtcgtggtggagggaagggcgagcggtggagaggggctcaacgctgggctgcagctcctcagctggaccaatttcacagccgtcggtccgagactgccggaaccccgctggctgaggccgtcctctgcatcgggcgcaccacacagcagtgctgcatctgcagtcttgggtgtgtgccccaccagcacaccccagannnnnnnnnnggctctgcatcgggcgcaccacacaggagtgctgcatctgcagtcctgggtgtgtgccccaccagcacaccccagagctcattggaggcagagtgtgtctcatttccccaccctctgcagctgggagccagactacgcggcagctgttcctggccacccccaccgccatccttgcggtcttcacggatccagcccaggagtttgtgcaggtaagcattgctgtcatgggacgggggctggcacccagaaaggcgccgccaccctctctgcaagagcctggtcgccgtcgctgctggggtccagcgccatgccctctgtgtctgtccacctggccaccgcttgctcccccccgcccctcttgctgcagaccatccctctggcaagctacgagggtgtggctgcctcgcaggtggcaccgtccactgattcaagtcccctgccaatcaccgtgccgcggcctctcgggcctgtggtgctcatgggcattcgccacagctacctgtggctggcagatgggctgggcaggccgtacctggtcagcctgaggcatgctggagtccggctgaggtgcctggcagcacgctccgagttgagcactgcccgcaccattgccgaaagaggtgggtgctggatgtggggtggaccttctataaggtggaatgtccgctgggaggttgctcgtaaggagttggctggcagcattcccgccctgaatggggctatggttgcctag

SEQ ID NO: 8333 - DNA, 1740 bp, Chlorella protothecoides
atggaaggcggcttctggaggactgcagccgcatcctcgtcctcatcaaaaccgccagggagggcttctggggtctggcagggcttgcttctgcgctgctgcttcaatgtcgggcatcctgcagggaccgacggggccgggccggaagctttcccatgcagagatgcccgggattggcacgatgaagacacagcaaatgcatgtacattgcaccgtcggtatgtgaggggccgagctgacactggggagaaggtgaaggcccgagtcgtcatcgcaccacgggcgaacccgagccgccgagctccaccggaggtctactttatgagtatttcgagaaataaatattccctgcgactgaatgcggtgagatttccagcagcggatccccagcagggttcgaaaatcgatcgaaagctagggagcgactgcgaacaaagcaaactgctcctcaagggcacccacggcggctggtccagtttcatcaccatgacggctatagatgcgcagctgctggacattgagaccctgctccagggagacctatcaggtctggagcgaagttgggacacgctgcctcccgagcagctccggaaggagatcgagaggtaccgcaatgccatcatagccgtgggcaatcaactgagtcaattgggtgaggaagattggagcagtaggctagagtctctcctgtggatgcgagtggaggtcttgattcgtcccactgttgacactgagagcaagggtggctcacatgctgcccccaaagaagaagacccaggttccatcgacgacttggaccccagcgaatggcaggttcctccacactgcataccaattcatgccaatgttacaacctacgactgggatgccctcatagctgccagccgctttgacgtcatcatgatggacccgccctggcaattggccacggccaaccccactcgaggtgtggcgctgggctactcccaactaacggaccgcgacattcaaaaccttccggtgccgcggctgcaagaggacggattcctctttgtttgggtaagggggacggaaggtcctgaaggggagcgtcctgtgcttacacaggagggggctgcgctgtggtgccacgactactgttcaggcggtccccaccagccaagcgacttgcaaaccccttggctgggctgcagtgcgacctcaggtcttgcttgcctttcaaccacccgccctccccacatcctctgtcagattggtggacgaggtggtgtgggtgaaaatgacagtgaatcgacgtctggccaagagccacggattctacctgcagcatgccaaggagcagcacaagtgcgcagccccgtggccacccttggcggtcccacccatggcaacgacgacgaccatccccttccttgccacctcagtgaaagacgggggcagagccagaagccagaagaaatatatgaacttattgagaggttggttcctcaaggtaagggcagggatattctacgaggtgttgcatttaatctgggcagtagcctgtcaaagtctgccgactctattgcaaacttgctctggtgtgaggtgaaggatcttcctcgtcggtatcttgagatctttgggaggaagaacaacctgcgcaaccattgggtcaccataggcaatgaggtcactggcaagggaccccctaaggaagatgccgcagccatgttccagggaagtggcgtcccaggggctgtctacggcaggtcaaactga

SEQ ID NO: 8334 - DNA, 378 bp, Chlorella protothecoides
atggagccaggggcaagcggtcccaagaatttgagatacgtgcatgacgccgcgcatgcacagcattccgagcgatctcggaagcctgatcagagacgggtcattgacctgctgcaaggcagcccgttgcccaagtgcttagtcttgggggtggcagggagcaccatggatcgtcccaagctcagcatcctcatggtcagcgatttcttctatcccaatactgggggggttgagaatcacatttatcagctctcacagtgcctgctgtcgaggggccatcatgtggtggtgcttacccacagccgcggcacaccacctggcacacgctacctcactaacggcctcaaggcgaggatggggggaaggtttggggtgtaa

SEQ ID NO: 8335 - DNA, 912 bp, Chlorella protothecoides
  modified_base (849)..(858): a, c, t, g, unknown or other
atgcatgacggtggcatggtgcggcatgcagctgagaagggggacgcaaacgaagtccctggagctgtcagacctgccgggcgtgggctgggcaaccagcaagaagctggcgagcctgggtctccagtctgtggccgatctgcaggtgacaatgattgctggaggatgctggcacttggggcagcctggggactggcctcatcctgtatcctctgctaccccatacctgcacaggcatggtcaaaggcccggctccaagcagaactgggagacaagacgggggctgcgctgtgggacgcctcgcgcggcatcgacacccgcagggttgcgccgcccgccgtgcgcaagagcctgggggctgaggtgaactggggggtcaggtttgactcgccgcaggatgccacccgcttccttggaaagctagcagaggaggtgtggactcggatgggcgcggcaggggtgcagggccgctccctcaccctgaagctgaagaagcggaaggaggtgagggctaggagatggagccgctctgctgattcccctgtgcgcctctcgcgaccttctgacattgtgtgcctctcgcctcctgttatgcagggcgtatacaaccccgtcaaattcatgggccacggcatctgtgacaacctctcccgcacccacaccttccaccgccccgcccactcggctgccaccatccaccgggccgcctgtgacatgctgacctccctgcacgtcccccatgccgatatcagaggcatcgggctgggggtgcgcgagctgtgccattgggaggagaggattgcttggggacaggcggtggcatggatggttcaacctccctccttggcnnnnnnnnnncagaggcatcgggctgggggtgcgcgagctatgccattgggaggagaggattga

SEQ ID NO: 8336 - DNA, 813 bp, Chlorella protothecoides
  modified_base (747)..(756): a, c, t, g, unknown or other
atgcaaagggcacggccgagatatcctctgccaactacgaagcccgcaaatatggcatccgggccggaatgttcatggccggcgccaaacagctttgccccgacctcatcgtcgtgccgtacaactttgagcgctaccaggaagtatctgagcaggtgcggcgtcgtgagcaggaggtggagacttaatacacccgggtggtatgtgtgggggaatggaagcgcatgtgttgtcggcagggaccgtcaccccactggcacccgtcgtgcatccatctttgaaaggctaatcacctgcccctgtcgggccgcgccgcaggcctacaagatcatgatggcttgcagcgcctgtgtccagcccctgtcctgcgacgaggcgtttctggacgtcaccggactgggcgaccctttccagttggcgagccggctgagggccgacatccaggcggccacggggtgtacggcttcggtggggatcgggcacaacctgctcatcgcccgcctggcgaccaagcgtgccaaacccgacggccagtgccacatccaggaggctgaggcggccagtgccatgctggtgaggccctggtggggatggcatgctctgtcagctcactcctcctcctcaagatgcatgacggtggcatggtgcggcatacagctgagaagggggacgcaaacgaagtttcgctgtgctgtcgggaccagggtccatcctcgtaccacagccgacccacctccgcgtgtccannnnnnnnnncacatccaggaggctgaggcggccagtgccgtgctggtgaggccctggggggggtga

SEQ ID NO: 8337 - DNA, 1110 bp, Chlorella protothecoides
  modified_base (552)..(561): a, c, t, g, unknown or other
  modified_base (863)..(872): a, c, t, g, unknown or other
atgacttacccttgcaggaaccccaagccagtggtcagtcctgagtggatattggagtccatcaaggcgcagtccctcctgccggattggtctcagaaagcacttccctcagtttctaaatgcctgcccctgcgcctgattgcgccattcctgctgtccacactgcgagacatccctggtcagcaaaggttgcttccttttgggacgagagctgatgtgctgcctgccaaggacggctgcggtacagcgcaccctatggcagcatctgaggaaaatccggccacagtctacaatcagccgagccccatgggtgcgcctgtcgcctacgacccagcggaaatgcgggcagcgcaggcagaggctgcacgactccgcgtagcgtgcgacatgctcaagggcgcgccaaagtcttcgcgggatgacccgaactttgtagagagcttcttctctgcttcacgtcttcattttataggtgcattggtggcgggagcagctgtgatttttgagaatgctgtccatcccccttccgatcactacaggaatgtggaagannnnnnnnnngagcagctgtggtttggcattgagcgtgctttgaggcgcgaatcgaacttattcttgagaatgctgtccatcccgcttccgatcactacaggaatgtggaagactaggctggaaagcctgatgctgtcgggggtaattgggggtccaacccccacccctgggcctggtgcacaagttatcttccatgtggatctggtgagttgcgcggagcaaggatatggagttgctctcaggcacacgtcctcggagaggatgcgcgagcggcttgagtcagcagtctgctttctgcgagtttacccatnnnnnnnnnncaaggatatggagttgctctcaggcacacggcctcggagaggatgcccaagcggctcgagggggcagtctgctttctgcgtgtttacccacctgacttacaatctctctgccctgcgcaggactgtttctttgcttcagtggctgaagccgagcaccccctgttctccggaaaacccctggtgcggcgcatggatcatggaagggatggctaccagcttattcattggcgcgacttga

SEQ ID NO: 8338 - DNA, 672 bp, Chlorella protothecoides
atgcacgccgtaaccaacaatctgaatagtaagaacatctctagcacgccagtccctgagcccagcgcatcatcaacaaatgctcctgttctagaagaggtcgtcaaggttggccccatctcaagtctcaggaaaagcacatcagattccgacgacctcgacacatcgaaggctgcgacaacaggcagcaccccaagcattcctggtcctgccagcctgcccgactcctgcaaggctacagatagggtcccagctgcagctccggcagggggtgcacctgtccctaagaatggcgtgggcattgcagaggagtttgctgtgaattcatctgacagcgtagctgcccataacggcgagcagaaggggcctgtgaagacagcagaagacgtcgtccccgcagcgatcagggaggatgctgggcaagccggtgcagacaccggctccaaggctggggatatcagggcaccatctcattatgtattcgagaccccccaccccaccccacccgtccctctcctcctgccaggcgcgaaggtgctggccaccaatgctgaagccaggaagcccggggcactgctggatgacgactccgacactttcctgaagaatgattgcaaggcggacaagtgggtgatcctcgagctgtcggctgtggccaccatctctgtgtga

SEQ ID NO: 8339 - DNA, 732 bp, Chlorella protothecoides
atggcgcacaagccttcggctgcggcagacctgaagaagcctgtcccggcggagctggagggtctcgctcagccacatatagactcatttgacttcttcctgggccagggcctcgaaaatgtcgtggagggcgtggcaagtgtggaggtggagcaccccattaccaagcaccgccacagcttctggctggagaatgccgtcattggacgcccgacaaaggacgacgcctcgagtggcgcagaccgtcgcctgttccccagggagtgccgcgagacgggtagcacttaccgcgccccgctgtcggtggacgtcgtttggcaggcagaaggcctgatgcagacccagcgcgtcacaaggaagctgggccagatccccatcatggtgaagtcccgtgcctgctacctccgtcacctgcgacaggatgagctggtggagcagaaggaggaggccaacgagtttggcggatacttcatctgcaatgggaatgagcgcatcatccgcatgctcgtgcagaacaggaggcactacatcttcgccctgcgccacagcgcattccacaagcgcggaccttccttcaccgatatggccaccctgctgcgctgtgtgcgtccagatgagtcatccctcaccaaccgatgtcatctcctcaccgacggcaccgcggtttttgccatcacactgcgtcgtgcaggtgcgaactctggccgaacaccgcctgggagatgtctttga

SEQ ID NO: 8340 - DNA, 354 bp, Chlorella protothecoides
atgtccacctcctttggatcatgcttctttgcagagttcttcattccagctggtatcctgctcaaatgcttcctggatgtgtccgacaaggagctctttgacatgcttgtcctgggcgcagcaaaggatggtggacactcgtcttttgtggcggaccgtgccgagttggtgctgcatcagtccactcgattcggactgcacacacgagcccagtgtctggagtacctgggaggtctgttccgagtagccttgagtgttcctgcccgcaagacggactatcaggcaagtcttgtgggtgcagtgcaaggtctgagtgaaagggtgtatgctggattcatagcaatgccaatgtga

SEQ ID NO: 8341 - DNA, 672 bp, Chlorella protothecoides
atgcctttgcatcgcagggtcgagctggtacagaatgagctctactcttctcgtgtgaaagacttcgaggtgtacgcccgccagagcaaccctcgccaggacgctggaggggacttggccgccggcctggcaaacccactgtggcgcatggtggggaacttcacggctccaaagaccaaggggaaaagcgcggccgaagagctggaggacgagcttgcccaagtgagcgccagggacgaggcccgcgaagccctcgcaccggaggctctggagggcgtcggactcctgcgcggtaccgacgttgcgagcaaaacgggagaggggctggagcccctgattgctgctgtgctggatgccggcaacgcatccggaagtggacctctggatccagtcgcggccagtgagagctcggagacctctacccgagctcagaacacagtcgctgggagcgcactccgcaccccagcacttctccccgacgagcgacaggggaaggttgctgcggacacgagaggggacgccacctccagcactgccggcacggcaagggaaggttgctgcggacacgggaggggatgccacccccagcactgctggcacggcaagtccttcgatgggaggcagtgcctcagcagggctggaaagtccaaaaccaaatgccgtggctcctga

SEQ ID NO: 8342 - DNA, 2184 bp, Chlorella protothecoides
  modified_base (304)..(313): a, c, t, g, unknown or other
  modified_base (736)..(745): a, c, t, g, unknown or other
  modified_base (1230)..(1239): a, c, t, g, unknown or other
  modified_base (1643)..(1652): a, c, t, g, unknown or other
  modified_base (2030)..(2039): a, c, t, g, unknown or other
atgcatgtgcttttgctagggaaggaacgatcagggatggcatgggacgacatcctgccctgccaccccaggggtcgtgcccctgcccactgtggtaataatactaatcagattgaccctcgtggcacgaatttttgcccaagccgtgccttgagcatgtacacttgtcgcctgcctgagcttctgaatgtcgacttcttgtgtctcaaaatcccaaacaatccgtgcaggatgtgcatggagccgagggtggtggaacgcgccagcatcttcgaggccagggtctacacgggacaggtacggnnnnnnnnnnttgcctcaaaaccccaaacaactcgtgcaggatgtgcatggagccgatggtggtggaacgcgccagcatctttgaggccagggtctacacgggacagacttgtccgtgcctcaattgtgctggagtttctgacaaggccatgggacccaaggcctccttcagaccatggctcgacatcaagggcccctcctccccctcactactactttccctcattgcagtggattccatcgcccttcaaggatgccaacatcctgctcaatgtcagggcgtttgatctggcagatgagcacagcaggtatgatgggtccagtgcaggcaggggcggttggcaaggggcatggcgctcaggcctcatcgttcccccttacacacacaccccaccccacccggtagcctgctggtcctgtttgagagtgaggnnnnnnnnnncttcccccctacacacacgccccaccccaccccgtagcctgctggtcctgtttgagagtgaggacctggacgtgtcggacccccggctccccaccgcggtttctcagcggcgcaccatcgatgtgctgccggggtctggcatccgattgcaagcgctgcccgccgggccagacggcatccccaggtccctggccgacattcatcttgactttgacccgcacttcccttacgtcccctccgtgctcgtcagcttcctcctgaaggtgctctgcccctacctctacaatgtcatcatcaagggaccaccccttcaacccccgcaccccgcaggtcctggattctcaattcagtggcgatcagggctgtatgtacgaggagagggtcgcctcgcggcccgacctgtacaagtacctggaccaacgcctgcaggggttccagcccagcccggcagccagggcctgactgtttgcaagctcggtacagcnnnnnnnnnngttcagtggcgatcagggctgcatgtacgaggagagggtcgcctcgcgacccgacctgtacaagtacctggaccgacgcctgcaggggttccagcccagtccggcagccggggcctgactgtttgcaagctcggtacagcaggcctgcgagagggactgctctcacaagacggtgttccaccaccctcgtggtactacacaaagccccgggcgcagtaccagggctgcagaccttgtgatgctggacctcaccttccttgcccccacctgcgacccttcctgccgccaagaccaccgtcttccaccacgaaattgctctgtcccctgctttgcccactggcgccctccattccccagcacctgcacatgtcagcagggcacttcacaccacgctctgcaccttnnnnnnnnnngctgtcccctgctttgcccactggccccctccgttccccagcacctgcacttgtcaacagggcacttcacaccacgctctgcaccttccagcctcagccacgtgacccccgcttgatcttcctcttccaccccctccttgtctgcgccaggaccgttgatcagtgtacagatgcagaacatggggctctgcagctgctgcttgggtacacggccgcggtcgggcagtcttgttatgggatatccactttggcacaatccagaggacaaaccggcatgaggccctcaccgccgcttgccgcggccgccgagcttggcgaccccgccgcggccgccacgcttggagtgtccggcctggcggtggcgtcgctgctcctcannnnnnnnnncgagaccctcaccgccggccgccgcgtccgccgcgcttggcgaccccgccacggccgccgcgcttggagtggccggcctggcggtggcgtcgctgctcctcaacaaccttggcgcgccctgacttcttcctgcgctgcttgctga

SEQ ID NO: 8343 - DNA, 2121 bp, Chlorella protothecoides
  modified_base (492)..(501): a, c, t, g, unknown or other
  modified_base (928)..(937): a, c, t, g, unknown or other
  modified_base (1299)..(1308): a, c, t, g, unknown or other
  modified_base (1818)..(1827): a, c, t, g, unknown or other
  modified_base (1992)..(2001): a, c, t, g, unknown or other
atgatctgcacggtgctgaagaagttcccggacgaggtggttgtgcgctgggctgacaccgccctcctccccctggtcacgcgcctcgtttccgatgcctccagcgcctgccgcggcagggccggcgcggcgctgctgacgctgctccagcgcgcgggccctgccctccgcgccacggctgccgatttctgcctgcagtggctgaccggggaggacggaaggctgacgcgtgcggcgctgcagctggcgggcgtgctggtcgaggccgatgccgaggcggccgccggccgggtgccggccctgctaccggtggtgggccgcttggtggcagcgggggacggcaagggcgcggagggctggcaggaagcctaccacgccctcctcctcctggagaagcatattaccttgcgacctcaaccccacccttctctccccccactaccgcgtcgcaaggtgcacgccaagctgccggctgcgctgcagcctggcgannnnnnnnnncctcctcctcctggagaaggtgaggcagtgcgatggtttctttgttgccattggggtggctctcgagtgaggtgccatgcaccggatgtagcatattaccttgcgactccaaccccacccttctcttcccccactaccgcatcgcaaggtgcacgcaaagctgccggctgcgctgcagcctggcgcctcacccgccgcggccgagagctgggccgccgcagtcggcgcgctggagcacccccacttgtgggtgcgccgcgccgcggggcgcctgatcctggccggcctggccgcccccggcgtgaggcccgccctgctccccagcccagggtccgcaggcgccctgggccgcgctttcctcgcgcagctggacggcgagcacgccgacgaggctctggccaagcaggctgtgcgcgggctggtcacnnnnnnnnnngcagctggacggcgagcacgccgacgaggcgctggccaagcaggcggtgcgtgggctggtcttgctggcccctgccgcgctcgaggacgacgcggctgccggtcggctgcccaccacgctgtggctggcaaagcgtgcgcccagcggcctggcgcgcgcggggctgcttgctgtcgctggcagctcggtggcgacgtccgatgaggtcgaggccgacgagggcggcggcgtggaggaggacagcaacgccgaggccgaggccgaggccgtgtccggcgccgaggcggcctccagcgacgacgagggcgaggaggacggcgacgcgcacggcgcctcggccgccgccggcacagcacgacctnnnnnnnnnngcggcctccagcgacgacgagggcgaggagaacggcgacgcgcatggcggctcggctgccgccggcacggcacgacccggcgacggctacacgagcctggcggcgctgctgcgtggcgtggcggcgctggccgacgaccgcgcgttcacgcgcgcgacggcacggcaggccgcactgcgctgccttgcggcggtggcctcgcgcctgggcgccgagggcgtgctccctttcctccccatcctgctgcgcccgctggcgcgcatcaccgagccgggggcgacgggggacggggaggagacagtcggcctggcgcgggaggtgctggaccacctgcgggcgctggtgggcgccgagcggatgctcctggcgcacgccgctgcgcgcgccgggctggcgcggcaacgcgcacagcgccgcgcggcagacgcgaggagggtgagtctggggggggcggggcaggaggacaagggtgctattgcacaggcaggcgggggaagggccttgtgtggnnnnnnnnnncagacgcgaggaggaagattgtggatactaggatgcaaatccacacggccatcgctcgtggcaggggcaagagcacgtgtcgagagggggttgtgcatgctgacatggcgccaccctccggggcttctatcaagcggcttgtggggtagcctgcggcatcatctnnnnnnnnnngcacgtgtcgagagggggttgtgcatgctgttgtggcgccgccctccggggcttctatcaagcggcttgcggggtagcctgcggcatcatcctgccactcaccccctgtgccactcctga

SEQ ID NO: 8344 - DNA, 573 bp, Chlorella protothecoides
atgatgcgcgagtctttgtacaccgccggctacctcggggtggccccattgctgaaggccaagctgacggggcactctgcgtttgaggggacccccggtgcggcgctcgtcgtgtccggcgtatcggccggcatcctcgccacgctcaccagccaccctgcagacaccatcaagacgcggatgcaggtggggtgcctggggagggcacagggagggtggcattacaaggactggaaggagtcggtggtatggagagaccggctcggcagcgcagaggagggcagtcgcccatcactgcatcctacctcggatcgggtgcctggcttgtggcacgcccagttgtgtgctgcaatgagacacccggccaccagccgaccagggactcctccccgcggtcacgccacccactctcctgagagcccgcccccctgcattcaatcccgccgcaggcccacccagacaacacggcattccctcattattccagcgtggcctccacggcccgccacatcgtggccgccgagggctacggcggcttcttcgcgggcgtgctccccaggaccttcaggctga

SEQ ID NO: 8345 - DNA, 1932 bp, Chlorella protothecoides
atgaagaaaaagcacgccaccgtggtgcgctcccggccgcaggaggtggtggaggaggactccggcatccactcccccgaggagctgagcgaggacgaggggtccgccgcgggcgcgggcgcggcgggcgcgcccggcggcgagccgcgcgcagggcgccccgcgcgccgctccgcctcctcggccaagctgtccagcgcggtgccctccccctcccccgagccgcggccgctgcccagccagacgggatggcaggccgagggcggcagcggcgccgacctcaaggtcaaggtgggccgccgccccggcgtgcactttgacaccgcgttcgaggagttccacgccgcgccttcgccactgcagtcgagcaccccgcccttcggccccgactccggcggcgtgtacgacaagctgtacatcatcctcatctccctgcacggcctggtccgcggcgagcacatggagctgggccgcgactccgacaccggcggccaagtcaagtacgtggtagagctgaccaaggccatggcccttcaccccgccgtgcaccgcgtggagctgctgacgcggcaaatcaccgacccgggcgtggacgcgtcgtacggcgtggaggaggagtgcctggcgcgaggcgcgggggacacgggcggcgccttcatcgtgcgcctgccctgcggcccgcccgacgagtacgtgcgcaaggagctgctctggccccacgtgcgcgagtttgcggaccgcggcatcgcgcacgccgggcgccagctggcgcgcatggccgagggcgggcgccgctgcgagctgtatgcggtgcacgggcactacgccgacgcaggggaggtggcagtgctcatggccagcagcctggacgcgcacatggtcatgacggggcactccctggggcgcaacaagctggagcacctgctgaagggcggcgccatgacgcggcgcgagatcgaggaggcctacgccatcggacggcgcatcgaggcggaggagcgcgcgctcgacaccgcgctcatggtcttcacctccacgcagcaggagatcgacgagcagtgggggctgtacgacggctactccccgggtctggcccgcgtgctgcacttccgccgctcctacggccgccacatgcccctgctcaaggtctcgccgccggggctggacttcagcaacctcaaggtcaccatccccgccgaccccgtggtcaaagagttcgaggccgcgcgcgccgccttcgccgagcgcgagctcgcgcccgccgcgccggcggcccagacccaggctagcggtgacgccgttgcggggggggggacgcccccgccgtccccggcggcgcagaccccacgcgtgccagacacgctggacccgcgcgtggcgctcatccccgagggcccgcgcatctggcaggacatcgcgcgcttcctgcgcaacccactgaagcccgccatcctggccatgtcgcgccccgatcccaagaagaacctggtcacgctagtgcgcgcctttggcgagtcgcccatgctgcgcgagctcagcaacctggtgctcatcatgggcaatcgcgacgacatcgagtccatgtccacggggacgcagaaggtcctggttcaggtgctcaagctcatcgacaagtacgacctccacggcaggtgcgccaagtctgaggggtcggggggtctgaaggggtccgaggggacgccctggcctgcatcagggtgtgcggtgtcgcgggccgaaccgcctgcaccgctcccatgttcccttgccagtccatgtcatcccctcaaagggtctcgagccctctcacctcctcccaacaccaatcccccccttttcgcagcgtggcgtacccaaagcatcacacccaggccgacatctccgacatctacaaatttgccacctccacgcgcggcgtcttcaccaacatag

SEQ ID NO: 8346 - DNA, 1137 bp, Chlorella protothecoides
  modified_base (203)..(212): a, c, t, g, unknown or other
  modified_base (639)..(648): a, c, t, g, unknown or other
atgggaagggcacgagggtgccacttccttcccttcctcatcgcgctcgtgggcctcctagccgcttccctaggtcaatgtgcgccagtctggacgactgaagccactactcagcgaaacgccagtgactgcgaaaacttcagcagcggcagcgtggacttctcggggggaaacctgacattctctacacacccgcagggtannnnnnnnnncagcagcggcagcgtggacttctcgggggggaacctgacgttctccagacacccgcaggggggagcggcatggggatcctacattccaggtcgccacacagattccaactttgggcagctcacgatcacgacctctgggctgtacagcgacagcgagcaggtgtacgcaggtgcggtgtgcatgatgtcaacgggagtgggcaaggtggatggcttcgctgttctgaacccatgcgctggtgagcagcagtctattctgttgatgaagcgaaaatcgctatctatggatgagggtgtccttcccgcagtatcagagcttgaaggggtgtggtgtgcatgctgtcaacgggagtgggcaaggtggatagcttcgctgttctgtattctcccgaggcaggcgttgtcatcgacactcccccacccccannnnnnnnnnaggaacccatgcgctggtgagcagcagtctgttctcttgatgaagcggatatcgctatcgatggatgagggtgcccttcccgcactatcagagcttgaaggggcctcccggcctgcagccgacactgccgaagccaggttctggtcagccacctgcctggctgtgagacagtttgatggactcaagcacgggtactgggctgcaaacggtggcccgggccctggaaaccagcggccttcctggtctgagggcgccagctccgacccacatgaggacgaggcagggaaaaagggcgtgggaaggcgacacaggcgtgattctgtgcgtgcgtccaagccgggatcaaaggctgcagccgagcaactattcaaccaggcagtcagtaacatcttgagatgcatgccagacctgcctggaggcgtcgtgggtgcagcaaattcgccggcattgcgccagccacgtcctcaccccaaccatcaccctctctgc

SEQ ID NO: 8347 - DNA, 771 bp, Chlorella protothecoides
atggggaagaagcgtgccgcaaaggatcgggcctacctcactgccactgagtggaaggaggaatggggcgggcacaaggctggcccaaggggggtccctttcaagagcttgcccttccactgctgcgcgatctctttccagccctttgaggacgcggtgtgcacagccgatggcacagtcttcgacatcgtgcatgcagtgccatacatccagaagttccacaagcaccctgtcactggggagccccttgaactcaaggatctgatcaggtggggggttgaagtgggccaggggttaatggccaaggttggggtacaaattggctctgcaggaaagctcggtgtgcgagggtgtgcagcgggacggatacgccaggagcttgctggcctcattgctgccctcactgctcccggttctccctcaggctgcactggcacaagaacacggatggagagtacgcctgcccaaccctgggcaaggttttcacgccgcacacgcacattgtggccatccgcacgagcggcaatgtctactgccacgaggtgtgcatgcggggggaagggcgctcgctgtggaggcaatgatggggttggtgtcttgcagcaactttcttgcgtgccagcactgagaagctgtatgaatgtcgccagactcattgaggtaaacggtgtgaaagcctccaagaccacacactccctgggaattgcccctgcaggctgtgcaagagctgaacctgaagaccaagaacctgcgggacctgctcaccgatga

SEQ ID NO: 8348 - DNA, 1002 bp, Chlorella protothecoides
atggggacaccagacttcctgatgctgccccacgtcctacatgctcatttgccttcgattccttctgcttccagctgtgcaaactccagttgctccctgccagtgcaggatccactgaatctttccgggaagaatctggccgagtttgaccatgtgaagaaggagctgacagtggagagcgcagaggagagggcggcacgagagtcgacccgggtcacactctccccgcaggcccagccgatgaacggcattcgagcggtggatgaggacacgcaacgcgtgctttccagcttgaacaccaaggaggccgagctcgtgtttgaggcaggaggcggcggcaggaaggctgaggctgagcgactgctggccaaggccctgcaggctgccacggggaagggggacgcctccaacaccgcggtcccaacacagccaggggggaccgacccgcgcctcaggcaatcgggcacgaatactcccgcacgcacatgcgaggccgggctggttcccaccacctcccattccgcgcctgccccaggtcggctccgcgcgccgagctcaatgtgtccttcaggccgggcgccagcacgtggaacaccgacgagcccgccccttccgcgccttccacctcgggccaggctggccaggtgcgcgagcatgtgcctggctgggcagaaagggagggcgcgtgagcagagcgggctttccggcgctctctttgctatctacgggggaggtgaaagcgaggacacacagccctgtgaccttttgggtgtaaggcactgtccaagccgactcacaattccccttacccctgctcaggcccctgcattcgatgccagcgccggccggcccctgcccaagccctactctgccaagttcgtggtggggcacagcacgacgggggccgcctcacgcgccttcacctccaccgccatgacgccaggtgggtggcatgggttgcggctaggcagtgggcatgggcgccgacctgtgaggcgctga

SEQ ID NO: 8349 - DNA, 1059 bp, Chlorella protothecoides
atgctgcagattcgcccctccatgaatccgcgcaaccgcgcagcttccggcggccctgaatattctgtaccgctcgcctccattggcatctggagaggagagccatctgggaagtcaacatatcttggggttgttgctgcttgtggcctccaaaggtttttagtgttgcacttgttgttctgcgagatgggttcgcaggcacagcgggcaccctccttgtccacgatgagattggtattgctcctcggcctggccatgctggcccatgtggtccctgccattcgcacacctttagtgccggaggcacggatggagccaaacccgaacctcttccgacgcgcaggcaatggggacccgccttctgctattttggcgggaactgtacaaatgaagcctagtaagtttcatcccaagctttcattgagtgacggcgacatctcgcggggtcggacgggatttgggtttctcgtcggaaggctgccgtcaagtctgtgttggcgggaaatccaaatactctgtccacctgctactgccgggcgcccagccacccctccatccgctccactacacagtgagacctttaccatccacggtctgtggcccaactacaataatggcagtcacccccactacggaggtgcgcttgacgcgcgcaccacagccagcgtcgaacaaacaccatgttgctggattgaggctgtgctattttggcttagatttgggggtggacggctgccaatgcttcagagtggcaagaagacaaaggaggcatgcattccagctttgggagatggggctctgggcttctgggcccacgagtgggacaagcatgggacctgctccacgcccatcatcacaagccagccagaattctttgagacgacgatgaggctggacaagcagtatgacatcaatgtcatcggagacctgtgccccagcaacacagcacctcaacatacacatgtgtctgttctcacacacatatccttgtactgctcagaaagcgctgctggctgctggaatcgatctccagaaagagatccgtgtgaagagttctga

SEQ ID NO: 8350 - DNA, 570 bp, Chlorella protothecoides
atgaaaggctcacttgcagcgcttcatgcctcccaccccccctttctccccgcccaggccctgttcgacctggaggccaccaacgcggagctgaagtccgacctgcgcgacctgtacatctccggcgcggaggaggttgacgtgtcggcgtcccgcaaggccctgctcatccgcgtgcccttccgcctgctcaagcccttccacaagatccagcagcgcctggtccgcgaattggagaagaagttctccggcaaggacgtggtgctggtgggcgtgcggcgcatcctgccccccgcgcgccacgcgcgccagagcgcgcggccgcgctcccgcaccctgaccgcggtgcacgacgcctggctgggcgacctggtgtaccccaccgagatctccggcaagcgcatccggtaccgcgtggacgggtccaaggtgctcaaggtcatcctggaccccgtggaccgcgccaacatcgagtacaaggtggagagcttcgcgggcgtgtacaagaagctgacggggcaggacgtggcgttcgagttcgcgccctccgagaaggccgaccaggcgtga

SEQ ID NO: 8351 - DNA, 639 bp, Chlorella protothecoides
atgctgaggctctggccatcctgcccccctccccttcaacagacccccatcacgggctggctggaggccttcgccgcgcacccccgcctgggggataggcgcggcctggctcagaggtctggcgccttctctgacctgagccgcgacgagcagtcctcggccgccggcgcggcggaggccaccctggccgcgctggccgactggaacgcgcggtacgaggcccgcttcggccacatcttcatcgcctgcgcggcaggcacgcccgccgaccgcatgctggccatggggatcccgccgatggatcacgtacagctcgacgcgtgggaagtcccctcacagctaggaagtggccacaccagcgcgccccgccaaccagctgcgcatggcacggccccgtgcccagacacatcgccagcccagcgccgccatgtcggtcgtgccatcttccagagaaccagtggggcgttgaggaacgccgttggttcgcggcggccctttcgggcgcgcgcgcggacgggaacccctcaacgacgacacaggcatgcaggaaacagcaggaggatgagctcggcgccaccggccggccaggtgcgtggtttttttaaccccggcacggcctcatctttggggcacggatga

SEQ ID NO: 8352 - DNA, 519 bp, Chlorella protothecoides
atgatccgcatcccggcccacaggcttcgagaccttgacgctcatggagaaggtgcccgtcgacgacgaggaccggcccctccaggtgggcacgcgaggggtgtggggagtgatggtcaggaccggcgagggggcactcgggacagatggaggatcgcattctgcatgtttgccaatcaattctcaggccatccatgttcatcgatcacatccatgcaacttgcgcagcccatcacgatcacgggagcatctgtgttcgtcaatccctacaaggagttgctggaggaggaggcaaaggctgccgccgccaagagcgctaccgaagccaaagaggctgcacgggagacagaatcagcggcaccgatacagcccttcttcgccctgccatctgccgacgatggcgaaggcggggtgggcaagtacttgactgccccggccggcccggctcggggcgggggcacagctgcacctaaaaagcagaagacagggggtggctttgcaaattttgatggctggtga

SEQ ID NO: 8353 - DNA, 288 bp, Chlorella protothecoides
atgaggctgcacaccagcctgggcgacctgaacctggagctgcatgctgacctggcgcccaagacctgcgagaacttctttgccctcctggaggggggctactacacgggcacggccttccaccgatccattaagaacttcatgatccaggtgggttcctggaaggcggggcagaggtcaagactttctgtgctttggctggggatggtcgtactccagggcaccggacgggatgtgcgtgcagaaactctggccgtcttacgagataccaggttgtacccggcctag

SEQ ID NO: 8354 - DNA, 540 bp, Chlorella protothecoides
  modified_base (220)..(229): a, c, t, g, unknown or other
atgacttccggagcgcccaagcgcgtcctcctgctggccgtcgacgactcagatgtaagcctgtccatgcatcgggcacgcatgttggcttctggtgggagtggcaaagtgcggtgcatgcgtggccgtgactcagcttgtcgtgccagccaagtgatcgtccgcccttggcctccatgtcgccagggtcggcttggagagcgctgctggaaccgcgctnnnnnnnnnnccggcctcgcgcagatccacctcctgcatgtggttcctgtgccgctgcctgagattgtgggcggcctgggcgggatggacacgggcctcgtgtcggtggatcccgacccgaaggaggacattaagcatgtgagctggttgcccgggatagagatctcggatgccaaggagtttatcaagcgccgtttcgtgaccaaggttgccacaaaaaacattgcctacaaggtgaggcaggcatgcccttcgattgctcaatggggcacaacagcctgtgtcgatgctgctccgccagcagggtcctacagccgctga

SEQ ID NO: 8355 - DNA, 1275 bp, Chlorella protothecoides
  modified_base (567)..(576): a, c, t, g, unknown or other
  modified_base (922)..(931): a, c, t, g, unknown or other
atgtccgtacccgctgaagaggtattctgccatgtgactcgccggatcactcgcccgcaccgtggtgacctggggttgcaacaattcaaatcttggcagatccgcgcggactgcaaatggccatgcaccatggagcgatgcaatgatgtgaaatatcactcagaagtatggcaaatcattcatgaccgcctcgtgaccgagcctggcaggattgctgtgagggagtacaagagtggcacccttcaagcaatcgagtacaaatgcgcacaattactcacatgggtggagaaggtgcaggatacattttcccaccatgccgatgtctctgcgggcaaggaactgagcgaaccgcccgcgatagctctatacctcgataactcctgctttcacagcacctcggcgagggacctaacacataagccaagcccaggccgcaaagtgccgcatgaacatcatcacctggcacactgtcttctcggtgacagtctgttccgccctcacccgcagggtgttgcccctgaggcatggcacacaagccccactcggcatcaggctccccaccgtgtnnnnnnnnnngcgatatcggggtccggggccagggtgttggccctgaggcttggcacacaacccccaaccggcatcaggctccccacggtgcacatcggacctccaccagacgccgcagcggcgccagaacccgcacagcacctatgtcatggcgatagtggcaactctggccctggagcgtcaacccccatgcctcacatctacgtcttgttcacatctgggagcactggctcgccggtcggcgtgctcgggacagagacaggcgagtcgacgggatcagagaaattgtgcatctcactcaggtgtccagccctgcgaatggacggccctggcctgagatgtccctctcctccgnnnnnnnnnntgcatctcactcaggtgtccagccctgcgagtggacggcccgggcctgtaatgtccctctcctccagacacagaccccttgcacacagcgaagtcgcaccccctctccaccactcttcctcgccaggtcttctcaatcgcgtcaaatgggcgcagtctcagggcttcctcaatcccagtgacacatatgcgttcaagacggcccccgtctttgtggacagcctgatggaatgcctggggtctttgcttggcggcgcccgcatactcgccataccccgcgccctcctgaaggatccggccaaggtgcgcatctgcaaggcaacgctcaagtccttgtggacatag

SEQ ID NO: 8356 - DNA, 714 bp, Chlorella protothecoides
  modified_base (291)..(300): a, c, t, g, unknown or other
atgctgcatctcagcacctgcgcccggttggggctcggcccacggggctcccttcatccgcgccatgtgcagcctcgcgcacagccccggccagcccgctcccggtcggcgccagcccagactcggagccaggtgcagctcctcgccgcccgggatgacgtcggcacactgcgcttgcccctggatttcatcgccattctgaccaccgtcagcgagcagaagggccccaatgaacgggacatccagtgtgcccagctcgtcccccccccccccccccccccccctctcccnnnnnnnnnnagtcctgtggcacgccaacttcagccccagcgccctgacggcgcgctccgagatcctggaaggcgcccgggccacgctacgcgaccccggcagccaggcccgctacgcgcagcgcgtgcagcgtggggaggtggaagagcgggtgccctcccgcctcgtccccggcgcgctcctgctgctgctggaggcgggtcgcgcccgggatgcggcagaggcgggccagcgctggctgtcccaggcgcgcaggggggtgcgggaaacccaggacgtggcgctcgcgacggggctgggcctctgcgacgccgccgccgaccacctggcccagacggggcgcgtggcagaggtgggagagactgggaggatgcatgtggctgggcagggtgcggtgtacatggtgctaccgagatgaactag

SEQ ID NO: 8357 - DNA, 390 bp, Chlorella protothecoides
atgcgcagccccagtaaccacccaaaccctcatccgccgcgcatcaccccgccagaccgtccacctgctggaggaggccgcgggtgtgctgcacaagcacagggcggggtccagcctgcaggcagacatccagacggcggtgcaggagctggagactgcggtggtgatggagctgctgggcgccgggaaggagggcagggtggagggcctgcgccgcgcccgccaaatcctgctgtcgtccggcgggaggcacggcgaggcacccacctcgagcccctcggcgccgccggcccccagcctggagtggaggtccaagttcctggccgacctgacaccacaagagctggtaaaccggctaatttgttgaggctgtgtggccggcgaccttga

SEQ ID NO: 8358 - DNA, 207 bp, Chlorella protothecoides
cggtgccggggacggcgcgcgcgccggggtccgacgcgccgggacccgccgacgtcgccaccgcagtgcacaactgccactaccggccctacctggagaagcaggccgcggaggtggcggagatggcgcgggacgaggcgctgcacctgcccccggacctggactacgcggccatgccggtgagtggtgaggggaggggagggtggt

SEQ ID NO: 8359 - DNA, 237 bp, Chlorella protothecoides
atgttcacccttcctgcagttgctgtcctgctcacgccatccaagaccaaggcaatcggggaggtgctcgtcagctatgccgagaaggtccatgccagcgccattgtgatgggcaagtcggaccgcagcgccctccaggagctcttcatcgggtctgtcgccaaggtgaggagcgccttgcatgcggttagggtcatcctgaagagtgccaccatgcccgtcatcatcatcaactga

SEQ ID NO: 8360 - DNA, 567 bp, Chlorella protothecoides
atgcggcgcgcgcccctgtttgcgccagtcgccgcttgccctggccgcaccggtctgtccgtggtcgccgtgagcgccgtgggcgactgcgcccgtatcgacctgaatgccagcctgaaggactgcgatgggtgcagcccaatcgccctgccctgcgcgccagcgccctccggggtctatgccccgctggtcgcgctgggcgatgggggcttggcgatggggtgcgaagacgggcggctgtgcatcctgcaggcgtattctggggccggctggcaggagcaacccctgcaaatcagcctcccgggcctcggctcacgcatcacggggctggtgcatgtcacggccccgggcacctccctcgcccagcccctcctagtggccaccactgcctctgggcatgtcgccctgctggcaccctctgaaggggccgtgcgtgcctggcagatcagggaggccatttgcctgcctgcgcccatcttttcagctccaacctttgatgtagagacgggcagcctgttcttgggttgccgcgacgaccatgtgtattgtttacgcataggccattga

SEQ ID NO: 8361 - DNA, 576 bp, Chlorella protothecoides
atgcccttgcataggcccgcggtcaatcatcaagcttgtaaggcatggggcctgctcgccgcggggagagccccagctgcctcctgcagggctgccaaccctgtgcaccagccgtccagtgcccagccccagcgcctggggcaggatgcccatgcgctatccccccgggacgctgcccccccggcccagccggcaccggtggatcctgtgctcaagaggacacgtaagcgcaacgtctccaatcgcctgcacatcacccccgagctgccgccggaggaggcgctgcgccgcatgcgcatcagcgatgcaaacaccggcaagccggcctggaacaagggccgcaagcactccgaagagtccctttcgctggcccgctctgcagagaccaaggccaagatccgagctgcgacggcggctgccatgcagcgtccagacgtgcacgccaaggtcatcgcagccttggagtaccgcaaccctgtctcccaggaggaccggcctctgcatgcctctgcatgctccaagaggctgggacatggtccagcaaggggtcttcgacctgtccgtcatccgcgctag

SEQ ID NO: 8362 - DNA, 1068 bp, Chlorella protothecoides
atggcggcatcgacccgtcatggagggcgatcggcaacatcgctccgaggcccgctcattaccgcgcaccggatcgcatgtgctgccagccgcgagacctcgagtcgccatcaggaatccgggagcctcggcgcgcccgtgctgtcgcgcaggcagatcttcctgatgctgcagacggctggggcggcatccctggcgcccatggcgagtcccccccaagccctctcccagggcttgcctgccgagccgcggggcaccacccagctcctctccaaggccgacatggcggccctgacccccacccagcgccagctctatgagtacaaccatcggctgcaggtctccaatggggctccagcaggcttcccaggattcgtcagggagggctacgacatgcgcgtgatcgccgaagagggatttcaggtgaggacgcagggcgtgcggaccacgccggagggtctcatatacaaggactacgaagctgggacaggggagctcccccagggggagcagcaggtgctctttgactacacggcctacaatgaagcaggcaagatggagtgggtggttgccatgggtgttgggatggcattccctttgtacgcctatttacatccttgccatctgccaccgcctccactaccaacagcgggagtgattgacagttcataccgcaagaatgccatcgccaaaacgcggttgggcatcggaagcctgattccaggtaggtcgatcggaatcaggatggtggaagaaaaggctggtcgttcaggggcccttgtccatgtgtcactggggtaccagtgggatggaggattagagcaacgcctccgcttccccaccacccattaccaccctcccaccccctcaggcttcgagatgggcctgaagaccatgcgtgtgggtggaaagcgacgcatcgtcgttccccccgagctcggcccccccgtggggccagccacattcttctcggccaagcagtttgaggtgtttgacgtggagctgcgtggcacacagaactgccgcaggcgccagaccggtttcttctctgacgtcgtgtgcgagtga

SEQ ID NO: 8363 - DNA, 2013 bp, Chlorella protothecoides
  modified_base (1287)..(1296): a, c, t, g, unknown or other
atgtttgcatgcgcggcaccagctcccatcctcgtgccgatacggtcgcacgctggagggtgctctgctggatcccccggttccgtgccgcgagttcgtccgctcaggcgtgatctgcgagctgggtgcagggaaattcctgtacattcccgatctctgtccgtgcaggcctctgcatcagaggccaggacccacgcggagcgtcaggcgtccttcttctcgtcgcgggtgcaggatttgagggacggcatcacccccgagatcgatgcccgcctgcacacgatagccggctcggtgcctggcctggggcctgccagccgagtgctggatgctgggtgtgggatcgaggccctgattccccacctgcaagccctgggcatccaagacattctggctgtggacacctgccctgccatgctggctcaggtggaggcacggttcgggcagggtgacagcctgggcaatgtgccatgtgtgcgcacatggccgggagacgtggcagagcttcctttgtaccagggcccgttttccgccgttttcttcaacgccgtcttcggaaatctgtacgaccagcatgccgcgctgctgcgggcgacgcagctgatccaaccaggcgggtacatcagcatcagtcacccgctagggcgtgcttggctccaggaattcaggtggcaggatgagttcaggaggcaaagagagcccgaggtggtaccgcatgagctgccagacgaggtggccttgcagcgcctgatccataccctgcccctcgcatgtcgcgagtatgtggaccagcctgacatgtatcgcgcactccttcaggtaccactgcggtatgctttcccaggaggaccgctgcggatgagcgggcctgttgtatctgggtttgggcgaggatctcgtcagctaggagtcccgaccgcgaatgttcccccggaaggatttcctgacagtcttccgaagggagtctactttgggtgggcccaagtcgacgcggtgccagacgcaccagacgcagacagggctgttcataagatggtcctcaatgtaggagagcggcctactttcggggatgcaggctttgcaagcgaatggaaggaatgcactcagacctgttcacaacacgctcgcgagttggctcacatgttttatcaccaaccaaccagtccgtcatcctctgtgagcagacccggaagtgagtgtggaggcacacatcatgcatgggttctcagaggatttctacggacggtccacaaaacttgtgatcctgggatttatgagggttcttgnnnnnnnnnngtgagagggccgggagaggtggttaaatctggcacaaatggtcacttgccgctggattgctcatgctcggatcttcccgatctccatgcaaatgcagaccggagatttcttttgggggcctgccggagctgctatctcagatacgacgagatattgggattgcacgcgtgcagttggatgatccagagcttcaagccttttctcgcgacaagctctttaccccctgagaagtttctgcatatcataagatctggtcatttacaagcgaagtcagctgtgtgcacatatatcatacctggatctggcagtgtatcttgatctgttcatccagaagcgaagtcagctgtgtgcacatgtatcatacctggatctggcagtgtatctgggtttcgtagatacgtcaaagttgcatcgtcgcaaggggttgcatgggaccctggtacgaaatgtcccacggccacctccagtcacatggtttggcctccgctctccggaacccacaccacccatgccggaacaggcgagttcccacggaattcatacgcggccatctcggataattgggcattcgggggtataaagtacttgtcttgctacagtatagtacagatcgcgggcataagccaaggtatacgtatcgagacccaccgctcggcaccatgcactccaaccctccgaaactgttcctggcaaccctgctcagcctgtgcgcactga

SEQ ID NO: 8364 - DNA, 768 bp, Chlorella protothecoides
  modified_base (46)..(55): a, c, t, g, unknown or other
atgttccatcgatccagtgggtctggcatcgagctgagcctggacnnnnnnnnnntgaggctggcgaggagcgctgccctcacgccgcacactgatctccccatccccccatcccaccctcctgcattacattcccattctcccctgccccctgcgcaggaattccccatgttccatcggtccagcgggtctggcatcgagctgagcctggatgagttcctggacgcgcgggaggtggtccagggcatgagcgacgagtacgcggccgcggagagcgccgattatgtgagtttgtggtgctgtccgctgggtccaaggcactgtgtggtgtgctggtctggccggccagtagaccgaatgactcgaccgaggtgcagcatgtgcagagcattgtccgacatcgagggcccatcatccgtcgcccatcccacagatcgagagggcgggaggagaggacgcgctctccggccaactcgccgctcagatgagtcttggcacggacccgcgggtgccggtgcagtgacgcggtgtgatgccatggatccctcttcccggtccttgactttgtgtgctcttcttgacttgctctcgctctggtctgccaccattcacgctacaggatcgtgtaaactgccgtccctcgtacaccaaggtactccgcacattggggttcgcagggcgctggtgccccggcaggaactctcagccatgacgcatgtatgtgatcgcgacccacttcccgcacgacacccaggaccattgctttga

SEQ ID NO: 8365 - DNA, 5442 bp, Chlorella protothecoides
  modified_base (16)..(25): a, c, t, g, unknown or other
  modified_base (414)..(423): a, c, t, g, unknown or other
  modified_base (1715)..(1724): a, c, t, g, unknown or other
  modified_base (3340)..(3349): a, c, t, g, unknown or other
  modified_base (3414)..(3423): a, c, t, g, unknown or other
  modified_base (3876)..(3885): a, c, t, g, unknown or other
  modified_base (4348)..(4357): a, c, t, g, unknown or other
  modified_base (4475)..(4484): a, c, t, g, unknown or other
atgtggtatgcgcatnnnnnnnnnngacgttgcaatggagatgaggcaaaaggacatggatgcagcaggggaagagcctccgtaattccctgccatcttcccaactgtgcgttctgtgcaatgtggtatgcgcacgctgagttggcacttgctctctcaacatgcggcgctgcaactgggtgccagcgtgacttgcatccctcgactaatgttcaagggcccttgctgccagggctgagcacacccacgcttccggcacttgacaagacgcaagcgcccgcagctgcgtccaggcacttgttcagccgctcctcgcctgacgcttggcctcctccacctcgcgcaccttctcccaggttggaagaagtagggatgatagaaggatgtttaagagctagcataaaggatacagcnnnnnnnnnngattgggttgagtggcatgagaacccagcaggggaacagcaggtgcctggaactggagtgcaacccagcagcgagtgcactcccatcagcacgccacagcagtgccctcaccttgccagtgtagacgaggtcaaaattgtagatgagcaggtccacctcatcatcatggttggcgatgttgtgctgattgcgtcgcgcccggttgacgaagaagttgccgacctcctgtcaccatggattgggttgagtggcatgagaacccagcaagggaacagcagctggagaggttgtatccccagagcggaagcaatgcgcgacacaggggagaaggtgtcaaccattcagtcacgtcgttcggccaccccggtcgatggacagcgtgagcacgtcaaagaaatccaccagcgtgggattctcggcaatggcagtccatgccagccctgccatcggatgatgaaaggatttggggatgggcaaaggacaaacgtgcaaagagggccttgcagcggggctgcacggcttggtcagcaggttctcatacactttgtgcggcagcacagagaaaaactcactgcagtgatgggagaaatagaagtctgtgagcagagagccgtacgtgaggatcactgtttctacgacaggcatacagcaacgtcaacaagaaggcaatcacggcaagggtctcgaacccaaggcaggtaccatgcagctgcatgaggcagtttcggggcatcgaacagggctatgcatctcagccaaccatggatgggagaccgggaagtctgtcaaacactccatcccaccgtgccgttcatccttcagatatcttcttacagggaagaagtcgccatggtcgttggccttcagggtgagttcaaagatcttggaggtgacgtcatagaaaccatggccaggccgcaggacctgagaaccaccaggcacaagaataccattcacgagcttgaatctgtgtgtcggggggagggtgttgggagaatgagccggtcagcttcagctctgcccttgcgtctgcagccggactttcagtctcatgagccgaccaatccgaaaacatgccgagtcggtgcgattccgagacgacgcgcagcgcgaggaactagccccatccactcaccggcgctccacctcctcggggggcatgtcggccagaatcggaatcacacgggctcccgcagcttccaagaacttgatgtaggaggccgcgatgtaggtgtggcccttggccggactttcagtctgatgagtcgagcaatccgaaaacatgccgagannnnnnnnnnacatatatgccgttgcgagaaaagttcgacacgctctgcaaaatctcgaacagcgatccccagtcacaagaaagatatgggcggtcgtttgacgggcaaaatcgagccagagcctcctgcccacctgggagacaaccccaatgataggacgcatgtttgtgcgctccttgtcagtctgcttgtcgcgcttccgcttgtagagcatggagctcatcccgcgtgcctccccgctgtctggccggatggccagggcggagagtgcccccagcaagacaacgaggatagccctgcggagagccatcccgtcccgacccaaagtccgctgccgaagctcccgccatgcgagcgaattttcaaagcggtgcacgcagggaacctggcgcggagacctgcggctcgccccatgctgcgagggctcacagcgttgctagaacgcatctcacacgtggtggtgcaagtgctcgagacctcgctcacggctcctgagacgcacgccccccttccggagcagcatgccgcgcgagataatcacgctgcaagttggtcaatgcggcaatcaggtgcgtggcgggtgctggggctcgcacactgcataggctgtggaccactccccgaccggcacccaccggaacgcatcgtggccccgtgcccccaggtgggcaccgagttctggaggaagctgtgtctggagcacggcatcaacaatgacggcattctccaggactacgccgcggccggcgacaccggtgacaggaaggacgtgttcttctaccaagctgacgacgagcgctacatcccccgcgcctgcctgatcgacctggagcccaggtctgagatggacgatcatttcagagggctgttggcatttattgaacatgatcccccgagggcgcagcaggccctcaggatgctgcgctgctgctgcaaccccctgacccggctccatgggctattgcacacgcccagccctgccccactcagcgcacctaaagccccccccgcgcttcttaacaccccctcccgccaaccccagggtaatcaacggcatccagaactcagaggtgcgcaacctgttcaacccggagaacatcttcctgtccgaccacggaggcggcgcgggcaacaactgggcctccgggtaccaccagggcgagtcggtgcaggacgacatcctggacatggtggaccgcgagctgggctactccgactcgttggagggcttcaccctctgccactccatcgcgggtggcaccggctccggcatgggctcctacctgctggaggccctgaacgaccgctacccgcgcaagctggtccagacctactccgtgtttccaaaccagtcagagagcagcgacgtggtggtgcagccctacaactccctgctcacgctcaagcgcctgaccttgaatgccggtgcgcgccccgggcagcatcccttgcaggcttccgctgtgaagcagcatgcactcccatccacccgctgcctccaacaccccaaacccctctcttcctcacccaccagacgcgcctggtgtcgaccgtcatggcagccagcaccgccacactgcgatacccaggtatcggcagtagggaggaggggagcgcctgggaannnnnnnnnnagccagcaccgccacactgcgatacccaggcatcggcagtggggagggagggagcggcggggagnnnnnnnnnnctacaactccctgctcacgctcaagcgccttaccttgaatgctggctgggaatggagcgacacacgtcggaggatgcactgcaggggtcatcaaaggcccccaccgccgcaactggccgcgctgtccccaccttttatcgactgcctcccgtgctcgtgcttggatgtgggcctccatgcgcgtgcatgctccccatggccctcacttttccctctttcctggaacaaccctctgcaggctacatgaacaacgaccttgtgggcctgctggcctccctcatccccatcccgcagtgccacttcctcatggccggtgcgtgggagggggccagggcagggtggggcactcgccgcagcctgccctcctcaggcagctggggctggggagtggggatcgctgtgcagggagggaaaaccagactaacgcctcctccccaatgccacgggctctgnnnnnnnnnngccggtgcgtgggagggggccagggcaggggggggcaatcgccgcagcctgcgcgtttcaggcagctggggccggggagtggggatcgctgtgcggggagggaaacccagaccgacgcctcctccccaatgccacgtgctctcggacatcatgcccaggttacacccccgtgaccctggacagcgaggaaagcagggcggcggccatcgtcaggaagaccacggtgctggatgtcatgcgccggctactccaggtacggatcttgatggtggtttggggatgaactggagggaagagcgccggattgtggctgaccttgggacatcagcagcccgttttgcgaatttgtggctgcaaagtgacatctgggctgcagtggatgtggaattaagggacatctgggctgcagtggatgtggaattgcaagattccctggggtccattcccaccttccctccctcgnnnnnnnnnngaatttgcgtgcctgtcgctgcgtggcgtgcctgcccgtcaggccgctgcggcgtagcccgtcggcacgcaagagcccaaactcgagcacaggtgaagccacaggctcagcatttctnnnnnnnnnnacacccacagcccaagaacctcatggtgtccacgccctcgcgtgccaagggccttgaccagtccaagtacatctccatcctgaacatcatccagggggaggtggggggtgagcgggatgatggggaggaaggcatgcaggaaaagagggattgggtgcgcaggctcatctgccaggggatgccagtgacggcaccttgcatgggcgccccgtctcctgtgatgaatttgcgtgcctgtcgctgcgtggcgtgtctgcccgtcaggccgctgcggcgcagcccgctggcacgccagtgtccgaactcgagcacacgtgaagccacaggctcagcatttccgtgctttcctcaccatgcagggcgacgtggaccccacccagctccaccagtccctgatgcgcatccgggagcggcggctggccaacttcatcgagtggggccccgcctccatccaggtgcttggaggaaggctgagatgcacagggctggcattccaggatgctctgccagcgtggcctgcccggggacaccactgccaccctctcagcggtggcaaggtgctgggagggaggctgagatgcacagggccggaattccaggatactctggcagcgtggcctgtccggggacaccactgccaccctctcagcagtggcaaggtggcgctgtcccgcaagtcgccgtacaccaaatcgggacaccgggtgtcgggcctgatgctggcaaaccacacctccatccgccacctgttcaaccgcaccatctcccagttcgacaagctcttccagcgcaaggccttcgtggacaactacaaggtggggtgggagagggtttattggcgcttgttgggggaccacgagtgccaatctgcagagccgctgtcattcgagctggcgctttggaggctgatgcttcgggtgaggctggcgaggagcgctgccctcacgctgcacactga

SEQ ID NO: 8366 - DNA, 1644 bp, Chlorella protothecoides
  modified_base (129)..(138): a, c, t, g, unknown or other
  modified_base (586)..(595): a, c, t, g, unknown or other
atggcaagacagggcatgtatttccaagcctctctgctcctggctgtcgtcactttgctgtttggcaacagcagcgcccagaccggcgatgcacgattaagccggttcccggtatccgtgcacgacatnnnnnnnnnncatttccaagcctctctcctcctggctgtcgtcaccctgcgttttggcagcggcagcgcccagaccggcgatgcacgatcaagccggttcccggtatccgtgcacgacatcgttgcggcccttcctggtgatgtggaccacatggacgtggctcgcgcaagccgcatctggcgcaaggttggatgggagtcgggaaagggaggtgcagaggcaatggcgggtgggcccttggaggatggctgtgctgatcaaggagagtgggaaagggctaccaaaggtggggaggtagtgcctacaagcacgcccagcacgtcgaacccgatcaatatggtgcctttgcagcttgaacgcaatcactgtaacttgtccgaggcaccaaacaggatctctgcgcaccgaacaaatttcaccattgcacagggtgtcatccggacctacatcgctggcnnnnnnnnnntaaggggagtgggaaagggctcccgaaggtcgggaggtagtgtctacaagcatgcccagcacgttgaacccgaccaggtgtcatccggacctacatcgctggcaacacccctcccacccccgaggttgtggcagagggcctcctgcacaacgagacctgggcctactacccggatgacaagccgcggaggtaagacactcgcagagtttggtgtatttgcgctggagcagttctgttccaggagaggagggcctcggtccatgtatgctggggacacacgggcaggcctggtgcccttcctggcccacgcccactttggcgacacctacagctggctcctgtacatggacgacgacaccgtcttcttcccccccgccctcctccacctcctgcgcgactttgatcccgccatcccctacttcatcaccggtgggtgccagagttgctatcaagcaggggttgggaaggtgctgatggggcccagtgggcgcgcacattgttctgtggccctccctgcctcgccgggatcttgcatgaatcatgaccctgaggtgcatgctcccctgtgcgccccttccctgcctgcggcttcaggctctcaaatcgaccatcatgcaacccgcctgcgcagaccacctctggtacgccaacggcacgggaccggcgacgcacccccatccccaggccccgcgctgcctgccctgccacttcgacgaggcgccgtacgcgcgccggcgccgctccttccccgcgccgcgcggctgcccctgcaccccgcagctgctctgcgccgcggcgccgcgcgtgttcaacgcgcactgcgacatcccacgccaccccgccaacaccttttccatgcacggcggcgcgggggcggtgctctccgccggcctcctccgcgcggtgggcctggacttcatggaggcttgctccctgagcctgcagtccaccggcggcgacgccttcatctccatctgcctctggcaggccggctactttgtcaccgacccggggctgtccgtgttcatggagggcgtgcacgcctttga

SEQ ID NO: 8367 - DNA, 612 bp, Chlorella protothecoides
atgcggatcgccatgacgcttgtggggctcggcaggagcttgtgcgcatcatcagctggcccagcgaaacaggcatggacctgccgatcacatgcggatctcagcgcgtctgtgtcacgggcctaccccacagagccccgggtaggcgtcggcgtggttgtactgagggagctgagccctggaaaccccgagaccctgctcataaggcgcgcaaaggcccccaacaaaggggactggtgtttccctggaggcagcctcgagctgggggagacgctggtgcagtgcgcagtgcgggagacgctggaggagactgggctgaggctgagatgccggctgccgcaggcggagcacggccagcccaacgcccgccacccccccttgagcccggacctggcgtatccctcatccttcatcgccggcgatgcgattacatacgatgatgcgggggccctggccttccactatgccatcgtcaatgtggcgggggtgccggagaacccggaggccgcagtcgtccctggggacgacgccgccgatgcacgctggtttccagtgaccgacctccgtgggttgaagggtgaggaggtgtctgagagtgggactgtggcgtga

SEQ ID NO: 8368 - DNA, 2841 bp, Chlorella protothecoides
  modified_base (593)..(602): a, c, t, g, unknown or other
  modified_base (1560)..(1569): a, c, t, g, unknown or other
  modified_base (2614)..(2623): a, c, t, g, unknown or other
atgctgtgggctccatcggaggtttttccgtgcgatgatcggacaggttaccctcatcaaccctgctccgcctcgcagcatcccgggcattggagacggaagaagatgatccaatcatcagggatgagctcgcggcatccctggctgggccaggtcctctcgagcgcgcgcgctctcgcgcccaggcaagcagagagtaagagccgtggagtgcaccagctctgtatgccacccactccgtccaacgtgttacatgcgcaccacaacctcacacaggcggccccagaggggtcgggccggaagttcaaggtggggcccatggccctgaggacctggtggtttgatcaacgcctgctgactctgctggaaagtgggaagcaaggccctggtcctcgccaggttgtcgtcctgggtgctggcatggacacaagaccctggagactgcagctgcctctaggtgagcgggagatgggcgaaatgcctttcaccaatgtgagagcagacctgtggatgtctcacgctcagtacgcaagactcctcacacgcttccaagatgctcctgtactgcatgtcttgtgcataggagcattcannnnnnnnnnggagactgcagctgcctctagtacgcaagactcttcagacgcttccaagatgctcctgtactgcatgtgttgtgcaaagaagcattccatcccagtcttgcaggtccacaacaaaatcggggatacatggatcctgcaccgtcacccctactcaggtgtcagctggtatgaggtggacagatcggatgtcctggccgccaaacgacatgccttgaagaagaatggggccggactggagccaggccacacgcggaaggcctacccactcctgacaggcagttggaagggcgtggaagctgacctggaggaacctgggtggtgggagtcgctgttggcttctggctttgacccggggagcccggtcgtctggcttgccgagggacttctcatgtcgtgggtgcgagctttgcttctcatcaagagagctcacttgcagcatgctctggctgggacggtgtgcttgattgcacgggtttcttgtatgaggaagggagctccatacgacccttccatgctctgggttctcctcgccacatttctgcctcacctctccattccaatctgtccagatctggagggcaagagcgtcgccagcctcttgtcgaccatttcaagtgaggctgaggggcaaggcgccaatctctcgccaattcatgatcattttgagcggctgtctgactttgtcatgccccacacccaacccacattacatgccatcctatctctcctttgtcccagggctgtccagccagaactccgccctgctgacaatgagcctcacagagagcatgctgaacaggctcagcggggtgcgctcgccccgggccgagttgattgccacttggaagtttggctgccccaccgacccaacagatgtgaggcgatcagttaccagggaaggcggtcctgtggcatggattgtgcgcctgcagtttcaccttgtttcaaccctccctgnnnnnnnnnncacttggaagtttggctgccccaccgaccccacagatgtgaggcgatcagttcccagggaaggcgatcctgtggcatggactgtgcgcctgcagtttcgccttgtttcaaccctccctccatgggttctgatgctgtcatggatgatcactcctcacctcaaaacctcgcctgcctacagtactttgcggccttgggctgggaggtggagagcatcagcacgcgggccgacatggcgacagccctgaaactggatcccgagatatgccagaagagcccatctgcttcgcctggagcctgggctcagggcgcgacaacctggggcgcgctcgaggaccttgaagttaaagcgctcgacccatctgcatcacattctcatcaagagtgctgcactcatccgtgtaaccaccaatcagatacttaccagtatattaccgcgggcgatcagcgggtcgataccgggcagcccccgtcccgacagacgacgattccaggagcggagcttactgccaggatggatttccagggccagcgcttgtcggagaagctgtatgtcgcgatacttagtctgtcaggggcagtggcctttctcgtgggctacctgacgcagagctttgctaacatgctcatcgccttcagctgcggcgtgggcatctcactcctgatgagtgttccagactggcccatctacaacaagcaccccatcaagtggctgccggcctcagacgctcctcgtgcagaggcaaggcaaggcgggaaggctggatcacagcggaagcagcggccaccaagcgcaagctggcgaaacttttggaacttattctaggtgggggagatctttgcacttgcttctgtagaaggcgtggcacagtctgtcacagtttactttggatggggtacccagtcctgccaagccctcgcaatgtcgcaaccgttcaccattggtcaagataccttgctgagtgtaatcacacctgctcttaggcagagagcagcccagtgtgtcgttgatcggtccgcctcgaggcggattaccgggatgctgnnnnnnnnnncatcttcttatgcagctgagtaacatcgggatggtcgatcgatcctggcccggccgctctctgccccggaaggaaggggtcacatggctgtccgccagtccacaacgacgatcaccacggtgaacccgcaagcagtgtgctacacccagtgtcgcactgaggtattccttgaagtatcagatctagtctctcagggccggttgaaaacaaggttctaa

SEQ ID NO: 8369 - DNA, 1335 bp, Chlorella protothecoides
  modified_base (262)..(271): a, c, t, g, unknown or other
  modified_base (749)..(758): a, c, t, g, unknown or other
atggtgtctcgtgccagcttcctcgcgttcatcgcgatcaccctcgtggcagcaccatgcgcgcttgccatcacggacactgatatcctgaactttgccctcaacctcgatcgcccgcagtggccagctccatggagggggaagatggcctggtggtgctctggtactgatccttcggtacagcttcctctagagccacgcgtgattgtaaaaattccttgccgattatccatgatgagggatgccaaaactcctgcctcgnnnnnnnnnnaagcttcctctagagccacgcatgattgtaaaattccttgccgattatcaatgatgagggatgccaaaactcctgcctcggctgccgtgaagtaccgactcgtgttcaatccgggatccttacgcaggcgcgttggcctcgactcggatctcaccggcggcggtcccgaggtcattggcggagagaaggccaacctgaccgagaagggtgcgcagctggaagttcatgggcgatgtgatgcctatgcgtctaccgatgctctgtcggttcattgctcaaggcgccaggcattctgcgatttcttcttcgctgaggctctggcagtcgatgagatcaaccacgtcaggctgctgaggtgcgttggtgtcctgggcttcagtacgagtttcttagcagatggtcgactgactggcatgagaggcgatcacccaaagttgcccacctttccttatttcacaggccagttcttcgctgaggnnnnnnnnnnttttcttagcagaaggtcgactgactggagtgtgctgggagacgcagccgtgcccatccccgccatcgatctgggccctgcctttgccgccgctgccaacgccgccctcaacctgaccctggacccccctttcaccccctatgccaacgacctcttcttctaccacggcgccttcatcttcgaggacgtgggtgtgaccgcctacctgggcgctctgccctccatctccgacaccacctacgtccccaccgccgccggtattgccgcagtggaggcctaccacgccggcgcggttcgcgctttcctgctgggcgacatcgacacggtcacgccttacggtgtgcccgtgtccaccatcgtggacgccatcgccgctctgcgtgagacggttcagggcgagcccgtggatgcctttgacctgggcggctcagagagtgcgcccctgttcgtccccgcctccgccaacacctcggtcgccttttcccgcgatcccagccaaatcctggcggtggtgtacctgggtggcactgacaagggcggcttcttccccgaggggctgaacggcaatatcaagtga

SEQ ID NO: 8370 - DNA, 504 bp, Chlorella protothecoides
atggggagggagggcgagggtggcaaggcaggcggagggcgcagagttgttacactcggaggctccggggcatgcaaacatccctcccgacgccacactcttcgtcaacagaccgctgccgcggcggaggctgctgcagcagaggctgagctgcggcggcggcaggccaggacccaagccgccgccgggctcctcgcccgactcccggccgaacccgggcgaggcgcggcggggtgcgccacctgcctgctgcgcctcggcgacggatcacggcatacgcgccggtttttcttggacggctcactgcagccgctgctggagtgggcggaggccagcggggcggccgcgctgcccgagcggtataacttggtgctgcagtacccacggcgcacccttttgccgccccagggcggccagtggcccagcctggccgaggcggggctggaggaggggcagaacgtgattttcgtagaggcattgacagccggtgatgacaaggcgtga

SEQ ID NO: 8371 - DNA, 417 bp, Chlorella protothecoides
atgaagggtgcaaatgtgctccgcgtgtttgccttcagcgacgggtatggaacccagcagaacatcctgacccccgtccccttccagccccgcctcggcgaatacaacgaggaggccctcaagaggtgctcaggggcgggcactggtgctcctcaggagctgttctacaccgacccagagatccgcaagtacttcaaggactacatcaccaagctcgccacacgcaccaacaccgtcacaggtgggggttgtgcgaactgccaggctcgccgcatcgtgggtgccagcgatgcgctgaagctcgcgctgcagactgcacttaggctccaaatccagatccaaactttttcccttccaggccagcgctatgtggatgaccccaccatcctcgcctggcaacttggaaacgaggtgtga

SEQ ID NO: 8372 - DNA, 345 bp, Chlorella protothecoides
atggctctccgcagggctatcctcgttgtcttgctgggggcactctccgccctggccatccggccagacagcggggaggcacgcgggatgagctccatgctctacaagcggaagcgcgacaagcagactgacaaggagcgcacaaacatgcgtcctatcattggggttgtctcccagagcgcgtcgaacttttctcgcaacggcatatatgtgcaggagggggatcctgcacccaagggccacacctacatcgcggcctcctacatcaagttcttggaagctgcgggagcccgtgtgattccgattctggccgacatgccccccgaggaggtggagcgccggtga

SEQ ID NO: 8373 - DNA, 267 bp, Chlorella protothecoides
atgacggcctggacgcgcgagatgagcgcccacatcaagtccctggattgcaaccacatggtctccaccgggcacgagggattcaccaccaatggcgactgctgcaatgggcacacctggctcaataatgggctcaccggcacggactgggtcgcatccaacctggaggaccccaacgtggactttgccaccctgcacgtctaccctggtgagcagcagggagcacaagcggggtgtggagaggagaatagtcgtacttgtgaatga

SEQ ID NO: 8374 - DNA, 180 bp, Chlorella protothecoides
atggagaaccacgtcaatgggctggcatggactgccattgccgagaatcccacgctggtggatttctttgacgtgctcacgctgtccatcgaccggggtggccgaacctatgtcagtaccatggaggccatagactacccaatcaccgccacccagtggtgcgcaggcggcaggttttga

SEQ ID NO: 8375 - DNA, 336 bp, Chlorella protothecoides
atgcaagtgccatctacaacctacatgacacgcaggcacccagagaaaaatgcctacgaatggacgcttgacaaggacatcccacacaacccagaggccatcgtcatcacacaggaggtcggcaacttcttcgtcaaccgggcgcgacgcaatcagcacaacatcgccaaccatgatgatgaggtggacctgctcatctacaattttgacctcgtctacactggcaaggctaagttcgagggggaggaggtggactttgatgagtcctacttcttcccaccctgggagaaggtgcgcgaggtggaggaggccaagcgtcaggcgaggagcggctga

SEQ ID NO: 8376 - DNA, 342 bp, Chlorella protothecoides
atgcggcgaaggaagcacaagcaagtgcgccgagccttgcgcttctaccgaatccaacacggattcagggctcccttcaaagtgctggccgatggtaacttcatcaatgcggtgtcggttctcaggaacgaggaccccacagagctactttctgagctgctcggtgacaaggtccgtgtcttcaccaccccctgcatcatgcatgaggttcgcaagatggggaatgagctgtccaaggctcgcgacgcctgccggcggctggcgctgcatcactgcggccacgaggaaaccacaaagctgcctgcagcagagtgccttgcgcagcaaataggtgaggtctga

SEQ ID NO: 8377 - DNA, 486 bp, Chlorella protothecoides
atggagggcgtccccaccaaccccacccggccctgggactcgcgcgagttctacgtcaagtgggcccggaactcgtacctgcactgctcctgggacacactgagcacgctgagccagctggccggctttaagcgcgtgctcaactactgccggcgcgtggacgaggcgcgcgcgcgtcgcgccgcgctctccgcagaggagcgcgagctttcagacctgcaggccgcgctgcaggagcagctggaggaggagcactcgcgcgtggagagggtggtggcggagcgcggcggcggcggggtggggagtggcgaggaccatggctacggcagcagcagcggccccgccgccggcccgcgctacctggtgaagtggcggggcctgccgtacggcgagtgcaccttcgaggccgcgcgcgacgtgctgcgcgtcggcggcggcgacgccatcgcggcgtggcaggcgcgggaggcggcgcgcgcccagcca

SEQ ID NO: 8378 - DNA, 1080 bp, Chlorella protothecoides
  modified_base (441)..(450): a, c, t, g, unknown or other
atgccccctcctttgatgcccctgcagacattccgggcacactccatgccagtgtatgcggtgcggtggagcgacttccatccacgcgtgtttctttcggctggtgctgactgggccgtcaggctgtgggatgtgaatgacccaaaggcaagcccggaaagtgggttgccttggtgcaaggatatgaccgtgggtggatgcgatggccagcgtgcccggcagctcgtgctttggagtgctattgtgctctgcaactctctctgcttgcctgctgcttcgaagtgtcctcctgaaaagcacattgatccattgatccaccgcccctccatgctcgatgcattggtacgcgtgtgtctgacccgtttgcgagtcgtgaaggtacatgaaagctgttcaagtcttgcccaagcatggttgagccccgtcacctaccccttcatnnnnnnnnnngcagacgtagcatggcttcccggggcgtctgtggtgtttgccgccgccaccgagaacgggcgggtccatgtcttcgacctttccaaggacagacgccacgcgctttgcgtacaaaagagttggacacggaatgctttggatgacaggaggagcttgctggatagtcttgacgacatacacaacactgaaacatcggtcatccagagatctcacctcatgcatgatgctcgcagcttgctaacaagacaaaactcacaaagctggccttcaaccccaaggagcccctgcttcttgtgggagacgacaggtggggcgtttgggttagggttgatggatgaaaaggatgcattggtacgcgtgagtctgacccctttgcgagttgtgaagaggagcggtgacctgcctcaagctgtcgccaaacctgcgacacatcagcaaggcagtgacggctggcgggccgaccccgctgggaagccccaacccatcccacacagtgccgcggccgatggcaaggctagggtctcccttggatcctggccctgtggccaaggaagaccatgctgccaccgcaagggacagggcgttgggggagctggacgctgcgatggcagccctcaagaagattcgtga

SEQ ID NO: 8379 - DNA, 3342 bp, Chlorella protothecoides
  modified_base (836)..(845): a, c, t, g, unknown or other
  modified_base (1034)..(1043): a, c, t, g, unknown or other
  modified_base (1592)..(1601): a, c, t, g, unknown or other
  modified_base (1845)..(1854): a, c, t, g, unknown or other
  modified_base (2018)..(2027): a, c, t, g, unknown or other
  modified_base (2464)..(2473): a, c, t, g, unknown or other
  modified_base (3146)..(3155): a, c, t, g, unknown or other
atgcgtttcacagcaaaggtgggtggtgggtgggtgtccgacgggtgcgaggggttgggttcataccgagtccgcccttggtggcatccagatcactacttttgctactatgcactcgaatatgatgtatacatgtatcgcattgcatggctgtttatctgcctgtgtcccggacctggacggccaactgacggagaaggggcagccacccaccagccctctgcaccctccctccgccggcacgcaggtgaaggtggagcagggcgacgcctcgggctccttcgtggccgcccagccccccaaggagacgatggtggagctctgccgcgacgcctgcggcctgcacaccctggtgctgcacaccaagccgcgccccctggccctgccctgcaaggccccgctcgtcctgtacggtgggagcgcggcccaggggcggctgggcatgcgcttcttggccgtgaagacggaggcgtggcggtcggtgccgcgctgcgtccagctcacgctcacttcagccgatgctgcggcgctgtgcggcctgcgggaccggctgcacgcctgcctgggaggcgggccggtcaaggcctctgggcacgtgccagtgcccacggggtcgaagacgagcgcgcagcccccgcgccgcccgctggtggcacgcgacctgaacgtcacggtgagcgagccgcggccagcgccgtcgctggcctccacctgcttcttcggcggcggccaggtgaaacccaggcccgcagcctcggggtccaggcccgccagctcggcggtatcgtcggggtcgcggaggagtgccgcctctcggccctgccaggacgtcacgnnnnnnnnnnctcggggtccaggcccgccagctcggcggtgtcgtcggggtcgcggaggagtgtcgcctctcggccctgccaaggcgtcacagacctatcccccgagcagcagcgggcggtcgccctggtccgcgccgggaagaacgtgttcttcacaggtgcgtgcacgtgggggggtgcagtggcgtcccttggggnnnnnnnnnngcgccgggaagaacgtgttcttcacaggtgtgtgcgcgcgggggggtgcaatggcgtcccttgggatgaaagaattctgccagagggtcctcaacagccaagtaggaagggttggcattctggcttgtggcgacaacagaggctgcccgggcgcgtcctggccagggtatgcgccagaagcagtcagcagactcccgaaaccaccaacccctgcctcgctccaggttgcgccgggacgggcaagtcgcggctgctggcggccatcatgtcggtcctgcccccctccacgacctttgtcacggccagcacgggcctggcagcctgcgcgctgggcggcaccaccatccacgcctttgccggggtgggcagggcggagggcggcatagacgccatggcggcgcgggccgggctgggtgagagcgcgcagcgctggcgccgcgccgccgccctcatcatcgacgaggtgggacaaggggggggcagcgggcgcaggccagtcttggatggcacgggtcgagccccgccacaccccgataccctttgtcacannnnnnnnnnggggggcagcgggcgcaggccagtcttggacggcacgggtcgagctccgccacaccccgatacccctttgtcacgtcccagatatccatgctggatgcgcacctgttcactgctctggaggagctggcgcggcgcctgcggggctcccaggccccgtttgggggcatccagctcatcctctccggcgacttccaccaggtcagcgttcgagggttcgtgggggtgggaggctgctgtttggagnnnnnnnnnncctctccggcgacttccaccaggtcagcgtgtgagggtttgtggggctgggaggatgctgtatggacatcaggggttgagtcttgcctgctggcctgctggaggtgggccatgtaattgcatgcagggccctttgcacggcctcatgcacgcctgcccttcagnnnnnnnnnnggaggtgggccatgtaattgcatgcagggctctttgcacggccttgtgcacgcctgcactgtatcatgagccccctcctccgccctgctctgctccctgggtcctcgccctgcctcctttgctcatggtccccaagcacttggacctccacctcaccatctgcttgcagctgcccccggtcacccgcggctcggggcgccgcgccttctgcttccagtcctccgcctgggagcgctgcgtccaggccagcgtcgtgctgtctcgcgtgtaccgccaggccggggacgaaggcttcatcgccctgctgggccgcctgcgcgtcggcgcggcgaccgcggccgagctggaggagctgcagcgccgctgcgcgccgcgggcaggaccggcggacgccccagatcctgcccctggtacgggcgccttcgcgccaccgccgnnnnnnnnnngggcaggaccggcggacgccccagatcctggccccggtatgggcgcctccgcgccgccgccccccgccgtgctttccacgcgcctcttcacgcaccgcgccgacgtggacgcggtgaacgccgcggcgctggcggagctgcccggccccggccgcaccttccacgcgcgggacgagggtgcccccagcgaggcgctggacgccgcctgccccgcgcgcgcctcgctggagctgcgcaccggggcgcaggtcatgctcctgcgctcgctggcgccacgcgagggcctggtcaacggcgcacgcggcgtggtggccggcttcgacgccgctcgcggcctgcccgtcgtggccttcgccgccgggcccacgcgcgtcgtcgcgcccgagcgctggacgctgcgctcgggggggcgcggcggcgcggcgcgcgaggcgctgcccctgggcctggcctgggcgctgagcgtgcaccgctgccagggcatgagcctggacgcagtggaggtggacctggcgcgcgccttcgagccgggcatggcctacgtcgcgctttccagagtgcgcggcgcggcggggctgaccatcgccccgggaggcatcgcgcccgccgccctccgcgccgaccccgccgtcctgcagttctacgagcacctgctttcgaccagggggggggnnnnnnnnnnccgcgccgaccccgccgtcctgcagttctatgaacacctgcattcgaccagaggggatccggtgctggaggaggacaaggaggcggacaccgccagcacgccgccaccgccgccgtcgaggggtagcaaggcgccggccggaggggcgacgatgggggcgaggagtactccgctcaacctgcgatga

SEQ ID NO: 8380 - DNA, 1164 bp, Chlorella protothecoides
  modified_base (509)..(518): a, c, t, g, unknown or other
  modified_base (1083)..(1092): a, c, t, g, unknown or other
atgttcaatcgggacaagctcaaggccctggccgatcaggccaaggccgctgggggccggctggccaccagcgcccaagccggcatcgcccaggcgcagcagaactttgccgcgcagcgagctgccaaccctgggtcaggtattgagagctgcgtttcaggatgcaaagccacaatgaggttgcgaatgtcgcttcccgtctgctacgccgatcccaacgcaacaccataccccaaatcccccgttcacaatgcagatctggccgctgaggatgccatccgactgctcacagcccagaacgaggccctccgcatgcgcctgaaggcgcaaaaaaggctgtctgaggagaatgagcacctacgagcggccctggagcagctgcaggtgttgggccgctcagcacctccatttactccaattgcaaatttccagggacgagacgagggcgtcgcggcgcctggccccgcctccgagcgctccgagctggagtcccaggtggagatgctggnnnnnnnnnncaatgaggtgaatcatgcgattttgcatgagtgggaacttcattgtccctgggcgttggcccgctcagcacctccatttattccaattgcaattctccagggacgagacgagggcgttgcggcgcctggccccgcctccgagcgcgccgagctggagtcccaggtggagatgctggtcgcggccctcgcagacgcccgtgcggaggctgtgtccgcgcggtccgccgcccaggacgccgctgcggagctggccgccgcgctgcgcaccgtggaggagctgcgcagcgagcgctgcagcctgagggagctgcaggccgccaccgcggaggccgccgcacaggcggccgcgctggagagggagaagcgcgggcttcaggccaccctgggggtggagcgcgtggagaggagggagctggagctggcccaggccgagatcgagggcctacgcgtttgccttggcgagtcgcaggctgcgtgggcggctcatgttgcggcccaggagctgcgtggacgtgaggcggggcccgaggaggaggaaggggtgcagggcgctcccggtgccgcnnnnnnnnnngcgggttcgcctcggcgagtcgcaggctgcgcgggcagctcatgttgcgacccaggagctgcatggacgtga

SEQ ID NO: 8381 - DNA, 750 bp, Chlorella protothecoides
atgaacccccccacccccccacccctccttccaatctccccccaggactttgggctgaaggccctgagcaagggcgaccgcctggacattgacctgaagagtgtgtacgtggcgccccgctataccctggtgtcctccatcacccgcgacggcaagctggcagcggcagtgacctacaaggacctggcccccggcctgaccctgggcctgtctggcaccgtgcccgagctggagacggccaaggtggcggtggactactcgctcccccacctgaccctcaagtcggtggtgtccctggcctcctcccccaaggtcgacctggcggccaccacggggtacgaaggcgtgaccctgggtgcgtctgggacttttgacgcctccaagtccgcgctcacacgctggaccgccggcgtcggctacaccgcgcccgactaccagctgactgcgctgctgaccgacaccaacgcgctgagcgtgctgctggcccaccgcgtggccgccgacaccaccattggcgcggaggtgagccgcgacctgggctcctccgccaccagcttcgccatcggctcctcgcggcgcctggccggcggtgcgctgactaaggccaagctggagaacagcggcatcctgtccctgctctacgagcaggagctgcagcccaagaccaaggtcgcgctcagcacccagctcaatgccctggacctgaacgccccccccaagttcggcgtcggcttcgacgtcaagtactga

SEQ ID NO: 8382 - DNA, 291 bp, Chlorella protothecoides
atgaggagtttggccagtgagccatgctggccatattccccagcgtctcctatcccagctgcatcccctccacacccacacggcaggcggcgggactgccgggagtctgtgagcctggagtacctgaagaacgtcgtgctctctggcttctacaccggccagctcccccccacctccccgctcgttcccgtacttgcaaagctgctgcagttcagtccccaggagtcgcgccagattgctgccaaggccgcccaggcctcgcaggcctaccgcctcctgccaggcttctga

SEQ ID NO: 8383 - DNA, 474 bp, Chlorella protothecoides
atgggtgatcaggatgcgctgagcacctacgaccagattcggctgaccctgtcctccagctactacaccctgcgccgggccttgaagctgaaccggctgcgcgacctgctgcagcagtcggccctggcgcccgacgcccccatatggattatggggcaggagtatgctgccagccccgaactggggcaggaggagcaggaggaggtgagggagtggtggagacgagggccggtaggagactcgcacctacgaacggacgcggggtggggctgcacgctgcgctcgggccagatgatcatggctcagggcctgcggcgccacctgctgggctccgactggcgctggccggaagaaagcgtggccagcccgccgcccgggctggccagcctgctgtccctcttccacgacctcccacagacctcagccccgctgtccatccactccctctgcgagcatggccgggcctgcgggtga

SEQ ID NO: 8384 - DNA, 459 bp, Chlorella protothecoides
atggcttcgttcgccgacgctcccgctggggatgcggccaagggagccaagatcttcaagctgaagtgtgctcagtgccacgttgcagagaagggtggcggccacaagcaggtgaagattcgcggggagtcggacgagggtagggctgggatagactcggaatgcgtgtgccctcagactctgccccgaaggtatgcaagacattgcaagcgcgctgcttgcgcgggtcccaacctcggcggccttttcgggcgcgtgtccggtaacgcggaggggttcagctatagcaaggccaacaaggagaaggcggtggagtggagcgagagcaccctctacgactacctgctcaaccccaagaagtacatcccagggttggagcgggagggggtggagggggagaggggtcgcgtggtgcctacagaccagacattgagcagctctattgattgggaactatga

SEQ ID NO: 8385 - DNA, 783 bp, Chlorella protothecoides
atggctaagtcgatggaggccgtcgcgagaaccagcaggcccctcctcgacgcagggctgactgtggccgtgttggacgagcctggcggggctcacccatcattccgaggccaagcaggcacctctgacccgcccgacccgcctcccctccccagtcacgaggatctctggggtggaccctttggcggagaggccgcggccggcccagagcctgggccggacggaggggccggcccttcctcctgcgccaagcgcccagggctgatcatgctcgtcccacttgtgcttggactgggcaaggtgaggggtggactatcgggagtgaagtgggcctccctgatgcgacgggccgtgggagggtacagtatggacctggcaaaccctgctccatccaccggccgtcggagcagggtatatgataatataatgcgactggactgccttgcagaatggggttgtcccttcacctctcccctgtccccatctgcgcagttgaaccctcgttacatcccccagctgcaagcggtgctgaccatgccccagagcatcggcatcgtcgggggccgtccagggtcctccctctactttgtgggcacccagcaggacctcctgctctacctggatccccatgaggtgcaggaggtgaggtgctgggcgggtgtcctggagtgcgtctgtattgagggggaatggagtggtgggaggaggtttcctcattgggactcttcaggcctggggtgctggttgactgttttctcgtcgagtggctttctcatgtggtga

SEQ ID NO: 8386 - DNA, 777 bp, Chlorella protothecoides
atggagggtgttgtgcgagcatgggcctgccccctcagcagtacctttggggagggatttgccgaccaccagcgctgtgttcttgcccccccctccacacatatatccccccacacgccccatcatcccacaccccattgtccctcaaagaatgccctcaacctccaaactattcccaccttgccaacccagatcatcacacacgtggccagcacacgcgtggcggagtttgccttcgactacgcgcagaagaacaaccggcgcaaggtcaccgccgtgcacaaggccaacatcatgaagctgaccgacggcgccttcctgcgctgcgtgcgtgcggtggcggagcgctaccccgacatcaagtacgatgagatgatcgtggacaacacgtgcatgcagctggtcacccgccccacccagttcgacgtcatggtcatgcccaacctctacggcgacatctgctccgacctctgcgccggcttgatcggcggcctgggcctgacgccctcgggcaacattggagcaaacggcctagcgctcatggaggcagtgcacggcaccgccccggacctggtgggcaaggacgccgccaaccccaccgccctcctcctctccggcgtcatgatgctgcgccacctgcgcctgactgacgtggctgggaacatcgagcaggcggtgctggccaccatcgcggaggggcagtacctcacccgcgacctgggcggcaagtcggggaccaaggacttcaccaaggccatcatcgggcacctcaagtga

SEQ ID NO: 8387 - DNA, 225 bp, Chlorella protothecoides
atgtcgcgcctgcgcgcgccctggcgcgcggtccccgccgccgccgccgcgttcgacccgcgcctcctggcctccggcgaggatgtggacgcgctgctgcactgcatccccaccccggaccaggcggcggcgctggagtcatacgtcgccgcgggcggggacgcggccgcgctggccgacgccgaggccctggcgctggcgctggggcggctgccgcgcctggcg

SEQ ID NO: 8388 - DNA, 3771 bp, Chlorella protothecoides
  modified_base (1121)..(1130): a, c, t, g, unknown or other
  modified_base (2035)..(2044): a, c, t, g, unknown or other
  modified_base (2835)..(2844): a, c, t, g, unknown or other
atgcaccctgatcgcgctccccatggacgccatgtcccgcatcgccggcagtctctccctggcagacgccggcaagctggcccagacctgcaccaccctccgcgcctgcgtggagtccccggtcctccggggcgagctgctggaccgctgggtctcctgccagccgcgcgatgcggggtgcaccaaggacctcctgcgcaacctggcggggcccaggggcgacctggccctgttgcaccgcctgtcagcctggccggcggggctctgggtcgcccagtctggcgaccaggtggtggagagctgccggctgctggtgtgcaggcaccacccctcctccggcagcttcagcttcacccacctggccccggcgcgcggccggccgccggactcctccctgccctgggcgccggtgcccggccagcccctgtggaaccagctggaggtggggtcgtactccccacccgactccggcgcgccccgctggcgctggctccgcagccagcagaagtcgcccagcctggcccgcatccgccccagcggcctctccctcgacatggtcgcgcgctggccctggttccagaccgggttcaacccactcatgggggagcacggccgccgggtggccttccaccgggtcgccacccaccccgtgtcggcacgggacctggggctgggcccgcgctttcctcctccgccggacgccatcgcacgcatgcaggtgtgggacgtgggggacgcgaggggtctcgcggcctgctgtacaaccctccgcgcatggttgtcaggcgagggggcctgccgtcatgcttgctcggccgcgacggctcggccccccgctgccctgccagcagcccaccccctgtggcacccctcgcccccacccgccccagggctggaggccctcaagctcatcggcgacgtgaatgtgcctggcggacagtgagccgggcagggggtggggggaaggctggccccatgcccttaagattccaagagggtcccgtgtgtgcccagtgtcgtgggctcgtccccccaacagcggactggggtgatgctcctcgccggccgaaacacatgcaagccaccccccctgtcatgcaccaggctgtccttcgtggtgnnnnnnnnnnatgggattccacgagggtccagcgtgcgcccagtgtcgtgggcccgttcccccaacagcagactggcgtgatgctcctcgccggccgaaacaaatgcaagccaccccctctgtcatgcaccaggctgtccttcgtggtggatgccgagtcgggcgtcgctgggccgacgcggcacagccgcctgcacgactttgcggccgaggactcccggcccatctactccttcgccgacgggcggtcggctgtggtggacgtggagcggctccccatctgcgcccagttccgggctctgggtcagatcaacgagtttgagggtgtgctggtggaggtggagggggggggggcttggagggatcccctcgccacttgcctgcctccgcctggcgggattcagcatggtgcatgctgggtggacatcacccttaccaacagggtgtctgttctgcccgacatacaaactgattcaaagacatacaaactaattcagaggtcacaaaacaccgcttccccttcccgtaaaggcctctggcagccagagtgggtgccagcggtgtttgttgtctactcccaagcccagccacatccagcggggcactcctgcgccatcgtagcgggacgacgacttctagccagcagccgctccaagaagcgcccagcctctgaacagggtacaagcagagcacggattgtagagccccaagctgtaccactgtcactgcctatctgcctaggcatctagccacctgatgctgcggacatcgagcttggtaccgagtgcttgtggtgccctggtgcagtccaaaatctcgcctcagacactcgtggggatgtgagggatacctttactatctcgtctttgagccccgccccccctcatcactctacaacagatatgcagtgggccnnnnnnnnnngcgactcccagccagcagccgctccaagaagcgccgagcctctgaacaggtcctacttgaaactccactgtacatacttaccagagccgcctgatgctgcggacagtaagcttgataccgagtgctcgtggtgccctggtgcagtccaaagtcttgcctcagacacctgcggggatgagaggggtacctttactatctcgtctttgagccccggccccccccatcactctacaacagatatgcagtgggcccctggtatcaatctgctccagatacccaatataacctggctgcatgcacaacctcactgctataccacccctgaatgctgggtctgtctacacgtgttagcatacaggggagggatgctgggggagctagcgcaggacccagagagtcatcaaagggagtcgtgcctcggggtgcaggatacaagaggggcgcaatgcgactcggacccaagcgcagcagccacattgtacagagttggcatggaaaatggggcaatgggattcatcagtgcggtgcgggtgggcggcaaatgggctgcgggcagggaggggtcacttcgcacgcttgctgatagagcaggcgggagtggcccggggaatttcctggggacagagagttcaagcggccagttcagaagatggggctgcgcttggggagcacgagcttccgcaggtgcgtgcggaaggtcagctggctctgcacggaattgggatgggattcttggcattcaacccaaagtgcacgggtactggccgcagtgcatgtgttcacaaatcgannnnnnnnnntcccagggttttaagtggcccgggtggggggggggaaggggggaggtgtggacccgcggcgagaatacatgttcatggaacaggctgaggttgccaggtcagcaaaagttaatggggagggtgacaggaagggggaggtttcattgtacagggagggtcccacagaggggaggggccctcacgcagatttctacaacttccagtgccgtatttgattgctataggcagtcttctgttcgcaaggaagttcctggggacagagagagttcaagcggccagtttagaagatggggctgcgctgggggagcacgagcttccgcaggtgcgtgcggaatgtcagctggctctgcgcggaattggggatgggattcttggcatccagcccgaagtgcacgggtcctggccgcagtgcatgtgttcacaaatcgagtagcccagacgctggctgacaggtggcccccccaccttgaccagcagcttgggcttgaccaggacgaccgggtcggtcaccgcctccaaggaggccccggagctcatggagtcgatggatgcatccctcagccgtctgcggcagcagaagcagagattccctcaggaaacgaatatcaagtagaagctgggggaagctcgtcctatatgctcccatcagcccatccggccggagagacttcaaaccagcttcacaccaacctccaacctccacgcgccagcgcttactttgaatcccgacgcgtcggccgcgctcgcagcagggcgggggccgagaccttgctcgctcgttgcttgatcataccacgcatcgccaggggctggtacccctccaggctgcgcttcacgaggtacctgcgagggacggatgtcggggatgaggctggggtttccggaacagctcatcacgataacaacggcgacatgcccctcccctag

SEQ ID NO: 8389 - DNA, 1971 bp, Chlorella protothecoides
  modified_base (400)..(409): a, c, t, g, unknown or other
  modified_base (746)..(755): a, c, t, g, unknown or other
  modified_base (825)..(834): a, c, t, g, unknown or other
atgcgagagaggagagtacagacttgtgctaatatcaatgcaatagcttgggtgccgtcgcgacgagttctgggagcaacaggggcccagcagtcaccgtcccgccatggcttgaggagcgagtcgctcgccggaagccctctttccggtatctctgacgcccgaaccaccgtctggaggcgtcaacatggcggaggtgagtgcgccgcagggtgtggaggcgcccatcgtcgcccgggtggcgctccgcaggtctcctcagtttccccgcttttctcccctccccccgcatgttcatcggatgcagtccgtgcaaaccttcgggcgcaaggtgcgtgggtggggactctcaggccctggcagggcctcgcgctcgtgctgcttggaaatgtcgtaggannnnnnnnnngtgcaaaccttcgggcgcaaggtgcgtggggtggggactcttatgccctggcagggcctcgcgctcgtgttgcttggaaatgtcgtaggggaaattgggtcggggtggacggggctgtccccacgggtcgcatccatggcgctcctcctcacacttccattctcctcatcgatgcgcagaagaatgctgtggccgtcgcacacgtgaagcgcggaaagggcgagctgcgcctgaatggtgggcaggcctggtctagggtggggaatgcccgctggaatgacgggctctcactctgcagagcactccggctccctactgtgcggcatggcacatcctnnnnnnnnnnggcaacgcctgcaggggctctcactctgcaaagtactccggctccctactgtttggcatggcacatcccnnnnnnnnnncccccccccccccccccccccccctcaacacctactccatccaggtgcccccctggagctcctgcagcccgacaccatgcgcctgaaggtgctggagcccgtgctcctgctgggcaagcagcgcttctccaatgtggatgtccgcatccgcgtgcgcggtggaggccacgtcgcccagatctacgctatccgccaggccatcgccaagggcatcgtggccttctaccagaagcacgtggacgagcagtccaagaaccagatcaaggacgtcctgctgacctacgaccgcaccctgctggtcgccgacccgcgccggtcggagcccaagaagttcggtggcccgggcgcccgtgcccgcttccagaagtcctaccgctgaccgtgcccatggagggcgggcgcggcgcacgccttgctggccgcgtcctacccctgctgcacgctgtaacttgcaaggaggaaccgccatggttgagggatgcacgagaaggcaggggtcaagaaggggcgtgccgaggaggtaccctcctgcagggccggcatccactggtgcaggaggaaccgccatggttgagtgatgcacgagaaggcaggggtcaagaagggcgtgccgagaaggtgccctcctgcagggccggcatccactggtgcaggtatggagcacatcataacgcaaagagtcttacagatcactgcctcctcgcgaggtctgtgagcaacagtcagggggcgcaggcaggccgaaacagccacagcctgacattttcagaggcgcaacgctgccactcaagcggcggccttggaggcgcctgcgacgagatcctccatgggggggtgtaccccaaagtcagactcggcgtgactgtacacgagctcgccgccggccttgaataccaggacgccccccagcacggtgccattgccggtgaagttggaatccttcacaactccgcgcttgtatgcggcacgtccgttcttgaatccgctgcagtgaatgggtgggaaggtgtgagggagagtcgggcctatggttcaccagggctgatggtattagggctgatggtattagagcagatgcaaaacgcttgctgtgcgctcagccaccggtgctctgtgctcgaccccacccaaatatga

SEQ ID NO: 8390 - DNA, 333 bp, Chlorella protothecoides
atggcagatgcagacgtccccctgcccacgtccgctgtactgacagcggtgtccaagcacgttggaatccggtgttccaaggtgaaccaggcctacatgcagtgcaaagcggagcacagcaatccagccgactgccttggcccaggaaacgaagtgacaggctgcctcgtggacttgctcaaggaggtccacgcccaggctcctgccgaatttaagaagtactacgagtgtctcgattacaacaggtggggtgaatcgggaagctggtgctctcatctccctggacagccggctcttgttgtcgcctctccaaggattgccatgctcgcttga

SEQ ID NO: 8391 - DNA, 630 bp, Chlorella protothecoides
  modified_base (332)..(341): a, c, t, g, unknown or other
atgggcgcggaggacatccgcgacgagaaggtcaaggtcctgcgcagcatgcagaccgtgcggctggaggacatggtactggggcagtaccgcggccggcgtgtcaagggcatgagccagccggggtatctggaggaccccaccgtaccgcccaacagtgtcgagtcacccctgcgtccctcaggtgcaagtgactgcgttgagaggttcatgggtgtcgcctccctcctacatcaacggcgcctgctcatcacccaacacccacccatccctgccctgcagcctgacgccgacgtttgccgcatgcgccgtcttcctgaacaacgcgcgannnnnnnnnntccctcaggtgcaagtgactgcgttgagagctgcatgggtgtcgcctccctcctagatcaacggcgcccgctcatcacccaacacccccccatccctgccctgcagcctgacgccgacatttgccgcgtgcgccgtcttcctgaacaacgcgcggtgggacggcgtccctttcctgctcaaggcggggaaagcgctggaggggcgcatggccgagatccgggtgcagttccgccacgtccctggcagcctctaccgggacaagctgggcttctcggctggcatgagtag

SEQ ID NO: 8392 - DNA, 609 bp, Chlorella protothecoides
  modified_base (452)..(461): a, c, t, g, unknown or other
atgatcgtggagaagcccttcggccgggacctggagtcctcgcgccagctggcgacggaactgtacaagcatctgacagaggagcagatctaccgtatcgaccactacctgggcaaggagctgatcgagaacctgaccgtgctgcgctttgccaatctggtgttcgagccactgtggagccggcagtacatccgcaacgtgcaggtcatcttctctgagaactttggcacggaggggcgtggcggctactttgaccagtacggcatcgtgcgggacgtcatccagaaccacctcctccagatcctggccctctttgccatggagcagccggtgcgggtgtgggggtgtggtgggggactctgtttggcgaggggtggtcgcgaagcatgtgggcggtggggtggtttccatggtctcacttcccgagcaccccccccgaaacataactcttnnnnnnnnnngcgtggcggctactttgaccagtacggcatagtgcgggacgtcatccaaaaccacctcctccagatcctggccctcttcgccatggagcagccggtgcgggtgttggggtggtggtgggggactctgtttggtgaggggcggtcgtga

SEQ ID NO: 8393 - DNA, 2130 bp, Chlorella protothecoides
  modified_base (81)..(90): a, c, t, g, unknown or other
  modified_base (168)..(177): a, c, t, g, unknown or other
  modified_base (295)..(304): a, c, t, g, unknown or other
  modified_base (1334)..(1414): a, c, t, g, unknown or other
  modified_base (1640)..(1649): a, c, t, g, unknown or other
  modified_base (1672)..(1681): a, c, t, g, unknown or other
  modified_base (1902)..(1982): a, c, t, g, unknown or other
atgctgccctcgttccacccatattcagtggatctggaaaccatgtggcaaaggccacatgccgggtatccagcagcgcannnnnnnnnntgccctcgttccacccatattcagtggatcaggaaaccatgtggcaaaggccacatacctgggtatccagcagcgcgnnnnnnnnnntcaagcatgggcacctcctgccggaggatggttggtgccagtgttgcacggccatgcgcagccctcccctaccttcatacctttgtggagatgtgcccgcagcacatctgcagcgcannnnnnnnnnagttgatggcgctgcacgcacccacactccgatccaacatccgcagtggtacagctcgtatcctaggatatcagcctggtgtgctcttgagcacttatcgaactacccgtatggagtcaagcatgggcacctcctgccggaggatgattggtgccagtgttacacggccatgcgcagccctcccctacctccatacctttgtggagatgtgcccacagcacatctgcagcgcgacttgcgatcagctgttgtcattgtggcattggatgtccatccaaagaatggacgccttgctgaacagtattaccaaggtctcccggctcagcctcatcattgaatgctcttctgcgatccccttcatggttcaatcatcaaggatagatgggagaacatcgaccaacagcaatactcaattgtcatcacaggcaatcctcaaaaggtactatcttgctctctcccctccagactcccatggcttgggaccgaacactgcattacagcctgcacagtgtcctgccagaaacaggagcatcaacccttggcccccgcgcagcgaggcgcacagcatggcatccttcacatcggccagggtagacgtgggccgaccgaggcttcatgccgtgtcactggcgagggccgattcgcggagggcagccacaggcgctgctggggttccggctgtgcaacactggagcggccggcgagcacaaggtagcaggggacgagtcgccattcacgcagccagtagtccccctgcgatcgagcaagatgcaccaggtgcaggaccactggattctgatgccctccaggtgaggaggggagattgtatcgggctggggctgagactgcatgacaacaagatcccctgcctgatccatgcactctgcacccacaaacgccaggcttatgatctgcctttagaggactggtcacagtctgcactgtccatctgcgtggttggggcctcgggcgatctggccaagaagaaaatcttccccgccctgtttgctctgtattacgacaatcaccnnnnnnnnnnnnnnnnnnnnnnnnnnnnnnnnnnnnnnnnnnnnnnnnnnnnnnnnnnnnnnnnnnnnnnnnnnnnnnnnnccagcctccagccgcctcgcctgcacctgcccaaccaagcacgttggccagccttggacctcgccttgttgatgcagcacttcacgatctttgggtatgcccggaccaagctggatgacgccaagtttcgggagatgatcgccggcaacctgtcctgccgcctctctgacgcgggcgactgcggtgccaagatggaggagttcctttcgcggtgccactaccaggnnnnnnnnnntgcccaagctgtcgggagcagannnnnnnnnncggtgagactgggagttggggaagtggtggcaaatgcacctgaatcccgactcacctcctgccggctgttgggagcaggctccgcattccctcacattggtcttggcccctgcgagatcgtcctgcacctagcacccctcctccccctgcttgtccctcgccagggtcaatacgacagcctggaggactacggcgcgctggacaagcgcatgtgcgcggcnnnnnnnnnnnnnnnnnnnnnnnnnnnnnnnnnnnnnnnnnnnnnnnnnnnnnnnnnnnnnnnnnnnnnnnnnnnnnnnnntccatcccgcccaacatcttcaccaccgtggccgcctcggcctccagcgcagcctcctccaagtgagcatcgatggccattcacatttccattctctgggcagtccctccttggagcatgccttgtcagcgcagggactgcaatgtga

SEQ ID NO: 8394 - DNA, 438 bp, Chlorella protothecoides
atggcggttcctccttgcaagttacagcgtgcagcaggggtaggacgcggccagcaaggcgtgcgccgcgcccgccctccatgggcacggtcagcggtaggacttctggaagcgggcacgggcgcccgggccaccgaacttcttgggctccgaccggcgcgggtcggcgaccagcagggtgcggtcgtaggtcagcaggacgtccttgatctggttcttggactgctcgtccacgtgcttctggtagaaggccacgatgcccttggcgatggcctggcggatagcgtagatctgggcgacgtggcctccaccgcgcacgcggatgcggacatccacattggagaagcgctgcttgcccagcaggagcacgggctccagcaccttcaggcgcatggtgtcgggctgcaggagctccaggggggcacctggatggagtag

SEQ ID NO: 8395 - DNA, 372 bp, Chlorella protothecoides
atgctgctgtcaatcaacgccctgcaagcccgacccacaccgcctcgcagggacgactacgagaccaacaagacgttgcggagggcgctgcgcggcgtgaggaaggacgagggcgcacgggagtcgcagcggagggcgctgggcctgccgtccagcgtgcgcctcctgccaggcagcagggcggatgcgctgcgtgccgcagcggtggattacggggccggcggcgggcccggcggcgaggccggcttccagagggactggaaagcggcgcgggcgcgcatcaaggccgcagacgcttttggagggccggcgcccaagcggaagctgcgagccgcgccgggggtgaagctggccctgtccaagccacagtga

SEQ ID NO: 8396 - DNA, 441 bp, Chlorella protothecoides
atgtcagtcctgtgccgtgagcagactcttgctgtctgggcggagcgcgagaagttcgagaagctgggcgtcaagctgatcctgaccgttcacgagtggaagcagcgcgagatcgacgcctttgctccggagtactggggtggagctgtgttctacgaccctgagcgcaccttctacgcagctgtccacggcggaagcgtcaagattgcttctaggctgagcctgctcaaccctttcagcaccggattcaagaacggacgtgccgcatacaagcgcggagttgtgaaggattccaacttcaccggcaatggcaccgtgctggggggcgtcctggtattcaaggccggcggcgagctcgtgtacagtcacgccgagtctgactttggggtacacccccccatggaggatctcgtcgcaggcgcctccaaggccgccgcttga

SEQ ID NO: 8397 - DNA, 426 bp, Chlorella protothecoides
atggcctcctcccgggggacggtgatggagctgggcatcggccccaccatcaccgcggggctggtcacgcagctgctctccgggtccaagatcattgatgtggactacagcgtgaagagcgatcgtgatctgatgtgcgtcccggagggtttctgttcagggagcctgagtggttttgtggggcgtgggggtcggttgggcactcagaggaatggcttccaggcccaccgagtgcgtgcctcactgcgcctcctggcctgcctggtctgcttctccgcctcaaaattacttggcggcgtgtgccgagcgccaagtgtgtctgcagtacccactgcacacccggtgtgcgtcacccgtgccctctgtgccggatcccaagttgcacagccctgcgcccctccattacccaaccccctcccaaactga

SEQ ID NO: 8398 - DNA, 732 bp, Chlorella protothecoides
atggacggcttcctggtgcaccacaaggtgcggtcgggggtgtggcaccgtgggagattctgtacggcgtgtgaggggggggaggaggggaggtgggagtgccacggaggcttgcgggcgcagggcaggcccgatgcttgctcgcgcggaggccgcgcggcgccccggccgccccgcggctcgcgcccctcgctttcctcggcgaagggcccccccccccttcgcccaatcccatcctcctccacaaccccccacctgaaggactttgcgcgcatcgcggcgacgtgcctgcccgggcgccgcgtgaccgaggtggtggccctctactactccctccagcgcaccgacgtcttcgctgccacgcggcgcaagtaccagctgcgcaagcggcgcgagcagacggaggtcaacctgcgcgcgcgcgccgccaccttcatgggcatgggcgtggggggcgagggcgccgccaagcgcggcgctgaccgcgctgcgggcggtcctgcgccgggcctggcgcggaccgtcagccgcactgaggtgcggaggttggggggggggttaggggaaggggagaatcgggaagtcacttgggtggggaggatcagtgctggggtcagtggcgagcttcagagtgcaagggggttgtctgtcgtcgccaggggcgcaccatggccgtgcagccgcgtctgcgagtcgtggccctgggctcagggttgtgcatgtgcgtgctga

SEQ ID NO: 8399 - DNA, 990 bp, Chlorella protothecoides
atgtcgggttctaccttgctcgatgtcctggggggctcccccgacagcccagccattgtggtgggcagcggcggacagaagctgaccaggggtcagtttttggagctggccacccagtttgcccagagcctgcgcgccagtggggtgaaaccaagcgatctggtcaccatcgtcgactccaacacgggtcgggctaaatgcatgagtcatgcccatgcatggggtctcgtggcgcatgccagtccaggtggccttgatcaggaacactcagagactaggaagtccctgatgccccacacattccgtcatcctcattactgtgcagctcgagtttgcagtggcgttcctgggcacgaccctcgccagggctgtggccgcccccctgaaccagaactatcacgaggtatgtggacgctgtgccgcactccatgggcatcttgggcacctgggactgagtggccgtctggccgcaatctccagcaaaggtgtcatgcagtcatggaagagttgctgctcccatggctggcacccctcctgtggctcctcccatcagccagcctgaccatgcatggctcgccccccatgtctgcagccggtcaaccccctccaccctcgcctctgcaggaggagttcaagtactaccaggaggatgcgggctccaccttggtggttgtgggagcctctgggaacaagggggcggaggcggcaggagtcgctccggccatcggcgtgaccctggactttgcctccggcgcacccgtcctgcagctcgcctctcgggccggggagtttgccctgaaaaccgcccctgccggcgaggctctggcagaccccccacgcggagacgacgtcgcgctcttcctgcacacctccggcacgacctcccgccccaagggcgtacccctcacccacgccaacctgactgccagcctggagaacatccgcaaggtggggtcatgggctgcacctggtggcaccggggtctgctga

SEQ ID NO: 8400 - DNA, 1083 bp, Chlorella protothecoides
atgggggcccatcatgtcacagcgtgcatcgggccctgcaacgacggcgggggtacaggggcggaggacttgcttggtcgcctggctctgccacccccctgcccagtccgtcgagcacgccaaacacccccaacctctactcttcaagctcctacaccctgcccccccccttgcgcaggctggctggcccctctctccgctggcgctagcgtggtattcccggcggaggggcgcttcgcggcggggaccttctggaaggacgccgcggcgcacggcgtcaccttctacaccgccgtccccacaatccaccagattctggtgcagcgcgcggagagcgacttccccacggccgcgccgccccccctgcgcgtcatccgctcctgctcctccagcctggcccccgccacgctggaggcggtggaggctgccttcggcgcccccgtcctagaggcctacgccatgactgaggccagccatcagatgacgagcaacccgctgccgcagcatggcccgcgccgccccggcacggtcggccgcgcgcagggtagcgtcgcactggtgatattggggcccgaccaccacccgctgcccgcgggggaggtgggggaggtgtgcatccgcgggcccaacgtgacggcggggtaccgcgccaaccccgccgcgaacgaggaggcgtttgcggggggctggttccacacgggggaccagggacggctggatgcagagggctatctgcagctgacggggcgcatcaaggagctgatcaaccggggcggcgagaagatctcgcccatcgaggtggacggcgcgctgctgagccaccggggggtggccgaggccgtggcctttgccgcgccagacgccaagtatggcgagaccgtggccgctgccgtggtcctgaatgaggagggcaagcgcctgggggagggggcggtggaggacatcaagcgccacgtcggcacccgcctctccgccttcaaggtgcggggtactcagattttggtttgggttgagcgggaagcgattggtggagccggggtggtgggggcaagtcggttgggggatgggcatgcttgtgcctga

SEQ ID NO: 8401 - DNA, 3279 bp, Chlorella protothecoides
  modified_base (320)..(329): a, c, t, g, unknown or other
  modified_base (777)..(786): a, c, t, g, unknown or other
  modified_base (1894)..(1903): a, c, t, g, unknown or other
  modified_base (2667)..(2676): a, c, t, g, unknown or other
cacgttcgagacggcggcctccttcctggtctcctccaccctgcacggcgacgtggaccgcctcacctcccccgcctcccgcatcgtgctgggccagcccgtggccatgggcacgggggccatggacctggtgcagcacctggacgcggcgcgctgagtcagcgcggtcgcgctgagtcagccgctgagtctatgcggctcgctggcggggaccgctcgcgggctcgggccgatctctcctctgcagcggcgcatgcattgcccttgcgtgatgtatgctgttgcagcgaggctttgtcagtgggaaaggcgtcgagagnnnnnnnnnncgggaccgcttgcgggctcgggccgacctctcctctgcagcggcgcatgcatcgcccttgcgtgatgtatgctgttgcagccaggctttgtcagtgggaaaggcgtcgagaggcgtcagggcctccgcagcagcctggagcttgtgagactcccaggccaggcaggcccgggacacgttggtgtccagcgcggccagcgggcgcagcgcgttggcccgcagctccagctccgcgacccgggccgccagctgcgcctccagggcctcccgacgggccgccgcgcgcgccaggatggactccagctgctcggcctcggcccgtcgcgcggcgtgcagcgcggcccgcacggcccgcgtggggcgatcctctcctgacagagacctgcgagtcggcgtcactgtcaacggcagccccactggccatgtcgtactacgaaatcatgatgccnnnnnnnnnngcccaactcctgggctcgtgggcgacattcactgaccacttcatgccaggtctctcttggcaatcaccaggcagtgtcactgtcaacggcagccccaccggccatgtcctcctccagctggtgcagcttatctgtcagcgccgtctcctcgcagatggcgtcgaagtcggactcgatgtggactcgggatccatgcaggacctgggggggcatgttcaaatggagggaaatgcgctaccagggtgtcctgtttttgcgttcacatttggaagtcccggtgccaagtcgcagcccaacccaagtcacctgacgatagccttgccagaggatctccaggagctcgggttgaatgtttggaaaacactcggcgaattgctcctcatcggcgccccgcagtgcatgcttgatggtccgtccatacgcatctgccagggcgctcacccgcctgccttggcgcggagcacactgcttgctggctgtgcgtgggggcgtactctgctgcatttcggacctggttggtgtcaggcatttgcgcagaagtggcatctgcgcagaagtggtgaagaaagatgggaatgggaggagggtggagacgtccgtgctagtgtgctccatcgcgtgtggtgttccagggcccgggggatcactccagaccacacctcggggccgaggtggaggggcaatccccgcggggcagcgcacggccagtgcatgggacaaaatcaaagcgctccaggttctggacaaggaggacctggagacaagcagaatgggcaggagaagaagaagaagtatgaaccgcctgcaccccctccccgcgtgggaaagaagcagcgcaagcggggtgcaggggccggcctgggcagcaagctccccaccatcactcctaccagcaagtgcaagttgcggttattgaagctagagcgagtcaaggactggttgctgatggaggaggagtatgttaccaaccaggagcggctggcaccccaggaggaacgcaatgaggaggacaggaccaaggtcgatgacctgcggggcagcccactctcagtgggtactctggaggagctcatcgatgagaaccatggcatcgtttcgtcagccgtcnnnnnnnnnngcgtgattcgagaagtaaccttgcattatcgctcggcatcctctcaattttgcagccatggcatcgtttcgtcagccgtcggccccgagtactatgtcaccatcatgtcatttgtggacaagacacagctcgagcctggctgctccgtcctccttcataacaaggtatggtgcgctgagatcgatgaggggtgcatagtgctctttagcccttcgacaccactccccacccacacgctcctgcagggcatgcacgtggtgggcttgttgacagatgagtcggaccccgcagtgtcagtcatgaaggtggagcatgcccccaccgagtcgtacgccgatgtgggcggtctggaccagcagatccaggagcacaggcggtccaccgagcagaccgctgatgctgttgccaggacaggcgcctctgccctgctccattgctcaatgtcccgtgctcgaccggtttccccgcaggagatcaaggaggcggtggagctgccgctgacgcaccccgagctggcgtcatcctgtacggcgagcccggcacgggcaagacgctgctggccaaggccgtggcgcactccacctcggcctccttcctgcgtgtggtgggcagcgagcttatccagaaatacctcggcgacggccccaagctcgtccgcgagctcttccgcaccgccgacgagctctcgccctccatcgtcttcatcggtgtgtggagtgggggccactggattctgttcctcctttcaggctgccttccctgcnnnnnnnnnntggtgtgtgaactgggggcgactggatcctgttcctcctttcaggctgccttccctgcccctggccgagctcttgcacgctccacccaccccctgcaccatcatcacccccctcatccacccgattcccgcagacgagatcgacgcggtggggaccaagcggtacgaggccaacagcgggggcgagcgcgagatccagcgcaccatgctggagctgctgaaccagctggacggcttcgacgcgctgtcggacgtcaaggtgatcatggccaccaaccgcatcgactccctggacccggccctcatccgccccggccgcatcgaccgcaagatcgagttccccctccccgacgccaagaccaagcgccgcatcttcgccatccacactgggcgcatggcgctggcgggggacgtgaacgtggaggagtttgtggtggccaaggacgagctgtccggcgccgacatcaaggccatgtgcaccgaggcgggactgctggccctgcgcgagcggcgcatgcgcgtcacgcatgccgactttgccaaggccaaggagaaggtgctgtacaagaagaaggacggcgtgccagagggcctgtacatgtga

SEQ ID NO: 8402 - DNA, 705 bp, Chlorella protothecoides
atgctcacagatgggcgaggccatgatccgcggcttcctggagtctggcgtgtctcatccctcccgcctgtctgcctcggtgcggtccagcgcccgcgccacggcgctgtcccgcctgggcgtcacccgcgtgttccaggacgcggtcaacacctggtggtgtccatcgcggcgggggtgcgcctggccacgctggaggcggggctgggcgcgggcgtgcgcgtcgcgcgcgtcatgcccaacacgcccatgctggtgggccagggtgccagcgcctacgcgctgggctccgccgcgggcgagcgcgacgcggcgctggtgcacgccctgctctccggcgtgggcatggccctgcacgtcgacgagcgctgcatggacgcggtgacgggggtctccggctccggccccgcctacgcctacatgatgattgaggccatggccgacggcggggtgcaggcggggctgccgcgcgccaccgcgctcgcgctcgccgccaagaccgtggcgggggccgcggccatggtgctgggcgagggcgccgacggcgccctcgatctcacacaccccggcgtgctcaaggaccgcgtggggtcgccgggcggcaccaccatcgccgccatcgcggagctggagaacagcggggtcaggggcgctttcatgcgcgccgtgcgcgccgccgccgagcgctccgccgccatgggctga

SEQ ID NO: 8403 - DNA, 915 bp, Chlorella protothecoides
atgcgtgacgcgcatgcgccgctcgcgcagggccagcagtcccgcctcggtgcacatggccttgatgtcggcgccggacagctcgtccttggccaccacaaactcctccacgttcacgtcccccgccagcgccatgcgcccagtgtggatggcgaagatgcggcgcttggtcttggcgtcggggagggggaactcgatcttgcggtcgatgcggccggggcggatgagggccgggtccagggagtcgatgcggttggtggccatgatcaccttgacgtccgacagcgcgtcgaagccgtccagctggttcagcagctccagcatggtgcgctggatctcgcgctcgcccccgctgttggcctcgtaccgcttggtccccaccgcgtcgatctcgtctgcgggaatcggaatccagtggcccccactccacacaccgatgaagacgatggagggcgagagctcgtcggcggtgcggaagagctcgcggacgagcttggggccgtcgccgaggtatttctggataagctcgctgcccaccacacgcaggaaggaggccgaggtggagtgcgccacggccttggccagcagcgtcttgcccgtgccgggctcgccgtacaggatgacgccctgagaaggggagcaggggtgagtcgaacattcaagctgtcaacaaagcatgctctgtcgcccgggctcccaggcgatcatgcatgcaaagccaaggtgcttgccttgggtggcttgatgccgatgtcctcgtacagctcggggtgcgtcagcggcagctccaccgcctccttgatctcctgcggggaaaccggtcgagcacgggacattgagcaatggagcagggcagaggcgcctgtcctggcaacagcatcagcggtctgctcggtggaccgcctgtgctcctag

SEQ ID NO: 8404 - DNA, 363 bp, Chlorella protothecoides
atgcagcagagtacgcccccacgcacagccagcaagcagtgtgctccgcgccaaggcaggcgggtgagcgccctggcagatgcgtatggacggaccatcaagcatgcactgcggggcgccgatgaggagcaattcgccgagtgttttccaaacattcaacccgagctcctggagatcctctggcaaggctatcgtcaggtcctgcatggatcccgagtccacatcgagtccgacttcgacgccatctgcgaggagacggcgctgacagataagctgcaccagctggaggagctgtgcgaggctcagggcgtgtcggatgaccctcacgccaggcaagcggttgggtgggggttggcatcatga

SEQ ID NO: 8405 - DNA, 435 bp, Chlorella protothecoides
atggcgcaggcgctggagagccggcacgtgtcggcgcgcctgcacaagtggatcaacctggtgtttggctacaagtcgcggggccagagggctgaggaggcggacaacgtcttccactacctcacctacgacgagatgtacgactggtttgtttccgtgggagtggggagaaggggtttggaaagggtgggggggtggcgctcctgtatgttccgccccgacgcagcgggatcgaatgtgttgccgctggggaggtgtggagtgagcgggggggtagaccacggcggctaccgggggcctcgctggcttgacgcacctgccagcccgggatcgaatgagtcgccgctggggcggtgtggagtgagcgggggggtggaccatggcggctgccggggacctggctggcttgacgcacctgccagccgtgatgtctga

SEQ ID NO: 8406 - DNA, 405 bp, Chlorella protothecoides
atgccgcccttcatgtacggctgccactactcctcccccggctacgtcgtcttctacctgctccgcgccgaccccaagctcatgctgcgcctccagaacgggcgctttgacgcgccggaccgcctcttctggtccgtggcggactcctggaagtcggtgctcacgcttcccaccgacgtcaaggagctgaccccggagttttactccaacgatcccaccttcctggtgagtttgcggcggtgctggtggtggggggcccaagcggggcctgtgatgctggtggccggggggtggcggggagatgcgtcacgtcccgggagcacgcgctcatctccagcagagtgggacgatggcgcgcacaccgtgacccctgaggcatgcgaaccgcagcgggtgctgccgtga

SEQ ID NO: 8407 - DNA, 1005 bp, Chlorella protothecoides
catccccagccagctcaaggtgtgcagccaggccctgtacatcgtgccccgcgacgaggcggaggccatcctgcgcattcccctcgccgccatcgactctctgacggagctggagggcgagtcgacgcccaccggcgaggacctgttggccgctctgcccctgctgcgcgagctgctagcgctggagtcgcgcgcgcgcggcggcgacgccgcggccgcgcgcgcggctggcgctggcctgcgcgacctgatcgcggcccacgaggccggcctgcccttcaacctgggctggctggaggaggacggcgaggaggtggcggccgaggcgctggccgccgcggtgacgccgctggtggagacgcggggacgcgtggtggtcacccaggcccgcctctacttccagcccttcaacctggcggcccaggccccggtgcagagccaccgcctggaccgggtgacggacgtgcagcgccgcgcctaccgcctggccgacctggggctggagctgttcctgtcggggcgcgagtcgctgtacctggccttcgacgacccgccctcgcgcgcgcgcttccaggccgcgctggagcgccagcccgcgctgcgcccgctgcgcccgcgcagcctgcgccgctggcagcgcgagtgggtggcggggcgcgtcagcaactttgactacctcatgcacttgaaccgcgaggcggggcgctccttcaacgacctcacccagtaccccattttcccctgggtgctggcagactacaccagccgcgagctggacctggacgacccggccgtcttccgcgacctggccaagccggtgggcgcgctgaaccccgcccgcctcgccgacttcaccgagcgccaccgcgagctcaagaagatgacgcagccggtgggcgggtgctggggggctggctgggttttggtagggaggagaaggggggagaggaggaggaggggagaagggggggaaaaggggggaagaaggggggaaaaggtggggtg

SEQ ID NO: 8408 - DNA, 2580 bp, Chlorella protothecoides
  modified_base (165)..(174): a, c, t, g, unknown or other
  modified_base (354)..(363): a, c, t, g, unknown or other
  modified_base (2271)..(2305): a, c, t, g, unknown or other
  modified_base (2374)..(2383): a, c, t, g, unknown or other
atggcaaagtcttcttcagactcggaggactgcaggttcgagtcggacctcgacccaaacacagacatcgacaatggggaccactcagaggatggaggcaccggtactgagcttggaaactccagcaaagccgccaagccgacgaaagtttcccaccgaactccnnnnnnnnnncttggaaactccagcaaagccgccaagccggcgaaaatctcccaccgaactcacgaagacaccttgatggaggtcccaggcagcctgatggccctccaggcgagatctcatcaggatccatacccagctccctctacacctttccattaccccttgttaacacacagatcaacggtgttnnnnnnnnnnatctcatcaggatccatacccagctccctcgacgcctttccattacccctcgttaacacacagatcaacggtgtactagaggatgcgctggcagactccgccctggtggggcccggcctgagccagtacctggaggctctgtcggaacacctggcgactgcgacgccaacccaggccgacagcagggccttcatggagtctgtgcagctgctgcttgcggccatgagctttctcccaggcaaccgacccttcaagtaccaggcacccattttggttcgcgcgattggaccagccgctctggagtgcgttttgttgggggagggaggcgtgctcagcgtcgacgtggcgctcgagataccggcctcctgctttgacaacaaggaccagctgaacaaccggtgcggcaggagttcaagggccgtgattcgaggtggctctctgtcctggctttaccaaccgatggccctgccgtacccttccctccccatctccaccacctccaggtaccatgcaaagagagcgctgtaccttgccgaagtcgcggccaggctgcaacgccacccgtccacatggtccattgcatgggaggccggcagcgacccgcgccgccctttcctcgcgctgcaaccagcggccactacaggcctgggcggcctgacgctgcgcctgcacgccgtgcccgcggagggcacgttccccctttccaaactggccccgcaccggaacaacctgaggggcgtggtcggagcggacggccagccggctcccacgccccactacaaccacagcatcctcgaggtacttggtatctctaccccggagggtatctggggaggtggatggggcggtcggctgttgatgggaatgcctgtcagcctgcaaagttctgtgcttgaaaagaaggaagggaaggggccgttgagttgcccattcttatccatgccctacaccgggcgatgcctacccgatgggtccttgttcccgcctgctgcctctggggctcagtctcggaatacggaacagccagctcacgatgttccctgccacgctcctccaccaggacctgctgctgctgaggcagaccgccgaggtgaccgaggaagcagccaggaacccggccctgcgctcggccctcgccctgctgctggtctgggcccgggcacactcgctggacgagggtgccgacggcctgagccctggcttcctcgtccagctgctgctctacaccgctgccaagggggggggggccctggctgggtcgaaccggatggtcaccatcctcgagaggccaaggatgttgctgcggcatcgaatcccctcccacccctttccccctttccgattcctcacacagagctcgctgccgtcggccctggacctggtgcgggcggcgctggtgacgctgtcctccagcaggaagctgcacgccggcgcggggctgacggtgccacgcggcgcgggcggcgcgcgggacgccgcgctttccccctccgcctggcgcgctgcacacaacgctgtgctggtggactctgcgacgccgcgccctggcgcgcgcaggaggccgcgacgcgcgacgtggcgcgccgcgcactgggcgaccgtgcgcgcagcgtgcgcgtcgtggcgcgactcactgcatcggacccggcgcgcccactgcccggcccagccgccgccgcggtgctggtcgccgtgcggctggacccggtcgctgcgcgacgcggcgtggacgttggcccctcggccgaggacgtcgagggctcccgcgccttccgcgccttctggggcgacgagcgcgcggagctgcgccgcttccaggacgggcgcattgccgaggcggtggtgtggacgaaaagcggcggcgccaagggctctgacaccgcccctccgccccgacatgcgatcgtnnnnnnnnnnnnnnnnnnnnnnnnnnnnnnnnnnngtggacgaaaagcggcggcgccaagggctccgacaccgcccctccgccgcgacatgcgatcgtggacgnnnnnnnnnnccccgccacatccccggggcgcgcgtgtcgcgtgcctcggcgacgctcctggatgcggcgctgggcggggaggcggaggaggccgcggccgtgcgcggcgtggcggccgccgccgagcgactgggcaagcagctgcgcgggctgacgggcacggtgctgcgcgtggttgccacacaggcgctggacccggcgacgcg

SEQ ID NO: 8409 - DNA, 720 bp, Chlorella protothecoides
atgacccgagccagggcgttattccgtaaagccaaggattatgtcacctacgatttggtggagattatagcccctcgttccatcccaaatcctcctggatacgtgcctccaagaaagcgcagcttgtcagaagtgctacaggtaagtgcaggcaatcctttgtggcaggccctgggcagttcgaggagcgcctgtcccacgacatgtctccatcaaatcctgcagaatgtgtacaaaggcaccaagctgtactttgatagctggagtcaggagaagatagaccgacacctggctgagcattatggcgaggactacatcagggagaaggccgagaaggagacttccaagaaggagtggcaggagcttgtcgaaggctttggatgctcaatcaatgtgagatgcggtgcttcatgccagctcttcccctctccttcctccaaaggtgatgcggccaagggcggcggcaaagccatggtgcccttccttcaaaatctttacaccagccgggcagccgcatacggtcaagccctccgacaatttgtgacagggtaccgggagggcattgctgagggggtgccggctccccaagcggatccaacggatgctgctggagagtcacagcaagctgtgacccagccatcgagggtgcgtcctgggcaagacagtggagactctcagccggagacagggagagatttccccagaaagccggtgtcatga

SEQ ID NO: 8410 - DNA, 1851 bp, Chlorella protothecoides
  modified_base (455)..(464): a, c, t, g, unknown or other
  modified_base (518)..(527): a, c, t, g, unknown or other
atgcctgcaggtcacatccatatgcaaagaatcccatggatacctaccttgtcagccttgccatccttggcgtctgccttcagcgatcgcacaatgtcgccctgtcgagccacgctctcgatggcctcctgcagcgcagcctccaactcggcaccttgggcagacatgctttccatatgctgcagtgatgtcaaaatgatgccaatacgatcatggcgtccttgctgggcctttgttggaggtgggtgggtgcggtcacctcatcggaacacggaaatcgtgaaaatggaaaaccgacgggatgcttgccttccaacacactgcctacatcggcagagaggagcacaaacatacacatgcaaggcggtggatgcttcatggggcccaagtatttttcaggtgcacccctctggcatccctagactgcgttggactcctgtcttgcagcaccgggnnnnnnnnnngtttcaggtgcacccctccggcatccctgaacctgccatggccatgcagtgcgnnnnnnnnnnagtgatccgctataccaaactctttcctcaacagcacgcatggctccacgggagcatcccattcagattctgtatagtacatagagaactcatggcaaacagcgtgatggctcagcctgccatggccatgcagtgcgacaccccggaccctccctaccccagcaccgacctcaaacctgtggcccagccacagattgccttggaaagacagcccgacgacccctcaagccacacgccagtggtttccttgaccagaatcgacacagctatgacgctcagccacaacccccccccgacccctttcactcgagtgcagagagagagcccaatggatgcccaggtgcaaagcctcatgcacgacccggcctttgcagccgcagtcagcgcaggccaagtccgtgctgcggctgaggctgcagtggcggcgtacaaggtgcggggcgtatgtgtgtgtggtgtggtgtggtggtggaagggggggggttccagcgccatgcgtgcgctttgggctgtggaggggttggtggaccggttgtcggaaaggccaggctcaagctcgccctcccgttctgtctcgcatccgtctgctcccacactgaatgtctgtgccttcccagcgacaataccctgtctaccctcgcagcggcacaagggcctcccggagcatgcacaccgcaacggcgcccaccccagccgaccgcggggtccgctcggctacggcaccgctgcacggggcaagacgctgccgtccccggcgtcccccggcgacggcgccgccgggctggagccttggcagcgcgacctcctccgcggcctgaccctggagatcctggccatggaggaaagcgtgccgtggggcctggtgcggcgctactggcgcaccaagcgcaccggctggcgccgcgccctgcgcgtcgccgaggggcctgccgacctggtggcacggctcagggtgaggcggcgtgttcaggctgcgtgcccctctgcgcaggggtcagcggctgccgggaacctcctgtcgctgcgcgcctcgtgtccttggtgctcgtcgcagagactccctcctgcatgtggggccagtgtggacgtaatgaggcagcattgtttggggccgcacccagcacacacccctcacgcgcacgcaggagctgcgcgcggcgctgctggccgacgacgccgcgctggccacctgcggcgaggcgtggcaggcggagctggacgcctgcgctggcctgccggacgggctggagcgcgtggcgggcgcctgggacgagctgcgcgcctgcgtggcggggtggctggagggcccgcgcggcgcgacccc

SEQ ID NO: 8411 - DNA, 2250 bp, Chlorella protothecoides
atgtctgcccaaggtgccgagttggaggctgcgctgcaggaggccatcgagagcgtggctcgacagggcgacattgtgcgatcgctgaaggcagacgccaaggatggcaaggctgacaaggcggccgtcgacgcggccattgaggccctcaagcagctgaaggtggtccaggagcagaagcagaaggcatatgaggaggccactgggaagagcggggtgcagagccgcgagtccttccgcgccaacgtggtgcgtgctgggagagctggctcttcggtgaatgccctggagcgcaagctctttgtcatcccctccttcaagatctacggctcggtggcgggcttctacgactacggcccccctggctgcgccatcaagtccaacgtgacccaggcctggcgccagcactttgtgctggaggagggcatgctggaggtggagtgccccgcggtcacccccgagatcgtgctcaaggcctcggggcacgtggagcgcttcaccgacttcatggtcaccgacgtgaagaccggggactgccaccgcgccgaccacctgttggaggcggcactggaggcggttttcgagggccgcaccacgccgccggcgggtgaggaggagcgccgcgccgcgcgcgacctgcacgcccgcgtcggcgagctgggcgtggcggagctgggcgcggcgctgacgcgctacggcgtggccgcgccggagacagggaacgagctgtccacgcccttccccttcaacctcatgttcaagaccagcatcgggcccaagggcgacctcacgggctacctccgccccgagaccgcgcagggcatctttgtcaacttcaaggacctgctctactacaacggcaacaagctgccctttgccgccgcccaggtgcctaggttgaggggaggctgggctgcgaagctggttgcgtggctggcttctgaggggcacgcccccacatcctccccatcacactcacttccccatgacaccctccccccctatcccccccattccacatcgcagatcgggaattcgtaccggaacgagatctccccccgctccggactgctgcgcgtgcgtgagttcacccaggccgagatcgagcacttctgccacccggaggacaagcgccaccccaagttcggcagcgtggcgtccctggcccccctcctctactcccgcgcgctgcagatgggggaggagaagcgcgcgctccccatgccgctgggcgaggcggtggccggcggcgtgatcgccaacgagacgctggcctacttcatcggccgcacccacctcttctgcgagcgcatcggcctggacccggcgcgcgtgcgcttccggcagcacctgcgccacgagatggcgcactacgccgaggactgctgggactgcgaggtgcactgcagccacggctggatcgagtgcgcggggctggccgaccgctccgcctacgacctccgcgcccacactgccatgagcaaggtggagctgagcgcgtacgagacctttgccgaggcgcgggaggtggacacgctgaccgtgctgcccaacaagaaggcgctgggccaggccttcaagggcgaggccaaggccgtgaccgccgcgctggaggcgctgtgcgaggagggcgcgctggcagtcaaggccgcgctggaggcgggcgggccggcgacgctggaggccggggggaagacctacagcctggcccccggctcggtggacatccggaaggagcgcaagcggttgacggggcgcagcttcacccccgcggtcatcgagccctccttcggcatcggccgcctgctgtactgcctgttcgagcactccttctactggcgcgccggctccgacaagcgctccgtcttccgcttctccccgctggccgcccccgtcaaggccacggtcttccccctgctcgcgcgcgcggagctgaacgccaccgcggcgcgcgtgtcggcggcgctgacgcgcgcggggctggccaacgcggtggacaccacggggaacaccatcggcaagcgctacgcgcgcaccgacgagctgggcgtgcccttcgccgtcaccgtggactacaccagcctggaggacggcacggccacgctgcgcgagcgcgacagcaccgcgcaagtgcgtgtgcctctggatgagctgccggccctgctgcgggagctgaccgatctgcggcggacctgggccgacgtggccgcgcagtacccggcgcaggccgcccccgcggaggaggagtag

SEQ ID NO: 8412 - DNA, 309 bp, Chlorella protothecoides
atgcagggcatcaacatctctgctcccgcgcctcgcgtgaatttcgaactcctgggccagcacatcggcaagcgggtgcgcctggtgggcaaggtggagggcgtgcagggcaactccctgcagcttcgagctgccgacgatggcatcgtcacggtggcgctgcgaggggcggctccctccgacctcttcatcgaggtggaggggacggtggacagccccaccgctctgagggaagagtccagcacaggattcgggagcaactttggtgagcgatgcatggcagaccttttggtagatctctggaattga

SEQ ID NO: 8413 - DNA, 3195 bp, Chlorella protothecoides
  modified_base (485)..(494): a, c, t, g, unknown or other
  modified_base (1642)..(1670): a, c, t, g, unknown or other
  modified_base (1808)..(1817): a, c, t, g, unknown or other
  modified_base (1882)..(1891): a, c, t, g, unknown or other
  modified_base (2245)..(2254): a, c, t, g, unknown or other
  modified_base (2331)..(2340): a, c, t, g, unknown or other
  modified_base (2417)..(2426): a, c, t, g, unknown or other
  modified_base (2631)..(2655): a, c, t, g, unknown or other
  modified_base (2953)..(2962): a, c, t, g, unknown or other
atgtccccctccagggagtgtccacttgagaccttgatcatcacttgctccctgcccatggtgtctgaacgcatgtctctcccgaggcctcgcgccgggtgctgcaagggccgttgtgggcaggtgacaccggtctcgacttcaagtggcctggcgcgcgctgggccgggggcagtacccccctacgcacttccgagcgcgcaggggacaccacccctccaacccgacccaatactgcccaacagggacgtggacactggcgcggcgctcaccagctacaagtccagcgcctgcaccgtgaatggcctggccctggtggggcgggaccacttcatggcctgccagagctccaagggcgccgtgcacgcctggacctggtccaacgaccaggtcagcgtgcgcagccacgcgccggagccgctgcgctgcctggcggccagcccctgcggcacctttgtggcggggggtgctgcctccggcgccannnnnnnnnnggcggccagcccctgcggcacctttgtggccgggagcgccgcctccggcgccgtccacctctggtccacgggctccgggcgcctgctgcgcagctggcccgcgcactacaaggccgttgcggcgctgtgctggagcgccgacgccgcgctgctctgctcggccggcggcgacggcgtggtgtcggcctggctcgtggcggccgccgccgaccctgccgcggcgccgggcgcggcgccggagccctggcagtcctgggccagccacacgctgggggtcaccgcgctggcgctggacgcctgcgacgccatcctcgtcagcgtcggcctggaccgggccctagtggtggccagcctggtgggggaccggcccgtgctggcccgccacgccctgcccagccccctgcacagcctggcgctcgaccccgggggccatgccgcgtatgcgggggccgtcaacggcgccgtgtacgaggtcagcctggcgggaggcgcccagggcgcagagtttcccgtgctggagggacacagcctgccggtggtggcgctggcctttgcgggcctcgacgccggcacgctcatctcaggtgtgtgcgtgggatcatccttgtgggtgcgagtcaggatggggagtgtgggggtgcgttcttgggctgtcactggaagttgctgtgcacgccgccacgcgtctctgtgcagccagtcggatgccgcgtcagtcctccctgccaaccctccccgctccatcacctcctcgctcccttgcaggctccgaggacggaggggtgaggttctgggacctacgcaccaggcagcagacacgggtgttggagactcccgccaagggccccgtcgccgccttggtcaccctggaccggccgcgcgccatgcaggtgctggggtctcggggccggcagcagcagggcgtgaagaaggagacggggacgcagccgctgggggcactggccaagttcccgggcgcgccgggcacgctgcggccctgggaggacgcgctggttctcctggacggcagcggggtggaggcattcgacgaggccgccgccggctgtgctcaggagagcggggacagcctcgtccctgggggcgccgcacatcgggtgggagctttgcgggagagcgacgccgccccnnnnnnnnnnnnnnnnnnnnnnnnnnnnnagggaggagaacgccggcctcaagctgcagctggaaagggcggcagcggcgctcgagcaaatggtggccatgcagggcgcgcccgctgagagaccgcgcagcaagggctaggggggaggtcatgcctgtgcttgaatnnnnnnnnnngctggccgatggagcagcagcgccggctgcggaggataacgattccggcgccctggtggcactcnnnnnnnnnngctggccgatggagcagcagcgccggctgcagaggacaacgagtccggcgccctgtgctcaacctgcatcagtcatcctgaattctgcacgtacgccagctgctgcgacagcttcttcactgcgtcctggggtgcctggggacggtagggaggcgtgcgggactgaggtttggatgcagagggcggggatcgcaatgaccaccgtcgctgccaggccccagtctggtctgccgccgcaccacgatgcacgtccagcctacgccctgccaggaagcagccaggcgccaagctctcccgtcgccctccgccgccttcctgtcctccctgtcccacccccaccgcacctcagcgtcnnnnnnnnnntccagcttggtctgcaggagggtgggggtgcctggtggcaacttggtggccgatgccgggcgcgccgcagggctggnnnnnnnnnntccagcttggtctgcaggagggtgggggtgtctggcggcaatttggtggccgacgccgggcgcgccgcagggctgtnnnnnnnnnngtccagcctacgccctgccaggaagcagcccgtcgccaagctctcccgccgccttccgccgccttcctgtcctccctgtcccaaccccatcgcacctcggcgttcagaccgccggagcgcagggagcgctcggcgtccgccacgaccaccgccaccttctcctgcaggatggagcgcagcgcactccgctcccgccgcagagccnnnnnnnnnnnnnnnnnnnnnnnnncggtgccgggaatgcctgccgccggcgaggccagcacctcggccctcctggcagacggggcagggtccggcgcgggcgactgcgatgctgtgtctgaggaaagcgtcggtgcgaccccatgctgtcgaccaggagcagggacaggctggcgccgccagtacagggcagcctcctggtgcggcgcgggccgacgatacacacgatctgcagtcgccgtcgcaccaccactcgccgacggctggggccaccccgcaatacaagtctcaacctcccttctccctcgtcccacaccacccannnnnnnnnntacacacgatctgcagtcgccgtcgcaccatcactcgccgacggctggggtcaccccgcactacaagactcgacctccctcttccctcgtcccacaccacccgcctgcgagctcgcgccgcggccattcacgctgctgccggcctcgctggaggtgtcggtgtgggggccgaggagcatgggcccgggctggcgctcctcgtgcccagcgccgatcctgattgcgggggaggg

SEQ ID NO: 8414 - DNA, 1257 bp, Chlorella protothecoides
  modified_base (761)..(770): a, c, t, g, unknown or other
  modified_base (1047)..(1056): a, c, t, g, unknown or other
atgcccctcttcagctcgacgccgtgcctcttgatttcgtgccgtagttcaccggctttcgtcaatgtatctccacatcccacaggaagtatgagggaccccgtggtcacagaactcttcgggtcagggcatgggaccgcagcccgacccagcgagcccctccccctcacacacaggtgcctgtgccgaagctcctggacatcagtcatcctgcgatacaaccagcggggcgtgggagcctccacgggttaccgccagccgcgggggtctggcgacttccaagatgtgctggacgtgctggattacctggcggggaccctcccgccggggacaaacaagcgcctggtggtggtggggtactcctggggctgctgcgtggcggcgcatgcgctgcgccacccgctcatcgccgcatacgttggggtctcctttcccctcagcggtctcagcatgatcctgggcaccaaagggcactttgaggagctgggcgggacgcgccacctcccccgtctgctcatcaccgggtctcaggtgactgctcaggaggaagagagggagtgctggaggctatgcagcgaggggggagacatgctaacagaagcaatgtcagatctcagctgcgtccgcacagcttaccacactattttctggatctcctggactggctgtgaatcttgccccgtcacacacattgtttgcatcctccggcccccaggatcaattcagcggcgaggcgcagctgatgcagagcttgaccaagnnnnnnnnnnatgtatgaggccttgctgtggagtgctggaggctttgcggcgaggggggagacatgctacagaagcaatgtcagatctcagctgcgttcgcacagctcaccacactattttctggatctcctggactggctgtgaatcttgccccgcgggcgcctgctggaggacgacgacagcttccaggtggttggaaccagcggcgcgcccgcacccacgcccggcggcgcagccgccgcgcccctccttcttcgggtgtgggccggcgccgaccacttctggnnnnnnnnnnacgcccgcacccacgcctggcgacgcagccgccgcgcccctccttctccgggtgtgggccggcgccgaccacttctggttggaccaggtggcggccatggcagagtatgtgaatgactggttgcggggcacgctggcggcggcgggggcggccgaggacggcgccgccattacggcgttttcacaggccgcacgcgcctga

SEQ ID NO: 8415 - DNA, 963 bp, Chlorella protothecoides
atgcctgcgacgacactactccgcagccagcacgcagacagagccccgaagggcacgttcacgccgtggttctatgcatgcattcgcatcccgagagggtctgataaccttttggtatatttaggccatcctttgcagtgtactctctgtgcagagcgatgcatgtggggcgtttgcatgacggaggtccgtgcccgtcatgcacatcatggcgcacatcgcgccgagagcatgcgcccccccatgggcgaagtcgtaatgcgtcacgcttggggtgggcctggccatccccatcggggtgcgactcaagtcttacaaccccctggtctacttgggactctctggaacactgctggaccttctcaacggctacaacaagtgcacgaaggagcgggcggagttgcgggactaccagctcgcggtgtccacgcgtgcaccgtgacgctgcgccctcatgtggcaaaggagtatgcagcagagtatggtgcagcagcggtgcgtcatccatctccctcaccacgctatgcacgctttatcaccctcaggcggctgtgtgggctggtcggccatgccagaggcgcccaggctcggcggctggccactggtgcaggcccagacctcggcctgggagcgaccctacagcgtgccgtcgcttttggcccctctgaggtggcggcgttcgtgaggctgacgggggacaccaaccccatccaccagtccctgccagccgcgcaggccgccggcttcgagcgatgcctcgtcccgggtatcatggccgcctccctcttccccgccctcatcggcagcgccgttcccggcgcgctctacctcacgcagaccctcaagtttcgggcgccagtccaggtgagggctggcggctggaggcttggcgaggtgacgcacagtacgctagaagcagtgcgcaccgagcgtaacgttccggagtcccaatcagaccaatga

SEQ ID NO: 8416 - DNA, 291 bp, Chlorella protothecoides
atggagctctgcatcccctcccgtgaatactcccatggcaggcaggcggaggccagcctggactcaaaggtcttatgcgacgccgactgtgctgccagcttggccgacaaggagcgtgtgcgcaccgcctcgggcctggagtacatcgatctcgtcccaggcaaggggcccagccctcgcataggctttcaggcgagtgccgggccccgccacgctggcccccaggggccctggctggtcggtgcggtggttactgtggtcacagccatgatctacaagtgtttgtgctga

SEQ ID NO: 8417 - DNA, 1188 bp, Chlorella protothecoides
atgcaggagagtaccggctgggtgccctggcacagcccccaggatcaggagctgcgggccaaagtgctgaaaattatgccttccctcgggtgcacaagcggatggtgccgggtcagcaccgaggccctgagccccgccgatccggtcccggcctcgcggggcggtcggacatcgccttttctgtcgcctgcgcccatccccggcgctgcgcagggccgcgtgctcggccatgacccccagcaaggcctgcgtgcccgaaaagtcgcaggcctgcgtgccttgagtctccgtgcctgcttttcatcccaccgccctccctcctcccaccccttgctcctgcagcacaacctctttgcagcgcgcaagccggacatactaggtgggcagccgccactcgggcagtcacatgtgcccccgtgcaaggcccctgtttggtgtggcctggctgcccatgcttgcctcgcctctgtcgcaccatatcggggcaggggatgcgcctgtcctcctccacattcactgccgccatgtgccacccccctcccgccccgcctcgccgccgcagttgtgggcgactccgatgaccccaacaagctccccgacttcctgggccggctggaggaggcgctgtacaaggccgcgtccagccgcgaagagtacgccgacttctccacgctggaggcgcgcttgcaggccgtggtccgccgcgtgatgaacaagcctggccgctcggcggcgagtgcagcggcggcggcggcggcggcagtgggccccgcaggcccgggccccgcctccagcacgccgcccccaggccacctggcgccggggcaggcggcgccgcagcaccacatgcagaacgggtacgccgcccccggcagcgcgccgcacgccgcacaggcggcgcaagcggctcagtacgcggcgcaccaccatgcgcagcagcaggcgcagcaggccgcgcagcacgcgcagtacacagcacagcacgggcaggcggcgcaggcccaggccgcgcaggcgcaggcgcaggcgcagcagttccaggcgcagcacgcgcagcaggcgcaggcccaggcccatatgcggcaggcggcgctggcgcagcagcaggcgctcgcgcagcaggccatggcccagcatgcgcagcacatggcgcggtatgcggcggtacagcagcagcagcagcagctc

SEQ ID NO: 8418 - DNA, 432 bp, Chlorella protothecoides
ctcccgccccctcccctccccagcccgccgcccgccggcgaccctccccccggctccctccccttcctgctgccgcgctgcaccgacgggaatgcgcagtgcgacgcttggcacggcatgggcgagtgcgtccgcaacccgggctacatgtactacaactgcccgcgcagctgcctggtctgcaacgtcacctacctggacacggtgccggaacaggtggaaatcgcgcccggcgtctggatgcccaccatcgggtttggcaccgccggtctgggggacgccactgcagaggccgtcgcctccgccctggcaaatgggtaccgcctgctcgattcggcgcaggtgtgggaggggaggtgggagagtgtttcagggctagtggcatggggggatgaagggtggaggagactgagtgggggacggggattttga

SEQ ID NO: 8419 - DNA, 864 bp, Chlorella protothecoides
  modified_base (376)..(385): a, c, t, g, unknown or other
atgggagggaaccgatggatctcgcggaaaaggaagagcattgaaggacaaacccatgagctcgggggcgattttccacctcaaaaggatgccaacgtatacaaccgtggtcaatgcttgcatgctgctccagcgtctctccttcacaaggcccatcttgcccgcacttcgccggcatcaagtcacgatggccgctgccgccaagtcctccggaaccgtcaagtggtgagcgtcggcttggtatcagcaacacgtcgacagggataccctgaaagcccggggtttgtgcggtcggtcgaggacgtgcacacgctccctgatccgcggctcttgccgtgcccaccagccctcagaggcccgctctctcgatcccctnnnnnnnnnnacgtgcacacgctccctgatccgcggctctcaccgtgcccaccaatcctcagaggcccgctccctcgatccccccaggttcaatgtcaccaagggctacggcttcatcacccccgaccagggtgcgaatcggggcgtttgtgcatactgtcctgtgggcatgggatgaccccatgcctgatttcctccccactgatcgccctcccagcaggtggtgaggacctgtttgttcaccaaaccgccatcatcactgacggcttccgctccctgaaggagggagagcccgtcgagttcttcgtcgagaactccgacgatggccgcgccaaggcggtgcaggtgaccggccccgatggcgccgcgcccgaggtgagggggccagattggagctcgcatgaatggtgggcccttgagcgcataccccggtggcccaagacctcgccagcttcacgtttcatttgcagcagagaagcggcaagttga

SEQ ID NO: 8420 - DNA, 1188 bp, Chlorella protothecoides
  modified_base (112)..(121): a, c, t, g, unknown or other
atgcgtttcagactgcccagcgccgtcccggggcagggcaaggattcgaagtgggcgaaggagagatcgggaggctctcgtattgactgcactgcgcagtccatgctgcccnnnnnnnnnncaagggcaaggattcgaatacgatgtggtggtcaccccgggggccaaccaggcattcatgaacgtcgtgctggccacgctagaccccggcgacggcgtggtcctgttcaagccctactacttcaaccaccacatggcgctgcagcaagggggtgtattccgtcacagcagcagtcaacacaagcaatacttgctaaacacccctcccaccgtgtaaaaaatccatccgctcccccccccctttccctctatgcccagatgacggggctgggcccttccatcgtgtacggcccctgcacgcccgagcacctccaccccgacctggactggctggaggcggccctggcccgcccctccccgccgcgcatggtggtgctggtcaacccctgcaaccccaccggcgcagtgctggcgcgcggggagctggagcgcgcggcgcgggtctgcgcagccgccggagcctggctggtggtggacgacacctacgaggactttgtgtttgggggcgaggcccactgcgcggtggcagggccgcacgtggtacacctcttctccctctccaaggcctacggcctcgccgggtggcgcgtgggctacgtagcgcacggcgcgggccccgccctggcctcggccctgctccgcgcgcaggacaccatgcccatctgcgcggcgcaggccagccagcgcgtggcgctggccgcgctgcgctgcggcggccgggcctgggtcgcggggcgggtgcaggcgctggcgccggggcgggaggcggtgcgcgccgcgctggcccgcgcgctgggcgacggcgcggtgaggggccagggcgccatctacttctgggcgcggctgccggggcgcgcgccggacgacgaggcctttgtcgcctgggccatccgccgccacggcgtcagcgtcgtgccggggtctgcggcggggggcccgggcttcatccgggtcagctacgccaacgcgccgccggagaccatcggcgcggcggcggagaggctggagcgcgcgctggtggagttcgcggcgtgcgagggcggggagctgccccagggcgcggcctga

SEQ ID NO: 8421 - DNA, 717 bp, Chlorella protothecoides
atgtactccttccatgcccatgggttgctgaccgctcgacctcaccccaccgtccccacccctgtccactcaccccgccgccacaggcagacgcccggcgacgcgctgtcggatgccggctaccgcgcgctgaacatcgtcatcggcgtggccatatcggcggtcgtggcgttcgccatcttccccatcaaggcgcgatcgctgctgcgcaagcagacggccgttgcgctgatgcaggcgggggatctggccgcatgggtcttcacccaggtgggcgtggagcccactgccaaggactccaacgccctgccccacgccagcggcacagacaagagcatgtgggtctttggattgtcttgtggggtctggggtcatggaggggaatgcatgtggggccgaggcgaagggggttgggcggcaccgcagttccacatggtgccacggaccttgggcttgcagggtccacccgtgctcgccagtggcccgacatgccctgcctgcatcaatgaaatccatgcgggcaacccgcacgtccacatccacccatgcaggaggtacatcgacgacgggctgcaggtggagatggcgccgctgtttgccgccacgcagcggctggcagtgagcctggcggggctggacgacctgctgcgctccgcgcgcgcggaggtcaacctcttctccaggccccaccgcttccccagcaagacctacgggtga

SEQ ID NO: 8422 - DNA, 294 bp, Chlorella protothecoides
atggcgcgcaagggcatccaccccctcatgcggacgatgaccgtggtcttgcgcaacggctccagcttccgcgccagcacggtcctgaaccggcacacgccctggaagctccaagtggacactacctctcaccccttctggacgggcgaggagacggggatcagcgtggagggcgcgcgcatggcccgcatcatggagcggtacggcgacctgctgaagactcctgcggagaaggctgcggcagccaagaaggccgccgaggaggaggcttccgtccctgctgcgtctgcctga

SEQ ID NO: 8423 - DNA, 687 bp, Chlorella protothecoides
  modified_base (543)..(552): a, c, t, g, unknown or other
atgtgccttgcacgcccggtcagcgactcactcgtcgatcgggtggtaggttatctgcaccgggccggcgccggttcccggggccgccgcggggggcgctgccagctccagcggctcgtcctctgcaatggtcggcacggtgcctgtggggctggagggcacgcccgacccctcgcgcgccatggccggcaggacgcgcgaggccaccgtggccgccgccgagccggcggtgggctcgagcacgtcagggacggaggaggtggacaggcccccgatcagggcacggctgctgccggcgccggggccccacgccgcgccgtccaggaagcgcgcgccgcgtccgcttgggttgctgctggatttgaggatggtggaggcatggcgcgaccaggggcggttggtgtacgatccctcgctcagctcggcagccaggtaggagccggcgcccgcgcccagcctcgctgtggattccttgctgggcatccactggccgtggtcgtacaccaggtccacaatactggagggggggggaggagggggggnnnnnnnnnngccccgcaaggtgtgtaccaggccttgccagcccctcgcttcacgttaagccgggccctgcgcccggccgagtatccccttcctgagagtccctttccagcagcacccgagcggagcgatgccagttttgaatga

SEQ ID NO: 8424 - DNA, 1392 bp, Chlorella protothecoides
  modified_base (485)..(494): a, c, t, g, unknown or other
  modified_base (874)..(883): a, c, t, g, unknown or other
  modified_base (968)..(977): a, c, t, g, unknown or other
  modified_base (1244)..(1253): a, c, t, g, unknown or other
atggcagcggctgcacaggctgcccagctgcctcgtcgtataatcaaggtgggttgccgtaagcttggctgcacgacaccgtggaagatcacttcagctatattttctggtggcaaccacgttgtggctccggttggtatcttgctccatccctcactttcccccgtcgatgcagtgcccggcatctctgctgcaccctccgaggagaaccttcgctacttcaatgtggtgatattcgggcccgactcctccccataccaaggtgtgaatctggggtcacaatggggcggtgatgaagggcgcatggacatgtctccaggaagcatcctccatccccaccctaagggtccgcttcctgaccaagatctaccaccccaatgtggacaagctgggtcgcatctgcctggacattttgaaggacaagtggagccctgccctccagatcaggacagtcctgctcaggcgactcccacccctcggcatgnnnnnnnnnngacatgggaggactccagtactagaggaggggtgtggtgtgtgattggcgactcccaccccttggcagttccaaacatgcaagttttgtctttccatcacctctgctcaccccctctcccccgcctcctccacttcaacagcatacaagccttgatgagcgcgccaaaccctgatgaccctctcgacgaggcggtggcgaggcactggaaggggaacgaggtcgaggccatggacaccgcccgcgcctggactgcccagacaggctctcgtggtgagagccgtcaaccaataccctgcagccccaagggtgaccacaccagttcatggccagagtttaaatattccgtcacgctgctgcttctagtcagcgcaagggggnnnnnnnnnnggctctgcatcgagcccagtcggcaggacaagctctcgtgatgcgtgacatgcaggggggtgagggtgtctcccctccctagccnnnnnnnnnngcaggcctcccgctcacagtgatgcgtagtatgcacggaggtgagggggtctcccctccctagaagccatgcacatgtgcagggggtgggggagacagatcgagctcaccacgagacactccgcctcgctcaagtgccagtgaggattcctgttgttttctcaagagcagtctttgcatcgtcaagctggtgtcaaccagaacagaagtcctggcttggcactgtggggtgtgcagctgttcccgctctgacaagccatccacaaannnnnnnnnntgcatcgtcaagctggtgtcaaccagaacataagtcctggcttggcactgtgtggtgtgcagctgttccctgctctgacaagccatccacaaggcgattatcctcgatgcctccctgtcaagccaccccccgtctttaa

SEQ ID NO: 8425 - DNA, 1278 bp, Chlorella protothecoides
atgcaggttatatggctgcgcacctctgcgttccccgtcacagtggcgtatattatgagtaagggtacagaggccatcgctggaggtcagatcaggcgccacctccctgatcaggagccgagagtcgccacgctgcatcccggcatatgcactgcgcgtgcttcgggcgccggcgcctcgagctggagggtgatctgtcgacgaaacgcaacggccagcgaagttaatgcccaagcatacaattcgcatgatgggtgcgactccccctgctcgggacctcccggcaccgctagcatgtcagcagcggacgagttcgtgtcatacacccggcagctgggatccccattcgtgtctcctgccgaccgcagtgtcgctgatgagtggcttcgaaggttcagggccagccccggggcctggagtgtcacgctggccctgctctcccagccccatgccggcctggcggtgcagctgcaggcctgccaggcactgacatggaagtgcaggaggcagcttgaggagctggggggagagtggggggtggtggtccggggcgtggtggccgccctggcccagctcagtgccctgcctcgatccagccccgtgtccctggcatgctgtgtcacgctggccgccatggcactgcgagtccgagactgggaggagccgctggccctgctgggtcagcacctctccacagcgcagctcctgcacctcttcacggtcctgccgcaagagtgtgaggacgccgagagggagactggtgtcgatcagctcgccgacatccaccctgcgcgcgcccgcctgcgcgcctgggtgccggctgtcctcccctggctcaggagcgtgcacggcaaggagtcgcgtcccgggtctgccatcgaggcttccatcctagcggtcttctctgcatgggtggcctggggctgcctggaggagctcgaggtgggtcaggccgactacttcatcgccgccgcctgcgcctgcctagagccgtccggcaacccatcccgggcccagcaaggcgttgacgtgctggcggaggtgatcgagcgcgcttcgcccaagcagtcggccaccctggaacgactggccctgcagtttgcgagcacggcagcgcggggaccacagggctccaccgccgtcgcctcgttgctggggctgtactgcgcggactccaggaatcagggcgtagtggccgggcgagggaagactggggaatcagggcgtggtggccgggcgagggaagactggggcagccttacgcgaggtgggggatga

SEQ ID NO: 8426 - DNA, 1950 bp, Chlorella protothecoides
  modified_base (22)..(31): a, c, t, g, unknown or other
  modified_base (884)..(893): a, c, t, g, unknown or other
  modified_base (1442)..(1451): a, c, t, g, unknown or other
atggcgccagggacgcttcatnnnnnnnnnncgtcagggtttgcgccggcggctggtgctggaagatggcgccagggacgcttcatcccacccacgatcatcacccccactcgcccgccccacgctgtccaggccgcgccagaggaccgctacacgcgcccgacgtgcaagtggacggtggaagtgtgcgcggcatccccgtcgccccccgagggcgccccggcgcaggcagccgaggccggcggctgccgcgcagctgtgcagtcggccgccctggccgcgcacgtcgcgatcgcggagatggaggacgaggcggcgctggcttccgtgcccggcgcaggggagatgtggggagttgggcagggtgccacccctccccacgcccacgactctcctgcccggccgctgactgcccgtgtggcggccaccaggcggatgaccgcgccagaccactggcaggatgtgcgccacttggagttggaggttccgggcgcggagtacgagccgggcgacgtgttgagcgtgctgccgcgccaggacccggcagcggtcgtggccttcatcgagcgctgcggcgccggccttgcgcctggcacgacggtggaggtgcggcgcctggcgccggggccggaaaccgccgggcccgcgccgcgccacctgcgcctcggcgacctcgtggccggcacgctcgacgtcgccgccgcgtcgccgcgccgcacattcttcgaggtcctgcgcgacgcggcggggtcggggcttgagcgggagcgcctggagtacctctgctccgcggaggggctggaagacctggccacctacaaccagctggaaggcgagcgcggcacctgcgacacccaacgctctcagcgagcgccacggcaccnnnnnnnnnnggtttggtcgtcaggcgtggggcccaatgagtcacaggcacctgttactcccaacgctctcagcgagcgccacggcacctcacgtccgactcacagggcgcacggtgctggaggtgctccaggacttcccctccgcccggccggacctgggctggctgctcaccgccgtgccgcgcctggcgccccgcgccttctccatcgcttcctcccccctggcgcacccgggcgcggcgcacctgaccctggcggtggtcggctgggtgacgcccttcaagcgccggcggcgcggtctctgcagcgcctggctggccgggctgcggccgggggacgagctgccggcctggacgcagcgcggcgcgctgcgcctgcccccagacccggccacccccctggtcctcgtcgggccgggcacgggggtcgcgcccatgcgcgctttcttgcagcaccgcgaggcccagaggcggcacggcgtcccgggtgcccgtgggtcgtgtgctttccggctgtcgagtggtgctgggcggggagcaggtgctctgggtgtggccnnnnnnnnnncggtgcacgtgggtcgtgtgctttccggctgtcgaatggtggagggcggggagcaggtgctctgggtgtggccccggcccgcccgccacatgttctctcaagtgctgtggacgggtctggggcttgggctgggagtcgggagccctggtcatcatctcaacccccccaccccttggaaaagcaggagtggcgcccagcctgctcttcttcggctgccgcaacgtggacaaggactgcctgtatgccgaggagtggggccggctgcgggccggtaacatcctgtccctctactcccttgcggcgtcccgcgaccaagaccacaagatctacgtccaggaccgcatcagggaggcggccgccgccgtgtgggaggccctggacagaggtgggtgaaaagcggggtgttcttaaatgcttctcgccatgcccaggtgcctttgtgctgagggcatccttcagccaagtgcaggacgcttcatggcatccgctcaccgcatga

SEQ ID NO: 8427 - DNA, 390 bp, Chlorella protothecoides
atgcgcatgtcagatcccgcaacccacgacgcggccccattcaagcccacctccccaccagccacccccgctcaccgacaggtcggccttgttaccaatcagcatgatggtcatgttggggttggcatgctgccgcgcgtcctccagccacgaggccaggtggtcaaacgtctcccgcctggtgatgtcatacaccaggagggcccccgcggcgccccggtagtaggaccgggtgatggagcggaaagactcctggcccgccgtgtcccagatttgcagcttgatctgcttgccgtcgatgttgatcatgcgggctccgaactccacgccaatggtgaggtcgtgcacaggctggaagcgcttgtcggtgaactgcagcagcaaacatga

SEQ ID NO: 8428 - DNA, 1170 bp, Chlorella protothecoides
  modified_base (371)..(380): a, c, t, g, unknown or other
atggcaaaccagaccattgccgatgtgtaccagaagagcagtgggctcgccaagtacccttttgagccgtactggccttcaaagaagctgcgaatctgtgtgacaggggctggaggcttcattgcgaggggcgctgtgagcacaccggcgttgcccaatggaccggtgtcgacaggggtgccgaaactgcggacgcctttcgacttggaaccccatccctgcagccacctggccgctcgtctgaagtcggagggccactacattattgcatgtgactggaagcgcaacgagcacatgcaggtgggatcatggtgctgtgtgcctctttgtgtggatccttgtgtgcagatcctgtgcatgctaggctactnnnnnnnnnnagcacatgcaggtgggatcatggtgctgtgcgcctctttgtgtggatcagtgtgtgcagatcctgtgcatgctaggctgcacataggtgcccagtggaggcatggaatcaacctaggacgaccagcgcaactgagcaacccctccgtgcaacgtatatcacaggaggagctcttctgcgacgagttccacctggtggacctgagggagttctcggcctgcgcccgtgtggtgaagggcgctgaccatgtcttcaacctggccgccgacatggggggcatgggcttcatccagagcaatcactccgtcatcttttataacaacaccatgatctccttcaacatgctggaggctgcgaggcaggagggcatccagcgctacttttacgcctcctctgcctgcatctacccggagaaccggcagctggagactgagatcgagggcgggggtctgaaggaggacactgcctggccggcacaggtgtggtgggtttgtctcggggttttgggggtgggaggactgaaacagcatgcagccatggaagtggctggaaccctgaccgggcagggtcggggatggcaggttggggatggaagtgttgcgtcggacaaggtgttgagaggcaaggccctgagggttgctgtggcagctccaggcttcacagacactgcatgctgccaggggcccattccgtgtcaagaaggggcacccctggctgctgtggttggtacggttgtcaaagcacgcgacggtgtccaccccgcacctcaaccgtccacatgcctggcttga

SEQ ID NO: 8429 - DNA, 708 bp, Chlorella protothecoides
atgcagcctgctcgacaccgctgcgaccatgcatctcaatgtttaaccctcgcaggtgtgggaaagtcatgtttgctgctgcagttcaccgacaagcgcttccagcctgtgcacgacctcaccattggcgtggagttcggagcccgcatgatcaacatcgacggcaagcagatcaagctgcaaatctgggacacggcgggccaggagtctttccgctccatcacccggtcctactaccggggcgccgcgggggccctcctggtgtatgacatcaccaggcgggagacgtttgaccacctggcctcgtggctggaggacgcgcggcagcatgccaaccccaacatgaccatcatgctgattggtaacaaggccgacctgtcggtgagcgggggtggctggtggggaggtgggcttgaatggggccgcgtccaccggcgtgccgtgagcacggaggagggtgagcagtttgccaaggagcacggcctggtgttcctggagaccagcgccaagaccgcgctgaacgtggaagaggccttcatcggcaccgcgcgcgccattcacgacaagatcgcctcgggcgtgctggacgtctccaacgagagctacggcatcaaggtcgggtacggcgcgggcggcaacgctggcgcgacagggattgtgcgtcccggggacgcagcggcggcgcccaggtcgggcggctgctgctga

SEQ ID NO: 8430 - DNA, 1938 bp, Chlorella protothecoides
atgcctagctgcacgttgcatgtaatcttttggttgaaagaagaatggtcgcttgcgtggaggaagagggtgtcatggagatggaattcttactaccgtgctgtgcctgcggtgtacaccaaatcggggtggtcgctctcggagatcagagagagtccaacatccacgaggtcgctggataccacacaacagcaatccttgtttcagcttgaatttacaatcatcgcgtgcaatgacgcctgttttcgcgatctccagcctcgcagggtaaggtcgagcatggaggggtgtcggtatggtcggagaaacgcatgcagctgtactcacaggtcgaaacccacacctgcaggaggaatgtcataccgcctggagtgcacggcaatgcgacatggagtcccagggtgggtgcattgctgtgtgcgcccctggagaatggtggtgctctgggcatggcttctagcctttactgatctccattcatactcctcaaagatgactgctcggggaggcgagcatcttggttgctcaagctttaagacattcaagggaggccatggagcgtctgtgcataagtcgccacccaggagggcacatcgaccggtgattccatgtgcaattctgactgttcaggagccctcgactggagtggagttccccctcgtacaaaagttctggtgggcggggggtggtggcagggaacaggctcctgctgggagaggagatgcggtgcatcggggccggcgtacgcaccaagaaagtggccttcctgggcatcaaggtgtatgcggtggcggtgtacgccgaagccgagaaggcggcccgagagctgggcatccgagccaggcaaggattgatgagggaaggagcggtcaaactgaatcttatataccagcctttcatgttggaaagttgtttcctgttgaccccacatcttgtggccaactgccacatgattacatttgcatcatcccatgcaggggtggcttctttgagagcgacgacgattactgctctgctctcctggatggtggtttccacaaagcactgcaggtgtgccgtttggagcaagccggccgactgactcctgtattcttcaagtatacaccttcaaaagtatcagaactgaacaattgtgtcaccagctcactccacaccgcaatcgctggctcatgcatcgcccccgcacccactgctcctcccgcacagatccacctggtccggaatgtggaaggcacccagtttgtcgaggccctggccgaggcattaacgccgcgaatgcgcctgtctggaggcagcgcagcgcctgcagccactatggcgatccacgagtacgctcatgttctggccccgtcggcgctttccctcctcgcagagatggagaagctggagaccttctcctccttcttccaaggccaacaactgagcaaggggtccgtcatcaccctgctctaccgcaccgacgccacgctggacgtcgctctttcctccccggagcggcctgccgacctggccgccgcccgggccagtctgtgcatcaagtctgcctccctgtgcagggcgctgtttgagaccttcctgggggagtccagcgtggtgccagaggcacgggctgtctgggcggccggggctcggcagttgctggcctcagatgaacacagcacgtgccctgtttccatgatgcatgttgttgaacctgcctgcacacctcttacacggagcggaagtggccagatggtggtgagaagggacggatgtacagtaacaggggttggcgacagcatgagatccgccggcgcggtcgcccgccggtcgaccgagccttgggctggtcgtctcccggcatggaggtccccgacctgccgcctcgatgtcatacgctgcgttctcggtctcgaaggggacaaggtgttgttctcgaggccttgcagcggcaattaa

SEQ ID NO: 8431 - DNA, 963 bp, Chlorella protothecoides
atgggtgtcgcagcggtggaacaacctgcatgcctcggcaagtgtgtcgtcccaggcgagcccatagccagccttcctgagacggggactgtgcgagttgggggtggggtgcagcaggctggtcggagcctcatcgctgtcaaggctggggtggtgcagcaggggcctggagacagcctgtgggtctgcaatcgtcagaagaggtgcggacgacggtgcgcccatgaccctcataggtacatcccgaacctgaatgatgcagtggtgggtatcatcacacatcgtcattcagaaaactacacggtggacattgggggcccaggaccggccttcctcccagtgctggcgtttgagggtgtggcacgacgaaatcgaccaaacctccaggtattttatgcatgtgtgttgcaggttcatgcctggaccgacgagggaggctcaaatgtgtcgcatgctctgctggggttgagcttgaatgggcaaggctatgcttgtgaggtgcagcatagtctgctcactcacgcgtccctgagcaccgcaggtcggagacgtcgtgttttgccgggtggaggaggcggctcgcgacctcgacccagtgctgacatgcatggatactgccggcaaggtgcgtgcaaaagtttgttcaaaggatgggaggcgccacagcgggcctcaacacctgccaaaagatactgccacctgactctccacccacaacaccaacttcccccgccaggcggccggcttcggcccactgaagggtggaaccctgttccaggtttccacctcccacgcacgcaccctggcgtctggtccgcctttcctcgcggcgcttgggcgctctctgaagttcgagctggccgtgggggcaaacgggcgggtgtgggtggatgcgccggggcccgccaacctggccctcgtggctcgcctggccaggcaggccgaggagctcgatgctgctga

SEQ ID NO: 8432 - DNA, 1089 bp, Chlorella protothecoides
atgtccgagtacgactggaccgatttattgagctcccagtcctgggagcctgacctcgagccgttgggaccttgcccagcccccgaggctcacctgccacacccaccctccgctcttgcgtcatgtcaagaggatgatgaggacctgtcccccccagcgtccaccattctaaaccccgccacacaacccctgatcgctgggcctcccagcgacctgcctgtcgccctggacgccgagcccgtgcccagcacggggcgaagcaccacgtgcaccgcaaagaccgccgaggagcgggtggcgcgccagcgcgagcgcaacaagctggcgcagaagcggtaccgtgcccgcaagcaggctgcatcccaggcccgggggatgagtctggcccaggcccgggaggcgctggtcgccgcccgcgccgaggcggcggtgctcgcctcccagcatggcatcctggagcgcctgctggcggtgcatgacgccagcctgagcatcctgggcgagcaccggaaccacagcgcctgccccgcctgcaactacgcggagccgggcatcaccccgggccagctggccgtgctgcacgccgtctgcggcgacggcgagcgctggcggggctgggcgctgggccccgacgatgcccggcacttcgccgcgctgagccccgaggtggtgaccgagcgctggctgggcaggcggcgcacgctggtcgacgtctgcgaccagctggtccagcgtgggggccgctgcccagccctggaggcccacctccagagcgttctggacgagggggcatgtctcgagagcaggaagcagcgggcgctgaggtatcacagcatggcagcaaaggtttgctggccgcaagtgtctacaagggcaaccctagggcaagtacagcttggaagcctccacgcacctctgaagcgccgccggcaaggcctgcccccacctggcatgcagaggttgctgatgtggcgcgtggcgcactacctgcccggccgcctggcggaggtggggcgaatgaggagggacgcgcccagcgaccactgggagaacgtcgtcgtgagtcagcaggggaggcctgatgtttga

SEQ ID NO: 8433 - DNA, 1341 bp, Chlorella protothecoides
atgtcggcccttcacatggacgcccgtccgctttctgcggatttggaccttttcatggacaccctgccggtcctgccctacgacagcttcacccagggccacaacatattcttccatgagggactgcaggcggactcgcccctggactccgggagcctagaagcgtcggggagtggcggggcccagtcctccgaatcccccacggccgtgatccaggacgaccacaagtctgggtccagcaagccgcggggcggcaagaagggcggcaccaagggcaaggaccaggagcagctggagcgcatccgtgctaagaacaggagggcacagagcaggtatcgcgccaagctgaaggcacaggcgcaggacaccgtccagagccacgatcaggtggcggacgagcttgcgcggctgcgactggagaacgcggcgctggcgcactccaacgacctgatggaccgcgtgctgacggtgcgggaggattacatggcgagcctgaagggcggtgccgaggacgccgccctcggcgatgccgtccccggcttcggcactgtcaccgactcgcgacggccgccctcggcgccgtacccggggcactcgcccgaggccgacgcggcggcgcggcaggcggccgccacctgcggcgtcacgggcctgtcggccgcggaggtggccaagatcaagtgctccgacccggcggccgtggtggcggcctggcaggcgctggtgccgcggctggaggacgcgctgacgcagctgcgcggcgcacgcgacgccgactcccgtgcgctggcctggaccggcatccaggaggcgctgcacgacgcgcgcatgtactgcttcgagcacgcggtgtacaagccgcacaacatccagcagctgctgggcgccaacctgggcgtgggccgcgacggagacggcccgggccccgaccactgggccttcgtggccgccgagctggagctggatgaggcccagcgcgccgcgctggccccgctgcgcgacgtcttcctgcgccgcatctcccgtgtcatggcggagcggcgcgccgtgctgggcgcactggccgccgccacgccggccagcagcctggcggcgctgcagcagtccaccgccgactggctgcgcgtgaacgccgccacctcggagttgtccgccaacctgcagcaggagcacatggtgtgcatggagtttgtgtcgcggggcttcggcggagtgctaacccccctgcaggtgcgtcggtgtttgggaggcaagtgtggtgtgttggaagggggggtggcgctgggcagggcgccaggcgggggtggatcaaggcagggaggcatggagtcagcatggtga

SEQ ID NO: 8434 - DNA, 1818 bp, Chlorella protothecoides
atgagcccctcatgctgcacctcgacatgcctctgcgtggccccgctgtgcaggtgcctgccgaatcaagagagctggcctcaggtctgggcagaggcccaggcggcccggcgactccagacccccgacgcaggaggagagggggcagccccgcggcccgggccagaggccgagcctgagacggcgcggggtgaccccccccccgcaaccaccgtgcaaggggaggccgcgaccgagcccggcgaggcgctcgccgcagggtccgcggaggaggacttcatcaggctgctgaacgagcctgccggggagccggcggaggctgtcggggatctcacgcaggcgctggatgcggggctggaaggggcggacgctgctgccgcactggcgccctctccaaagtctgataccgatgtcgtttccctggcagccgtcccgcaggcctcgcctgggccggaggcacgtgctcagggaggcgcggcgctcccgcccggactggcccagtccaccgtccctggcctgacaccgagcgatgcgccggaggcggtcgacgcggtgctcgaggcagcaatggattcatcccccgtcgaacggaccgcggccccagattctatcgccacggatcccgcggcgggccccgtcaccaccgccgctgccgccctcccgcccagccccgcgctgtgcacgctgggcatgcacggggccggcgtgaggctacgcacgctgtccatctcgctggacggcctgctggactacaacctgtcggacacgggggcgggcaccttcgagctgtccctgctggcggaggcgctggccgacgcgctagccctgcgctacagcggcatcatcatcggggcgctgcggcgggacggccaagcccgcacgcgggcggcgcgcgcgcagcgcaagcgcgcgcgcgcaggcgaggaggccggcgcggggaagcgcgaaagggccgagggggcgcatgggacagcggagacggcggcaggaggagggaatcctgaggccgaggccgacctcgacctgaacacgccgccgctcgcagaagtgacggcagtgctagcaactgagcaggtgcacgtgaacgcaggctcgcatgcgaaagcgggagcagccgcaaaggaggcgtcgatcgatggggcggcagccgatgtggaggcggcgctgcacgcgaggacggcacccggggcggaagtggggcctgaatcgaacgaagcacccgctgcagaggtggcaacaccggcagagctgcccctcccagtgctggtcgacgtcgggcccgagtccagcgagcctcttgccgcactgagtccgggaccgtcgccactcggccctggtccgctggcaagcgagctgcccagcggcgcggaatcgggcgtttggggtgtaacccccgcatctccgggcgcggtggagctcgaagtggaggcacccggagacaaatccacgaccggcgagcccggcgggtcggacctcggcggggacctggcaggcctctttcaggacgacgatttcgtgtttgcggagcggctgcgcagccagggcgggatggaggtcgccgccgaggaggacgccgcgtccgcgccagtgcagcccggcgagggtggaaacggcggcgcgcacttgaacgaccaggacctcgccgtctccctgaccatggccttccgctactttgacgctggagggaagggctacctcgggtgggtggcggactgggggtgggcggctgagatcgatacccctgggctgggtaaaccccggtatacatgcgtagacagggccgaagctcacgctggtgatgagatgacactatcttaa

SEQ ID NO: 8435 - DNA, 780 bp, Chlorella protothecoides
atgaacctcaccaagtgtccagcatccacgcccatcccccttcccacccccacaatccttccacccaggctggggctggacgtgtcgcctatcgagggcggcctgcccggcacccgcttcacggtgcgccgcgctttcctgctcgaggacggcatggcggcgctgctgcgtctggacgccgcggcactcaaggcccgctgcgcggtcacgtttgtggatgcgctgggccgggaggaggcgggcattgacgccggcggcctgcagaaggagtttctggagtgcttcgtggcggcgggcgtggacccccgccgcggcctcttctccgccgtgccggggacgggggcggtgtaccccaaccccctggcagcgcagctggagggcggctggctggcgctggaggccctgggctctgccctcgggaaagcgctgtacgagggtctgctcctggatgcgcccctggcgcccttcttcctccgacgactccagggtcacgttccgcagctggaggacttgattgcgcttgaccccggggtgcaccgctccctgctcctggtcaagcagtatgacggcgatacgctggacagcatgtccctcgacttcacggcggagactgaggttttcggcaggagggttggcgaggagctggtcccagggggggccaacgttcccgtgaccctggccaaccgcctcctgtacgtgcactccatggcgcactggcacctttcgcggcggttgggcccggctgcgggggcatttgcccgcggcttccagaaggtgtga

SEQ ID NO: 8436 - DNA, 3714 bp, Chlorella protothecoides
  modified_base (584)..(593): a, c, t, g, unknown or other
  modified_base (1226)..(1235): a, c, t, g, unknown or other
  modified_base (1736)..(1745): a, c, t, g, unknown or other
  modified_base (1849)..(1858): a, c, t, g, unknown or other
  modified_base (3228)..(3237): a, c, t, g, unknown or other
cgggcagagagtgcagggagtcgagggatgggagtgggggcgcaggtgtgccgtgtcctaggctgccggtgggagggccggtggatgagtgagcgctgccctgcgaggctggcctggcggcacaggcctcccaaccccagcgccatgactgggaacggtcgctcgctgatggggggaaagacaggacctgcagcaggcagtcagatgaggggggtgctcactgactccctcccatacccgactccaccaccttccccagagccgaccggcgagacctccgactgcagcagcaccctccccgaatccttttccagcgtgacgctgtgcaattccacggtcactcgccaggccccactgccccccttcccacacggacaacccggcttcattcccaaggtgcgtgcctgggtgggtgggtcagtgtctgctgcctgcaggggcagcattggtatggggaagggagacgtggtattcgacacgatcctgctctgtttggggggggcaagctactcatgcgtgcaagagggcccagtcaggcactgggtggctgtcaagccctgcaaggaaccctggtgtgcgtgcgnnnnnnnnnnaggcgggtgggtgggtcggtgtctgctgcgtgcaggggctgcattggtatggggaagggagacgtggtacttgacacgatcctgctctggtttgggggggcaagctactcatccgtgcaagagggcccaatcaggcactgggtggctgtcgagccctgcaaggaaccctggtgtgcgtgcggagactggcgtgggcggcatgatgtcaggcggagcgcatcgggccgattgctgggtcccatggtgcccccgtttcctcccctcccgtcttggagcgcccgctcagcgcagcaccaaaaaccccacacgcttgatcgcacagatcgtgccggggacgaagatgggcaagcacgcgccgagcggctttccaaccctcggcacgctctccgtggccggcaagattgagaatgcaaagtgctcggtctttgggatgcactccaagcggccctccctcatcctggcaatcaaggtgggggggggggagtgggagatcaggggcgtggggatgtgcgatggctctgcaggcagtcatgcctgggcgggggcgagtcgagcagtgcctttcgctgcgtcggacggccgccctcaagtccccgccgttgcggcccatcgctcctctctgcaggcccccgnnnnnnnnnntgtcggacggccgccctcgagtccccgccctcacggcccatcgctcctctctgcaggcccccgccgttgccgtgacgcccacagccgagaccctggcccctcacgttattggaagccgggtctggatccgctggccatatttgacagaggggctcatctcatgcatcggggacgagaccggcagggtgagcggagtgttgggtgctctggggcggccccttggggactgactttggtcgccagcaagccccatggagctgtggtgcgggcgcagtcgcaccctgggaagatgggtatcttgaaaaaactgtgcaatcagctcggcccccgcatgtctaccccaggtgcccgctgcgggggccccggtgatcgtggacccagcgtggaaggagaatgtggaggcccagaggatcgagttcctggagaaaagggtgcgtgcatgcgtcaagcggtggttggaggaatgcgggcggatgggtatgctgtcgcgaaccctctgcnnnnnnnnnntacgccgacggcagcttcgccaagagcttcgcggagaagggggaactggtgccgctgcagctggcactgcggagcaacccctcccccgacccccgcttcgaccnnnnnnnnnnaatcaagttcctggagaagagggtgcgtgcgtgcgtcaagcggtggttggagggatgcggacggatgggtatgctgtcgcgaaccctctgctgggagacaaggcagtgggccgcaggcatggggagtgggcctgccgctgctagagagcacggtggcttggcctgagccttgcgccggcaggccagcgaggcattcacctgatgtgagcctgcccaacacctcctggggcgagcggcgagtcgcggcccgagcaacacgggagccacggagtcttcccccccctctcacactcccgccagggcgtggacatcgggcccagccccctgtgggtggaagtgcgtccgctggaggtgctggtgcgccacgtcgacggcagcttcgccaagagctttgcggagaaaggggagctggtgccgctgcagctggcactgcggcgcaacccctcccccgacccccgcttcgacccggacgcgctgcaggcgggcgcggcgctgttcgagcccggcagccgcgcggtggttggcaaggggccctactacggctgcctggcgcgggttctgggcccgggcgccggaggggaggtcgggccgggaccgcggcgcgcgatgagcgtcagcgtcgagccgccgccccccaccgccgccagcgcggccaagaccgcgctggcgctgctgggaggggggccgccgcgttactgccccgcccaccaggcggccaagcaggtcggcatcagcccgagcgccctgggccggatcgcagggttcagggccacagctggggggatcaggacggcggccctgtgccgatcccctctccttcagcctgcctggcgcccgcgcccgctgcactgcccactgccccctccccccttgcctcgccaccgccgccaggctcgctgtaccttgtgattggggagagcaggagggaccggctggacgtcggcctttgcgtgcggaatgccaagctgggcctgtgcgtcccggatgcggtgaggtttgtgccgcccaagcagccgccgccgcggccgcaggctgtgggggaaggacccccggcgcccgtgcccaagggtgaggagcgggcaggggaagggggcgttgggcaggggagggtgcaggtgtgttcagcgtcgaggccggctcgagccactgcactgcgctcatgtcaggggagcctggcgtgctctggtgggaatgtacgcgggatgcctccgcacgtcgggccgacctggacactcgcgcccatgtttgtggcgatcagagtgggacatgggatcgcaaagacggggtcctcttgtctctggccaccccagcctctctcggcagcacagtccgggggaacccatccgccaaacatcctcacccgcccaccnnnnnnnnnncctcggcatcacagaccggggggaaccatccgccaaacatcctcacccgcccaccctccttgccccacaaccaccccaggatcttgggagtactccgaggcgctgatcaagctgctgaagtcgtacaaggtcaaggccccctggctgtgggccgccgtggagcaggatgccaaggcctttgagctggacgcctccagggtctgccccggcgagacgcccgaggagcgcctggccgccgcggagggcctgcacgcctggctcaagcgccagcccatggcccggcggcccctggtgtcgcaggacgcggccgtcgcgccggaggcggcggtgcgcatgctccagggcgcgctgcccccgcccgggcccccggggccggcggtggagctgaccaacgtgcagccacacatgctcatccctcccagcgaccagggccacgtggtgtacgccgaggcaggcgagtggaatgcgggcagatga

SEQ ID NO: 8437 - DNA, 726 bp, Chlorella protothecoides
  modified_base (519)..(528): a, c, t, g, unknown or other
atgggaaccaggtgcgaaccctgtggtcatcttgctggtccaggagtattcgggaattgggctgcgtgcatgacaggtgttgttgtcttattcagaggcatggcagcgcagcttagagctccaaacggggctatgctttctgctgagtttggtgtgcgcagcggcagacatacctctgggtttgcctgtcaagaggccccatgcctgtcctcggacttaattagccgatcatccactagcaaccactttacaccatttctggacttgcagtgggctaagctagcccagttcgttccagggaggaccgacaatgccttgaagaatcattggaactccacactgcggcgcaagactccagttccgctgccaacacatccctctgtgccaccattcctcctctccccatcgcctcaggtggagcaaggggaattcttaggcctcaggccctgggtggaccgaccaggcgacagtcaaggtaagctttgtcgagacagccaggctttgtacaagcaggagatnnnnnnnnnnccaggcgacagtcaaggtaagctttgtcgaaacagccaggctccgtgcgtgcaggagacgcgctcatcgatggcatggatggccagtgctgggtcggggatctgcacgatgggagcaagcggggtgacctgccccgagaggaccttcatgcacagagagacgcacccgggtgtctctgcggccgaagtcccgcgctga

SEQ ID NO: 8438 - DNA, 825 bp, Chlorella protothecoides
atgccagccatcgcgaaacagacttgcgagcgtggtcgacatagagaaacctccatcatgccccaagacagccccacaaagggtggcgcagggagattagggcgagggaagcgaagacgatcggaaccggctggaggcgtcgaccggtcggcagccaggtccatggaggagcccatccgaaggagttcgcggggggcttggaccaaggaggaggtgaggggctcccttgggaatggtgatcaggggagtgtgctgtggccgttcacctggtctgtgaccccccgacgcccaggactgagacaagtctgcactttgtatgagcaggacgccatgctgacggagcatgtggcaaccaatggacctggcagctgggggcatatagcgccgcttccctctgctttcatggttggctcactcgtcgaatccaccctccttgtgcaactctctccggctaattattccccactcccctcgcatatgctcatgctttcagctatgctactgcccaatcgaacggaagcccagtgtttccatcgctggcaaaaagtgctgaaccctgaggtctgcaagggaccctggacgaaacaggacaggagatgttcatacagtggagtgtgccagcatcctcctgcacgatctcgtcctcagacggcgactctttgaagaccaactcattctgaggttggtcgaccattacggtgccaagcaatggaccttggtggcaggccaccttcagggtcggctggggaagcagtgccgggagcgctggcacaaccacctgaacccagccatcaagcacggaaactggactcaggaagaggatga

SEQ ID NO: 8439 - DNA, 438 bp, Chlorella protothecoides
atggggttgttggtgctcctccagtcgctcccagggacccacccctgttgccatgccacacgaggccacgctccctccacccacatctcccatgtcccttcacacacaccaacacatcccctccgaggctcgagcaccccctaccccctccccaccgatgagctcgccgcccgagtccaggagcgggcccccgctgttgcccgggttgatggcggcatcggtctggatgacgtcctggatggggcgccccgtggcgccagggatctctcgccccgtcccgctgatcacgcccgtggtcagcgtgtgatccaggccaaaggggttgccgatggcaaacacgcgctggcccaccttgaggttggcggagctgccgatcttcaggggggtcaccgacttctgtgttgtgttgattggggggtggaagaaggcgggatctga

SEQ ID NO: 8440 - DNA, 504 bp, Chlorella protothecoides
atgtttaccctcggcagcccccaatcccctgatcccggccctgccatgtctcacacacactcgtttccaacctcccagatgcccttcccatccccaatgcatacacactccctgcccacccaacccccaggcggcgtgctgcccctgcccctgatcaagaacaagaagacggtgaacccccgtgactccggctccacccccgtcttccagctagagacggccatgggtgcggccatcgagtgcttcgacgactccggcgcggtggtggtgccgcgctcgcgcttcgccccggtcaaaacctgcgcggacctgctggtcctgcgctccgatgcctacaagatcacgcaggccagcaccgtggagctcagtgacgtggcggcgcccgccgtgaagctggacgacgctcactacaagtcggtggagggggtggggcagggagcagcgggtgcagcagccgcggtgcgtgtgggtggtgctgagcatggtccagcttctgctctgtga

SEQ ID NO: 8441 - DNA, 873 bp, Chlorella protothecoides
atgtctgggcggctctttgggtgtttttgccgagcaaccccgggagcggtcacggttccattcccccgtccacgcgctcgacttgctggattgatacagcatcattcgacagcatcgcgctcaggcctattcgacccatccgtgacatctttcagtgggccctggaccctcaccagtgctcgtggagcacggactggggctgtggcaggcacctctgccagcatggcaggcagcacctccgccagcatggcaggcagtgaggatcccctcattcagtacatcatcatccgagaggatctatggaaggagcaggcctggagcctgggcagtgtgatggcgcaggggtgccatgctgctgtggcagcagtgtgggagagcaagggagcaaagtccacagaggagtactgcagttccgcaaacatcgactccatgcgcaaggtgtgcactgagggccattggggccgggccggtagtgtatggaggattccaagtgatctgcatgccaatatgcacggatttaaatgcactggccgtccccttgcacttgagagctgcacccacaatttcactttctggcatgtcgagcccttcgacctggagtcatctgcccacccttggcccgtttcccctgtgtcctgttaccaggtggtgctccaggtgccaaacgaagcacagctcctaaaaactgcaacatccctggagtcggctggcatcgctcacaaggtgtggatggagcagccagaggccatcccgacctgcatagcaaccacaccgcagctaaaatcgattgtgggatctgcactgaaaaggcttcccctctgtaaacggccgctttacatgagcagggggaggggtgatggtggggaattatag

SEQ ID NO: 8442 - DNA, 1317 bp, Chlorella protothecoides
  modified_base (1154)..(1163): a, c, t, g, unknown or other
atggacagcatcgagcccgtggcctcccgcgtgccctacatggtgggcatcggcaaccacgagtacgactgggagcacaagaactcgcacgagcccgacgcatcgggcgcggacctgccgtacgcccccgactggggcaactttggcaacgactccggcggcgagtgcggcgtggccgcggccaagcacttcatgatgccctcctttgccgagcgtgggtactgggcccccggcgccaacgcgggcaacgcgagcctggggcccgacgggtgccgcaaccccaccctggaccgtatgccgggggcggtgccctcgcccgatgcggcgccagcggcgggggccggcgcggacgcggcgtgcggcgcggccaaccacggcggcctggcgcccaaccctcccttctggtactcctttggccagggcccagtgcacttcctgaccatctccacggagcacgacctctcaccccactcccagcagtacaaggtgggtggggtggtggggagtgtacgaggggttgcgagtctcggggaggtcgagggaaggcgtgggaggggaacttgctggccggccctgggatccactggcaggaccagccaggaggcatgtgacccggccaaggaattggctttacctcccaatcatggcccgtttgacttgacctggctgggagcgacgctcccacccctggggttgcgagtcttgggtgggtggagggaaggcgcgggaggggaacctgctggccagccccgggacccagtggcaggaccagccaggaggcctgtggcccggccagggagctggcgttacctcccactcatggcccgtgtgactggaccaggggtgggagcgacgctcccaccgctggtccttccaggggtggcccgtctcttcttgacacccaacccttcccccctcccaaacaccacgcagtggatcaagcgggacctggcacgcgtggaccgctgcaccacgccctgggtggtggtgggcatgcaccggcccatggggcctgggtgtcggcggtggggagtcagtggtgaaaccctggaaggcaacggccgcgccaccgcgtacccagcgcgtgccctctgggccccccatgtgaccgcatcaccatgcgtgtgctcacctgcggccccgcgccccacggnnnnnnnnnnatcgtgggccagcacctcaggtgaggccctaggtctggtggtgaggaggaggggggccctgggagccggcggcggggagtcggtggtgaagccctggaaggcgacggccacaccactgcgtacccagcgcgtgccctctgggccccccacgtga

SEQ ID NO: 8443 - DNA, 1008 bp, Chlorella protothecoides
  modified_base (149)..(158): a, c, t, g, unknown or other
  modified_base (539)..(548): a, c, t, g, unknown or other
  modified_base (605)..(755): a, c, t, g, unknown or other
  modified_base (922)..(931): a, c, t, g, unknown or other
atgcctccatctaaacgacctcaggtcaagcacgggtcgtcggtgttcttccgtgccccctccgcgccctcccccgacgctggcctaaagttcatcgcctttggggacatgggagaatctgagcaccgcgctgccaagtcccctggatnnnnnnnnnntcttgaagaccatcctgtccaaggaggcactgcccctgacaatgggatgatcttctccgatgaggacccagctgctgtctcagacaccgcagactgcctcaaggacgaggtggaggccggcgcggagctgatctaccacattggtgacctggcgtatgccaacggccacaagacggtgtgtatggatggggggttgcgtgcctgtccccactgcccgtatgctgaacaggaaacccgtgtcattgacactgctggtagccgcaggggctgttgttgtggccttgttgtacctctggagctggttcctgcaagggaagcccccagaatccgccaccatcatgccatgtaccacgccccacctccaccctgcccccaacctcnnnnnnnnnncggccacaagacggtgtgtatggatgggggtcgagtgcctgtcctcactgcccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacttcatgatgccctcctttgccgagcgcgggtactgggcccccggcgcaaacgcgggcaacgcgagcctgggcccagacgggtgccgcaaccccaccctggaccgcgtgcggggtgcggtgccctcgccggatgcggcgccggcggcaggggccggcgcagatnnnnnnnnnnttgttgtggccttgttgtacctctggagctcgtacctgcaagggaagcccccagaatccggcaccatcatgccatga

SEQ ID NO: 8444 - DNA, 570 bp, Chlorella protothecoides
atggttcagggcaccctgggcctcgtcctgacgctgctgctgatcaccagtgtcgagcgtgtggcctccgtggcccggcccctgcaggacggtctggccatagactcgaatcggcacgactgcgctccccatgagggtgtgaggctcctcgggcacattgcaggggtgccaccacccgcctgcttctctcggctcctggcacaaccaaggtcgcccctgctgcactgccaaagagggtgccccggtggttgcacactccttcaccagcccaccaccctccctcgtcgccgcagctgcccgtcctctgtggcactctggacggcggacgagaatgcccagcctaatgagcctccgcccggggccaatgagctgatagggtcgatgtcatcctacagcagccgggacatgtgctcggcgcccgcgcgggactttgactactccccgctgtccctgcactctgttgtgctgacggatctcgtgccgggggctcgctaccgctacaaggtcggtgcaaggggtgcttggggcggggtgctcagggcaaggaacacaccaaaggcatggggttga

SEQ ID NO: 8445 - DNA, 840 bp, Chlorella protothecoides
atgcagccatgggagctgttcgagaagaagatggagcagaagggatccagccaggccgcgatcggagccttcaggcacaactacgagcagctcgtggcgggtgtcaccggcctgctgccagagtctgacatcgagtctgtgacggagctgccatacctggagtccctgaagagctccagcagcccggacaacctgcaggagctcctgtcccagaccgtggtgctgaagctgaatggcgggctgggcacctccatgggcctggagaaggccaagagcctgctggtggtcaaggacggcaagaccttcctggacctgatcgcggagcagatcaagtacacccgcaagcagtacaagtccaatgtgcgctttgtgctcatgaactccttctcgacctccgatgacaccaaggcatacctcaagcaggcccacaagggtgcgggcgctgggagttgggggctgggctggggctggggtgtgcgcctcctgggccaggaagtctggtcccaaatggacaaggtagagatctcagtgtgcttggcgttctctggcgcagatctgatcgaggaggaggacgtggagctgctgcagaacgcctccaccaaggtcgacgcggcgacgctgaagcccgcagagtatccggagaaccctgacatggagtggtgcgctggatgtggtggggatggcaagcgctggagcgccctaggtggcgggcgctgcctttggggtgatgctgggggtcttgagagctgttcgtgctgcaatgtcaccaggcttggcagcggcatagggccgcgagggtgctatgccatgctccccttactgcatcatcacctgatgtag

SEQ ID NO: 8446 - DNA, 264 bp, Chlorella protothecoides
atgctggacaggctgctcaagaagggactgaaattcctgtttgtcagtaactcagacaacttgggcgccaccctggacctggacctgctggcatactttgcctcctccgacaagtcctttgtcatggaggtggcggagcgcaccgcctcagacaagaagggggggcacctggccaagcgcaagtcggatgggcgtctggtgctgcgcgagagtgcgcagtgccccgacggcgacaaggcggcctttgaggacatctccaagtga

SEQ ID NO: 8447 - DNA, 231 bp, Chlorella protothecoides
atgcatgctccccccgcccaccgtcccggacatgaccaaccccccatgcacatcctcaggctggtgctgggggacatcatcatctccatagacggcgccagggtcaagaccgggtccgacctcttccgcgcgctggacaagcgcagcgtaggggatgcgctggacgtggaggtcctgcgtggcaacgaccgctcccacgtggccatcacgctggcggccagcaacacgtga

SEQ ID NO: 8448 - DNA, 504 bp, Chlorella protothecoides
  modified_base (164)..(173): a, c, t, g, unknown or other
atgtcctcccacccgcacccccccccgcccctcaccccttccatccgcagccaacattggctacgtcatccccacctcggtcgtccgccactttctgcacgactacatgaggtgagagggtcaggggggaggcggggtcgcacaggtgtgcatgctggagctgnnnnnnnnnnactttctgcacgactacatgaggtgagaggcccaaaggggaggtggggtcgcacaggtctgcatgctggagctcgaggtcgaggagccccatcgaatggagccgtggacgggagtctgggcccacgccgcttgcatcctcttgatttcagcacctctcgcacattccccgcacacaggacgggcacctacaccggcttcccctcgctgaacgtggtctggcaggaactggaaagcaggaccctgaggctcgcctgcggcatggggccccagcacaaaggtgtgtgtgtttgtgggccatggagcgaggatgcagacggcaccggcctgtag

SEQ ID NO: 8449 - DNA, 900 bp, Chlorella protothecoides
atgaagccttctctagggctttcatcatggtctgccttgttaagtgcgcggaccggcgaccgtgggtggcctgctgacaggctgggttttcaagatgggcaggcaggcgtgcttggtcttgctcagagccatgcaaggctgctctatgtctgtgaacatgagggactcccgggcccagcagccgagacacattaccacctgaacaatcactcgcccctgaatccccaggtgcgagactatgcgtttgacccagactccggggccatctccagcctgaagttcgacgtgctgggcctgccatccattccccaggccctgctcccctgcagcgccctgcgctgggaggaggtcgtggccgttgcgccacagcgcatcgtcgtgcgcaggggggcggaggcgcgggcggtgcaggagaacgatggctggctggcagaggggatggggatgctgctgggcatcctgggaggcctgggtgaagaggcggaggcggggccgggcgagcggagggctggggaggcagacgcgtaccgctcggaccccgcctaccgggagtggtacgcgcggcacgggcgggactactcccgctattacgggctggacctgcctgtgccgctggaggcggcgcagcgcccgctgccacggcgggatgccgcgccgcgccgcgcggtgccgccgcagcgagccctgcccgcgccgcagacccccagctatgcagaggctttggtgccagggcgtcggactgccgcgcctgcggctgcaacggaaacccagggcgatttgctggaggtcatgcagcagcgcactcgcctggcaaacacccgcggactgccgctccgcgaggcgccgcctgcaagacggagtgccccgaggcaggcacagcaggcacagaggcagcgctga

SEQ ID NO: 8450 - DNA, 2073 bp, Chlorella protothecoides
  modified_base (428)..(437): a, c, t, g, unknown or other
  modified_base (650)..(659): a, c, t, g, unknown or other
  modified_base (894)..(903): a, c, t, g, unknown or other
  modified_base (1442)..(1451): a, c, t, g, unknown or other
  modified_base (1862)..(1871): a, c, t, g, unknown or other
atgcgcaggggtaagctgtggggaacatatgataggagcagtggacgcgtggagggcctcagttctgactctgaggaggtgctggtgcccaccaacggcgatgcaagcggactctaccccattagcatcctggaccccgatgtgcagtatggactgcctgtggtccactactttgacacatttgtggagtatctgacggtgagctcattgacgcgggaagctcaagtgggtggagggaggggaacccttgcagcaaatggcagctgcggtcaaaggggagcctttgcggtttccctcaggctcctcgggtccaatctctcggccccaaagcgtttgcccagtgggcactcgcttgcacctacgagtttcctcacctcaaccccaggtctcccaccaacacctcctgcagagcaagcagggctacacgnnnnnnnnnncacctacgagtttcctcacctcaaccccatccaattccgcgcatgtgccggctctgctggaccggctccgcagcatgcacgcgctgacggggcgccgcgccgacatcctgagccacagcatgggagccctggtcgggctgagtgcgacctgggatgtgatgggcggggaacatcggatcggcctcaataccgatctcctgacgcattgggtgnnnnnnnnnnagaagctggtgcgctgtgggctgggtgggggtcagcaggggctgagtgcggcctgggatgtgatgggtggggaacatcggatcggcctcaatacagatcccctgacgcattggctaggtctcgcgctccaatgacaatgtgccactgttgctggaagagccagtcgcttggcccctgccccgggtttccctctcgctgcttcacctcaccccagattatgccctccccccccctnnnnnnnnnngtcgcttggcccctgccccgggtttccctcccgctacttcacctcaccccagattatgacctcccccccctcccccccttacctttaggtcgagacctggattgcagtggcggcgccattcggcggcgcccccggattcggcagcgacgcgctcctgaccggggtgcagtttgcggggtcgttgggcgcgtacttcttcgtcgaccgcggcacgttccgccaggcctgcgtccagtcgcccgctgtgtacgagttgctgcccccaccgcacttcccgtacgctgcccccgccccggagctgaccctgtggctcaccacacccctgcccggcgggggcgaaggagccgctgccctggcatcgggggccgccgcgcagcccggcacgccggcacggcagtgcgcctcggagcatccccgggcacgcccacgcttggtgcgcagggtggcggtaccctctgcgacccacccttccatgcaccgacccggccccgaggcggcggctgcggaggcggcggctggggtgaggaccctcgggcctnnnnnnnnnnacccctgcccggcgggggcgaaggagccgccgccctgcctttgggggccgccgcgcagccccgcacgccggcgcggcagtgtgcctcggagcaccccccggcccgcccgcgctcggtgcgcagggtggcggtaccctctgcgatccacccttccatgcaccgacccggtccggaggcggcggctgcggaagcggcggctggggtgaggaccctcgggcccgaggaggccccgctcgccagctggcacgaggcgcacgagtacaagtttgcactggaccagctggggggggtgctgcagggggtgctggagggcaacagcgtgagcatcggaggccaggcagtggccatgcccttcaatccggatgtgagtgggtgcagtggagcagggccctggggtgtgccctggggcgnnnnnnnnnngcccttcaatccggatgtgagtgggtgcagagggacagggccctggggcgtgtcctggggccgagggctcgggaggggggtgctgctggtgggtgttcgagcctggacagcattgattgcacgtctgcagctggtatggatggcaggcgtgaggcgtgcagcagcgcacatggctgttgccatgggagagagtcttgagtag

SEQ ID NO: 8451 - DNA, 1230 bp, Chlorella protothecoides
  modified_base (916)..(925): a, c, t, g, unknown or other
atgtgcggtcatgcagtgccctggacagtgtatgcattttgggcttgtactggctgtttctgttcaaggaggtgcaggtgtttgtcaccaccccaagcatcaaaaggcccccccccccccactccacccatcacgattgcacacggcccacagccagatggacgtgatcaagttcctcgcggcccggcccgaggccctgggtccactggccgacgcgacgctgggccagctgggggtgctggactccgcccgggaggtggtttcggtggaccccctcacccccaccctggctgcctttgccatgctggcctcacgacagctggcgggcgcgcccgtcgtcgccgacaccggagacctgatcgccaacctgtcgatcagcgatctcagctcctcgagcacgactaccctggcaggacgctgaccggcgagcatctgggggtgctcgcgctgccggtcgcagagttcctggcgctgcggcatgatacgacgtgtgctgcgcccttgcagtctaccgtctccccgcaggccagactaccccattccctctcacacctgtactgcctccgtccctctccccctgactcccatccattcccttcctaccaagcagacattgggtacagcgtgcatacctcctccctggcccaacacgcttacttcaatgccgcgcaccgccagataggccccggcaagaacgacatcgccctgttcacggtcgtgccagcgacaaccttcaaggatctattggccaaggtagggtactgggtgtggggggccggggccttgattgctctgcccatggaaagccatgcgttcctgcaccggactctcagtccatgctcttccaagatgctggcattcttctctttctctgctgggctgggatgttttttcccgcttgcctgcatttgcgtcnnnnnnnnnntcacggtcgtgccagcgacaaccttcaagggtctattggccaagatgctggcgttcttctctttctctgctgggctggaatgtgtttttccgccgcctgcctgcatttgcgttctctcacacatctcttctgaggccctctcagtcctccttcctacctccctcctcacagtttgtggagcgccatgtgcaccgcgtgtatgtggtggagtcgctggagcggcccagggtgtgtgctgtgatcaccctcaccgacgtgctgcgcctggtgaccagcctggcgacatgaccaggctggcggcgtga

SEQ ID NO: 8452 - DNA, 936 bp, Chlorella protothecoides
atggcctccgcctccgaacacgcacggtgcatggaggtattcactcgtcctacctgcattgcatcgcctatggagaggttctgtcgtagtgtgacgatgtcctgcttgggtttgcatagcgcactggttggcgtcttctgcagcagctcgtgcacggctgagtggtcgatcggtggggttgctcaacacgctccgaaaccaggctacagaatcccagtggccatgcccctgcctgggagaggtggcgtgcacgcagcgcgcggaagaggccgtggcagggggtccaagttggacggtttcgctcgagggaagcagagtacctacgacccggtagcacgaagggagaaggagcgtgcgctgaacgccaagaccgtgaacaagtatcgcaagctccagaagcgcctggcagcggccggggagcacgaggcagggcaccgtcatgaggtgagtacagcttggtgtggctgtggaagatgcgaacatcattcaacaccagtacagctgatgtccccgattcggcatgcacagggcgtggacggctctgctggcactctgagtggggcgccttcagcaggcgcactctttcccccagccactgatgcccttggttcccacgggcacggccgccctcgcgtatcggatgatggaaaggaagaaggggaggatgtcaatagtgccgccagatttcctgcagagggacggaagtcgcatggttcacagctgctgcgcctcgctgagaaggtcggtgccacgaaggaggctgctcatcaggaggcagagaccagaagggcggaggcggtggaaaggaaacgcaagctcgcgcaggacaagaaacggcgggcagcaaaacatcagacattaatgaaaaggactggacgaggccagccggtcatgaaacaccgcatcgagatgctcttggacaagctccagtcttga

SEQ ID NO: 8453 - DNA, 936 bp, Chlorella protothecoides
  modified_base (392)..(401): a, c, t, g, unknown or other
atgctggacaatcgcaacgacactgccagacatcagcgtcgcaacggcaagatgagtgatgcaccgccatacaggaccaagcaaggattcctcatgcccaatgggcgtcaaccatcccagcatgcagtattctccaagacacctgcgcgctccccgccccttcctcccaccccagtaaagcctcaagcacgcaccattcgggtttggtttggaggcaggtggaggggtgcagtaatctcgcgaattaaagtctgtagacaccatgttcacgcccagcctctggcagatgcggagctgtgggttagagggggtgatgagggaggtggggcaagtgaggatcaagatttaggacttcaggcacgcaccaggattgcccatttgcacagcccacnnnnnnnnnnacaagtgaggttcaaggcccgtcggaaacatgccgcatcttctactgaaggcccgccacagacacccctcgccccatccccccgtccgccatcgcaccagctgcccccggacattgtccgcagacttgagggcccgtgcgttgaggaagttctggtagcaccagtcggcgtcgccgttgtgctgcttgtaggcgtggtaggcgttgagcagggtgaggtggtccccatcgacatgcgcaaacctggccttggcctcgtcggcggcgcgcgcggcctcgcgcggccgcacgaacacctgtggcacgctcagcgtggcggcgatgctcaggatctcgttggagcagttgaagcggggggaggccaccaccatcttagacagctgggggtccagggggaactcggccatgatggtgccgatgggggtgaggttgccgtcgtcgtccagcgcgcccaggaggtggggaggtatggagctgagccccggtttcagagttggcgtgagtccagtagccgcaaacaggctgctgctagatga

SEQ ID NO: 8454 - DNA, 1470 bp, Chlorella protothecoides
atggcattccgaggggtgtggggcctcggccgtgcgtcgccgggcccgagggtttggccgcccactcccgaccctaaccctgccctgcagatcccccagcgcttcctcatggggcccgggcccggcaactccgaccccagggtcctggccactcagagcctgcccctgctgggccacatggccgcatgctccttggatcatcaccccgatcggtttgccctctcgaccattgtcccccccgtttgcacaaccttgacccgtcctgccccttcacccacccaccccaccccctcaaacatcccccccaggcacccgcccttcttgaagatcatggatgaggtgcggcaggggctgaagtatgtgttccagaccgagagcaactacacgctctgcgtgtctggcacgggccacgcgggcatggagtcgacgctggtaaacctgctggagccgggcgagacgctgctggtggggaacaagggcatctggggcgcgcgcgtggtggacatggcgcggcgcatgggcgtgaacgtggtggacctgaagaaggaggcggggcgcaccttctccctggaggagctgacggcggcggtgaaggagcaccgccctgctgtggtgttcctggttcagggcgactcctccaccggcgtgcaccagagcctggcgggcgtgggcccgatgtgcgcggagcacggcgcgctgctcctggtggacacggtctgctcgctgggcggtgtgcctatgtttgccgacgcctggggcgtggacgccatctactccggctcccagaagtgcctgtccgcgcccccgggcgcggcgcccctcttcctctccgagcgcgcgctggccaaggtgcgcgggcgcaagacccccgtcgcctcctactacttcgatctcaacctggtgggtgactactggggctggtacggctcccgctcctaccaccacaccggcatggtcagcatgtggtacgccatgcgggaggcgctggccatcgtggctgaggaggggctggaggcggggtgggcgcggcacgccgccgcgcatgaccagctctgggcgggcctgaccgagctggggctggagcactttgtgccggcgcctgaggaccgcctggtcaccgtgaacaccatcaaggtgccggagggcgtggactgggccgcgctgtgcaagtttgccatggagcgctacgcggtggagatcgcgggcgggctggggcccaccgccggcaagatctggcgcgtcggcatcatgggctacaacgccaagcccgccaacattgagctggtgctggccgccttcagggacggcttggccgcccagggctgggccaagaatgcatgtggactgatatcaatggcgccgccggagcgatcgaccccgggtgtgaatcggtgccagaaaatttcagagactgggaggggaggcagacaggcagggctcgcctccttatgcagggcagcagggacataa

SEQ ID NO: 8455 - DNA, 990 bp, Chlorella protothecoides
  modified_base (243)..(283): a, c, t, g, unknown or other
atggacgccgcttggacctccctcccccacgttcccgacaaccctggggagaaaatcccgcgccagtgcatggagtggataggtgtggccccccttctgggtcacgccgagagtactatcttgatcgatgcgaatgggacccacctgacaccaacagaccatgctgtaggtagctggagaacctcggtattcatacatggggaaggtcccatgttccacacatgtttctgctgtgcaagtaannnnnnnnnnnnnnnnnnnnnnnnnnnnnnnnnnnnnnnnncactggaacgccaagcagacaggcttgttggggatcttgagatggcattcactcatttgattggtcagatggctaatctccaagatgggcttgctggcaagggtggtcatggcattcagttgcaatgcgttgacaatctggcgaaaactccttgtgagcgatttcacttcgctctggttgcattgcgggtgatagtctggcgaaaactccttgtgagcggtttcacttcgctctggcattcctacagcatgtctgtcctcgcgtgctcctccactcggccagctgccacgccgtgcgtggctgggggccacccccgtgcaaagcccagccgggcgggtcccattaccgctagcctgcgcgtggtcacccccgcattccgccgtgccgacaatgtgcagctgcgatcagtgcgatccagcgccgcgccccaggggcgcacccttggggccactgtggaggccaagaacgtcgccctgctgggagcggccggcggcatcggacagcccctggccctcctgctcaagctgaacccccagatcaccgagctgcgtctttacgatattgccaatgtcaagggagtggcggcggacctttcccacatcaacaccagcgtcaaggtggtgaccatggggtggcagagcggggtgtacctgctcgtgccaggccctggccgcatgcacaggcgaccctcattctgcaagatgtga

SEQ ID NO: 8456 - DNA, 450 bp, Chlorella protothecoides
  modified_base (341)..(400): a, c, t, g, unknown or other
atgaggccccaggtgccgctgtccttgcccgacgctcccactcacaaccaccccctcccctcacagcacctgggacagcaggggcaggatggtctcgccggcgtgcccaccgatgacgggcacctggacgtcaacgacgtccaggcccttggcctccgcgacaaaggtctccgcgcggaccacatccagcgtggtcacgcccagcaccttgcgcttgtcgtacacgccggcggccttcagcgtctcggccgcgatgggcacggtggagttcaccgggttggagatgatgttcaggatggcgccaggggcgtgctgggccacgcccttcgccagcgtcttgnnnnnnnnnnnnnnnnnnnnnnnnnnnnnnnnnnnnnnnnnnnnnnnnnnnnnnnnnnnncaggtcgtcgcgggtcatgccgggcttgcgtggcacgccggcggggatga

SEQ ID NO: 8457 - DNA, 615 bp, Chlorella protothecoides
  modified_base (391)..(400): a, c, t, g, unknown or other
atgagtgaatctcgccctgctcggtctgcggacgctcaccagcccagcaccactgctccgcaggccaccccctctgtcgcgttctcgaaggcggaggcggcagccctcacgcagcggatacagaatgcgggcaccgaggtggtggaggccaaggctggagccgggtcagccaccctttccatggtgagtgaaagggtggagatgggcgtggttgagtttcagctgcgctggaagctcccctccaacgtgcaccaggcatatgccgctgcacgctttgcggagtctgtgctgctggcgctgaacggcgaaaaggatgttgttgagtgcacatttgtggagtctgacgtccaccctgacttcaagttttttgccagcaagggtgcagcaccannnnnnnnnnttgtttgtgagcatctcttgccaggggcaatgccagatatggtcatcctcaactgccctactcgaatgttccaggtcgtgctgggccccaatggcgtcgaggacttcctgccgctcggcgagctctcacctgctgagcaggccggtctggacggcatgaacgagctgctgaccaagaacatcaagactggcatcgagtttgcgaacaaggcttga

SEQ ID NO: 8458 - DNA, 777 bp, Chlorella protothecoides
atggtgggcgtgaactctgggccggctcgcgccaggccgcatgcatgtgcgaacaggaccacaccgctggtcatcgctggtgacccatgcaccggctttcctgaccccggcgctgtgatggtacgacctcctcgctctcctcgtcatccgcctgccgcagacaagttcaagctcgccaaggagtggggagcgacaaagtgcatcaaccccaaggaccatgacaagcccatccagcaggtcctgatcgagagctcccccgatggctgggggtacgacgcgaccttcgagtgcatcgggcacgtggaggtgatgaaggcggcgctggaggcggcccatcgcggctggggccagtccgtcgtcatcggcgtggcagccgccggccaggagttgcacacccgccctttccagctggtcaccgggcggcaatggaagggcaccgcctttggagggtacaagtcgcgggagcaggtgagggcggctgaggacctgcttttgctgctgtggggagtccctgggcttgtcgagctgtacctcaagggtgagaccaagctggacaagccgagccagcgaaccagggacgatgggacggtgaagcaggtgcaagcctgctacaatcgccttgctccaccttctcggggtgaggtctcagctgctgcatgggagccccatgaagttctgcatttgtccttcttatacagacacgggcttgggatctggaagggcgtcacgccaaacatgaaggactggacgggggttggggctggacggtgccgctag

SEQ ID NO: 8459 - DNA, 1182 bp, Chlorella protothecoides
  modified_base (705)..(714): a, c, t, g, unknown or other
atggtggtgagttctccgggtagtggatgtttcggaccgagcgctgggaagaacccggccgccatcgcgtgggatgcgaagcagcccctggaggtggccaccgtgagcgtggaccctccccaggcaggcgaggtccggatccgcatcatggccaccgctctctgccacaccgactcctacaccctggatggtcatgacccagagggtctattcccttgcatcctgggacacgaagctgccggcatcgtggagagtgtgggagagggtgtgacctacctcgccgtaggtgtgtatggggctgcggggcctgcagctgctgaagaggcatggactgatctcagggcttggatacgggggcttggatgcggggtactaggcatccaccttttgaccaactgccaaaagtatggccctgaccttgcacaggcgattcgccgtccgccagtacaccgggaagggtgtgatgaaggcagatgggaagaccaggttccactgcaggggaaaggacatctaccacttcatgggcacctccactttctcaggtggggtaaggcaatgccccccggaaacctggcagcactatccttttgcacaccccagccagcacatcttcctgagcagaccgcatgcagcaagcgagaattgttcacattttccgtgaggcgatgctggggggcccccctcacccacaactctcactccccnnnnnnnnnntcatgggcacctccactttctcaggtgggggaaggcaacgcccccggaagcctgccagcacatcttcctgggcagaccgcatgcagcaagcgagaattgttcacattctccgcgaggcgatgctggcggggccccctcacacacacctctcactcccgaccccccactccagagtacactgtggtgcacgaagtgtcggtggccaagatcaaccccgaggcgcccctggagaaggtttgcctgctcggatgcggtgtggccaccgggtggggggcggtgtacaacaccgccgaggtcaagcccggccagtctgtcgcggtgtttggcttgggctccgtgggtctggccgtcatcgaggccgcgcagcgcgctggtgccacggagatcgtggccatcgacacgaacccgggtgggtgcggggggtgggggtccgcaagcgtatccctctgtgcgatgggtggcagctga

SEQ ID NO: 8460 - DNA, 837 bp, Chlorella protothecoides
atgcgcgtgctcgtggcagtgaagcgagtcatcgattacaatgcccggggatgtatgccaggatacagcctactcatcagtgccttcctccgcctccgcacccttccatccccaccctttgcaggcatgaaccccttctgcgagattgcggtggaagaggcggtgaagctgaaggagggcggctccgccagcgaggtcgtggcggtgaccatcgggcccaaggcggcgggggacacgctccgtaccgcgctggccatgggcgctgaccgcggcgtgcacgtgctggaggacggcgaggtgcagcccctggccgttgccaagctgctggcggcgctgacgaggcgtgaggaggccacgctgtgcatgctgggcaagcaggccattgacgacgactccaaccagaccggccagggcctggcggggctgctcggctggccgcaggcgacctttgcctccaaggtggttatggacagggaggcaggcagggccagcgtcacgcgggaggtgaggcctgggaagcagttgggagtggaaagggcacagagtatggatcccgcctgcctgcatcccaaggtataccgtctccccggccacactcccatctgtcaagtgctgatacaggtggacggcggcctggagacgctatcgctcaagctgccagccgtgatcacggccgacctgcgcttgaacgagcctcggtacgccacgctgccaaacataatgaaggccaagaagaaaaaggtcgacacggtgactgcacaggtagcgcgggcggcagatgttcaccgggtgtgctttgttggtgtgtggggggggacctccaccttggtcgcgtaa

SEQ ID NO: 8461 - DNA, 324 bp, Chlorella protothecoides
atgagccctgagcctgacgtgctatgcctcaagcagacccctctcccacccctgcctgcagacactgtcaaggtccggctgcagacccagtccaacaccaagcccatttacagcggcgccctggactgcttcaagaagactctgcagtgggagggcgtcaagggcctgtacaagggcatgtcttccccgatggcgggccagatgttcttccgcgccaccttcttcgccgcctttgccgagtccaaggcattactctccaggcagcccgatggcagcatgaaggtcctgacagacatggacctgttcaaggtgattggggtctga

SEQ ID NO: 8462 - DNA, 501 bp, Chlorella protothecoides
atgccgtgcatgccagcaagccagggtgtggtgccatgcatgcctgcagaggagggggtctggcatgtccgggacaagtcgtccacaatgtgtaaatcacaaacgcctgactcccgcagggagtgcgtcctgatacgccacccccggcacggggagtacgcctttgggttcatcacgggacagaccaagatgaccactccggagggcgagctggagctattctcggtgtatgttcccaccaaccatgtctatgtgggcgacattttcctcctggccgcccccgacatcatcaggcacaacctctctgtccgagaaggaatagagttccaggcagccatgcatgctcacgtcaccaagctgggccttggtgctcaccagctggtctgttacaattttgtggtgctgcagcaataccttttccttgcccctacgcgccccgcagaggttgtggtgtctgtaggaatggcgttgccaggccacttgcaagccactgggaggtag

SEQ ID NO: 8463 - DNA, 498 bp, Chlorella protothecoides
atggatgtggtgaccgccgaggaggcccgcatcgccgaggaggccggtgccgtggcggtgatggccctggagcgtgtgcccgcggacatccgcaaggatggtggcgtggcccgcatgagcgacccggacatgatcaggtccattaaggccgcggtgaccatccccgtcatggccaaggcccgcatcgggcacttcgtggaggcccagatcctggaggccctgggcgtggactacatcgacgagtccgaggtgctcacccctgccgacgacatccaccacatctccaagcacaacttcaaggtgccctttgtgtgtggctgccgcgacctgggcgaggccctgcgccgcatcgccgagggcgcagccatgatccgcaccaaggtgggagggggtcgcactggtggctggtgggaaggttgggaggggttgcgcatcgacagtcctgttgaggcttgtcatgagagctgggtacctgaagggtcgcggggctcaggctga

SEQ ID NO: 8464 - DNA, 474 bp, Chlorella protothecoides
atggccagctcagcacactcgaggcgggcctctcgcagtcctctgtgctctgtcaatggctcgggatgggctttgcggcaccctgcacccaagggcacgctcagctcgggctcggctgggaggtacccttgccagccactgcaggcgattgccaccaaggaccttcctcgcaccgacgatgatggcgcctatggcgtgttcaggctggagtatgacctggatgcggtttgcgagtatgtcatcacgtttgtccccaccgaagtgaagccggaggtttcccttttacagagaaacccttctgagacgaaaacatggaagaaggtcatcaatgtggccgtcactggtgccgcaggcatgatctccaaccacctcgtcttcatggtgaggctgggtgctacgatgacctgttctgatggaaaggttcgaacttactcgtcaggagggttctgcctcttctctcgtgccagcttctga

SEQ ID NO: 8465 - DNA, 546 bp, Chlorella protothecoides
atggatgaccggtgtccctctgggcactctgagtccacccgtcctcgcgcctgcgcctcgccccgtcctctctcatgccaaatccacacacacactcacactcacacacagggcgaggccgggaccggcaacgtggtggaggcagtgcgccacgcccgcgccgtccagggcgccatccgccagctggcgaccctcgacgaggacgagctgtacgtgtacgccaaggagattcgcgcgcctgtggagctggtgcggcagaccaaggcgctgggccgcctgcccgtggtcaactttgccgcgggcggcgtggccacccccgcggacgccgcgctgatgatgcagctcggcatggacggcgtcttcgtcggctctggcatcttcaagtcgggcgatcccgccaagcgcgcgcgcgccatcgtgcaggccgtcacccattacagcgatgccaagatcctggcggaggtgtcgggcggcctgggcgacgccatggtcgggatcgacgtgcgggagaacggcttcacttcctacgctgcgcgttccgagtga

SEQ ID NO: 8466 - DNA, 396 bp, Chlorella protothecoides
atgacatccaaccccgactttcgcatcggggagtcgctgggcaccatgccaagcacggaccccacacagccaccgcccagcgctctggatgtgctgaccgagcagcgggactacttcctgcaggagctgggagtgagcgaggaggagtacgagtcgatcaaggccgatgtggccgcggacttcgaggccacggtgcgccctctcctggacgctcgcagcgattccggcgaggcccaggcccaggccctggaaagcgtggcgcaggccagcgtgcccgaggaccatgtgcacgccgccgccatcaaggacaagctgggggtgctggagaggaacgcgttctggccccaggcgtccaaactgacctttgcccagaggctggtgaaggccctgagctga

SEQ ID NO: 8467 - DNA, 687 bp, Chlorella protothecoides
atggagcatgaaggcggaatatggccatttatggaagtcaagtgcctcccggtgctcctgcaatgggcagcttatgctgatccccacctgcccgccctacccctggatccacagagggtggcctgccacctcctggaagccatccgcggagtgcacgagggcggtcacctgcactgcgcactcagcccccgcgctttctacaggcgcggccagggcgccgaccacccaggcatgctctggcgcctgtcgggcctcggctccgcccagctgcagtccaaacggcagtgcatgcccagggccgatggggcagggcccggcgcgtacaccgccccaaacctgcacaacccccttgctctgccggaggagcgtgacgaccttatctcctggctgttcattgtggcggagatgctcaccgggaggctgccctggaaggggtctggcgatgagccggggtgcagtgagcaagccatgctgaagctgaagatggaggcggaggcggatcccaaggagttattccccagcgagggggggatggtcatgccgaggggtttctacgccttgcacgagactgtggttcgtggggagccggacgacgggccagactatgccaggatcgagctgctggtggacaggtgcgagggtgcggccaggggctgcctcgcttggaggctgggtgggtgtctctaa

SEQ ID NO: 8468 - DNA, 189 bp, Chlorella protothecoides
atgacgccgcaagcttctgtacccatccgcagcgaggtgctcatgaatcccgaggtgccccaggccctgcgcctgcaagccgtccttgccgggggtgtggtggtcattcagcaccggcaagtgacctacctcctggatgactgcaatgacgctctggtgagtctctcaaaaaattggaggaccgaatga

SEQ ID NO: 8469 - DNA, 315 bp, Chlorella protothecoides
atgggctggctgccacctccctgcccttcctttccccctctcgcaggcagctggtggttccccgtgtctgagctcaaggcactgccccacgccaatgcctcttacacctacgtggacggggacggcaccgtgcccaccgagtccgcgatggccgacggcttcgatgctgtagaaagagtgggcctggtgggggcgcaccgcccgctcatctccatgcagagcgcctgggaccagatcatgacctggatacgggcgggcggggagccagcgggaggggcggtggggggtggcttccagatggtcggtcatccctga

SEQ ID NO: 8470 - DNA, 318 bp, Chlorella protothecoides
atggctcgatcaggatctgtttgtcatgcctgtctgccgctgctgggtggtggccccctcagggccggcatagctcagccgccccgccctcgtcttttcacagaggggctggtgtactccatgcctgcgcggtccaagggtgatggtgactacgagatcatcccgggcttccacatgaatgactggctcatcgaaaagtgcaaggcgagcgaggacgagctgctgaaggagcgggactgcgtgggccaccttctgcccaacgccaccgtggcgcagtgcatgattacggaggatacgatgctgcctggagagaactga

SEQ ID NO: 8471 - DNA, 1569 bp, Chlorella protothecoides
atggcagaacgaaaacgcaagctcgagctgtatgacacacccgcggcgcccaacggcacgcccgcggtgcagtccggtggtgtgaacccctttaccgggcgcccctactcccagcgataccatgagatcctagccggccgtcagggcctgccggtgtggcaggcccggaaggacttcgtggacatgctgggctcccaccagaccatcatcctggtgggcgagaccgggtccggcaagaccacccagatcgcgcagttcatcgcggaggcggggtactgcaccgctggcctcaaggtggcctgcacccagccgcggcgcgtggccgccatgtcggtcgcgcgccgcgtggcggacgagatggatgtgacgctgggggaggaggtgggctactccatccgctttgaggagtgcacgggccctcgcactctggtcaagtttgccaccgacggcatgctactgcgcgaggccatgactgacccgctgctggagaagtactccgtcatcatcctggatgaggcgcatgagcgcaccctggccacagacgtcctcttcggcctgataaaggaggtcctggtcaagcgcaccgacctgaagctggtggtcatgagcgccacgctggaggcggaaaagttccagtcctacttcctggatgcgccgctgatcaaggtgcccgggcgcctgcacccggtggagatcttttacacccaggagccggagcgggactatttggaggcctccatccgtaccgtggtgcaaatacatcagtacgaggccccgggcgacgtgcttgtcttcctgacgggagaggaggagatcgaggacgcctgccggaagatcaccagcgagatcgagcagctgggctccaaggtggggcccatcaaggtgtaccccctgtactccaccctcccgccgcagcagcagcaaaagatcttcgaccaggtcagagggggcgcagcacgagcgtgggcacacgaagatcccttctctgtgcaagtgcccgcatgccggcaccatcacctcgagcgttcaatcccccagcctccattgtcgccgcgccccgccaccttcctcacccctgacgcacccgtccctgccctgccctgttcccaggcgccgggcccgctgaagccgggcggcatccccgggcgcaagatcatcgtctccaccaacatcgccgagacgtcactgaccatcgacggcatcgtgtacgtgattgacccgggcttcgccaagcaaaaggtgtacaacccgcgcatccgtgtcgagtccctgctggtctcgcccatcagccgggcctcggcccaccagcgcgccggccgtgcggggcggaccaagcccggcaagtgcttccggctgtacacggaggcgtcctttggcaaggacctgcaggagcagacctaccctgagatcctgcgcagcaatctggggtcagtcgtgctgcagctcaagaagctgggcattgatgacctggtgagtggtgggcttggagggcaggagggctacgattcaggagtgggaggattgggagagctggttgacatccatcgtttggaaggactgtgtcagtga

SEQ ID NO: 8472 - DNA, 498 bp, Chlorella protothecoides
atgtccctgatgcagccacggcctctttcctgcgccttcatccatgccattccccctgcagatgcgagtggggagctgcagttggtgaggtctgaaaacttcaggccgctgaccctgcctgcacgctctcacggcctgggtgaggctggctgccatgcgggcagcggccaggacaaagtccccagctcagacaacgcagcccgccaaatgcccgcctctggaagcccgccagccccaagcatcgtagaccagattgcggagcggtttgcgtgccagcgcttggaagatgctcccaaggcgcaggatgctgatggcgccgctggcaccgcacccaagggagcagacccgctgcgctggtatggaggcctcgtaccgcatgacatgaggagggcagagaagcactttcagagtgccctgcagctgatgatgcgagcggcaacgttgcggaccaagctggccatgacctttgagacaaggtggtatgagccatctcagtga

SEQ ID NO: 8473 - DNA, 585 bp, Chlorella protothecoides
atgccctccgccggtcccctcccaggagcggcgttgagcggtcgtgtcgagctcgccacccacctctgtcatccgcggcgaaccacaaacagacactttgctccattcctgactgattcgaggcctcgtgatgcgtactcctcaacatttaccccctcagagggccgatctggccagagaggtgcagcgggccgggtgtcggcctcaactccccctactgccctcgttgctgcgccccgcacccccgccctcctccgctcccagctgatggacaaagaggtggtcacccgaacctctggacgccgactggggtatgtgcaccaactgacggtggacccagccaggctggaggtggcagcgctgtacctgcgcaccagccccacggggttgggcgcccaggccacggaccatgtgctgctgtacagcctgcgccagataggcgacgtcatcttggtccatgacgagtcggccctgctggatccacccgccgacgaggccgccggctactgcaagctggtgggagcggagcttgtgtcagagagtggcgtcaagcttgggaaggtgaggggagcgtgtgtctgttga

SEQ ID NO: 8474 - DNA, 474 bp, Chlorella protothecoides
atggcctcaggaagagcacatcggcgctcacttgtccccatccatggagagctcgtagggcgccaccaggatgccgtcccggtcggcgtacagccagtcccccggcgtgaccagggtccccgccacgaccacgggtacgtcccgcaggccagggtcgcgcttggagctcttcagcgggtgggtgttcagggccttgacgccaatctccatgccggcgatgtcctcgctgtcgcgaatgcagccgttgaccaccacgcccgcccagccattgcgcgcgcccatggcggccaggttgtcgcccagcacggcgcagcgctgggacccgccggcgtccaccaccagcacgcggccctgcccctcctcctccagcgcggcgcgcacgcgggggttgctctcgtggcacttcactgtcgatacctggccgctgaagcgggtgcgcttcccatagtccctgcaagggagggcggagtttaa

SEQ ID NO: 8475 - DNA, 645 bp, Chlorella protothecoides
atggagcgacgggacctgctcgacctgaatggccagatctacaaggagcaggggcaggcactgaacgaggtggcctcccggaactgcaagatgctggtcgtggggaacccctgcaacaccaacgccctgatcggtctggagaatgcccctgaccttccgcgccgcaactggcatgcgctgacccgcctggatgagaacagggccaaggtttgtgcgcatcatcatcagtatgggagagtcatgtcatcatcccactgtgcaaaggagcggaaaagcacttggcgccttccggagctcttgaatggagtgcttgaagttggttacctggagtgcagtccgcctcgttcctctcttctggatcctcaaagttccatcgccctctgcaaaaccccacagtgccagctggcgttgaaggccggaaagttctacacctccgtcaccaacatgtgcatctggggcaaccactcgaccacacaggtccctgattttgtcaacgccaagattgaaggtgtgcctgctcgcgagtacatacacgatgacaagtggctgaaggaggagtttactcccacggtgaggcggattgagagcgtggttgcagagcatgtgtgtggattgcctctcctcttggttgaccagagacaataa

SEQ ID NO: 8476 - DNA, 390 bp, Chlorella protothecoides
atgaagtttgtcagacaccagaagaccacgctgctggagcagcagaagaagcagcgggagaaggcacaggagatcttcgaaaagcagatggcggtgctgcatgacacggcggaggaagacctcggcaaccaggaggagttggaggccgagctggagcgggagctcctgggcgaggccgagaagaagaaggtgcacgctgggcatgggggaaacattgccatgggcatgtgtcacatggtgcgtgcctcccgcctcaccgctaccaggctgcgggcgagggtggacacagcggtccttggcctcctcgtcatcgaagcggtcttgcaacccaccccctcccctggacggccattcccgcccacccggccatgcctcagtttcacggcctga

SEQ ID NO: 8477 - DNA, 444 bp, Chlorella protothecoides
atgggggcaagactgcagctctactatcggaggaagaacgtcaatgacacggagtacatgcagctgacaggcaagtggaacaggaggggagcaaggaccttggggagccttgggtgggtgggtgagggatcgggcacgggggtcgacggcggatcatggcacctgtcacggtgcaccttcagtgcgccgacagcgcccatcaagcacaaggccgccggtgccaccctcatcgcagacggcgacgaggcgcggtggaaggttgggagcgtgctgccactcggcgacgacgacgaatcccccttcctcggcgacctgaagcccggggcacgccagctggcggtggagacggggctgttccgagcacccgcccagccctacgacgtgccgcccacagacttcctcctggtccgcagcccggtgcgtttaggaagggggggaatgtag

SEQ ID NO: 8478 - DNA, 783 bp, Chlorella protothecoides
  modified_base (528)..(537): a, c, t, g, unknown or other
atgtgcgtcgccgccctgccctgccccgccttcgaggggtctgagaagcgcatcagcgtcagcttctcctcccgtgcgggcgccgttggcgccggcctgcgcgcgctgacccgcgccgagctggacgcgctgatggacagcgccgcctgcctcatcgtgtcggcgcgccaccacgccagccacgacgcctacgtcctgtctgagtcctcctgcttcgtctaccctgaccgcatcgtggtcaagacctgcggcaccacccgcctgctggcctgcgtccccctgctcctccgcctcgctgccggtctgggcctggagccggccgcggtcaagtactcccgcgccagtttcctcttccctgccgcccagcccgaggagcacgccagcttcgaggccgagaccgccgtcctgcgcgccgcttttgccgcgctgcccctagcctccgcctacgtcctgggcgacgcgctggcaggcctgcagtggcatgtctatgccttcgcgggccgtgtgtggattgctctgttacgtcgnnnnnnnnnnctccgcctacgtcctgggcgacgcgctggcgggcctgcagtggcacgtcttcgccgcgggcgttgcgcgcggcgcggccgcagtggcgcaggccccccctccgcccccgctgcacaccctggagctgtgcatgaccggcctgtgcccgcgcaaggccgccaacttcttccgcaccgaggcatttgtgaacagccgccgcgtgacatgcgactcgggcatccaggacctcctccccaaggccggtga

SEQ ID NO: 8479 - DNA, 954 bp, Chlorella protothecoides
  modified_base (48)..(57): a, c, t, g, unknown or other
atgtccacccaagactttccagtcccagccggtcccttgtcgcctcgnnnnnnnnnntcactcgtgcggagggcagatacacttcctattacttcatctccatgtccacccaagactctccagtcccagccggtcccttgtcgcctcgacgcagggtacgtgccggcaaagctgcccccctccagcctcactcccgtccaaaccgcactcttcctcgtctcctccgtctcctcgctggagctgatagagaagctagtgtacaacgctgtggtatcgccccaggaaccaaaattcaagaagaggtcaacacccctcacctttccaggtgcgactgggcaatccccgcatcaaggccgccatcatcgacacgcccgctgcgctagaggccatgctggccatgggttggcagcaggcccaggagggagaggaatcggtgctcctgctctcaaaatctttgtccatggcagtggtgcgaggggaagccttggggatcgaggggtgcctgtatggatcatgtggttaacacccggttcctctgacctctcctcgtatcaagtatgcatgtatgtatctctcgatcatgttgccatactactggcaagaaggcttccaggccaggccaggcagcacctgcatggccgcctcacccgctcccacccccctctggaccccggcacgcaggtgcgtgatgttcaggaggccgcctcgcgcgcaaagaaggcggcgcaggaggcccagcgcaccgcgcagcgagcggcggccgccaagccagctgcgctgccggggtctgacagccgggagagcctgcgggccatgctggaggccgaccgccgggaaagggcggcgcgaggtccggtcagcgtcggcagcgtcgcccagccgctgcccagcgccggaggcggcggccctgcccgcatccggacggcaggggaggccggactcaactcgggctga

SEQ ID NO: 8480 - DNA, 1014 bp, Chlorella protothecoides
atggcgcggggcccgcgccactggccgtgcccgacctcctcgacctgctgggtgagagattcggtgcttgtcggggaggtgttggtccctgcaagcgccctggtcctcggccgtccagcgaccagcgacgtgttgatgtgcgaccttggggagcccagctccacgaccccggcgctgggcggcctggagggtctgggcctcccccccacgccacaggaggcggcccccgccccatccccgccccacccggcgccggcggccgtggcgcccagcggcagcctggaggcctggtcccggcgcctgtggacgcaggcctcgggcatcctgtatgaggacgccaacctgcaggccggggtcaagtcggccttctcgggcgcggcgggcaccgtgacggtcttcctggggaacaagaccggcggcgtgctggccggcgtggcgctggagatcgtgggtgcgccgccgcacctgacggcgaccctgccggcgccgcccccggcggtgctagagccgcggcggcaggtccaggtccccctggaggtgggcgccggcgcgccgggatccgcgcccctgcgcttgcgcctggcctatcacacggccgacggcgcggcggcggacgtgcagctggacctgccgctgccgcccgccaagttcagccagccagtggatgtgcccaccgaggtgtttgccgcgcgctgggagcaggtggccggcccgcccttcaaactgagcgccgacgtggcgccggcgagcggcgcgctttccgatgccgcggtgcagcagctgctcgcctcgctgcacctccgcgtgctggccggcgtggcgggggtgccgccggggtccaccgccgcggcctgcgtgctgcatgtgggcggcggcgccgcccccgcccgccagatcccctgcatggtggtcgtggcggcgggggcggggcgggtgacggtggccaccgccgacggcgcggcctcggcggcgctgctcagccagctgacctccgtcctgggctggggggcctga

SEQ ID NO: 8481 - DNA, 573 bp, Chlorella protothecoides
  modified_base (323)..(332): a, c, t, g, unknown or other
atgcactcagtccccattcccacctccccctcaggtgttggtccgactcgggacgctgcccgccgccgacctcgccgacctcaggagcctggcgaagcgggtggatcaggtgcgagggacttgggagggcataatctctgtaacttgcctgggcgtgcaaggcttcggggacctcgcaccgactctacatgcgcggctggaggcggaggcggaggagcaggccctggacgacatccccccggaattcgaggacccggtgctgggcacgctgatgcgcgacccggtcaagctgcccagcgggaatgtcctggaccgagccaccnnnnnnnnnncacgctgatgcgcgacccggtcaagctgccgagcgggaacgtcctggaccgggccacgatcatgcagcacctgctcaccgaccagcgggaccctttcagccgagtgcccatgtccgagaaggacatggagcccatgccggagctgcaggcccagatcgcggcgtggctggcggagcagcggagggccagggccgcagcagcagctgccgccgaggagaagaccgacatggaggagggctga

SEQ ID NO: 8482 - DNA, 1140 bp, Chlorella protothecoides
  modified_base (104)..(113): a, c, t, g, unknown or other
atgtcatggagtgccctgcagcgccaccgcacgtcgtgcccggcttctgcggccctgacccctgccagacaccccatgcctgaaaggccctgggttcagtgcannnnnnnnnngtcatggagtgccctgcagcgccaccgcacatcgtgcccggctcctgaggccctgacttttgccagacaccccatgcctggaaaggccctgggttcggtgcgagcgacatctcccctgcgcacacatgaccctcaccctgcgcttctcacccccgacagcctggtgcagctgtatgtggacatcgagatgacagaccggcacaacaccttttacgaaaagttcaccacacgataccagattggggagatcatggcgtacctatggcagctcccgcaggacctgcttcctcattgctggtcctccgcgactccctgtggtcctgacacctgccttttggcaactgcaagctctccaaaggagtacccattcatccccccgctctccccccctccagcaccaagcatcgtggcgcggggtcgccaaggagcacccctacatctacgtacgcttcatcaacatgatgatcaacgactcgcagttcctgctgcaggaagccctggagacgctgcccaagggtggggccttgcacaaaatgctgggcgtgggccctcctgcgcgcctgagcagtctgcctttttgcacccggccgcctccccgccagcgcaggtccaggaggtcgagcgtgcgatggaggacgaggcggcctgggccgcgctgccggacgcagagcgcacggaacgcgaggagcagctccggaccgaccgcggcaggctcaaggtggggtgctgttgctcgcaactggtatcatgccacctccagttggcggttggtcatgaatcccagccgggcttgcatggaaagagtctatatcaaggatctcccccccctgtgtttctgggtgctatcttccatgcccgaggtgagggcagggacaagcctggaggagcaagcgtgacctgccgactgtctcccacgccgcacgcgcagagtgacttctacctggcatccgtgtgcatccagaccatgcagtacactgcggtgcgtgggagagacagtgcacctgggggttccctgcactgcctctag

SEQ ID NO: 8483 - DNA, 402 bp, Chlorella protothecoides
atgggcccacctcccatccggcgccctgcgcaggaggcgtgggtcgagtcgctggcggacatcctcattctggtcgcccagacccagcgctccgccagcctggcccagggcgacatggaggacctgatggtcttcatcaccttctgcctcgcctcccccgcctacgtccggaacccgtacctgagggggcggctggtggaggtgctgcatgccctcatgcctcccaacgaggacccggggtcggggttcaacgcccccccccgcacccaggcctcacacgccgagattgcggccctcttccaggcccaccccctggtgctcgacaacatggtgaagaggtatgggtgtgggtttgaactgccgctccggcaggggcatgggtggaggctgcctggtgagtga

SEQ ID NO: 8484 - DNA, 681 bp, Chlorella protothecoides
atgctgtgcatggcttcctttcgtcgctcgattgtcctgccttgggccaatgatgccgggctctcacgttctggagtgatcgcccgaggagggctagttgccaataccccgctcgtatctaccacgcgagggatcaagacccacatgatggcaaactacgtcgaaaactccgcgctcgagagggtcctgcgcgtcaccctcatagcagaagacgctgaggctggaacagggatgcagccccctgtggtgtatctcagcgaccttgctcaggcgcgtggatgtcacgcagcgcacgccacctctcactgggagctggtgacagagggctcggcgccagagctgaatgacctcaccctcgaaagggccctgatggcgcgcctggctgcgccccctcccacatacccccagtggccagtgcattacctggtcggctgctacggaactgcaccccatcccgacactgctacattcactcccgtccccacccaccacagacgagctgcgtgggaaggatcaggcgctggtcaagctgctggaattagccaaggagctgacggtgtcctacacagccctcatcctgaccctgcagatgttcccgcaggtaggcgcagggccgtgcgagtgtcattctgcatgtcagtctccctgtcgagtctgcctcggcgccgcccctgcctctga

SEQ ID NO: 8485 - DNA, 1887 bp, Chlorella protothecoides
  modified_base (538)..(547): a, c, t, g, unknown or other
  modified_base (1440)..(1449): a, c, t, g, unknown or other
atggcccgcaccgactacacccgcttcagtccacagctgacggactctgatggtgaccatctcctgcgctcgcgcaacacgatgcgaggcggccgcaagcccgtcgcgactcccaacggaaagccttccgcaacccgcgcgtccggcgtgctgggcgccctcctgcagtccgtcaagtcggtgggtcgtcgggtgacctctcgagccaacaattccgcgcccggctcccagatcaccccccggcgcagcagcaagaggctggcccggggctcagccccggattgcccggacccccagcccgtcgggaccgtcatcgcgacccgcgcctcctcactgcggccccggatcgtggagcaggtggcccacggcagcgtcaccaggagcggcaagcgccgcacccgctcgccgccagccgagcggggcgggaaggggctggccggagcggaggccaccctccccagcgccgccaagcgtcggtgccgggccgtgcccctcacggcacgcgagagcgtccctgctgcgggcagggtcgcggagnnnnnnnnnncggccggagcggaggccaccctccccagcgctgccaagcgtcagtgccgggccgtgcacctgacagcgcgcgatagcgtccctgctgcgggcagggtcgcggagacagagctcagtccctttgccgaagcagcgcgagtcgaggagcccgggactcgcttgtccccggcagcgctcacggagggcctcctggacctcggcgagagcgcgtcgccctccacccccccaggcgtggcagacggggacggcgtcgccggccaggccgccgtccagccgatccccacagagcccccgcccacgacgccgacgagggcgtcggctgcccccagcgccgaggcgcaggagacgccctggcggcagggcctgctgccgtccctggaccggctgacgagcatcgggcccaagccctcccagtcggtgcgggactccatcctgaagagccccacacccccgcgccgggccacgatggccagcgccggaccccggatccggggcgtggtgcgcatgctggtgccgccccccgacctcgcgggcatggagtcggggagggagcctgcggaggagagcggcgccgcggcggggcccgcgaccagcgcgccggcctccctgcccgccggacccgaccaggagctgccgggcgaccaccggccacgagtggccgaggtggccgcgccggagcggcccagcgacagccctgcggccaacgggccggagactgcagggctcgtggccggctcgtcgggggaggtccctgccgtccctgccgtccctgccgtccctaccgtccctgcctccgcacagcccttccccacgtgcgatgatcaggcctggtgggacccccttaaccccgccaaggtgaggcatggggggaggttgggaagcctggaccaggcnnnnnnnnnngccgccgcacagcccttccccacgtgcgacgatcaggcctggtgggaccccctcgaccccgccaaggtgaggcgtggggggaggttgggaagcctggaccaggcctctcacccctggccagagtctcaacgccacccccaccgcactcccacccaggtccgtgcagccaaggcggcgctgcacgcctcagcggacgcgacgagcatgctcccgctgtgccgcgagcgacaggccgccgcggtcaccgactggatccgggagtgcctggagtctggcaccggcggctcctgctacctttcaggccccccgggcacgggtgaggggtccgggcgcacagccgggttgcagcgggtgcctgcctctgcgacgagaccggcccgcccggcgaatggatcccaaacacatgcgcgctgccgcccctcgcaggcaaaacgctga

SEQ ID NO: 8486 - DNA, 381 bp, Chlorella protothecoides
atgccaaacgtggtggatgagctgttccccctgggctcagatgcccgccccgccgacatccgtagcggggtgcagactctgcaggcagcctccgaccagctccacaccgccctgcactccctggtcctcaacctcctgcgcggccaggcatgctttgtgtgccgtgctgctcctgctgggttcaagaatgggggcagggtgtccattgaggggaactccgatgggttggcgtcagaggataccaaagagggaacactccagtggctcaccgtggccgtgcaagtgaatgctgagcgagcaaagatgcacccggaccttaaggtggcgtccaccgatggatttatgatcaacctgacgggggtaggcagaagggattcatag

SEQ ID NO: 8487 - DNA, 453 bp, Chlorella protothecoides
atgattatcgacggcacccgcctggttgtgagcgacaacagcggggccaaggaggtggagtgcatcaagcacaagggccggtacgcggccatcggcgacatcatcacctgcgcaatcaagaagggcgttcgcaacagcaaagtcagcccgggtcaagtcgtgaaggcagtggttgtggagaccaagaaggagctgcgccgacccgacggcaggtgggagggtcatggggcaatgggcgtggcaagtacccacaagggaaggatgtactcacacccgccccctcctcccacaacccttgctccgtgcagtaccatcaagtttgaccgcaacgcgtgcgtcctggtcaaccccaagggcatccccatcggcacccgcgtcttgggattcgtgacccatgagctgcgcgccaagcagatgctcaagatcgtcagcctagcagcccgcgtcttctga

SEQ ID NO: 8488 - DNA, 366 bp, Chlorella protothecoides
atggttgaggacctgtttgccctggcgcatgcgccgggctcgcggctcttgatcctgggcatcgctaacaccgtcgacctggtgcagcagctcctgcgccccggcgccgccttccacgtgagttttgagaggggtgcgaggacgaatgtctgggggaggggcgtgggaggaccaaagaatcatggctggtggggtggacaggctcagccatggcagagggccgcagcagctgatacatttctgagcggcagggtcatgcagtgcgaaggggcccgcctcctcgatcctgatcacatccagtgctatgcgtggggatgccccgtgctgccgatccctacccctgcgctgcccaggacaccacgatga

SEQ ID NO: 8489 - DNA, 507 bp, Chlorella protothecoides
atgccatcgtccactctccctcatgcagacgctggtccgcctgtgcctgcccttcatgggtgccagcagtgccaaagcgtggccaaagctgaatgcccggacaccgcctgcgaggcaccctgcaagccctcctccaatctccgtggtgtatcccaatcccccgtctgcctcccctccctcccctgctccaggtacctgtctgatccggaggcccgtctcccgctttctttcgacgagacgagggtggcggctacgggggaggaggtccgcgcctgggcgacggagtgggctgatgtctcccactccagggacaaggctggtgctgcggggccctcccaacgccccaccgcacccaagtaccacttcatgtgcgacgccttcttcctcatggcgcgctgcctgggcctggggtacgccaagtgcattgagaacctgaggtccctcggccggcgcgtcagcgactatgagaatgcgctcaccgagctggaggctcacctggcagagtga

SEQ ID NO: 8490 - DNA, 951 bp, Chlorella protothecoides
  modified_base (896)..(905): a, c, t, g, unknown or other
gcggccgccgccgcgccgccggactgccccgccgccgcggcgtacgcggaggcggcgtggaacgtgaacaacatgccgcggggacgcgggtcggtgctgcgccatgcgctgggcgaggagctgatcacgggcgtgatggtgccctggctctacgtcggctccgccctctccgccttcgcctggcacgtggaggaccacgcactgtactcggtcaactaccaccacatgggcgcggagaaggtgtggtacaccgtgccgccctccgccacgcgcgcgctggaggacgcgatgcgcgacgcactgccgggcctgttcgccgccgcgccggggctcatctaccagctggtcacgctgctgtcgcccgccgagctccgcgcgcgcggcgtgccggtctaccgttttgtccagcgcccgggcgagttcatgatcaccatgccggactcctaccacgcagggttcaacgccgggttcaactgcgcagaggtgtggaggcgtgtgtggggggtagctagggggaggggggtgtctgtgagtggctgggggtgtggaggagtgagtttggtggatgcccggatagacaagggggaaagtgccaaagcagaggcatgcacagccatacactgggtatcccaaaccccctctccccctcgaacctcaggcggtgaattttgcgccagcggagtggatcccctacggcaccgacatcctggacaagtaccgccagagcggcaagcccctcacactgagccacgactcgctgctggtggcgctcgtccagggtggggccaggcggggcgctgctgcacccgcgcgggcgggcgccgaggagcgcgggccgccgggcggtggggtcgagcgggaagacggcgggggggcgggagggccgagtggcgagnnnnnnnnnnactgggtatcccaaaccccctctccccctcaaatcttaggcggtga

SEQ ID NO: 8491 - DNA, 948 bp, Chlorella protothecoides
  modified_base (409)..(418): a, c, t, g, unknown or other
atgtccccgtccgcacaaccctggagcagctggttgacgctactgactgtcttcggaactatttacgtcgtgaccgtgagtcatttcattgataactcaaagagaagcgtgatttttctgcaggcggactgcgacccgagaataggattcttcagtcttcccaccatcttcatcgccacgcgctcactcgactgcaagcaacccattctgtacaggtatgatggagagttgtacctcgcacacggtggaaacccggaggcttactgcagagcgccgtccacaggagatggggcagttctgagagagcgctcaccgcgacaacgcaggctcaagggcttctctacgagtgcactcgccgatattcgtctgttaagcaacggagatccattctcagatgcagccattaagnnnnnnnnnnactctacgagtgcactggccgacattcgtctgttgagcaagggagatccattctcagatgcagccattaagaccatcaacccggatggttgggccgtgtgtgacccttccacgcattccatgaagaaacattgcccctacctgggcattgtcgagtgtctgccggaaggagtgtcaaagtgtgagagctgggacaccacaatcgaggacacgattggcacaggcaacgaaggaagtgctaactggggtaacaacaacttcggcgaccagaatcatggcagcggcaatcgcggcgaccgtaatgttggcgacaacaacgttggcgatggcattgtttgtaataacaagcgtgacacctccccatgcctactgtcagacctcctcacctcggagaccgtggttgtccatccaaggccatccccgccgccagtggtccctccgcctccccagccacagcctccctcaccaccccccggggaaggtggctgtgaccccagcatcgccttctttggactgcccactgtggagtaa

SEQ ID NO: 8492 - DNA, 774 bp, Chlorella protothecoides
atgcctcgccgccctccccatatgcaggcggaggcgggcatccggacctcggctggcgttgcctgcaacaaggtccttgccaagctcgtgtcgggtctgcacaagcccgacgaccagaccatcctgctccccccggaggccgccgcgtttgtcagccccctgccggtccgagcgctgccaggcataggtatgcatggtgggagtgggggggtagcgtgcacccagaggaaggagcagaatgtgacggccacaggcatggggatttcaggtctcatagcagcatgcggcactgcccaccgccgccgccacccccaccctgataggccacaaaatggaggcgcagcttcaggagatgggggtgcacagtgcagaggccctgcgctccatcccgctgcacatcttagtggacacatttggggagcgcctggctcgcatgctgtcccggctctgctggggcaaggtgggcggggcgcgggctgtgctggtgggctggtaatggtacgctgtgaaggtcctctcacatcattggcgtctgacgccaggtctcccacccattctcgcttccaggatgataccccggtgaccgtgcgtggccccaccaaggccgtgagcgtggaggactccttcaagtcctgcgacagctggcagggggtggagcgagtgctggccgtgctgactcccgacctgctggctcggctgcacgaagaggcacatgtgggttctgtgctgaccgagagggcagctcttgcctttatactggaaagggcgctttga

SEQ ID NO: 8493 - DNA, 720 bp, Chlorella protothecoides
atgtggacttggggcctcttccctgctgtcactgccgcccatgcatggtgcaacgcaagcatcacccctcagtctaccaccgccacccttccaggtgtgacgcaaaagtacctggtggtcacctgcaactacgtggcgcgcgagtttggcgtccgcaaactgatgggaatccaggaagcgcagcgcctctgccccaacctggtcctcgccagcggtgaggacctgggcccctaccgggccgccagccggaggatgctggaggtggcctcccgctttggcccagctgagctgctggggctggatgagctcttcgtggacgtcggggcagaggtggaggggcgggccgcggtctgcgcagcgggcctgcacgccagggccgccgcgctcggagtcattcctgctggacccagcgaggcagcttatgtggggcacgtccatcgtgccggccagcggcgggtggaggctgactcgcggcatcgcgtccaggacctgcgtgccgtgccgtgcattccgccgccggcgggcgatgccgcgcccgagaatgaagaaagcgggaccgggtggcaggctcgcctggcggccgggtcgaggctggcgctggagattcgagccgccatcaaggtcggcaggctggagaatgatgttaatccagggttcttgtttgatgcagtggatgatctgactggcccagttcgctcagttcccgcaagagccagctga

SEQ ID NO: 8494 - DNA, 1239 bp, Chlorella protothecoides
atgtctggcgtgcccgagtcggccaaaggggtcggcagccctgtggacctcgagtcccaggctgccaccgctgcgcccttcccgccccacctgaaggcggtcgcagggcagggagccgaggcgcggtctttcacccaagacctctggacggcgctggcacctgatctccggcggggcgtcgtccaggcccagcatgcgcagctcgcggtccaatctgccgtggggctgacggtgtcctgcggagtggcgcgcagcaagctggccgcgcgactggcgtccccgctggccaagccgcacgggctcacagtcgtgccagacaatgtggcggtggcctttgtgcggtcgcaacccctgtccagcattcccggcctgaaaggaaagcggggcgcggaggtgtgctcccagctgggcgtgcacgccgtggccgacctggcaagcattcctcgcgcacgcctcgtcagcctgtttggcgaggacaggggcgccttcttggaggcgctgggcgcggggcaggaccctcgccccgtggtacccaggggaccgcagcgctccctggtcgtggagcgcagcttcccgccggcttccccgggctcagacgcggcgcgcgccgcgctgcgggagctggcggcgcaggcggccgcgcgagcgtgcgcccacgcggcgaagaccgggtgtctgccgcgacgggccttcctcgcctggcgcgccggctacgagagcggctgcctgcgtcgtgggttcccggtggcccccacgctcctggcccacctccgccgcggcgccgccgcgagcgtgctggccacgcagtgccgggctcccgaggtcaccaggctggcgctgggcctggagctcggtgagcgggagcccgtcgaggcccgcatagccccacccagcgccccgccggcgcagccgggcatccgccaggcgctgggaggcggcgcctcggcgcccgccggcacctcccccggcgagccccggcccgcgctggagcgcgagctgctgacgctggggggcgccgcgctggttgacggcgcagcgggccttctggccagtgcggcgcccggggagagggacagcctggccctggctctggccctgcagcgcgaggagctcgcgtggcggggcagcggcggcagcgtggggaccagaccgggaagcgtgcctgggcgggcaaagagggcgcggcccgctgcgggtcccctggacgcattcttcatcaggcgcagccagacgcgctga

SEQ ID NO: 8495 - DNA, 717 bp, Chlorella protothecoides
atgcactacctcgccgcccgaaagagcgccaagcgcccccatcccccacccctgccgccaccctgccccctttttgcaaccaacccctccccacccacccatcagaacgtgggcctggccatccgcgccctggcggcggctcaggcccagacttcgcatcgaggagcttcggctgcgaattcctcgctgggccacgactcgcggctgcgggagaacgtggagcacctggcggagctgcgggcgctggcggcggagctgggtgtggcgggggccgtggctttcctcccctccttcaccgacgcgcagcgcgcggcgctgctggcctccgcgcgcgcggtgctctacacccccactgacgagcacctgggcatcgtgccgctcgaggcggcggcggcggggcgggcggtgctggcctgcgccagcggggggccgctggagacggtggtcgagggcgagaccgggctgctccgcgactcgcggcccgagagcgagacggggctgctccgcgacccgcggcccgaggtgtgggccgacgcgctgcgcgcgctgtgcacgcccggcgcggcggagcgcatgggcgcggcggcgcggcggcgcgccgcgcagtgcttctcccgcgccgccttcggcgagcgcctggaaagcctggtggcccgactggccgcccacggtgcgcagcgagcgggggcggggggcggtggtgccaagacggagtga

SEQ ID NO: 8496 - DNA, 588 bp, Chlorella protothecoides
atggagaagatgcccagccgccaggagcttatggccaccatcgcgcggctgatcaatggcgtgcctaccaagctggcgcgctccatcaaggcggtgcccaccaagctggccatcagcatcaaggccctggccgacgccgatgaggacaagtcgcagcgtgtgggcgacgtgctcccccgccagccccccactgaggcggcgtatacaaggccatccgacaaacatgtgtcacgcgtccgcggcgtcgtcgagcgcggcgtccatctgcaatcgccgcttcttcaggaagcgcacgtccccgctgtccatgcccgctggcgcggggccaccggcctccgccgccggcgtcgcctcccgctccccgcccggccgtttggcgctggccgccgccgccgccatgcgcacgcccgccctccccggcttgggcagccgctcctgcggcgtgggggcggggtccacgcggaagtagcggtgccggagcgcatcggcggcgctgatgcgctgcgccggggcgaggcttaccatgcgcgacagcaggtccagggcgtcgtcgggggcctgggtggcgggaggaagtggggcagatga

SEQ ID NO: 8497 - DNA, 468 bp, Chlorella protothecoides
atggggtctaggaggattggcgctgggcagccgtcagggcgatgcctggcgtggccaggcggagtcgcggcggaacatggcggagtcccgctatcccccgtcttctggagtcggacggcgaagcgcacgaagaaggtcggcatcgtcggcaagtacggcacccggtacggggccagtctgcgtaagcagatcaagaagattgaggtgtcacagcactccaagtacttctgctccttctgcggcaagttctccgtgaagcgcgtcgccgtcggcatctgggagtgcaaggcctgcaagcaggtccaggctggtggagcgtacgaacagtccggtgcacagggtctgcctgctctccgcagctctcttcagtattctaacctgcatgtcccatcccccccccacagcactgctgcctccgtcaccgtgcgatcgaccatccgtcgtctgcgcgagcagaccgagatctag

SEQ ID NO: 8498 - DNA, 315 bp, Chlorella protothecoides
atgaggcagccagggcccttgtgtaccacgatcgacgccgctccagcctatcccactcgcctccttccccctcgacgtccatggaactcggactcgccttcgccaggcatctttgcgcgcaccttcaggcggctgcacgggcgaggcctcgtccccgacgtgctctaccccgcggtggtggtaccatctgatgcgcagctggcggcggcgcgggcggggtggaagcggacgctgccccccgacctggcccgcttcatcgagtccagggacgctgtcttcctctccatcaaccgcttcgagcgaaaaaaggtttga

SEQ ID NO: 8499 - DNA, 1119 bp, Chlorella protothecoides
  modified_base (214)..(223): a, c, t, g, unknown or other
  modified_base (838)..(847): a, c, t, g, unknown or other
  modified_base (1098)..(1107): a, c, t, g, unknown or other
gcggcggctggcggagctggcggcgggggcgatggcgcggcgccagggctcgagacccccggcacgcccctgcccatcgacgtgcgcggtggtgctgtgggattattctggggcggggatgtcagaggggtttggagagggggtaggaaactcatgcattatcgggcacaggtgttgctgctggtccgccccaaggggcaggggcggtggggcnnnnnnnnnnacggggatgtcggaggggtatggagaggggttaggaaactcaagcattctgaggcaaagatgaacgcgtgggcggaggtgacctccaccctggcggccacctttgcgctgtccggcgcagtgtgccagaccagcagcgagctggggcccgccccggcacccggcgcccctgaggcccccggcggggtccgcctgctgacatcctccggcgtgctgctggcggcgcggcacgagctgcgccccgcctttgccgactgggcgctgcgccacgcgggcgtgctccaggacggcttcgcacggtacgaggtggcgcggctgcagcgcgcgggagcggggcgcgggccgcctcgccccgccgccgtcgccgaagtggacatcctgggcgcggcgccgcgcggcgcgggcgaggccctgctccccctcgccgagctggcggccatggtgagtgtcgcgctggccgcgctgccctgtccgggggccttcgagcttagggtcgggcaccgcggcctcctcgccctcgcgctgaagcacgtcggtgagcaggagggcttgaggcaggggtttgaggcgcgctggttggggtcagggggttgcgaatgcacggagtgggggcggnnnnnnnnnncgagggaggggtttgaggcgtgctggttggggtcggggggttgcgaatgcacggagtgggggcgggggtgcagacgggagcgggggtgcagacgggagcgaggcgatgggcggggtcccggggccgcgtggtgggagtcagcagacatgcatggagcgccaggcgctgccgcacaccctggacgcttgctggttgttggtgcacctggcgcatcctcatgccctgtgccccccccccgctgccgtcggcgnnnnnnnnnnaccgcgtggtag

SEQ ID NO: 8500 - DNA, 645 bp, Chlorella protothecoides
atgccctgtgctcccccctcactgccgtcggcgggcgatccctgcttcccgcaccccactccctccccccacgcccaacatgcctccacgaccatcccctcctcaggcgcaccgccggagctgcacgcgcgcgcggtgcagctgctgtccaccgccgcggcggcctcgccgctgcacactgcggcgcgcgcggcgcgctggccggccatccgcgcgggtctggagggcctgggcctggcacctgacgcggcggcgcgctgccgccagctgctcctcctgggctcaggcgagccggagccggccctgcactggctgcgcgcgacgctgggccatctggcgcccccgggcgctccggggacgaacattggcgcgccggccccgctggacgatctggccgccctgctcaccgcgctggccgactgcggcgtgcccggcggctgcgtggtggtggacccccttattcccccccacgctgactacttcacggggcccctcctccagtggcacctggtggcgccaggcacgggtgcggcggccatggtgggcgtggcggggcgctacgaccgcctgctgcgcgcagcctgggcgcggcgcgccgcggaccccgatgtggcccaccccccgccgcagctaggcggcgtgggc

SEQ ID NO: 8501 - DNA, 381 bp, Chlorella protothecoides
atgcgccacaggcccagcaactctttggtcatctccatcaggggcaccggtgagctgagtggtggaggtcgacggctgggccagctacctgcttgctatgaccggcaagaccgcagccccaaaggagtaaccgacgcccttgccaccacagtgagcatggaggacctcatcacggatctgctgagtcagcccgtggacgtgtctgactggctccccccatgggtccaggaggcgcaatcacacaaggacgagtgcatgtatgcccatgccggcgtcgtgtctgccgccacggccatcctccttgacatggaggagaagggtctgctcaaggcaagttgcacggacgaggcacctccctgcatgcctgtggagcaagttctg

SEQ ID NO: 8502 - DNA, 543 bp, Chlorella protothecoides
atgctgaggcgggccgcgcctccagagctgcatccctggtgtgctgagagggggttgaaggggccatgtggggaggtattggatggggtgggagagccttgggctgatgtgacttgtttgggtcggagggggagcaggactgacgagactcagcagcaagaacccctggcagtgggcggactggggagcaggcgtgaccaacgactgggcatgctgccctcctccccagcagcccgcaacctcactcctgctccgtctcacacacacacacctcctcgcccgtcccagggccgcacgaagcgcgcgcggcacgtgctcctgcgctggatcctggacaccctggacggggccgccgccgcccccgcgacacgtgcgcgtgcgctcaaggcgctgggggaggcggtcagggtggagccggggctcctgggcacgcccaccgtccgggcggccgtcgaggcagccctcacggtgcgcacatacgcggagtgtggagggcggagggctggcggggctgaggaagggggaaggcgtggggaactctaa

SEQ ID NO: 8503 - DNA, 498 bp, Chlorella protothecoides
atggctcgccggcactccagatttcgcgcatccccaaatctcacttccaccctcctcacctccctcttgtgcagaggggatagcccacgtgccgctcccgcggcggagcccgtcgctgccgcccccggcgagcctatggacgtgaacactgccgtgcagcaggtactgaagaaggccctggcccacgacggtctgtcccgcggcctgcacgaggctgctcgcgccatcgagcgcggccaggcccagctggctgtgctggccgacgactgcaaccagcccgactacaagaagctgatcgaggctctctccgccgagcagggcgtgtccctgatctccgtgcccgaggcctccgagctcggcaagtgggccggcctgtgcaagatcgacgctgagggcgaggcccgcaaggtggtcaagtgctcatgcgcagtggtcaccgactacggcgaggagacgcccgccctggtggtgctgcaggagtacctgaagtcccgctga

SEQ ID NO: 8504 - DNA, 1737 bp, Chlorella protothecoides
  modified_base (1299)..(1308): a, c, t, g, unknown or other
  modified_base (1666)..(1675): a, c, t, g, unknown or other
atgtccaaactccgatcacttcttaaatctatgcctcacctgatccatacagggtttgcgtgtggaatctctgcagcagcgcccggccttgcgaagacccctcagcgtgccagcactggccctatcgggccgctgtcatcacccctcagaacgatggcgacggcggtgaatgctaccacagatcgcatcgcaccccccaccccctccaaatccaagttcaagctggcactttgccagctggctgtgggtgcggacaaggagcgaaacatccagcatgctcgccaggccatcgacagggcggcgggcgagggcgcccgcctggtaatccttcctgagatctggaactcaccctactccaacgatagcttcccagtctacgctgaggaggtgggcgggggcgagtcgccctccactgccatgctctccgacgctgccgcagccaacagtatcgtgctggtgggcggctccatcccggaacgctcggagggcaagctgttcaacacctcctttgtctacggccccgaaggggagctcctgggtcggcatcgcaaggttcaaggaatcggaggtgctgacccccgggtccgacctgaccgtcatcgacaccgagctgggtcgcatcggggtggcaatctgctacgacatccggttccccgagctagcggccctctatgccgcgcggggctgccagctcctcgtctacccaggtgcagtgaggctggaggcaccgacgagttccagcttgaccctctgcgtgcctcgtgggaccgtccctgtcgtcctgaggcccaaatttcagctggccccacccaggctatcgtgtcccatccgcgcacaggcgccttcaatatgaccacgggcccggcgcactgggagctcctcctgcgagcgagggccgtggatgcacaggcatgctggcgttcgaggctgaatgcgtgccttgcgagtgcgggcatcctccgacgaggagggttttggccgctgtctgacccagttgacatccctgttggtcctcaagcgacatcctttgtatgtggctggagtggctccggcacgcgacctttccgctggctaccactcctggggccattctgccctggtggacccctttgggcgggtggtggctgcggccgaggaaagcgaggcgatcattcacgcggaggtggacctggaccaaatcgcggagcagcgaaagggggtgccgtacaacgaccaaaagcgctcggatctgtactccctgctggacctcacgcgctgaggcgcctgctagcagcctggacgcagttcactgcgggcccnnnnnnnnnnggtgccgtacaacgaccaaaagcgctcggacctgtactccctactggacctcacgcgctgaggcgcctgctggcagcctgggttgggagcatggcccttgtaatctatgatcagaccgctacaagcgtccacgaagcactcagtgcagattcggaccgtccccttccgtcccccaacctccaaaaccagtggctgcacgcagcagggagcagggttacaccgcatgaccagcgcatgcacatggccgcatacatgtgggcgagagttgcacagactccaaggtgggctgctaactccctcccctcgccgccgtacgcacgctccgccgaggtcaccccctcccagctcatcagcttcnnnnnnnnnngggctgctaactccctcccctcgccgccgtgcgcacgctccgcagaggtcaccccctcctag

SEQ ID NO: 8505 - DNA, 189 bp, Chlorella protothecoides
atgtctggggaggcgtggaccaccatcgagagcgacccgggcgtgttcaccgaactgatcgagaggcttggcgtcaagggggtgcaggtggaggagctgtactcgctggatgccgactccctgcaagctttcgagtgggttgacggcgggagggagttcggccctggggtgcgatgcggggagcgctga

SEQ ID NO: 8506 - DNA, 387 bp, Chlorella protothecoides
atgcctgcaactccattcagacctgctctctgcctcatcccccggtgcccaggcgaggccatcgggaacagcgagacgatccggagggtgcacaacagcttcaccgccccgcatgcgctcctcccggagaaccccgacaatgactccgagggcgaggccttccacttcgtggcctacacctaccgggacggctccatctgggagttggatggtttgcaggctggacccatctgcctgggcgaggccggccagggctttgaagtggccctgggcagagcttccggtgctcggcccaagtcccccgatggaagcacccctcccaccccgcccctcctcgtcgaacccttctcaaggacgagtggacgcagactgcagccagcgcgatga

SEQ ID NO: 8507 - DNA, 408 bp, Chlorella protothecoides
atgaggacccgggcacagcgccttgggccctcgccacgcactcccacccacccactcgtctgtacgccgtgcaggtgccgtcgcaccgcgctgcaagacgccctgaccgacaactgggtgcggtgcgccgcgctggaggaggcggcgccggggtcgagcccggccgcccaggagctggcggcctgccggcacgagggcgcccgcctctccgccgccctggacgcggagtgctcgaggcgcgccgcctggtcggacgaaaacctgcgccgccggacagactacgtgccggcggtgttcaacctccttaccgcgctggcggcctgcggcgagctcaagggccttgttgcggcggcggcagcggcggggggtggcggcgcgagtgggaatggggaatcttccgatacctag

SEQ ID NO: 8508 - DNA, 195 bp, Chlorella protothecoides
atgtccggaactcactgtgctcccctccttcccctcatcacctgccaggtcattctcgggggggggtacgacacctcggctgacatctggtcgctggcctgcatggtgtttgagctggcgacaggggactttttgttcgagcccaagcagggccatgggtacacgcgggacgaagaccacctggcacaggtctga

SEQ ID NO: 8509 - DNA, 1491 bp, Chlorella protothecoides
atgggcgtgtgggctggggtggccgaggagggttgggggatcgtgccgccgtgcgatgccggcgcctgcggcgtggcaaggggggtgggagggtgggagggtgggggtgggggtctcgcgagacggggcgcgacccgacttgcgcagagcagagcccctggtgcggcgcgtgggcagtcacacccagagcgtggaggcaggccccggtggatcttgatcttgccccacacccttccagcctcgtcttctgcacccggccgcactcacctcatcgccccgtgcagcggccagtgctgccgcggcgcggccggcggccccatccccgacctcgggtccttcgaggctcgcctccagccgcaggtcgagcctcaacgccgcgtgcttcagcagcgccctgcccagagggtgctccgacccgctctccgcgcaggcaatcaggaagagcacgctctcctccggccactgtttgggagacgcccagcaaaacccttcttcacccgggagtcctgccctctccaccctgccccgccaacaagaagcagccgtttccacccccacagactgaaaactcacgccgcaggcgtcctcgaagcgcgcatccaccacgcagggcttcccctgcgtcagcgtccctgtcttgtcgaacacgacgtcgctcaggtgcaccgccttgccaagcacctcggcggacttgatgaggatgccccggcgcgccgccacgcccgtgccaaccatcaccgcggtgggcgtggccaggcccagcgcgcaggggcaggcgatgaccaggacggcaatgccgaagaggagggagaagagggagggggtggtgcccgccggcagccagtcagcggggtaggcgccggccacgcccgcgccgtaccaggcggcccaggtgaccagggcggccaggatgacgccggggacaaagtaggcggagatgcggtcggccagcgcctgggcgggggccttggacagctgcgcctcctccaccaggcgcacgatctgagacagagcggagtcggcgccgacgcgtgtcgcgcgcacccacagcacccccccgctggcggtggtccccgtgatgacttcagcccccgagcgcttgggcacgggcaccggctcgcccgtgaccaggctctcgtcggcgtaggccgcgccgcgcgccaccacgccgtcggcggggatgcgcgcgccgggcagcaccttgaacaggtcgccgggctgcagcaggccggcgtccacctcgcgctcgctcgacacggcgtcggttccagggtcggtttcgcaaaggatcgcggtggggggggccagctccagcagcgcggagagcgcctgggaggtcttgcccttggccgcagactccagatacttgcccaggcacacaaaggtgatgagcagggcggaggtctcgaaaaaggtgccatgccccatgtactctgcaggcatgcgtgtgtgaagcggggggggtgtgtgtgcaatggtggcaggtggtga

SEQ ID NO: 8510 - DNA, 750 bp, Chlorella protothecoides
  modified_base (245)..(254): a, c, t, g, unknown or other
  modified_base (566)..(575): a, c, t, g, unknown or other
atgttgcaagacccagtgtcgatagtttctcacctccattcaaggcttctagaatgctggattgcctgccatacaaaccaatgccgatcctcccacgctgaatgtgcagggtttgtcaagggctatgcgctgattgagtatggcagcaaggaggaggcccaggctgccatcgatgatctggatgggaaggagctgtatgcaaagccaatcaatggggtgcaggcggatgctgggagtgacagacnnnnnnnnnntgtaagcgagtatcctgacgccgagggggtccaggctgatgctgggagtgacaaatcaaggacacaaccaccttgtgtcgcgggaaagattccatcgttcgggggtttccaccggtcaccctcctcgtttatccgtgcactcggtggacacccttgctcctttgagggtgagggagcggtttcggaactgttggctgagcatccctcgcgcaccggactggccacgccctctcggttcctgtggcgtttcggaggctcccaggtacgtgggcggacctgttcgcatcactcttgccatggtctcgctgtgannnnnnnnnnggcgtttcggaggctcccaggtgcacctgtgcggctccttcacgcgatgggtggagacggtgcccatgacgcccgtggaggggcagcctggcgccttctcggtcatcgtccagctccctgcagggtgagtgcgtgtgggagaggtccttggtgttcgagcccggcgcgactgtga

SEQ ID NO: 8511 - DNA, 708 bp, Chlorella protothecoides
  modified_base (134)..(143): a, c, t, g, unknown or other
atgttggccagcaggggctacgctgagacccgagtgactccgcgcctgaatgtcgagcagcacctgcaaccgatccagttgctaaacgagcgagcactttgcgctttagtgaccacaaagtatacatacacaannnnnnnnnnatgtcgagcagcacctgcaaccgatccagtagctaaacgagcgagcactttgggctttagtgaccacaaagtatacatatgcagagtggtatcttgtgcaagtttgactgacggtgcgaccaacaatagacatcctctccccagagtccagaaaccaagcgatggaggtcgatggagagcgaaggcagaagggccggggcttccgcgaccagaccagccttgccgacaggtttggtcgccgggtgtgattgagcgcacgctctccgggtgcactgaggaggggaagcggggtgcagctcaggaacattcagtgctcgctgtggaggggtgggtactcctggtgacaggcgttcatgaagaggcacaggaggaggatctgcacgaagcctttgctgagtttggggacatcaagaacatccacctcaacctggatcgacgatccggtgagaacgctgggctcagcgatgggaactggctggtgccgggatttatggttgtgtaccccatgttgcatgacccagtgtcgatagttcctcaccccctttcaaggcttctagaatgctga

SEQ ID NO: 8512 - DNA, 261 bp, Chlorella protothecoides
atgtcatggcacagcgacaatgagcctctgtatggctctgagcctacgatagcatcggtttcatttggagctgcgcgcgatttcatcctacggagcaatgaggaccatgcttgcaaaagaacctactctttgggccagggaacactgctggtgatgggaggtagcacgcaagatcactggatgcatgctgtgccgccgagagcccgtgtggaggagccgcgcataaatctcaccttcagacagattatccggcaaccttga

SEQ ID NO: 8513 - DNA, 1326 bp, Chlorella protothecoides
  modified_base (74)..(83): a, c, t, g, unknown or other
  modified_base (371)..(380): a, c, t, g, unknown or other
  modified_base (530)..(539): a, c, t, g, unknown or other
atgccaggggctcgtttctcaccttgccccggtgtaggggcgactctctttctaccacttacgcgaaaaacacnnnnnnnnnnggctcgtttctcaccttgccccggtgtaggagcgactccctttctaccacttacgcgaaaaacaccatcgtccctgcaccgcccgtgcgttgcctctaggagcgccttctctctacccccagcgccgtccagccatcacccaccaagtctctttaccatggcgatggcagcagctggaagcttgaagggtgtgggtatccccgtcaagctcatccacgaagcagagggccacatcgtcagcccgtctctctgccctgacattttttattgtgccctcctcaccacggnnnnnnnnnnctgcctccgtgcctcaaaggggattgcaagcctttcagcaagagcactggcctcaaaccggtcagcatgtggcactggaagggtgcaagaatcgctgtctgagcgtgcccagcatccccacagtaatggtctcaacccctctcaaaacannnnnnnnnntgtgggtatccccgtcaagctcatccacgaggcagagggccacatcgtcagcgtcgagctgaagactggcgagatcttccgaggggagctccacgacgcggaggacaactggaacgttcagctatccaacatcactgccactggacgtgatgggaaggtctcccacatggagcacatcttcatccgagggagccagatccggttcatcatcatccccgacatgttgaaaaacgcaccgatggtgacgagagcactggcctcaaaccggtctgcatgtggcactggaagggtgcaaaaatcgctgtctgagcgtgcccagcatccctccagtcatggcctcaacccctctcaaaatgctctccccaccccagttcaagcgcatcgaccccaagaacaagatgaagaacgtggcacttggcatgggaggccgtggacggggagggcggccatgaagcggagagcctggagagggccactcctcatccaacacattgtcatcactgcttggaaggcaggcgtctttcctgcttctcaagcaggatgcttgtcgcgtcagacccccaggaggcgccagggaccagcctcccatgcccctgccacgcacctcttatcctcctttgactcgctacccgattccctgctcgctcctcgtactgttaccgctgccacgcccctggctgtaagacactccctgttgcctacacaaggctgtctgacttcaggacgtggcttgcctagagattctggcacatcggaacatcgccatgcacactgtcacaggacttaa

SEQ ID NO: 8514 - DNA, 1098 bp, Chlorella protothecoides
atgacaagcccagatcaagtgctgggccccaaaagccgggccgatgctctggcaactgtctcggggtcgccctatgtgctggtggggtgctcctccttccagggccagaaatggacgggagggatagcgttgatccgtgaatcgaatttaagcggcgaggctgctggcctcgtacaggcttgcgtcgagatgccggccggcgtgccggcgctggtgtgcttgagcgaccgggacccattcacaggtcaggtgattgcagtgagcggcagcgacgacggcgcggtgggcatgtggagcgtcagcaccggcctgcagccctccatacaggaagcgtcctctgtccggaggcatgatgacattgaaggacttccacacctcagcacagtcatccaaccctctctccacccctccacctcttctatgccaccacgacaggtgtcatgcattgctccctccggccaggcgtcatcacaggtcgtcagcacctcctgggacggcaccgcagtcctctgggactgcacctccactggcccgcgcagggtctccgagctgcgccccgggcagcacgctgtgcacgctgcggcctggtgcaattcctcggtggcgctggccactgccgccgacggctgcgtgttctgggacccccggtctggggaggcgggccgcagcggcctcgtgggtggcgcgagggagctgcagcgggagggggtggctccgggtccggcggccgcccgggccggactgacggctgtggcggcgtgtgagaacgagcaggccgtttacctcggcaccgacgccggcggcttgctgtggctggacagacgagcggctgggggcgggcgcccgcagaccctggcttcgccgcacacagaaggcatccggcagctgctcctaggcggtgagaatggcagcatcctggcttccagcgacaccgccgggaaggtggtgctggcccacaccaccgacgcggcgcttcagcgcgtggtgcatagcgcggcggtgcctggcgggctggcgctggggtggcagggcccccagctgctgctagggggtgtggccggcgtgcggatgcttgcgctggaggactgcacgttttga

SEQ ID NO: 8515 - DNA, 519 bp, Chlorella protothecoides
atggctggtttcggcgcatatcagtcaggcgcatacagccaggagggcctggacttccagccgcgcctgtcgcgcaccgatgtcgccgccagcgccggcgtcgcgctcggcgtctgctgctctgtctatgccctggccgcccccagggtcgtgagcctgtggttcggcacctgcatggcagcactggctggaaccagcctagcgtgcacacgggcactgctgctggagaggcaacacaaggccctgcagcgcagtgaggaggagtgggtgcgcctgttgaaggctgggacctcgctggtgccctttcgtcgctcccgcctgcatgtggccaccttcccgccaggcactgggtcccccacctccgacctgcgcatccactgcctccacggctttggctccgccctgcactcctggctggcggtgggtccacgcattgcggcggcgctgggagcaaccatcaccgcccacgacatgcccgggttcgggctgtcagagaggtgcgggaagttcatgagctga

SEQ ID NO: 8516 - DNA, 684 bp, Chlorella protothecoides
  modified_base (456)..(465): a, c, t, g, unknown or other
cgcgccgccgccgcggacggcgatgtgcgagccccgccgccgggccccccgccggtcgtcggcgccggcgtgccggcgccggcgcacccaggcccgggccccatggcggatgcggaggagccagcgcacacgagccgcagcatccacgacttcctgggcagccacaccgcgtacgagctcatccctgagtcgggcaaggtggtgctgctggacgtggacctgcccatgcgccaggcgctgcacgctctgcacgagcagggtgtgtgctggggaagggttgtgtggggaggtgtgtttgtggaggggtccatcccaggggagtccagcgggtcgctgcgaatcttatgtacacgatgggagggggaggggcatcgctccccacgctccacaccattcgacacccctccacatcccccctcccccccaacaacccgccatctacgcaggcatcgcgtnnnnnnnnnnaacacccctccatatcccccctccccccaaacaacccgccatctacgcaggcatcgcgtcggcgccgctgtgggactcgcaggtgggcgcggtggtgggcgtggtctccgcctccgacttcatcttcatgctgcagcgtctgcgccatgtggtctccgcctccgctgcgctgtccgaggcggagatggacgggtacaccatccgcgcggtgcgcgatga

SEQ ID NO: 8517 - DNA, 4002 bp, Chlorella protothecoides
  modified_base (737)..(746): a, c, t, g, unknown or other
  modified_base (933)..(942): a, c, t, g, unknown or other
  modified_base (2011)..(2020): a, c, t, g, unknown or other
cgcggcagggaggtcggcgccgggggacgcggtgccagccgccgcggcgggcagcagcagcgggggcaggcggcgcggcgcggcgccgccgccgcccccgccctcaaacctcccgccctcaaacctcccgcccgcatccagcccggcgcagccctccaccccggtatcggcgcggcgcgccctcagctgcagctccgacaccaggcgcaccaggcgcgcgttctcctgctgcagcgcgcgcaggtcgccgcccgactcctcgttcaccactgcgcggttgcggatcttcttggcccccgacgcgaacagcagcgtgctcaggctctccgtggccgactccgcggcaggggtcacgcatgccaccacgctggtcttgctgttcccgcccagcgactcctgcagcaggaaagtgaggcgcgagtcgcggtacggcacgtgcaccgcggggcgcttctggcgctccaccagcgcggagatgacgcgccccagcaccgtcagcgacttgttgatcgaccgcgcctccgtcagctggtcgccgcgcgcgccgctgcgacccacccgctccgaccctgcacgggtgccgacgagggctcacttctttgggtgggatggagtcggaggtgcgagtgtttgtgccagggccatgtcgaggtgcaggccatgcgtgttttgctctgccctgtggtaccgttcaggcacccttcctcaggccatggaccgtggtgcgaagactggcnnnnnnnnnngggggtcacttctccgggtgggatggagtcggaggccatggaccgtggtgcgaagactggcgccaggatgccacccactctgcatcactcagcctcaccttcacccaccccccaaccccccaaaacaccaaagatcccgaccccttcccctcccaacatcccacccgccaggtctatgaggttcagnnnnnnnnnnccacccagcctcaccttcacccaccccccacccccccgaaacgccaaagatcccgaccccttcccctcccagcatcccacccgccaggtctatgaggttcagcttgctggtgcgggtgctggtgatccccgtgtcggcgcgctccgtggcctcaattgtgcaggtgaacaccgagtgggaccggctgctgcgctcattcatgcgcgtggccgcgatgtgccggttctcgctgccccgctggatcagcaccatcacgtcgtcggctgtgggggggcaggggggaagggggtggctgaagggttgtgcgtgtgtcgagaccgagtttcccaggtgtcatttgccacatgccgtggggctgatggtggcctcgcagagacccgagcgccgtgggatgagggtggggcacccctccgatccagcccccttcataccaaccagcctccccccctctcccctcctctccaaggcctcaccattgagcacgttgtgctcgctgaggtcctggacgtacactccccgcttcacgtcgccgtcccggatctgcagcgccggccccggtgccagcaggtctgtgatctcctcgttgtagatctccaggaaggagcaggagatgcggtagcgcagcgtctgcggcccctccccccgctccacgtcctcgatggcgcggaacagggcggcgaagacgcgcagcgtgaggccgcagtcggggtgcaggccgccggcctcggaggcgcaggcctcgcccatcatggtgtgggtcttgcccgcccccgtctggccgtaggcaaagatggaggagttgaagccggccatgcagtgctccaccaccggcgcacccgccactgtgcggggccgagagcgggtgggaggggtggggaaggggggtggagtgggcccatgtcaggggctccatgggcagacggggcggtggcgacaggcggggggaggtgtgggcaagaggcgggctcacacgctgtgaggaggtctttcttgtccggagggtcacaccgggaggaacctcccacctccgcccatgcccccacctgcgtacacctcctcctgcgtggannnnnnnnnnctgaggaggtctttcttgtccagagggtcactccggggggagcctcccacctcggccatgcacccacctgcgtacacctcctcctgcgtggactcgcagccgaagacatggtcgtagctcttcaccaccggctccaggcgggagggctcggtgaggaccagggttcgtggccccacgagggagagggcgggggcgccgccctcccgctgctcgcggcggttggggggccggacccggaccatcacccgcacgccctcccccccgctggcaacctcctccccgctggcgtcgtccacgcagctgctgacgctgggcgcgggggaggccaggagggagggcgagggcatgctgtcggccgagggcaggctgcgccgcgccatcctcaggcgctcggggcgccccgtgctcagcttggagtgggtgcccggcgcgctccttcctcgggaatgctcgacctggtgtccgcgctgcctggtgtggccatgtcgagctcggcccgaggggggcgggctggaagtgtcggtcacagatcggagggccctcgtgcgctcgtcatgcagggagggggtgggtttgtataccggtcggcatgttctgaagtttggtggcgcccagcgtccagattcggcccgtgtgcccgtggatctggcaaggcggggacaggtggttatattgaaaccggcgtgctgcgcatgcccttccgtgataccaaaacttacataccctacagatctggtgtcccgcacgggccgcgcccgtcgggcgcggctgcagcacttcaatacacggagagagcatcgttctactttgaggcagcgtgcgcctgggcacggcccgccctcccagggtcttcctgtcgttgtacttcagggactgcattgtccattcttcactccaccgcggtggagggttgggccccggccctcccgctgtcctcaggccatgggcttggggctggagggggaggtgttgaagtcgcgcttctcgaagggcacgcccagctccagcagcttgctgaaggcctggcggggatgatggggtggcagggtgtgtgtgaggtggcgacggtgggtgcggtgcggctgcaggcgtggccacgctgccgcagtccctgcatgcccctgcaccggggcagaggggggcccatgctcccctgccaagcccccgtcacttcgggcctcatgcctcaccctccccgcacaaccacgagaacccaccgcggcaaagtcctcgaagaacttgtcctggtccttggcgtacaggtccacgtactgcctgaacttcttgtcccagaccatccacatgtcggtgggcagcatcatgagctcccccgtcttgtcctcgtactggatgggtccgttccacttcttcttgtgccacttgcccttcagctcggtgaagtagccgttggagaaggtggtgggggagaaggtccaaggccccacgaacccggagcggtcggcgtggcagcgcccgatggcatgcgcgcccatcagcgccacgatctcctggtcgttgaagcccatgcggtagaagacgtcgcgcacgtgcttgttgtcgcgcgacgcgtcgggcaggcgcccgtccggcagcggcacgcacccattctcctccttgtcggagcgccccgggcgccacttgatctggggcccgcccatggcctcgatggccaccacgccggccagggtccagaggtcggagtaggagatccaggggaacttcttcttgatgggctccaggatgtcgcgcgcgtcgcccagccccgcgttggccccccagccggactcagggccgaagcgcatggtggcgccgttggagccgcccgtgttgtcgttcttgtcgtaggtgccgctggtgtgccaggccaggcgcaccagcacggggccgtagctgccgtcgtcgtactcatcgttggactccagcacgtcctcgatggcggcgcgcaccgcctggtagtcgggcttgaagtcctgtgggagggg

SEQ ID NO: 8518 - DNA, 642 bp, Chlorella protothecoides
atggccacaccaggcagcgcggacacctgccaggatgccacatcccccagtcccccatttttattcttttcccacagtgcaaacgaccgggtacgagggtgtgcaggccggcttgcccaccaggtcgagcattcccgaggaaggagcgcgccgggcacccactcacaccatgaatcctcccccccggcacagggcaccccacccctgcgtggaggcccggcctactccggcaacactctccgctcatccacctccaagctgagcacggggcgccccgagcgcctgaggatggcgcggcgcagcctgccctcggccgacagcatgccctcgccctccctcctggcctcccccgcgcccagcgtcagcagctgcgtggacgacgccagcggggaggaggttgccagcgggggggagggcgtgcgggtgatggtccgggtccggccccccaaccgccgcgagcagcgggagggcggcgcccccgccctctccctcgtggggccacgaaccctggtcctcaccgagccctcccgcctggagccggtggtgaagagctacgaccatgtcttcggctgcgagtccacgcaggaggaggtgtacgcaggtgggggcatgggcggaggtgggaggttcctcccggtgtga

SEQ ID NO: 8519 - DNA, 1035 bp, Chlorella protothecoides
gacttcaagcccgactaccaggcggtgcgcgccgccatcgaggacgtgctggagtccaacgatgagtacgacgacggcagctacggccccgtgctggtgcgcctggcctggcacaccagcggcacctacgacaagaacgacaacacgggcggctccaacggcgccaccatgcgcttcggccctgagtccggctggggggccaacgcggggctgggcgacgcgcgcgacatcctggagcccatcaagaagaagttcccctggatctcctactccgacctctggaccctggccggcgtggtggccatcgaggccatgggcgggccccagatcaagtggcgcccggggcgctccgacaaggaggagaatgggtgcgtgccgctgccggacgggcgcctgcccgacgcgtcgcgcgacaacaagcacgtgcgcgacgtcttctaccgcatgggcttcaacgaccaggagatcgtggcgctgatgggcgcgcatgccatcgggcgctgccacgccgaccgctccgggttcgtggggccttggaccttctcccccaccaccttctccaacggctacttcaccgagctgaagggcaagtggcacaagaagaagtggaacggacccatccagtacgaggacaagacgggggagctcatgatgctgcccaccgacatgtggatggtctgggacaagaagttcaggcagtacgtggacctgtacgccaaggaccaggacaagttcttcgaggactttgccgcggtgggttctcgtggttgtgcggggagggtgaggcatgaggcccgaagtgacgggggcttggcaggggagcatgggcccccctctgccccggtgcaggggcatgcagggactgcggcagcgtggccacgcctgcagccgcaccgcacccaccgtcgccacctcacacacaccctgccaccccatcatccccgccaggccttcagcaagctgctggagctgggcgtgcccttcgagaagcgcgacttcaacacctccccctccagccccaagcccatggcctga

SEQ ID NO: 8520 - DNA, 384 bp, Chlorella protothecoides
atggccggcttcaactcctccatctttgcctacggccagacgggggcgggcaagacccacaccatgatgggcgaggcctgcgcctccgaggccggcggcctgcaccccgactgcggcctcacgctgcgcgtcttcgccgccctgttccgcgccatcgaggacgtggagcggggggaggggccgcagacgctgcgctaccgcatctcctgctccttcctggagatctacaacgaggagatcacagacctgctggcaccggggccggcgctgcagatccgggacggcgacgtgaagcggggagtgtacgtccaggacctcagcgagcacaacgtgctcaatggtgaggccttggagaggaggggagagggggggctgggggtgtag

SEQ ID NO: 8521 - DNA, 384 bp, Chlorella protothecoides
atggtgctgatccagcggggcagcgagaaccggcacatcgcggccacgcgcatgaatgagcgcagcagccggtcccactcggtgttcacctgcacaattgaggccacggagcgcgccgacacggggatcaccagcacccgcaccagcaagctgaacctcatagacctggcgggtgggatgctgggaggggaaggggtcgggatctttggcgtttcggggggagtgggtggcatcctggcgccagtcttcgcaccacggtccatggcctggggaagggtgcctgagcggtgccacagggccgagcaaaacacgcatggcctgcacctcgacgtggccctggcgcaaacactggcacctccgactccatcccacccggagaagtga

SEQ ID NO: 8522 - DNA, 936 bp, Chlorella protothecoides
  modified_base (303)..(312): a, c, t, g, unknown or other
atggcgatcctgcctcagcgcctggctgtgataggtgctgggcagatgggtgccgggattgcccaggtggtggcgagctccggcatcgctgtcaagctggtggatcagtcccatcaggcccttgataaggccttggcgggcatagagagctccctggcccgcctggtgaccaagggaagggtggatgcggtgaccgcggaggctgccctgggccggctgtacacctccacatcactggaggtaggggggatggggtgggctggccaggtgcgtggcaggcttgcatggggatatgcatctgannnnnnnnnngtacacctccacatcactggaggtagggggaatggggtgggctggccaggtgcctggcaggcttgcatggggaaatgcatctgggcatcccttccctgtccagacctggggtcccaggcctcacccatgagtcgacctgaccccactctgaagtcgccatcccctccccctccttctcccccccgaaaaacaaatcgacattttgtcccccctccattcccccatcccgcccccacccaggacctgcacgacgtggactacgtggttgaggcggtgcccgagcgcgaggacctgaagctgcgcctgtttgccagcctggatgcggtggcccccccccatgccatcctggcctctaacaccagctccatctccgtgacgcggctgggcgccgccacgcgccgcccggcccaggtcctgggcctgcactttatgaaccccgtgcccatcatgggcctggtggagctggtgcggggcatgcgcaccagcgaggacacctttcgggcctccctggccctggccgcgcgcctgggcaagcagacctgcgtgtcggccgataccccgggcttcatcgtcaaccgcctgctcatgcccgggatcaacgaggcgttctacgccctgcaggag

SEQ ID NO: 8523 - DNA, 909 bp, Chlorella protothecoides
atgtcgtctctcgccagcttgcgcaagctcaaagtgtccgagctacgggatgagctctttaggcgcaacctggacaccaagggcgtgaaggaggagctgatccagcgcctcgcagatgcggatggagctggggagggcgagccgaagcctgagggtgaggagcctgtcaccgactccccggaggatgtcacagagccacagcccacagcagaccagccggcggagaacggaagccaaggcaccgcacctccagaggtggaggcggcagaagcccctgcctccatggtcagtgccccggccgcccccgaggagcccgcctccagtcaagtgacagaggcagagaaggccaagaggagagctgagcggttcggaatcgctgtggtgcccccaagtgggtctgccggcccggcgccagaggacaaggagaggctcaagaagcgcgccgagaggttcggtctgccccctcccatcgaaacggaagaggtctgttgggaccgctggtggcgtaagtgctgtcctgctggaggtgacgaactcctggcaacccttgggaaggatgaactggagaagaagaagaaacgcgctgcacgctttggccttcctgctcccgtcatcaagtctgaggaggaggagaagaggttggcgcgtgcccagcgattccaggcggcgagcgctggcgtgactggtgagaggcacaaccgaggaggtaaaggcaaagctgaaggccagggcggagcgctttgcactccaaggaatcctgaaggcagtggcgccgccggctgtgtgcagtgcgtcccaaggattaggtttacgtgcaccttgcaccaggcgtcgcagatgccaagctacctcgtctggagaacccaccttccactgactgatggcttgacaagactaatgaaagaataa

SEQ ID NO: 8524 - DNA, 381 bp, Chlorella protothecoides
atgcagcgcctgaccggcccgcaagttcacgcccacctatgcctatccccaaaccaccacctatctccaccccccgcagtgcacgcctacctgcccgccgagagctcgtttgggttcgtggatgagctgcggcggcgcagcagcggggcggcctccgcctccctcctgctcagccactgggagcggctgggggtggaccccttcttcgtccccaccagcctgttggaacgggaggagtggggcgaggaggggcagggcgtgggggcggcgaacctggcgcgcaagctgatcgacgccacgcgccggcgcaagggcctgccggtggaggagaaggtggtggagagcgccaccaagcagcgcacgcgggcgcgcaaggtgtga

SEQ ID NO: 8525 - DNA, 2037 bp, Chlorella protothecoides
atgcttctggacctccctgcgaccctcgtcgcggagccggggccgggcggctacccctcacctgccacaccgtggcgcgggaccaggtaccgagccctcaccccccgaacatcactccacaggattgccagcggagcctgtgcggaaaccagtggtcgtgccctcctcggccgcgcgggcctggccgacggtgcgccccgctccgtggcggacctggagcaggtccccaccctggtgcgcagcatctggggccgcggctgcgagggcgtgctggcgggcctgcgcccgggccaggccgcggcgcgccagctggtccggcgctgggaggacgcggagctgcggctgatcgcggtggccaactccctggcctccaagtccggccagaaggtgctggcggtgggcatcccgctggccgccgcgcagctcatgggcctggggcgcgaggcccgggcctacgccgtgcccctggaggcgcagggcgaggcctcttcacaccacccgcgcaagccggccggcggcacgggggccgacgctctgcacgccgcgcgccgcctcgcgctttgcctgctggccgcggtggcgcgcgaggcgctgctggccgcgcgcgccgccttcctgggcctgctcttcctccccgccctgctgtccagcccggcgctgtggtgcggcgaggccgcgcgcggcgcctggctgcgcctggcctgcggcacgctcgcccgctccggccccgccttcatcaagtgggcgcagtgggcggccacccgccccgacatcttccccgccgacgcctgcgcggcgctggcgtcgctgcaggccggcgccccggcccacgcctttgcccatacccgcgccacggtggaggcctcgctgggcgcgccgctggagcgcctcttcgtccggtttgaccccgagcccgtggcttccggcagcatcgcgcaggtgcaccgcgccgtgctgtccacggaaggagcggccgccgccgcccccccacgcgacggcaaggctcgcccggttggcgcgcggcgcggcaaaccttcgcccttcgcccccggcgcggtggtggcggtcaaggtgcgccacccagcggtctgcgatctgatcgagcgcgacatcacgctcatgcgccgcgcggcgcgcctcctggagctgctgggcaccggcggccagctgcgcgagagcgtgatgcagttcggcgcgcccctgcgcgagcagctggacctgcgccaggaggccgcacacctgcagcgcttcgccgccaacttctcgggctggcgcggcgtgcgcttcccgctgcccgcggggccggggctggtcgcccccgacgtgctggtggagacgttcgagggcgggcagctgatcgcgcgcttcctggagacggagggcgcgcgcttcaacaagcgcctggccggcctgggcctggcctgctacttgaaaatgctcctgcgcgacaacttcctgcacgccgacatgcacccgggcaacatcatggtggacctggagcgaccggggccctccacctgcctcggcgcactcgccgcctggacggggtgggacctgcgcctgccccgcctcgtgctgctggatgtgggcatgaccgcgcggctgacccccgccgaccagggccggctggtcgccttcttcggcaacctcacccgcctggacggccgcggcctggccgacgccatcgtgtccttctccgatgcgccgccgccgccgcgcgccgccgccgccttccgcgcagacctgggcagcctgttcgacgggctggacgccgaggccctgcgcgccgacaccgcgggcgtggtggcgggactcatggacgccatccgacgccacggcgtccagctccagggcgtggtctccaccgtggtcatcaccacctgcgtgttggagggctggtccacgcagctggacccgggcatccgcatgatggagagcctgcgcgacatcctacccagcgcctggggggagcgcgcggggcgggcactggactccgccttcaccaagtcctccctggccatggccgtggccagctga

SEQ ID NO: 8526 - DNA, 402 bp, Chlorella protothecoides
atggcggggcccctcatgtggtccatcgttgcgatgcgcaactccctggtcttccacgatgtcgacaaggtgcggtacggagggcagcaggggcagtgtgtggcatgcttggggaatcgagagaggcgtgggcgtgtgcttggtggctttgcatctgcgcaggctgcctgcctggttttcagcatgggagggcgaggggacggggagcaggcacaggaaggggcgacgcagcaccaggcccctttgacttcctgcaaggctctgacctcgctccgcatcctccctgcagcaaaccacgttgatgatgcatgcctcgccggcgatcttggcctgcgggggtgtaagatcgtggaccagggcgggtctacatcgaccgattccaggcaacggcttgggcattga

SEQ ID NO: 8527 - DNA, 1149 bp, Chlorella protothecoides
atggagccttcgagcggcatgcgactggcgagagtacctcgaagcctgctgacgccactaactcggcccctggccaggcccttccgtcagcacccgggggatggtcgcaggttcggccaccgaatccccccccgcacccccgccccccctacctgcgccgccctgacctctgagtcgccctgctcccaggccccgacctccacgcccaccaagctctacgacatgaccaccctgggcaacctgtgtgtcgacgtgctggtggaggtgcctcgcctgcccgatcccacggcgcacccagcgctcctggaccggctgcgggcgacgccgcccggccctgactccctggaggtggggggcagcggcaacgccagcatcgctgcggcgcgcttgggtctccgcgtctgctgcacaggccctctaggcagggacctttacggccagttcatggcatccgtgcttgccgtgagttgccttgttgggggagggcgggccgagggcatccggctggcccgccccgcggccccgccctccctaacctgccacgtgctggtggacccggcggggcaccacgccttctgctccgcctacgatcacggcccctggccgctgctgggcgacgcaggcgccgccttcgacgccgaggccctgctggccagccgcgcggtgctcgtgtccggggtcctgctggacgaggcccccccggcccccgtgctggccgcgctggccgccgcgcgcgccgcgggggccgcgatcttctttgaccccggcccgcggtcctggaccttccagacgcctgcgcgggcggccgcactggccgcgctgctggcgctgtcggacgtggtgctgctgacagaggacgaggcggcggcggtgacgggcgtgcgtggcgcggaggcggccgccgtcgcagtgctgcgtcgcaatggctgcgctgcgcggtggtgtgcggtgaagcgcggcgcggcgggcgcggtgctggccctgcgtggcgcagcggacggcgcgggcgcggttaggcgcctgctggaggcgcaggcgggggcggggggggaggggcggggtcccgcgctcggagccctggccatgctctccccctgccacggcgccgaggcggggagggacggccgcgcgctggcggcggaggtctga

SEQ ID NO: 8528 - DNA, 261 bp, Chlorella protothecoides
atggccaccgaggcagggcctctgtgcgatgagcccatgtggggcgtcggcttcgaggtggaggccagggtggtggggtccggggacgaggcctcccccgccccgcgcacgggcgaggacgtgtacgggcctctcagcggccaggtggcggccgctgtgcgcgctgcggcccgacgcgccctcgccgcctccgcgccccggctcgtggaggccatgtacctgtgcgaggtgggtcagctggcggggaccagggggggctga

SEQ ID NO: 8529 - DNA, 618 bp, Chlorella protothecoides
atgccgctcgtgcaccacagcacgatcgaccaggctttccaagacctgagccagctgatgagcaaggccgaggagatggtaaagctggccgagtacttcaaggagcgcctgcaccagcagccgggggccggagcgccggaggcagagctggacgctgagacggccctggacctctttgatctgggcctggtcaccccagtgaccaaggagagtgccgggcggcagtaccaccgggagcttgctcgacagggcccgcttcagaaggccggcggcatgctgccgctgccggaggtgtactgcctgtactgccgcgtgcggggctcggagctcatctccccagacgacctgctgcatgcgctggagtgcctgccccacgtgcaggcgcccatgcaggtctggcagcatggcgctgggggctttcgtggctccatccagggcgtggtcgccgggggcatgatgggcgatggcctgcgtgccagcccccaccgtctgggcctcccagcccatgcccagcctcactccattagccctcgacctcaaccctcctccacaacttacgcagctgagggacttcacctctggtctgcgggtggtgcaggccgcctcgttttcggatga

SEQ ID NO: 8530 - DNA, 312 bp, Chlorella protothecoides
atgccgcgtgcgaccttcttcaagtgcatcacgctggccgagggcgctgggcccgctatctacaccgcggtgaagtggaagggggaggggcacatcctgcgctggcgccagctggcgagcggcgagatccgtctggaggtggggaggcgccgcagcgagggtgtccctgggtcagggctgtttgtggggctgggagtggctctgacgtgccgatacggatgcgctggccgggcaacgcagggagatccatgcctgccagggcgtgtggaacctgtgtctgcggcgtcgcacatgctccagggttgttgctga

SEQ ID NO: 8531 - DNA, 861 bp, Chlorella protothecoides
atgcatgggcgcaacaaccccaccttcgatctgcacactactctcaggatgaagcggcgtgccccactccaaaagtatggggcgcctctgtatggcgtggcctggccagacggccctcacgcgtacatggctggtgggggcaacctcggaatagagaacaaggtggtcgtcgtgagctgcgacgagaggggcaagctgtcggatgaggtcaccaaatacaacaccggcgacgacgctccctaccgcatggcgatgcacccatccggacgatctctggtcctgggcatgacccgcggaggggtgcagggggtggacctccagcccagcaccagcggtagagatgcgccggagctctcccgcccaggaggtaaggcgtgggacgcttggaggaaggcacaggccggggtggtaaacagggcccgcatccactgccgcgccgccacacaccccacaggcagctttgcgtccagggcccccagcatcggcgccctgaagtgcctctccttctcctccgacggtcgcctgctcgtgatggggggggaggacggcagcgtgcgcatcgtgcactggccctcccttgagcccaagctgcactggcaggcgtcagaggacaaggccattcgggcggccgacctgtcgcgcgcccacagcgacggcatcctcaccacgacggacgaggcggggatggcagcgctctggaatgccgagacaggggataaggtgctccagctggccgtaccgcagggtgaggaatgggggaaggaggagaaatcgtggaggcgggtgctgtgtggggcagggcacgctgcgtgtgggagccctgcgcctgttggcaggagtgaggcgatgcgcgtctggtag

SEQ ID NO: 8532 - DNA, 687 bp, Chlorella protothecoides
atgcggtttgtagagctgttcacgacctcgctggcagagaatggcggcatccttgcggcgtcggccctcatgtcctttggacgcgtgggtctgacgcctggccagcctcccaaccactcggccatctggatcaatgccggcgggcaggtgcgtgggggtgcctggcgcattgctggcctgggagaagggactggattggatcaggtcatcctggcaacatgtagaacagaatgtggcaacggggcccaggacagtggtggggagaggccacccaaggacatcgcagcagcaaggattcaggccaagtaccactgctttgaatgggagagggcctaccccaagtccatcaaacgcgtcatgaagtatgtcgccgtcatcatcatcatcggcagcaccaggtgggaccttggaagaaaggaagactacttagcaggttgttcaggcagccccttccccctcgcggccttatgcccacctcccctcctcacgcgcatgctcccgccatgcaggctggcggtggagctcatgctcctgttctgcccgcactacgatgaagccacgggcgtcacgctgcacagctgcgaccgcccctccctcttccaggccatcaatgtcgcctttgcggtgcgcaaccgcaacaccgccctgggctcctatctggacctcaactccacctcgagtttgtga

SEQ ID NO: 8533 - DNA, 867 bp, Chlorella protothecoides
atgagcacaggaaggggcgatcctacgctgacctctatgagttggtccagcatgcgggcaacctcctgccccggctgtgagtccttatcttgctgtttctcagggagggggggaggtttgccaaggactgggcatggccctgaactttatggcaatctcggccctgtgaaatcgtctggccctagacccatcgtcccgcccccgtcctggcttgagcgtctcaccgctctttcccacccaagcacgatgcactcacccggccccgcctgtctgcccaggtacctgctctgcaccgtgggggcttgttacatccgatcccggcaagcccccgccaagctgatcctgagggatgtggcagagctgtgtcggggggtgcagcacccaacccggggtctattcctgcgagcctacctagtacaggtgtgcgggccgacatggccatggcaacgtgccacgctgctgtcgtcctgtccgtcttgggtgtccaggaggccgcagcctcgttggtcaagcctaccgcagcctgctgcccgccaccggcagtccctacgagagcccggagggcggcaacgtggaggacgcggccgacttcctcctgctcaacttcacggagatgaacaagctgtgggtgcggctgcagcaccagggcggctccgcggaccagggcaggcgcgagacggagcgccgggagctggcggacctggtgggcaagaacctgacctacatctcccagctggagggcctcacctttgcggcctaccagaaccgggtcctgcccaggtgggtatgaaggtgttggagcgacagccagcttctctattgcccccgagggttctgggactcacgtgcttatgcgctgcagaatag

SEQ ID NO: 8534 - DNA, 849 bp, Chlorella protothecoides
atggcaaaccccgcccacaacggggcggccgcactgccccccatgggggcttcccctgacggcctcctcttccgtccggttcctgacgcgagtgagaggccagagagcctcaccttgtcaggggaggaggttgagcaggatggaagtccagaaagctcgagcggggtgtgggaggtggtggagatcaagaatgtgtgcccctttggacagagcggcagcggcctcttcacgctgaaagacatggaccccgtctgggaggtccgagccgagtgggtgccccagctccagttccacatgctgtgttcaggtgagcagcagggccctgctgctgttggggggcccaacgcagcgcatgtcgcgcctctgcctgctggtctgctgcaggctgcgccgcccgcctcgccggcctccgtgagccctggcccccacatcacgcacccctcgtgcaggcctgtccagtgccctgctggtgagccggtcggcgacccggggcctgcgtgtcttccgcatgcctgcggacgaggcctacgccggcctcatgaagcactacatcgcgcggctctgggcggcggtgcgggcggggcggcgcagcctgccagccaacccctgggtccgggaggccaagtaccaggacctgctgaggaggacgctgatgctggcgcgcagcgcgcgggtcgtggcggagcacccgggcgcccagccgctgcgcggatgcacccacctcactcgctggttcctggacgatgggcgggagggggcggcgcccagctgacggagggagattcagtgatggtgacgggcgtgctgtgtgggctgtgggcgtcccatgcgcgcatgggcttctcgtga

SEQ ID NO: 8535 - DNA, 1071 bp, Chlorella protothecoides
atggaacaattcagcgcttggcactcggtacatgctgtcgacgtgcaagtcccagtttcccccccttcccttgatcgccgctcctctcagagcacggcgctgaaggacgagggcattgtcatcaaggcgctcgactcgatgtggaccaccaacgaccggtcggggtcctggctgaagatcaagctggattacgtgaggaacatggacatcgacgccgtcatcgtcggcggctggtgggtggcggagtgcttgggtgtagaagaagctgaagggggggggaggaccaccccgctgcacggtcgggagtgggagggccgacggggcgacgcaatctcccagttcctccttgcactggcggtgcccaatcctgtctccggggaagctcccagctcctggctgacgttctgccgggtgaggctgctggggggagacgggtgtttttgttgcactctggtggtagttggttctgccgtcacatcttcaaaatacggctgtgggattgcgcgtattcaactgtccactcatccactccccgcaattgtcgactacttgaatcctcctacctcccgctcactgggagcctcaggtcggcaccggcgtgaccgacgaggagcgagcttcactgaatgcccagctgaagcacctgttcctggatgggaagagtgtgccacccccttgcctgcagtgagtacttggatgggaatttgcctaggaatggcatctagctcctgctgcagacacctgccggcacgcactgcattgacgtcagcagggcgccaaggtttggtgcatagagctgtgctgacgggtttttcccactctccctctcaaacacatcgcaggaccacaggcagggaggcgccggatgtgtggatcaaggatccctcgcagtcggtggtcctggaagtgcatgccgacctgaggaccatcccatccagcaccttcgcgaccaagctctccctccgcttccctgcggtgcatgacataaggtggcatgtgtgtgaggggtggagggtggtggaggaatacatagggggaggaaaggggagcaggagccctggtgcctgttga

SEQ ID NO: 8536 - DNA, 1005 bp, Chlorella protothecoides
atgagcgagactacgctgttcaaggcatggcacccagatgctgtcgagtactataataagtgtggcgccagcctccgagctgttttcaacaccatgatagatcccagcacccactttgacacgggcatcattcccggcagggcggtccggccacagctggccttgggcacgggctcagtggagtatgccttcaagcgcatgcagaccaagcaggggcttgcacggccctttctcctggagaccaagtttgacggcgaacgcatccaagtgcaccgtgatggtaatggcgtgtactcctacttctcgcgccgcggcatcgagcacggccagcacagccggtacagcgcgtttgaccccgtgctgcgccgccagctgccgggccaggcgcgcttcatcctggacggggagatggtggtctggaacaggaagaaaggacgattcgagccttttgggggcctgaagacggtcatgcacgctgcagggcggcgttcgcgccccggcgagcagctggaggtcatggacctggaggggctgggtctggaggagagcgacccgacgtactccccaccccggatcaaggtggagttggcagagggttctggctgttggcccgagggcagcctctgcccctcaccaccacaccaggatgtggagctggtgtacatcgcgttcgacattgtgtacctcgacgaccgacccaccacccacctggctctgagggagaggcaccgcctgctggcagctctgctgcagtcacgcgacgccggtgctcaccgcaggatgcatgcagcctgctccccccgacccttgccgcctccctccaccaaagtcacgcccctccgcattggcagttgcgatacctacatctggggtgatggggcgagtggtgcccctgctgccgggggagacgcggttcaacgacgtcctgtgctcccgggagggcaggacccaggaggacatacaggaggctctggaccaggcaaggctgactgggcgtggctttga

SEQ ID NO: 8537 - DNA, 1203 bp, Chlorella protothecoides
  modified_base (225)..(234): a, c, t, g, unknown or other
  modified_base (1187)..(1196): a, c, t, g, unknown or other
atgtcgagtcgtcgtcccgaggcggtgcagccatcggacctctccttcgacaccctgtgcagcctgttcgacatcctgacgaacagtgccaactcaaagaccaagagcgccgcaaacaggcgcaaaattatcgataaatttatcgacacttgcgtcgcgcgggctggtggtcaggccttttgtcttttccggctgtgcatcccggcggtgagtcgcttggttgannnnnnnnnncgcgcgggctggtggtcaggccttttgtctcttccgcctgtgcatcccggcggtgagtcgcttggtgggcacatgggacgcccacctgtctctctccattaccttgctgacataatacagtgcattcccatgcagttggatgcagagcgaggaaattacaggctgcaggagggaaagctggtggatgtgttcatcaaagcttgtggggtggccagggatggctccgtcgccaaggctgcgaagggctggaagaaaccgggggtgaaaggcgtgggcatctttgcgcgagtcatggaggagatttattgcttccaaggccattctggattttgtcagacacgtcatttgattgaggcaatcagtcatgatagccatgccttccaggatagctgcaactccttccccgacccgaataccccaatcctgcagcactttttctcttcttactgtgagagaacgcatggaactccgggcgcaaaggacctaaagatccgtcaagtgaacgagaagctggatgccatggtagcatgcgcaggtgagagggaaaaaaggagtcgaatagttcatgtttttcctcatgattggaagttgagacatgaactgattgctggagatgctacagcatctgagcctcacagccctgctaaaatcttgtgcattgccagcgcttccagatccattctcagcagtgccccactgagggtatggcgtactatcgtagcctggtgctttggagtggggtactggtcatcctttttcggactgaagaaaccagcatgcagtgagcagacctatacatgttcgcacatttggctcaaaccatggtgctcagagactttcaaagagcagtgtctgcatgcactgagtttcagcaaagtatctaacacttgtgggcaccctggcaacctcttcatcccgcaccttccctccccagatcaacatgagcgagaccnnnnnnnnnngcactga

SEQ ID NO: 8538 - DNA, 447 bp, Chlorella protothecoides
atgacggagcaggacgcgtttggcacactggccggcgtggcgctgcgcgtgactcagcgccacccggacacgctggtcgctgatgtggcgggcatgtacgcggcgctgctcgcctttgcgggcacggtctaccccgaacgcctggagcatgtggacatggtgctcggcaactgccacgacgccctgcgctcgcgcggcaccgtgccggcgggaaaggcggagcgggaggtggtggccctcctttccaccccgctgaacaagtacgacgtcgtcacagcggggagggaccccgtgcacctgtgccgagtgcccccccgcccttcccccgcctcggcagtgctgggcctgaagcagtaccccgccgtgctgagcctgctgaggccaaacatgcagcgcgaggtggcgctgaacatcgcgcaggtgaggggcccccggggtgcggcgtga

SEQ ID NO: 8539 - DNA, 480 bp, Chlorella protothecoides
atgtccaccatcccctccctctggtcgacggtgtttcagttcctgcgcgataatgccaccctcctgcaccccaacaatggcctggcatcggtggcgccaggcttctcgcgggtgtcggtgactgacctcacggtgacagagcacactgtaccatacacggggtgccactactggagcaactttgagatcggcagcgaagcctaccaggccttcttcgcggccttggagaggagcggcggcttcttttacgagcggtggggcgacgcgcctgtgcactccctggcagccctggcgctgctggacgcccgcgccgccatccacttcttcgacgacatcggttaccggcatgacgacgccatgcactgcccccaggccccggacgcggtgaggcactgctcttgcatgcccgccgtggacttcaaccagcaccagagctactgcaaaagcctgcagcgccaggcggggctgctagggcagtga

SEQ ID NO: 8540 - DNA, 1266 bp, Chlorella protothecoides
ggcgagctgcgcgtgcagggcgcgctgtccgccgagctacgggccagcccccggcacggcgacggcgaggtggcctcgggcctgctgccgcccgacgcgacggcggcggcggcgccggagcccatggtgccgtcgggagtgccgccgccggtggtcgtgtccaagggtcggaacaaaacgtaccgcggcgtgcggcagcgcccctggggcaagtgggcggccgagatccgggaccccaccgtgggcgcgcggcgctggctgggcacattcgacaccgcggaggaggcggcgcgcgcctacgatgcggccgcgcgcgccatccgcggcgcgcacgccaagtgcaacttcccgctgccggaggaggaggaggccgccgcggccgcggccgcaggcggggccggcggagcgtccggcgccggcggcctggttgccgtgcaccgccacgccagcacgacgagcctggagctggacgcagggcccgacgccacctcctgctcgctgacggggcagctggacggagcggggcgcggcgacggcggccctggcgacggtcgccgcctgtcggcgcacggcgccgaggaggaggaggacatggacgacgacctggacgacgactaccccgaggtggagggcctggcctccttctcggtcacgctggagggcttcggcggcgccgaggcgcgaggcggctgtgcagccggccacggcgcgcccacagcctcctcgctggatgaggccgccctcatcagcaacccactgctggcggcgctgcccacacaggccatgcgcctgtcggacgccatgagcattcccaccggcctgccccccatctcctccgtggccatgtccagctggcgacagagcagggggtggggaggatgtcgcccccatcctcatgcatgtgcctgcacgggcatctgctgtgcctcccctgccctcccccggcctgaagtccacgatcccaccccctaccccttcatctcggcccttgcgcagaagcgcaagagcacgggactgacgccgcgcgctgcgccctgggccggccccgagtgggtccaggcccaggcgcacgccggctacagcctgggcgccagcccctttggcatgtcggtggacatgatgagcgtgggcggcggcggcgacccccacctctactggcacatgcacaacgaaggcggtggggggcaggacacgctgtccgacatgggcagcctgaggcagagcctggggcaagcttcctcccccaccaccccattgccggtttcg

SEQ ID NO: 8541 - DNA, 408 bp, Chlorella protothecoides
atggggccccatccggaacctcagtgcgacacggtactgcctgctcaccctcaccctccttcaatgtttctgggcgcactggagcgtgaagcagcgtggggggttcgtccagtgtctttctgggtccaaggtatggcgaagcaccgcaatgaggtcccccgcgagttgcggcacttccaagccgtcgcccacgatccaaccgtgacggcacccttccccccgccctcccgagcccagggtctttggtccatcggcattttcaaaggcagcggccccttcgatctccagccggtggaggagtactccccgcggcaagacaccctgacggcctggccagtggccaaccctgtattgacatgcgaatccctgttccttgacgacgaagttgctgggggtgaggcctggtga

SEQ ID NO: 8542 - DNA, 1593 bp, Chlorella protothecoides
  modified_base (122)..(131): a, c, t, g, unknown or other
  modified_base (535)..(544): a, c, t, g, unknown or other
  modified_base (1070)..(1079): a, c, t, g, unknown or other
atggggctggggtctccagcagtccttgccaaacgcagatatacacagcaggcgctctgcacacgtggcaaggggggtgaacttcccctgaagaccgtccgggaaatcggcactctcaattnnnnnnnnnngttcacagcaggcgctctgcacacgtggcgggggggtaaacttcccctggagaccgtccgggaaatcggcactctcaatttcgcgggatcagagggttcacctcagccaacagattccgcctctgtcatctcacgacaccttgctcctgctttgcaagcacggccagagtcagtcgctgcaatggccaccgctgcacggagctccctgggtcggatcgctctcggcgacaccgcccttttcgtgtgtgacatccaggaacgcttccgggaggccattcaggggttccccgcggttgtggacgtttcccgacgcatggtaaggcgtttgcttcgtcacagtggaggctgcattgttgagttgacgtcatccctagcagcacaacccgggggcatcaggccttccnnnnnnnnnngcagtggaggatgcattgttgaattgacgtcatccctggcagcacaacccgggggcatcaggccttccgatcccttgcacttgtcgtaccctaaatttccaatccctttgacctacagatccatccgtgccgcggaggtgtttcagatccccgtcatcgtgacagagcagtaccctaaggctctgggcaagacggtttctgagctgacagaggtgctccccaaagatgcccaaggtggaagtcgcacttctgtcgccatggatggcaatgagcaggtcgatgtacgtcaccgcccacccctccataccatgtcccttgcagtgtttgagaagaccaagttcagcatgctcatcgacgaggtctcggagttcctgacgcgcagggacgacatcaagcgcatcttgattgttgggattgaggcccactgccgaactagggacacctttggtggtgacaccatgtttggcttggcactggcctcggctcaactcccccgccccataccaccctcatctctatcagatcnnnnnnnnnnttccttcctgagtgccgaactagggatacctttggtggtgacaccatgtttgacttggcactggcctcggctcaactcccctgccccataccaccctcatctctatcagatcctcctcttgcatgcaccaattttgtatccctacacccatatatatgtacccttggcgccaccacccgccctcccagatcgcggttatgaggtacacatcctgacagatgccgtctccagccggtatgccctcgaccgctcgacagcactgcacaggctctccaaggccggcgctattctgacgacttcaggtgattgccggatttgtgttgcaagtgtcgcattcttgatgtttacacccgggagggattgctcggaaggctttcacccatttgcacaccctctgcccactgctgcagagactgccagtttccagctgatgggcaacacgacctaccccaacttcaaggccatctctgccctcttcaaggagaagaaggcagactccctgcctggcctctga

SEQ ID NO: 8543 - DNA, 2406 bp, Chlorella protothecoides
  modified_base (278)..(287): a, c, t, g, unknown or other
atgcacagcatgtaccagctgtgggtgctgggtgcccttgacaacaccggcggcttgacggccctggggcgcaagatgggcgagttcccgctggacccgcctctggccaagatgctgttggcgggcgcgcagatggggtgcagcaacgagacaggttggtgggctgggaatgagcggaaaggaggggatcttgggccgaggcagaagagaggggcagtgaaggccggagaccgggaacacagtgctgttggaacccaggagcgttgcatggagggaannnnnnnnnngacaggttggtgggctgggaatgagcggaagggagggggatcttgtgccgatgcagaagagaggggcagtgaaggccggagaccggggacacagtgctgttggaacccaggcgctttgcatggagggagcagcccctggcatgatatcgagcgtcaggctgaaccaagtacgccccatggccacctgccaaccctcgcagggcggaggagagcgacgccgcgcgtgaaaagttcttcgttccagagtcggaccacctcaccctcctgcacgtctaccagcagtggaagagcaacggctaccgcggcgactggtgctcggcccacttcctgcaggtgccgcgcgcgcgctggaggaggggggccgggtgtgggatttgctagtgccgcgcatgcgctggaggagggggcccggatgtgggatttgctagtctgccagaaaagcgtgacgctcagagctggcagcctcgctctcactcactcctcatccgtcgcttcaaatcctcaaatctcaatgcagtccaagggcctgaagaaggccaaggaagtcaggacacagctgcttgacatcatgcagcagcagcgcatccccatcaccagctgcggcaacgactgggacgtcgtgcgcaaggtggggaaggcagcatgggcagaaaccattgcacctgccggcaccctagctcggatcgtcattcggagtccccatcctcccacacccctttcggccgccctgcaggccatatgctcctcctacttccaccaagccgccaagctcaagggcatcggggagtacgtcaactgccggaccggcatgccgtgctttctgcacccgacgtcggcgctgtatggactggggtacaccccagactacatcacctatcacgaactggtgttcaccagcaaggagtacatgcagaaccgcggcccgaccgcccgcacacccatccacccacccacccagtgcgtcacggctgtggatccggagtggctggcggagatgggccccatgttcttctccgtcaaggagacgcactcctcacgcctggagcagcgtcagaaggagcggacggccagggctgtgatggagggggagctggagaagtcgcaggcggaggccagggtgctgcaggctgcccaggctgagcgggaagcggccatccgggagaagcaacggaagtccatcgccacgcccgggtccgcacgacctggcacaggacaacgcaagtttgggctgcgtatgcctgccagcctcgtccgagggtggggtgaagcacgccccctgcgaagcaatgtcgaggatcgaacagccccaatgcgacaaatctcccctgtcgcgcacagtgtccaaagccgcccgcatggcgaggaccaagaccccccagtccttgctgcctggaccccaatcctcgaacggggggagcatgctgatggaacccacaccctcccagagggccatcatctgcatccagtatggggtggtgtccgtcagcattaccctcttcaaccgagcggtattcagcgtttaccagttcaatttcccggccttcgtaaccctcatccagctcctggtctccattctttatatttatacactcaagtactctggtcgcctacgagtgggtgccctgaccatcgagggtgcacgacgggtgcgtgggtgacgccgggctcgtgctcaagattggttttgcatgccggctttgagcaagcctctctgtgccgggtccaaactgaccaggaggccccctcccacccaccccatcaccaggttgcaccccttgctctgttctggtggctctatgtggtgtctggtgtgacggcgcttcgcttcctcaatgtcccgatgtacaggtgggggccggttttcaagggcagcacgcaggtagacttgtacagatcatgcgcgatcaagccatacacctctcccctttctttccaccccagtgtcttgcggcggagcaccaccctggtggtggtggcgggcgagtacttggccttccacaaggtccccactgggttatcgctggtgagtggggatggtggtgtggatgcaaacaggaggacattatttggtgggtgtgcagagtatcatgtgctgccccatcgggcacgtgtgatatga

SEQ ID NO: 8544 - DNA, 2070 bp, Chlorella protothecoides
  modified_base (56)..(65): a, c, t, g, unknown or other
  modified_base (304)..(313): a, c, t, g, unknown or other
  modified_base (929)..(944): a, c, t, g, unknown or other
  modified_base (1176)..(1185): a, c, t, g, unknown or other
atggatgttggcagcatcgtcaaggggatagtgtgcgtcactccgactagtaagcnnnnnnnnnnatccctgaacactgacgtcctctttggcatcctgaagaaggtgatggggcgctggggtagggtcgtagagcggtgggggcagaatgctgcccgggatgcccctccctgctcacttggaggcgagagaacctggcatcggcgaggagggctccgacctacatgctcccgaagaatcccctcacgtctctccaccaaccaacctgtgcaggtcgtggctcggcgccgtgacttccgcctcnnnnnnnnnnctgtggttcagccaccagaggaggctagaagaatgatttcctgtcccaggcgcgcctgcttggagccgactgtcatgaagccaatccatgcgctgcccgtgtcacagggtcgtagagcggttgaggcaggatgctgcccgggatgccccttcctgctcacttggaggcgggagaatctggcatcagcgaggagggccccgacctccatgctcccgaagaatgttgacaccctgatgcgccattgtcacgcacctgttgtggctcgccgccgtgacttccgcctaatcgtcacctcggccacccttgactcccagaagttctccgacttcttcggctccgtccccatcttcaagatccccgggcggaccttccccgtcgatgtcctcttctccaagacgccccaggtaggtgggaggcgaggccatgtcgtccccagcagcgcggcagctgctcttggtatgggaggattatgtggaagctgccgtgaagcaggccattgccgtgcaccttggccatcctccgggggacatcctcatcttcatgacggggcaggaggagatcgaggccacctgcttctccatcgcggtgtgttttctggctttcccgcgtgggtgcnnnnnnnnnnnnnnnngcaggagcggctcgaacagctgggggagggtgtgccggatgccctcatactgcccatctactcccagctgccctcggacctgcaggccaagatcttcgagcgcgcgcctgagggcacccgcaagatagtggtgcgcagaggtcgggacgatcagtgggctccggaagggtctgtcgaggatgcatccgagcctcctcatcgaccaccctcccctcacacttccacatccttnnnnnnnnnnacgtctgaggggctccggaaggaggtcgggacgatcagtggggcagtcgctgtccaggcattgtgtgctgacggtcgagtctcctactgcgcacacgcacgatcccgtcctgccccacaaattctcacctccctcccaccgtgcttgaaggtgtccaccaacattgcggagacaagtctgaccgtggatggcatcatctatgtcatagacaccgggtatgctaagatgaaagtgtacaaccccaagatgggtatggatgccctcacggtgagcagggagagcgggggaggtggggtcaagaccggctgggtgaggaggcgagtgggattgagacaatggctgcaggcctggcagaaggatgcggttactgtagaaggacagggctcagccacatacagcattggtgactggccttacatctgtgatcccttgcgacccattccctcattcttgtcaccccctgacacacgtcgccgcaggtcttccccgagtcccaggcggcggccaatcagaggtctgggcgtgcgggacggaccgggccgggcacctgctggcgcctgttcacagagagcgcctttcgccacggtgagcttgcacagggttcccagccggcgtctgagtcacagatatgtgttccttggaccggcagaccgggccggctgcacctcccaagggctgaactcggtttgctgtgtggtgactgccggcgactgtagcagcccagtctgtcctgcttcccacccaatgtgtgccccactccccattcccccctcacgctcctgcagagatgctgctagccaccgtgcccgagatccagcgcaccaacctctcaaacaccgtgctcctgctcaagtccctgaacatcgacaacctgttggagtttga

SEQ ID NO: 8545 - DNA, 336 bp, Chlorella protothecoides
atgctgctgctgggcaccaatgagctggcgggcgtggctgcctacccccgacttgccgacccccgtttcctggttttcctcctggtcagctgctctcaggccttcctgctcaacgtctgcatcttccgctgcaccctggtcaactccgcgctggcaaccaacgtctccgggcaggtgaaggacatcctgaccaccgccctgggagccacgctcttctccgacgtccccctccgccctctcaacgccctgggcctggcgctgggcctgcttggctccaccgcctactcctacatttcctatcgcgaggccaacccgcgcaaggtggtggtcaagtag

SEQ ID NO: 8546 - DNA, 1158 bp, Chlorella protothecoides
atgcctgtgatcttgtgtacgagtgggttgccagtggcctccgctcccatcctcgctgcaccccgtcccggagcctggggacccaacagacgcaagtcccggcgccctgcgccctcctcagcatggcgccccgggacactgggcggtgactcggtgccccccggggcggagtatggcgaggtgggtcgggagcctcccggagcggttgctggggcaggctgccaccgggatttgctgctgctgccagggcccaccccttcacccacgcccacgcagggcctgctccaattcctcactcccggcggcaccacccgtctggacgtcgaccgcctgaatgagaagctgcggccggagggcgcagcccggtgtcggcagagcatgttccctgacgaggcgcatggcctgatctttgactgggacgatgtgattgccgacacggccggcctccagctggccgcctggcacgacctggcggcgcaggagggcctgagcctggaggccggcatgcggaggcggggggccctgctggacctccgacccgagcgagccatccttgaggtcggactggagtatgaaagggttctgggctggacgagggactgggtgcgcgcgcaggcgctggcccgccagctggcggccctgtacctggcgcgagtggaggcctcgcccgcccccctccccggcgcggcggcctggctggctgccgccgcgcgccaccgcatgccctgcgcgctggtgacgtggctggaggagggctgcgcggcgcgcctgctggaggcctggggcctgacctccgccttccaggccgtgatcggcgcgcgcatgggtgcggagacccaggccgagcgcctgctgtgcgcggcctgcgcgctgcgccgcccgcccgagcgctgcgtcgccttctccgcctgcccgggcgccgtcaccgccgcccacaactgctccatgcgtgcggcggccgtggcggggaagcacccggcctacgcgcttgcggcggccgacgtgaccgtggcctccctggccgacctctccgtcgtcaacgtgcgccgcctgtttgccgacgcgggcacccagcgcatggacctgtgcaagcaggaggcgcgggcggagggccggtcacgcccgcggagagcgaccacgggggagacccctacctga

SEQ ID NO: 8547 - DNA, 1146 bp, Chlorella protothecoides
gacggccccggccagcctctgcggccgcgcagcagcgtgcgcttcgccgcggggcccgccgcctcgcccgccacgacgcccagctggcgcagcgccgcctggaaccgggcgcccggcggccagcccaccctggaccgctccccggacctgcacggcggcgagggcacggcgcgaggtagcgaggacgcgcagctggaccgcgactggtacgaccaggacgacgccgggggcacggtggacgagacgcacaaccccttcctgggcgacgcagaggtcgacccggcgctgcgccggcgcgcggaggcggcgcagcgccggctcacgcgccgcgacggctcgctcatgacgctggcccagagcaagcgcgcgggggagctgcagaaggacatgaacgcctgggaggagaaccggctggtgcagagcggggtggtgcgcctgcgagaggtggccaccgagtttgacgacgccgccgacctgcgcaccgtgctgctggtgcacgacacccggccgccgttcctggacgggcgctttctgttcacgcgccagcgcgggccggtgctgccgctgaaggacccgacctccgacctggcggtgatcgcgcgcgccgggtcgcgcctggtcaaggaggtgcgcgagaagaaggaggcggggaagagccgggcccggttctgggaggtggccggctccaagatgggcagcatcacggggctgacgggcggcgagcgcgaggagaaggcgcgccaggaggagctcatgcgcctggagcagggcagcgacgacgagggtgactaccgcggcaagagccaggggaagggaggaattgaaagctccagggcagagggcgactggctttggctgccccaagtgcccgccagacatgaagggggagggtgctgcatgcatgaggcaaggggccgggcaagcatggctctttttgacacacccgagtggtgcggcagcatgatcgcccccgcttttcctcatccacacctgcagttccggacgcacatgaagaccaacgaggcggcgtccgagttcgcgcggaccaagaccctggcccagcagcgccgctttctccccgtctacagcgtgcgggaggagatgctgcaggtacttgtgctaaagggttcaaggaggagggggagc

SEQ ID NO: 8548 - DNA, 594 bp, Chlorella protothecoides
atgagcatctcatggacatgctctgacgcacccttccccctctccaccgcacccgccagcttcaaggaggcggagcggctgaaggccgagctggcggcggcgggcggcgagcgcgcgcccccgccccccgctttccacctgggtcagctggtgtgcgagcagggccggggctacacgggcgtcgtggctggctgggagcaggtttgcggcgagggccccgcctggctggcagccgcagggcacgaccgcgcaggggccccagggccctggtacttcctgctggtggaggaggtggcgggtcggggcccccgctccggcctgccccctgtggccctggtgccggagggcgccctggagcccgcgggcgacccctcccttgtccccgggggcgcccaccccctgctcagcctgctgttcctggggaaggacgcagagggcaaccacctgccctgccgccagctgaggcagaggtttggggcggagaggcgcgacgtgcaccctccaggtgggcctttggcggggtgcctatgtgaagtcaggctggaccggaggggtagtggctggaggggaaggggggagaaatggggtcgttga

SEQ ID NO: 8549 - DNA, 336 bp, Chlorella protothecoides
atgccccgggcgggccaaatcctctccccatcccaccccccaccctccaaatacccgacccgccaggtggtcaacatcgaggctccggaagcctttgtgggggcgctgtgccactctacctgcctgccgcgcctggccctgcgtgccgcagccctgcgcgaagcgctgtgcttcctggggcatgctggggaggaggggcgggaggtggtcacgctggccgccttccaccaccccgaggccttctcggcggccgaggcggcggagctgctggcattcgagaggggagccgcggtgctggagatgcagcagcgggagaggaggatgcaggcactgtag

SEQ ID NO: 8550 - DNA, 2115 bp, Chlorella protothecoides
  modified_base (1738)..(1747): a, c, t, g, unknown or other
atgcacttgccgctgtgcgccaggaccaccgttacggacatgtcaggtctcgaggtttcggtcccgagcacggacctggacgcccgcggaggggtagggcacggagcgggagctttgccgaagctctcagccgatctcgtttcacatgcttttgagctggagcaggcgtccctcgctccccgccctctcggagtcgggagacgctggagacctctgatacctccaagacttgcttggaatgatggcagggactcgccacctccctgctatgatcaggagaggagagaggagtcaccacagtcaaacgatctgaatagagggagggattttgtttggagcgcgtacgccctcgtcagagctgtgttttcagggcaagggtacccatccagctgggactgggaggtccaccgggtaccacctgggagcacagatgggaggggaagtcgatccaacttgggcgcgatctcagccccgcaagtcaatgcagatcacaacatatttctggagagcaggctggccatggggaaggagatagagatgaaggacgccgagtcgccttcacctctcgtggggaaggatgaggctgccgtggaggaggccagcgttctggaacagctggccgtgacggtgtcggtgatcgaccgggcggtgcgtgccaaggagacccgcaccgtcttcaaccgggtcctgcgccaggtggcgggcgtgcgccgacgcatgcagtccaaggacctgcgggactttgtgacggctcacattccccccggcaacccctccctggagcccctgctggcagccctggatgagccgtacagggccttttggggggagggggggtcccatagtaggcgtgtatttgtggagtgcccagaacaggccccgccttgcgctgcggcagctcgggcctggagcgcatcagcgatcaccgggcattcccttgcccaaaactcccatcagccacaccgctgcatccctgctcatccacaggccgacaccgcggccatgtctaccctgacccccagcagctcccccccggcacccgccacctcccctccgctgccggaggtggaggccctcgctttcctcctggtcacgctcttgctggtgaatgggcggcagtgggccgcggcgcacgacctggccagctccgcgctggcacgcctggcggccttcaaccgccgcacgctggacgtgctgggcgcacgcctggcctcgttgctgtcgctgtgtgcggcgcgcgccgggcgcggcggcgccgcgctgcgcgccgcgctgctggccgctcaccagaccgcggcgctgcgccgcgatgaggtgggccaggagaccctgctcaactgcctgctggccgggctgctggacgagggcctgtacgagcaggccgacgcgctgcgggcgcgggcgcagcgccccgacactgcgcgcgacgtgcagcagctggcgcgctacctgtaccacctgggccgcatccacgctgtgcgcctggactactccgaggccaaggagtgcctgcagcaggccgtgcgcaaggtggagaggggggtccagggtggatgggtgggtgaagggagctctcgaggggagagtggtcctcaaggggagagtggtcctcggggggcgagtactcctcggggggagagtagtcctcggggggagcggggaggcggcggtgagaaaagagggagccgcgcgggcggcgacgttgagcaacctcgccccggaaatctccaccgcccannnnnnnnnnggtgtgtgtgtgtgaagggaggtggagctctcgaggggagagtggtcctcgacgggagagtggtcctcgacgggagcgggggggcggcggtgagaaaagagggagccgcgcgtgcggcgacgttgatcaacctcgccccggaaatctccaccgcccacccttgtgcaggcgccgctgacagccaccggcttccgcgtggccgccaccaagtggctgaccgttgtgcggctgctgctgggcgagtcgctggaccgcggggagctgacgcgcggggagctggcgcggcacctggcgccctacctggcgctgacccaggccgtgcgctccggagacctcgccgagttcgcggccgcgctgcacgcgcatga

SEQ ID NO: 8551 - DNA, 567 bp, Chlorella protothecoides
atgcttgagctggtgtttgcgcccgccgaggaatggatcgggcgcagcgacgaggacatcatccacgccaccatgaaggtgggcggcggtacatctgtctggacgacaggatgtggggtgcctgcctgcgcatggattgggtcttctgaccctggccctgcagcagccttgcccacccctcctcctccctcacaacccctcctcgtcctcattcaggagctggagaacctgttccccggtgagatcaaggccgatggcagcctggccaaggtgcggaagagccacgtggtgaagaccccgctctccgtctacaagacggtccccggctgcgaggcggcgcgcccctcccagcgcacgcccatccccaacttctacctggcgggcgactacaccaagcagcgctacctggccagcatggagggtgccgtgctctccggcaagctggccgccctggccgtggccgaggacgcgttggagagggcgggcgaggcgccggcgcccagcctcaacgcggcgcagcgcgacgccaaggagagcgccgtggaggccccgccggtcgccgtctga

SEQ ID NO: 8552 - DNA, 1212 bp, Chlorella protothecoides
atgtccagcacctctcgttcgtgcgccacccctcccacgtcttgcgccaccctcggatcccatgccggagcccttcgacgcacgcacattaaacccttcacacctgtgacgggcaacacccctaggagcaagaggaacctacagatccagtgtcgagacttccccaagcctgccttcgagaatgagaagtctttcaaggaggctgccagcctgtcctctgcagccactgccctgccccggccccagcggtccctgcgggtggccattgcgggtgcaggcctggctgggctgtcggcagcaaagtacctggtagatgctggccacacaccgatactcctggaggccagggatgtgcttggcggcaaggacaaggatggtgattggtatgagacgggcctgcacatcttctttggtgcctaccccaacctgatgaacctcttcaaggagctcggcatcgaggaccggctgcagtggaagtcgcactcgatgatctttgccgtgcgagagtcgccgggggagttttccaggtttgagttccccgacctgcctgcgcccctgaacggcatcgtcgccatcctcaggtctggtgctgggggttgggacctggacgtctattctcatgatgtatttggaccacatgatgggatgatctgtgtccttgtgccttggttttggagggaaggccctcagagtttgaaacagcttcaagctggatctgaatcgcgtccccaacctgcccactccaggaacaaccagatgctgagctggaaggagaagatccagtttgcgctgggcctcatccccgctatccttggcgggcaggattacgtggaggcgcaggaccacctcaccgtcaagcagtggatgctgaagcaggctgtaggcgccgggccgaccaaggccttgggtcgctggacgagcaggaaagctgggagcccagtgcagggtcagcgccccgcacccccccctccgtcacctctgagcctcccatccccttgcccactgccgcagggtgtgcctgagcgggtgaacgacgaggtgttcatcgccatggccaaggcgctgaacttcatcgaccccgaggacctgtccatggtgtgtgcgatgcccgtcccccgcaatggatggctggacccccaaggcaatgcacgtctcgagcccctgcgatgggtgtggagcctccccggggtgcctggaagggctgctgcatag

SEQ ID NO: 8553 - DNA, 219 bp, Chlorella protothecoides
atgcgggcgggcgcgacgcgggacgtgtacggaagcggcgagcccgcggcggccttccacgctcgcatcgccttctgcatggacatccacaatgaggcgctcaaggcgatgcggtatgagtcgctgggcgggctgcagctggaggacgcagacaagctgagggagaggcaggagcaggagctccaggcggcgctcgaggacgacgggatggacttctga

SEQ ID NO: 8554 - DNA, 552 bp, Chlorella protothecoides
atggccttcctggacggcgccccccccgagcgcctgtgccagcctgtcgtggactacatccgcgagcggggcggggaggtgcggatgcaggccggcatccgccgcatcgagaccgcccccgacggccgggtcacgggtttcaagatggcggacggcagcagcctgcaggcagatgcctacatgtcggccatgccggtggacatcgtgaagaagctggtgccggaaccctgggccgaccagcccttcttcaggaaaatggacaagctggtgggcgtccccgtcatcaacatccacctctggttcgacaggaagctgtccaccgtagaccacctcctcttctccaggtccccactcctctctgtctacgccgacatgtccacgacatgcaaggcgaggctgggatttgggacattgggaggtgcacctggccggcgcaatttccaggagcagccaagttctcgctcgccccttcactgggcatggttctgtcacccccaccacatcccacatccaccaatctgcgaccctgcactccccacaggagtaccatga

SEQ ID NO: 8555 - DNA, 411 bp, Chlorella protothecoides
atgcggtctcacacaggtctggggccccccttcacgaagcgatctggcccccacagggcggacgcggtgcaggccgccctggcccagctcaccggcatcgagcaggcggaccagatactgatgcatggcggaaacagggtggacggtgccaagaccctggcgcagtacaacctgccagaggtgagggcctttgccgtttggctggaacaggggggaatgtggggagagggtgcaatgcctctctgcaattctagtcctcgaggtggctccaccccaattccttctcaggacccggcaagcgctcagccagtcttcctgtacagtcgccggctgatgcgacctggaacccccgcgccgccgctggatccggtgcccgagacccatgtgcaatgtgagtgctgcaggggttga

SEQ ID NO: 8556 - DNA, 603 bp, Chlorella protothecoides
atggctggcccctcccttccaagctcagagatcgcggaggaggtggtgcacgaggtcgcggcgctcgtggcccagggcctggtgagtgttacccccgccccctggttcgggaatgcgcagtcgcatggcaattgtccacaggccggttccatcaacccaacgcccgccaccctgtgccaacaggaggacgtgcggatcccgcgcaacatctgcgtggagaaggaggcggcatccactgtgccgcctggccgagtcagcgtggatgtgtttggggtgcccgcctcctccctccccatcgaccccgtctcatgtcccaactgtgcacgtcgggtggcttcaagccgcttcgccccccacctggacaaatgcatgggccgggggcggattggggcgggcaggcaggacccacctgtaccggctgccgtgaggaggcaagtctcagagcctgacagacaccttgtcgagcactgtgcgcagcagggcacttgggtcccacgccttggtcttgctttcctctgcaagttcctccccgcgcttgggcccaccatccagggaggcacccgtttcttgccctgcggggcggacaggcagctggtcaagtag

SEQ ID NO: 8557 - DNA, 537 bp, Chlorella protothecoides
atgaccgacgcagatccggctcctcaaagctggtcggcgccgggggctggcgtcgggcagtgggagccgggcaccgacttcattccgatactggagagtcagctggaggctgccactgccatctggcaggccagtcagcagaggcaagctgctctggcggtggtgtttgaggcggggtgcctgctcctgggcgggcgccactttaggccatcaacttgcttgcgactaatccccacttctcctgcgtgtttcgccctgcgtggcatgctacacgtgctcacctgcaccctcaccacatgcgctccctgcatctgctgctgcagggttgcggccgccgcccagtacctcggtgaggtggaggcccagggcctgtctgtcgacgcggcgtgcaccaacgtggagctgcattaccccaagaccgccgccgcctgggaggagttttccacgcgcttcgcctcccagcacgccgccgccgaagggggtgcgcgtcgtgctgggggcctccccgctgcgcctgccgacatgttcctagactga

SEQ ID NO: 8558 - DNA, 1200 bp, Chlorella protothecoides
  modified_base (192)..(201): a, c, t, g, unknown or other
gcgcgcggcgccgccggcgaggccgcggccgccgccgcgctggccgcctcggccatcgagctgctgcgcaccgagctgcgcgcctactccccactgctgctgccggtggagccgcgcgcgcgcggcgtggccgcgcgcgcgctgcaggacgcctttggcgctgccttcctgccctgggtggtgggcgtgagnnnnnnnnnncgcgcgcgcgctgcaggacgcctttggcgccgccttcctgccctgggtggtgggcgtgaccgtgctggacaaggccacgctggaggcgctgcgcctgggcgtggcgctggaggagtttctcaagaaggaggcgcgcgaggacccaggcgagccctgggacctgcaggcccgcatcaatcccctgctctaccagtgggtggagggccaggccagcatgctgcgcggctggatcactcgcatcctggcctccgaggactggcagcgccacgggaggcagccggggcgcggggccaggcgcgtcgggtctggggcaggggattgcaaaggcgaacgacggcgcagctcagaggatgctcttgggccaagacaggcacgagcacctcgcagtacccgagcgccaacaagtttggcagggcaggccggcctgcgaaggcctccacccgtgactttgccctggtccacccgctcacgcacccacatgtacacactcccccactcatccacccccccaccaccaccaccaggtccacgacggaggcggtgaaggccgcgacggacacgctggagggccttttcgacctgggcatctccccgctgcccacgggcgtgctgcgctgcctggtggacggcgtggacggcgcccttggggcctacgccgccggcgtgcgcgccagcctgcccagcgtggccacgctgcgcccgccgcgcccggcgctgacgcggtacaagcgcgaggtggtggcggcggcgcaggaggcggaggccgctgacgggcgtgtgggcctggagtcgctgtcttgggtgccccccgtgtcgcgcgcggaggcggagggcgtgctggccacgccctgggacgcgctgctgctgcgggccaacgccgccgccgcgctgctggacgcgctggacgagctggagcgcctggtgctggaccggtggcaggccggcacgccgcgcggcggaacgggcgggggcagcggcgccgacggcgcatccgccagc

SEQ ID NO: 8559 - DNA, 903 bp, Chlorella protothecoides
atgcgaggtctgtgtcggcagatagagcccacgggccctatctgcctggcgcgttgtcatcgtcccgggcacgaggccccggaccccgggattcccagtttgctgtcccccatccccactgcagagccagtggatgggagcttcccggtggtcgttacctcttatgaaatcctgctggccgacatccgcaacttccagaaggtgtcctggaagtacctggtggtggatgaggggcaccgcctgaagaaccacaactgccggctcatccgcgagctgcgcacgctgcgggtagacaacaagctgctcctgacgggcttgccacggcctggtgcgaggacgtgcccatcaacaggcccacaggcacctgcccctggtggccgggaccggacgatccacttccgcccatttctcctacgcataggcacgccgcttcagaacaacctgacggagctctggtcgctgctcaacttcatcctccccgaggccttctcctccctgtcagactttgagtcgtggtttgagtccatggccgacgccggcgggcagcaggaggacgaggtccggcagcagacagcaaaggtgggctcaagtggtggtggtgcgctgggcacgctgcacgcgtgggcgaggcagccgtgtgccgcacagaccggggcgcgggtgggagtcagctgccctggggccatgagatcctgctcctgttggcactctcccatcctctctcccgcccaaactcgacaggtggtggagaagctgcatgccatcctgaagcccttcctcctgcgccgagtgaagagcgatgtggagaccagcctgcccggcaagctggaggtggtgctgtatgcacagcagtccgccaagcagcaggagcttaataagcaactgaaggacaagactctgcgg

SEQ ID NO: 8560 - DNA, 756 bp, Chlorella protothecoides
  modified_base (648)..(657): a, c, t, g, unknown or other
cgcgtccccggggccaaggaggcgctggtggaggagctggcccggctgcgggagtttgagcgggaggaggaagggaacgagggcatgactgacgagcagcgggaggagcagaggggcgtcggcatcgagcagcaggaggagcaggtgggggacgccgtcggggagctgaccaatcaacgtgccagtcgcagcgcccatccagcctcttcaaagccagacgccagccaggcccctcccccgcccggccccaagtcgcgattccacagcaaggcgtcgcggcgcgcggccatgctgggcgtcgcagcgcagcgtgcacagcacgccgagccggggagcgatgggctctgtgtcgaggcccgtggggcgaccaagaaaccgggcatgcccgcgtggctgcgcgagacgctggcacgcctgctggccgcgccgcctgacactctcgaggccgccgccatggtgacggcctgcaggccagaggcgctggactcgctgaccgcctcgccccgcgaggcacgtggccgtgggttcggggagggtatggggggcccttcaagtcaccctcccgccaatgttgtggagagcagcaatcaaagcaggagccagcccctttcctgccgttccttcctccaactggccggccccactccnnnnnnnnnngtgtggagagcagcaatcgaagcaggagccagcccctgtcctgcccttccttcctccaactggccggccccactcctgtgctcggcaggctgtgcctga

SEQ ID NO: 8561 - DNA, 945 bp, Chlorella protothecoides
  modified_base (354)..(363): a, c, t, g, unknown or other
  modified_base (452)..(461): a, c, t, g, unknown or other
  modified_base (827)..(836): a, c, t, g, unknown or other
atgcaggcgctgatgcaggcgctgaccaggcctgagcgggtgcttggcctgccgggccccgtgggtttgaacgcgcaaactgaggacgcatgcctggcttggcagctcttcgaggcggacgccaactgccagaatgtggccgactggttccagagctttgcagacgtgcgcgagtgtcatgggccgaggaagaaggggaggaagaccggctccaaggcggcagatgccaaggtgcgactgagcttccccagtactggccaaggctgggcaagaaggttttgggtcgggcttgcgcgtgagggagccgccgtccatcagcctagaaacacatgcctaggctcattccagtcatannnnnnnnnncctgagcttcccagaatactggccgaggctgggcaagacgtgcatgcttgccatgccggccaccaggagatgtgtaactcatcggcagnnnnnnnnnnattcactccgtcgcaggccgatgcatgtgccgacggtggcgcgcgcatgcaggtcgcggcccgcttctcccaggcggtgtcagagctgcagttcgtggggctcatccgccacgccacgcggaggaagggggattatgtgcagcgctgcatgtacatgccagccatcataaggtcattcactcatttctggtctggcgattacgaatttgtaaggagaagtcaaggggtgtgcgtggagggttcgtcaggcagaggaccacacatttgtatgggagtttcgttattggaagtcggaaggttcgagcgtggctccgccagcatcgcgttccgtcgcgtgattggcgaaataaaagctcacgcagaacnnnnnnnnnngtttggaaatcggaaggttcgagcgtggctccgccatcatcgcgttccttcgcatgattggcgaaataaaagctcacgcagaacgaggagcattacacattcacattaa

SEQ ID NO: 8562 - DNA, 840 bp, Chlorella protothecoides
  modified_base (437)..(446): a, c, t, g, unknown or other
atgtcgatggttgccatcccaaacgcgatgaccacagtgaggccctctgccgcctcagcaagaccttcccgggcagcatcccgcctggtcgtggctcgagggtgtggacccgggtaccgaagccagggatcgccccgtaactggtcgtatgggcagcctggctcatacggggcgagctgctctccccgcttttggggcccaagcatgggaatgggaatcgggctcgagggagcgttccgtgatttcgagaagatgatgaacgccttcaaggagacggaggtccccaccgagcgcgccgccttcagactccccatcgacctccagcaggaagacaagcgcatcaccatctcggcagatctgcccgggctgaagaagagcgacgtgaagacaccgctcttctcaggtcgaggtgtctcccgagggtgtcctgaccatcnnnnnnnnnntttcactcgcgctagagaccataatgttctcacgggacggcggatctcgcgagagtctctccacaaccccgcccgcccgctgaacttcagacaccgttcttctcaggttgaggtgtctcccgagggtgtcctgaccatcaccgccgagaggaaggaggaggctggccagcggtcctcccggtctttcggcgagcggttccgcggccggttccggcggagcgtgcgcctgcccaagtcggcagcaccggagggtatcaccgccaagctggaggatggcgtgctcacgctggtggtgcccaagctggagactgagagccctgagaaccgcatcatcaacatcggtgatgactctgggcccgagtctatggagtttcccccctctcctgctgagtga

SEQ ID NO: 8563 - DNA, 1290 bp, Chlorella protothecoides
  modified_base (321)..(330): a, c, t, g, unknown or other
  modified_base (771)..(780): a, c, t, g, unknown or other
  modified_base (1016)..(1025): a, c, t, g, unknown or other
atggcgaccgttatgagggctgcgggctccgcacgcacaccacccagcacaattcatgatggcccgcacccatgcccgatgcagaggaagctgccaacaaagccatgtaatatgggcagaatgcgacatacaggtcctatggtgtgttgcatggcggaggcgcccgactccagcgagcaccccatcccacatgatctgcgaatgggccggcgggccattctgggctacggcatggcccttgcagcgtttggagcgtcaccagccttcgccgtcgagaacctgtccaagcttccttcaccgcctgcaatccctgtacttgannnnnnnnnncgtcgagaacctgtccaagcttccttcaccacctggtacgtcatgatggccatcctatacagagctgatgtgtttctatggtcgttgcttgaggcatgcgacttaaatgtttccctagcaatccctgtacttgacaggtttcaagcgtcatcaggacatcctggatggctacaacttcctagtgccaactccatggcagtttgtgacggtcagcaccctcacaagtgtcacaccgctgtcccacctcccccgcagacatccggtaacgatgtattctatcgcaacccttacgatgtggagcagaccctgtttgtggacgtgagctcccccacctctacaaagtttacggcggtgactgatttgaagagcccccaggatgctgccgagggcctcctgacagttgcactgcggcatcccacagtgcacccatcccagccattnnnnnnnnnngctgcttgctctgattctgcggtccaacattgctttgtcattgcccagcagttgcactgtggcatcccacagtgcacccatcccagccaccgcctcgctgcagttcaaaaaggagtacatgtccacccggctgggagtgaagcggaatgccgagatcacgagtgccacggagcgcactgccgacgacggcaggatctattacgacatcaggctgcgtgcccggtccttcgcctccnnnnnnnnnntgccgacgacggcaggatctattacgacataaggctgcgagcccggtcctacgcctcacgcaaccagctggccgtgtcccagagagagatcgatgccggcaccgagctggagtgggacaggcagtacctgacggtgctggggacggccaacggccgcctgtacagcatgcggttgcaggcacccatctcggctgttgaggggccagggggcgagaccctacagaaggtggccgactccttcagatgcaccaccgttgaaagctga

SEQ ID NO: 8564 - DNA, 420 bp, Chlorella protothecoides
  modified_base (364)..(373): a, c, t, g, unknown or other
atgggaggggggccgtgtcggaattgggcgtgccggaatgagcggcgcgagactgcgcctgagctgcgactccctcccaccaagcgcaggttcctgctgtctgccctggtttcggatctcctaatcctgcgcctcttcctctttgcggcctacatctttctcttcgcggcggcgctgacgggctacccccgattcccccggtggggctggcaaggtggggcacctacaaggcggtcacagcgccgggaggtgggagtgtggcaccctcccgggcaggggactgccctgccaagctcggtacccctatcaactcccacctttctcccgccccaacccccatccacagatgcgatatccgtggacnnnnnnnnnnctcacagcgccgggaggtgggagtgcggcaccctcccgggcaggtga

SEQ ID NO: 8565 - DNA, 1143 bp, Chlorella protothecoides
atgggcggactggggctgggcgctgctccgcccttcgagggcggcggcctcggcttcgccagggccggtctggaggccgacccctcgatcagcaaccggccgcacggggcacctgcggacgacggtggcagcgaggacgacgatggcgtgctgcccgaggcctttgggcgccagctcgcggctgccgcccggcagagggccgctgctgctgctgcggcggcggcggccacgcaggctgcttcgtggcgagcgcctgcatcccggcccgggatcggcgggggggccgcccctgcccccgaggccaccgggacatttgagtcgcacacccgcggcatcggggccaagctgctgtccaagatgggctggcaggctggcaagggcctgggcagggacggcaagggcatcgccaagccgctggaggcccagatgcgccccaagggcatgggcatgggcttcggcagccggcccgagcccaagctggtgcagccggagcccaatgcccaggctcacagcgcgggcccgtcggccgccaccgcatcgccaccccccggcgcggccacccccagcgccgaggcccgggcctggaagcggcgcgacgcggcggcgcgcgagcggcgcgccttccgcaccgcgcaggaggtgctggacgcgggcggcgcgcctcctgccaccctgctgtcccagcccgtgatcgacatgcgggggcggggcggcgcgcgcgtgctgcgcgacctggcgggcctggaggtggtggaggaccgcgatgggggcggcgagtccgcgaccctgggccccatgccggagctggcgcacaacctgcgcctgctggtcgagctggccgagtcaggcatccagcgcctggacgcgcgcctgcgcggcgagcaggactccgcgctcctgctgggccgggaagcggcgcggctggaggaggaggcgcgcgcggcggaggcgcgcgtccaggcgcaggccgcgctgctggacgcctgcgagcgcggggagcgggagacggatgctattgcgctggcgggcttgtacgccagcctgcgcaccgagctgcgagaggagtttgaggcgcgcgacgtcgcagcggttgcggcggcgcaggccgcgccgctgctggcgcggctggagcccgctgggtga

SEQ ID NO: 8566 - DNA, 609 bp, Chlorella protothecoides
atgctggagggctggatggccaacggtgtggcccccggaggccagctcaccaccaccaccgacctggagaacttcccgggtttcccggagggcatcctgggggtggagatcaccgacaagttcagggcgcagtcggagcgtttcggcaccaagatcttcagtgagaccgtgaacaaggtgtgtgcgaggggtcgcagggagcaccacaccgtgcctgtgtggcatgccgcatgcggcctgccctgctgctccatcgacgtggaccaggtggacctgtccaggcggccctttgtcatcagcacggacgagcggcaggtcgtcgcggacgctgtgatcatcgccactggcgccgtcgcgcggcggctggagtttcctgggtccgaggagggcacggggtactggatgaagggcatctccgcctgcgccgtgtgcgacggcgccgcgcccatgttccgcaacgtccccatcgccgtcatcggcggcggcgactctggtcagtgcgaccgtgtgcggccttgggtggacaggaggaaggggaggggggctcggaagcagtgcaaaacggtgctgagaaggggtttgtcgaagcgcctgccgccgattgggtga

SEQ ID NO: 8567 - DNA, 1458 bp, Chlorella protothecoides
atggtgtggctggacgatgaacagagggcctacctgaggtcgttcacgtacaagcatgtgcccgcagcaggcccccaggtagtgtgcgctggctgggcgggcggctggggtttcttggggggaatgggatttccgacccgcagtcgaccctcgcaggatattcttctcacgtgcatgtgcgcacactggtgggaagggtgcgctgggcggcatcgcaacggggctgttggaccaccaaggcctcgcctcacgcccacaggccttcgtcaagttgggcctgtggaacctttccaaacctctccctcacccccctcgcccccttcacccacgccgcagaagcccgtgctgcagtcgccgccctcccgcccatgcggcgcggtgaccccgcgccgcctgaccctgcaggagatgctggaccgcatggaggactgggagcgcttcgacgtgttcgtgctggagaagctgaccggcggcgagcccctgcacgcggtgtgcatggagctgctgcgccgccgcggcgtgctggaggcgctgcccatccccgaggaccggctgagcagtttcctgcgcgccgcggagcgcgcgtactgccccaatccctaccacaactccacgcacgcggcggacgtgacccaggccctgggcgccatgctggccatggacgcctacggcgcggcgctgacgccgctggagcagctggcgctgctgatcgccggcgcggtgcacgacctggggcacccgggcgtgcagaacgccttcctggtgcgcaccgaggcagactgcgccaagcagtgcggcggcaagtcggtgaacgagtcgatgcacgtcgcgctggctttcgagctgctgcgccgccctgagaacgacttcatctgccggctgccgcctgaggaccgcgccgagttcctgcgcctggtggaggccatggtgctgtgcaccgacatggcctaccacgcggccgcgctggacgactttgccgacacgctggccgagctggggcccgacctggtggcctggccgggggaggcgcgggtcaaggcgctgcagatgctgctgcacaccgccgacatctccaaccccgcgcgtccgctgcaccactgcatggtgtgggggcgcaagatccacgacgagatgtacaagcagggcgacctggagcgcgcgctggggctggaggtcaccgccgtctgcgaccgcgcctccgcgcccgtggcctgcggccagctcaagttcatcaacatcttcctcaccccctgcctcaagctggtggaggggctggcgcccaacttcgtggccgcagccatgccccacatcgagggcgccgcggcctactggcgctcccagatcggagagggcggcgaggaggccacggcctgcgcgcccgcctgcgccaccttcccggggtcggccgcgctggggtcgcatgagattcccgaccccaagcccgccaagggggcctga

SEQ ID NO: 8568 - DNA, 180 bp, Chlorella protothecoides
atgagctccgacgagcaggagaatgatcgcttcgatgtggacaacgactacgaaggtggcgaatttatcgagggcgaatatttctacaggaataagcgattcaagaagcagcaaaccgcagaggacaggatctatggcgtgtttgccgaatcaggtgtgggcagtggattgtggggatga

SEQ ID NO: 8569 - DNA, 618 bp, Chlorella protothecoides
atggaggaggccaacttcctgaccaagtacggcagcaaggtgtacataattcaccgccgcgacgagttccgtgcctccaagatcatgcaggttggtggtggcagccgaaagcgcgtgctcgacaaccccaaaatcgaggtgctgttcaacagcgtggtcacagaggcctttgggaatgagaagggcaacctgggcggcctgaggctgaagaacacggtgacgggcgaagagtccagcatcgatgtgagcggcctcttcttcgccattggccacgaccctgccacaaagttcctggacggacagttcttgtctggagcctttgtgtgcccggctgctgcactcatgcccaacgatgaacactacagctcccagcgcccagccctgctacccacccccaccccttctaactcgtctgacccctcgccccacactctgcagttggagctagacagtgagggatacatagtgactgccaatgagtccacggccacgtctgtggagggcgtatttgcggctggggatgtgcaggacaagaagtggcgacaggccattacggcggcaggcacaggtagcgtggagggtcaggcgggaggcacggggtggggatcgcaggcttga

SEQ ID NO: 8570 - DNA, 357 bp, Chlorella protothecoides
atggtgcaacatcccgacccaaagtacatgcgccgcgccatcgagttgagcgccaaagcgggcatcgaagagcgtacaggaggagtttttggagcagtcctcgtgcgcaaggagacgggagaaatcgtgggcgagggctacaaccgtgagtgggtttgggggcctgagggtttcggcgcggccctcccgacgcaattgccacacatgctcgccccctcttcaccgcaggcgtcctggccgaccatgatcccactgcgtaggtcgcgtggatggttcctctcatactcgggatgcgctgcatgcgcggcgaccttgctccggcgcatgcccccaggtggcgaggccccgcgatggtaa

SEQ ID NO: 8571 - DNA, 243 bp, Chlorella protothecoides
atggagaggaagggagcagttggagtactagataagcccaggaagccaggcggccaagctcgaggccgcggcgccacctacgacgacgtgaagaagtacggccagttcgaggatgccgacttcctggccgagatcaacgcgtccgacgaggacaagaacgtaaagatcaagcagtacctgagggaggaggcggtggtgccctggaagacctactccgagttgaccgaccgcatccactactga

SEQ ID NO: 8572 - DNA, 2673 bp, Chlorella protothecoides
  modified_base (119)..(128): a, c, t, g, unknown or other
  modified_base (420)..(429): a, c, t, g, unknown or other
  modified_base (1293)..(1302): a, c, t, g, unknown or other
atgggcggggaggggtgcgcgcccggtggggaacacggcggccaggctgagcagagcatctctggacccagatttcgcccagagcaacaccaatttcccccgtcctccttgcaacattnnnnnnnnnngctgacgcagaagtcggagctggccaaggagtttgagaactctggctcgggcgagtcggggaacgcatgggcgggaaggagtgcgcgcctggtgggccacacggcggcgaggctgagcagagcatctctggacccagattttccccagagcaacaccaatttccccccttctccttgcaacatcgccatccctcgcctacaactacgccttcactgtctttccctgcaccctgctgcagattccgagcggcactacggcacagactttgatgaggaccaggaggagttcaannnnnnnnnngggggtctgccgtgccctcggcaggtggggatctgccatctggggccccatcggcgctaccctccgaggacgaagccatctcaggcagggaatgtgcatcaaccccaccaccccccctggcacaccatacagacgaggggagcggtgacgaggaaggaagtgatcaggacgcttgagctcagcctctgccagcggctaagtgcttggagcggcccagcgcatcaaatgacccctcgactgcgtcagcgccgcgtgtcatgcaggatgatgtgcatgacctttgccccctggcagagcctgcaggcatgcagacggtgcgtgtggccggctcctgttacagagccagccgaaactgtccatacaaaacatgttggccactcaatagagcgggaacagtgtgcaagcgcgatgtcgagcgctgaagagaacctaccattttacatggggtatccattcgaccccggagcgatggataccaatccgaggagtgcttggcacggaatccgggcccgagccaggccggccgcggcgctgacccctgaaatggagaaggtcacggggatggtgctggaccacgccctccagcgcgctgcgggcccgcttaccgagcccgtcccctgtcttgctcgcgcagctgccgcggcctcgctggctccagaacggcctcgtctggaaggagctggccctgcagaccaccaccgggtcctggttcaagcgtgtcaccctggccctgcatgccctcctggtcgtgaggtaggtggagatgctgtacagcctgggtgcagtgttaccccacccgcatcgcgcgcagctgtcccgcctggactacctgatcctgggccgcgggcagggcctgcccccccnnnnnnnnnnagcctgggtgcagtgttaccccacccgcattgcgcgcagctgtcccgcctggaccacctgatcctgggccgctggcagggcctgccccctcctccaaacgccatgaatgtcaaggtcaccaagcattcgttcattgccacaccgttttgcagggagatcctgctgcgcctgtgtccgcccggcaccttccaggcggcctggaggtccctgtggccctccacccaggtgtcggcctttgccgcggcagcggccgtcgcctgcgtcgacgacgcggcggacgccccgcgcctcgccctcgccgccgggagccacgccccgcaccacccggccgacgccgagtggtggatcacggagtccgactggcaggtgttccgcgacgcgtgcgagggcgagggtgcgcccgggcagccgcggtgggaggacatgtgccgcaaggagttccccgactgcatctacacagcgcagcggcgcacgctgcactgcggccgcaccgagtaccgctccaccaccgtcctgcgcgacgccggcgcggaggcggtgatggacttttacctggatgacgatgtgcgcgcggtgtgggaccccatgatctccgagcactcgctggtggagagccgggccgtggcgggcaacccgggcgcgcggtgccaggtggtgcgctggctgcgcactttccccttcgccttcatcagcagccgggagtacgttttgggccgccgcgtcttccgcgacgctgccaccggcgcgctctacggcatcacgcgctccgtggaccacccgggcgtgcggcggtgcgggcggcacgtgcgcatggaggactgccactccatgtggcgctcccgctccgtggagtggccgggggagcccgggcgccgcgccgccgagaccgtgctgctgcacttcgaggacctgggcatcccggagcacgtcgcgcgcttcgccatccgccacggcatggtcggcttcctcaagcgcatgctgccagaggcgcgcgcgttcctggcgcgccgcgctgagaagctggacgtggacgagccggacccggacgcctacgcgcgccgcgtcgcggcgggggccgacggagggtgtctactactgtcgcaggcgcacggcgtcgcgtcgcaggcgcacccgctgccgccccgcgccgacgccgatggcgcggcagactccacggaggcctccagctggtcgtcgcgggggagcagcgtgagcatgcccagcatgcgccgcctgggcaccatggtgttggcctccagcgtcgccgtgctgctggcgcggtcgggggccaagagcagcgcgtcgaggagacggcgccaccgcgcggaggccgtccgcctagacgcgctgtgcctggagtcggtcgcggcc

SEQ ID NO: 8573 - DNA, 873 bp, Chlorella protothecoides
atggcttctccacacgcctggatcgcggcgcgcctggggctgagcctgcgtgccaccaccgggctcttcttcgtggtgtgtgtggcctccatctgggtggcagccagctttgtggtccaggacatacaggcagctggcgccaagcccgcggtgctgacctacatcgccaacagtctgttcgccctgtacctgcccctgtactacttcaaggcctggctgagcggccgtgccgggcgactggcagctgggctgccacaggatgaagaggagcggggcaggctcgtggcgacacgggcggccccggagcgggtattgctcgacgggccgccgggcatcgaggggggtgcccagcaacggcatgcgctgctggtggtggaggaggctgcgcccgcgcagatcacagcctggcagaccttcaacgcctcggtggtgacactctcacctccccacccccctcccaaacaaacaaccccttcccgcccaggtcgcgcccgtgtggtacctggctcagttcaccttcaacgcctccctgctctccacctccgtcaccagcaacaccctcatctcctccacctccgtgctcttcacttacctactcagcgtcgcgctgctctccgagcgctatacgctgcgcaagctgggctgcatcgccctgctcatcctgggcacagccggcgtggcgctggccgacgagctggccagccccgacgccgcggcggctcggggcagcctgctgggcgacgcgctgtgcctgctgagcgccctgctctacggcacctacaccgtggcgattcgcaggatgctgggcgaggacgagacggtgaggcgggggaggaaagagggggggaatcatgcatgacactgcagccgtga

SEQ ID NO: 8574 - DNA, 411 bp, Chlorella protothecoides
atgggcagcatcatcttcgtctgcggcgcagcgttgggcctggtcgcgctgctcgccggcgccgggctgggcacgctgacttggcccgttttctgggccatcgtggccaagggcttgctggacaatgtgctctccgactacctgtgggccagagccatccttctcatcggccccaccctggcgacggcggggctgtccctccagatcccactggccgtgacagccgacgctctgttcaggtcccccgcctggctgcgtgccttttggccactgttgctcacggccgcgggggggctgaccatcctggtcggcttcctggcaatgaccctggtgcctgccaggccgccagcccaggagctccccgtcgcagagatgacgcgtgacccctcccctaaagcccccgcccgatga

SEQ ID NO: 8575 - DNA, 1251 bp, Chlorella protothecoides
  modified_base (176)..(265): a, c, t, g, unknown or other
  modified_base (1027)..(1036): a, c, t, g, unknown or other
caccccccccctccgtccccagctgggctaccgcctggcccacatccagcgccgcatgctgccgatctccatgcacctgctccagcgcgacggccagttcctgaacgggcacgacctgttcctcaagcgcgtgggcgcggcctaccacgccttcatcgaggactcggagacggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctggaggacctgcagagcaccacgcggtacgtgacctggagcctgcacaccaagtcgcggagcagcctgaaggccatgctgggcaaggtgaccacgcccgcgggcggcgcgccgcgcgcgggcaaggccgccgcgggcgcggcggggggggcgggcgatgcgcccatgctggaggtactggagaacacgctgtggagccggacgctgggcgcgatgagcgaggagatcgtggccgcgctggtgtgccagatcttcgagggcatccgcgaccactttgtgcaggcggtggagctcaagttcaactgcttcttcctcatgcccctcatcgacgccttcccgacgcgcttgcgcgaggagctggaggccgcctacgcggaggacctggacgagcgcaagtttgccatgatccactccaccctggcccagcagcagtcgggcgggggcgggggtggcatggcaggcggcggcggcggcacggcgggcggcgccaaggaggcggcgcgcagcagcgccgagaacgcgctcctggcggaggcgctgcgcgccgaggcggtgcgcgcgtcggcggagaccaacccgctcaacctgtcgcagagcagcctgcccgggcgggcgggcaaggcgggcacggaggccgcgcgcaccgtgcaccgcgcccccctttccacgctgcgatgaggatggggcagccggggggcgggcgggcgggtggactgccgccgggcggatggactgccgccgggcgggtctactggcgannnnnnnnnngagccgggggggtggcgggcgggtggactgccgccgggccagggggctgctgccggccgggtggactgctgccggccgggtggactgccgccgggcgggtctactggcgagcgctcacaccggcggtgtacgcggagcgccgggcgctgcgctgcattgcctttcccccctcacacactgaaaaggaagaaatcctcccttacccccaacattag

SEQ ID NO: 8576 - DNA, 2166 bp, Chlorella protothecoides
  modified_base (410)..(419): a, c, t, g, unknown or other
  modified_base (870)..(879): a, c, t, g, unknown or other
  modified_base (1056)..(1065): a, c, t, g, unknown or other
  modified_base (1142)..(1151): a, c, t, g, unknown or other
  modified_base (1587)..(1596): a, c, t, g, unknown or other
  modified_base (1955)..(1964): a, c, t, g, unknown or other
atgcactcgcagaactcgctgacaccttcgtaccacgctctggttccgggtgagggtcgagatggtgtgacacagggtcgcgaccgccaggcagatgagcaaggcaatggaaagcgcatcaagatcatagtagatgtcgcgaagcaggggaccgacgcgggtcaacgctcccggtgtaagctggttgtacacaaaccagaggtccgcggccactcggtccagcaccacaccgatgtggtgatcgctgctcattctggagtaatgcttggtatcgcgactcctttcaatgcgtgtcggagatgcgcgcgcgcacagtccgcattccacggaaagagtaactgtgcttgcagagcatcaggtgctccaggatcaggtttgatatattatttagagatcgaattgacaaagannnnnnnnnnagatgcgcgcgcgcacagtccgcattccacagacagagtaactgcgcttgcagagcatcaggtgctgcaggatcagctctgtcggctgggcgttgccttcatcctgcatggagcccacccgggcgccgtgggctacagcggctgtgccgggatctcagactgcaagacagaaagagtcgtccaccacacatgcaccttggtccaagtcagagacccgacgcctggacgttgtcatcagggcgagcgcccgcttccccgaaccattacccgaatcagcagaagacctcgcgtggggtgctgctcgcaaggaaatactgtccctggatgctctggagcagttcctcaagtcagaatccatgtccagctttctggggtttctgctgtgcctcaatcaggcggcactgggtcgcagtctgacatcaagtcagcgggtgagagaggggagccatgnnnnnnnnnngcactgggtcgcagtctgacatcaagtcagagggtgaggagggaagccatccactccatgctttgtgatgtcccaggctgggctctgtccttgatgcaggcatctcacaactaccgacgtcgtctgccaccattgaatgctgtcagcttcagcggcacctgcctgagcgatccctannnnnnnnnngcttctagagcccctcctgtcaggcgcccaggctgctgctcttcccgagctggtgtcctacctgcaggacagctttnnnnnnnnnngaggagtcccgcgatcgaagccctgctggaaattctgggatctctacagcgcctcgtggattcccacccccccgctgagcgatccctgcgatatggaaaccccgcgttcaggcacgcagggatgatgcgcatgttggcagtgaactggccacctggtaatgtatgggactggatggagggcatgcgctcagctgcgccgcagcttctagagcccctcctgtcaggcgcccaagctgctgcccttcccgagctggtgtcctacctgcaggatagcttcggaaactcgactcgcatagactatggcacaggtgtgagggaatgtgtggggcagcccaccggtcagacacctgataccagatgtgcattcagcggcctttgggatgtctgctctgtgtgttccctggtaggggccatgtcgaggcaaagtgaggaggtnnnnnnnnnngcccgccgggtcgcatggggtttggggcctggacgattaccaaatcctccctttcctttggggttccgcacaggtgcggtgaggggtgtgcacagggatgtctgctctgtgtattctctggtggggcccatgtcgaggcaaagtgaggagtcatatccatcctcaccggtcctgcccgatgcatgcctggagaggggctctcgggtgcgcgacatgcctgccaaaaacaacctgctgtgctggtcgcacccgaccactgccgtgaaactgcaggtgagagccagggaccctgatcctctttctcgcatccccctctcgacagctggtggaccatggggacatcacaccggggagcatannnnnnnnnnagggaccctgatcctctttctcgcatcccctcctctgcagctggtggaccatggggacattacaccggggagcatccacaaccctgcggtgcttcaggatgggaaggaggagtacatgtacctgtctgcggtggcctttgtgaagcaggcaagccctcctggccagggaaagggcacagtgaggctcaggagcacagcctag

SEQ ID NO: 8577 - DNA, 1320 bp, Chlorella protothecoides
  modified_base (1257)..(1266): a, c, t, g, unknown or other
atgactgctgatcactgctgctcctgttttggaaattctagcttacaattcgcggacatgacggacatctcggcctggcatcctgtatctctgaccccaaagaagcagatcaatgtctcgataggaagcggttaccctcaggattggtcgggggacctcctggcattgggcgtcttcgagggtgatctcccgtccaaagggcatacccttaccccttcggatgcagaggggagcttatccggatgcctggccaccctggatgcaagcctggatggcgccatcgaagatatcatccagacatatgagttcaagggcaaagaggtgagctcttggtgtagtagcattctatgctatgaattgagcagcttgacatggagcggaagccagcaggcggtgcgcgtgggcggcaagatcaagaatgtggtgttgattgggctcggcaaggtggaggacgctgccctggaggccaagtggggcctgtccctgttccagacactgggtgctgcggccgctgccgctgccaagacgaccaaggccaggacccttgccctggcactcacgcagcttccccccgtagacgaggcagaagctttgctttctgtgactcatcatgaatgcctgaagctgcgaagcccttcccgaaccccgccccccattcctccgcgccagggggaggcaagcggcaaggcagccaatggcctcctgcacgccatctacgagaccagccgcttcaaatccagcgagacgggccccaagctggagagcgcggagctgctcttcggtggaaaggacggcgcggcggctgtgcagcgggcgcaggcctttgtggcgggcgcgaccctcacgcgctacctggtcgaggcgccgccaaacgtgtgcacgcccgctcacctggcccaggctgcggaggagatcgccgagtcagcgcccgacgtctaccagctcaagcccacttccctttcttccccttccctgggggatctagccgctttctcagtacatgctagaaaatcgagtgctaagctgacaagattgctgccatcccggcgtgctgcaggtgctggagaaggccgactgcgaggcgctgaagatgggtctgtacctcggcgtggcagaggcctctgcccttccgcccaagttcatccacctgacctacaccggtgcaggcaagcagcgactcgagtttgtgcaccgcactcatccacgcacctcacatgctcgcgcttctccacctcatcatctccgatgcctatgtcnnnnnnnnnncccctttcttccccttccccgggggatctagctgctttcctcagtacatgctag

SEQ ID NO: 8578 - DNA, 828 bp, Chlorella protothecoides
atgtccgctcaacactcacaggagattgctgggcatgatgagatggttgggcagtacgaatcgtaccagtccttcaccatgccgcacctctaccgcgtcgtgaatggcatcgacatctactcgcccaagttcaacatcgtctcccccggcgccgactcggacatctacttccccttctccgagtcctcgcgccgcctgacctccctgcacgccgacctggaggagctgctgttcagccccaacagcaaggaggcgatgggcacgctgtccgaccccggcaagcccatcctcttctccatggcccggctggacaaggtcaagaacctgaccgggctggcggagtggtacgccggcagcgagcgcctgcagggcctggtcaacctgatcatcgtgggcggggtcaccgacccgtccaagaccatggaccgcgaggaggcggtggagtgccagaagatgctggacatcatgaattcggggcgcgtggacggcaagttccgctggatcaacgcgcagaagaaccgggtgcgcaatggcgagctgtaccgcttcatcgccgaccggcgcggcgccttcgtgcagcccgcgctgtacgaggcctttggcctgacggtcattgaggccatgacctgcggcctgcccacctttgctaccaaccgcggcgggccggccgagatcatcaagcaccgtcgctctgggttccacatcgaccccttccacggcgaggcctccgccaacgtcattgccgatttcttcgaggccaccgccaagaagccggacgagtgggaccgcatcagcaagggggggctggagcgcatcttctccaggtga

SEQ ID NO: 8579 - DNA, 1014 bp, Chlorella protothecoides
atgtcccacctctacacgtctggaggccatcacccgagccccttgagaacacggctcatccaatcctctcaacccctcccccgccccaccccgccccgcccccaaaatccgtacccccaggcatcccccgacacgcgcgacacccccaccgtccctctgggcggcgaggaggggtatgatgtgtacgtctatgaggcggagcctctggaggagggcgtggccaagcacacgctgtccgtgtttgtaggggacgaggcgggaatgatcaaccgcgtggcgggcgtgtttgcgcggcgcggcgccaacattgaatcgttggcggtggggctgacccaggacaaggcgctgttcaccatcgtggccacggggaccgaggccacagtggccaacctgtgcaagcagttggccaagctggtgaacgtgcggtatgtggaggacatcaccgcctccgagcacttccagcgcgagctgttcatcgccaaggtggcggcgccccccggcgccactcgcaccgagctgcagcaggtggccgaggtcttccgtgcccgcgtggtggacgtggcggagcgcacgctgacgctcagcgccacgggcgacccgggcaagatcgccgcgctgcagcgcgcgctgggccgcttcggcatcgtggagctggtgcgcacggggcgcatcgcgctcaagcgcggcgagaacctgttcactgggccgcaggtgtaccgcaagcgccccgccatcagtaacgccgacgccggcgagccggtaaatgtggaggcctccatggacggcgacgtctacacctcctccggctcagggtctgctgcccacgaaggtgtttggaacgtgcgcaacgtgctggacgcgtactatgagaacgagggcagcgagtttgagccctacacgctgctgctggaggtgcaggaccggccaggcgtcctgaaccaggtgcgagcagggttgggaatggaacgtgggacacggcatgacaggttgtgggtcgggccgtctggctcgtga

SEQ ID NO: 8580 - DNA, 261 bp, Chlorella protothecoides
atgtggattgagccggacaggcccgctgcccagccctcagcccaccgaacaacccatcctctttcctcttgtcctccccccttgacgtattacaacaggaagtacatctccaatctggagcacagtgaggccaagcgctacctggagatgttctacatcctgaagatgcgggccctgattgagaagatgtctgagcaccccaacaaggccacggaggaggcagaggagcagctgaagaagaaggagcaggcctctgcctga

SEQ ID NO: 8581 - DNA, 306 bp, Chlorella protothecoides
atggttgtccccggcaatgccacggggatcgagaagctgatgaaacaggtgcagaagctggtgtacgtcgaccgcgtgacaaacctgaatgccaacccctttgtcgcgcgggagctgatgctgatcaaggtgcgggcgaccgccgcgcagcgcggcgagctcctcaacctggcccagatcttccacggctcggtgctggacgtctccctcaccacgctgaccatcgaggtgacggggaaggaggacaagatgcgcgctctccagtccgtgttggagccctatggtgggtcgtggtgttggggctga

SEQ ID NO: 8582 - DNA, 780 bp, Chlorella protothecoides
atgacctttcatcttccaggtccccctcatggtggtccggcccttcatcgcaagggtggagggcagggcgctgggcgctgctgtgaccaagggcgtgtcaccccagcagcagcttgtcaagcctggcaacaaggccatctccttgtcttgtccttatctctcgtcccaataaatataccgtaccagattgtgtatgatgagctggtgacgctgatgggcgggaaacagattgtgtatgatgagctggtgatactgatgggcgggaaacaggtatccctcaatgtcccagagggcggcgatccgcaggtgggtgaggaagagcctgagggaccatgcaccctggtcatcctgatggcgggactgcaaggcactggcaagacgaccactgctgccaagctggcggccttccttaagaacaagggcgggcgagtcatgctggtggccactgacgtgtaccgtcctgcagccattgagcagctcgtggtgcttggaggccaagtgggtgtgcctgtgtttgagcgagggctgaatgtcccacctgcggacattgcgagcgcgcaagctctgggaggacttcacatggcccccctttcctctgccagggagggagtggccctggccaaagaggagggcatggatactgtcatcatcgacaccgcaggacgactgcaaattgatgcgacgctcatgcaggagctgcaggaggtgagggtcgtgcctcacatggtgggctgcaatgcatgccacccgtccaggccctcccttggggatgctgtctga

SEQ ID NO: 8583 - DNA, 984 bp, Chlorella protothecoides
atgctggtgcatacgaagtatccttgtcacctgttcaccacaggttgccgccctgaaaagcttgggcttgaacatcacacgtgcaaagctgaggtccactgggacccacaaattctacatcacggatgcgggcgcagcctggttcagtacttgaggtcagcctccttccaatgtgccaaaggctcctccacatcaacctgtgaagccatgtgttccccattgtcccaccaccaccgcccctgcaccctcactctcactgcagagacgagtgagaaggtagtgaggtcatccaggcttgaggagatccgattgaccatcctgaacaacatgctgagggtgagcatgtcaggctggacccctggactccatgcacctcctctaacgacctctggcaccaatgcagtaccacccggagaccagccagcagctggcatggggctccccgtctgcttacagtggcatgaacgccgccgacgactcctcccccctgggcgtgaggaactacggcatcaagacccaggtggaggtcagggaggacaagaacgggctgaccagcaagctcctggtcaacaccctggaccgaccgggcctgctcaccgacatcgtccacatcctgaaggacatcaacctgaacgtcatctcagccgaggtggacaccattggtgcgttgggaggagccgtggctcgagggatgggagtgtcaaatgggcaggcggagcttcatttggccgcatggctgtcactgcagctggggagacccccaaaatctcctcctgcatccgtccaggtcgcaacgcgttcgatatcttccagatcacctaccacggcgagcctctgcccccgcccatgtgccagctcgtggtcaactccctccaggtgcgccctgctcgcatgtgttgcacttctcgtggcatcgaggggtcggggtcgtggactcccttgcatgtgcatggggcgcgtgccatccctgaggatccgaagtga

SEQ ID NO: 8584 - DNA, 219 bp, Chlorella protothecoides
atgctggacttcctgcggtaccgccgcatcaccaccaacatggacgcgcgctttcccgacgccacggccgaggacctggtccgggcggaccacacctgcatcatctgcagggaggaaatggtcgttggtggccggaccaagcgcctgccctgcggccatgtcttccacctgcactgccttaggtgggtgccaggcgtatatcttggggtttccccctga

SEQ ID NO: 8585 - DNA, 288 bp, Chlorella protothecoides
atgtctactcgccatgcaggcgccatagtgaccaagctggatggcgatgccaggggcggcgcggcgcttgctgtgaaggaggtgtctggctgcccgattaagtttgtggggatgggggagaagacggatgccctggagctcttctacccagatcgcatggcctccaggatcctaggcatgggtgatgtgctcacgctcgtagaaaaggcagagtcaatggtgaaggaggaggaggccgcggccctcaccaagaagatgctcacaggcaggagcttttggcagttgtga

SEQ ID NO: 8586 - DNA, 804 bp, Chlorella protothecoides
ggtgggaggtggtcgtggtccccccttgcgcacagcgccctgcagaccgtgccgctgtggaggcggtgcggcgatctcaggcgcaggcctccgcgccaactcactcccaccgacctcctttccacatcccctcgccgcctgccaggcggcggccacatggttgtggtgggcacgacctcgtccccagacagcctggaccccgcgctgcgccgccccgggcgcttcgacaccgagatcccggtgcccgtgccagacgggccggcgcgggtgcacatcctgcgagcgctagcggcgggcctgggcgcagcggctggcctggacctggacgagctggcgctgggctgcttcggctactccggcgccgacctggcggcgctgtgccgggaggccgcgctgtccgcgctgggcagggtcgcgggcggcgcgggcgagggttcggggatggagccggggcctcggagtccccgacagggagccggtagcccaggccccagggaggaagatgtggttgtaacgatggaggactttgagtcggcgcgctcaaaggtggtcccctccatcacgcgcgggctgaccctggactttgtgcccgtcgcctgggaccagatcggcggcctcccggacatcaagcggcgcctgcggtgcgtggcgggttggaggtcttgcatggggggagggcaagaaaggcgtatctcaacagggcacagtggcaccggcaggcaatgcaggcacttgccactggggtacagtttggtgcctcgagggtctggtcgccctaccttttgttgggagcaaggtctgtaa

SEQ ID NO: 8587 - DNA, 294 bp, Chlorella protothecoides
atgccgctggcgccgggcgtggacctgcgggccctggcggcgcgcacccagcgctacacgggcgccgagctggcgcaggtgtgtcgcgaggcggcgctggctgcggtgcgcgaggacgggccggagaggtgggtcggcccggcgcactttgaggccgcgctggaggaggtggcgccggcgctgagtcagcacgacctggacagggcggcggcgtggaggcggcggccggcacccacgcccctgccctcgcgagcccccggtcctcgcaatgaaccgacggcgacggcgccgtga

SEQ ID NO: 8588 - DNA, 270 bp, Chlorella protothecoides
atggcgcagccgcagggccgcgccaactcctttgtgggcacggaggagtatctggcccccgagatcatcgcgggcgtggggcacggcgcgggcgttgactggtggagcctgggcgtgctgatctacgagatgctgacggggacgacgccgttccgggggccgcgccgcgacatcaccttcgacaacatcgtgcgcaaggcggtggcctggcccgaggacgtggaggcctcggaggaggtgcgagacctggtcggccgcctcctggtcaag

SEQ ID NO: 8589 - DNA, 1485 bp, Chlorella protothecoides
atgcccccaccgagcttccgggtccccgagccggccgagacgcggtgcgacccggccacctacccccccgagtccagagcggccatcaataccttctgcgagaagatcacgggatctgtgagaaatgacagacgagccctaagtctcatggggatctttcacgcatggagcctgcagaaacgagacgaggggactttgctccggagggagcagccagcctgcatactgccctggaatcggaggaaaatcgctcacatccctgtgttctgtgcccccggaccggaggggacgtacgtggtgcgcctgatggcggcagtggctgacccccctgagctcagggtcgaatgggatatggccattgtggaggctgtgggtgagggccaccagcagcgagctgagcgggctacccaacgggtgggctggcaggatggggctcaaagtgtgcacccccttccccacaggcatggctggcatgcatggcctgcttgctggtccatgcagcttttcctggtgggggagctgccagatctgccagctatgagaactgtggcagatatgagagccaggctggtggccacccatgcaccccaggcaccagagggagaggctgggcttggcatgcaggctccaccccccaagaaccgaggtcgcccaaaagggagtgagtctggtggggtgtggggcatgtgtgcgccccccacctgctggccagccctgctgagcacccctgctcccacccatggtgcagggaagaacgacccccctgtggtcatggccagcaccaagggtcggcgggacctgaagtccctgggtctgagctacctggatcagggccccagctctgtgcaggggcctgcctgccagcagggggatggctctgtgcagggggccaggctgcccctggtgcctggcctagctgtggaggaggaggctggcgccaccagggaggggggggaggctggcgccaccatggaggggggcagggctgcagctcccaggcccatggaggaggaggaggagggggctggcccctccaggccagtggtggaggaggctgcacctgcacccatggaggtggaggctgccccagctgaggagcagcagcctgggcctgcctctgggcacggctcccagaccccccccacctccaccgggcggcagcagagccctggcgcccgggtcgccgtgcccgcaccccgtcccggcggcgccgacgggccaccccctgcaggagaccacggccccgctgctgccatggtgggcgccagcacacaccccgaccagggcgaggggcgggctgtgggccgcagcgacgtgcagagggtcgccgaggccctccatggcaaggcgaccacccgtgctctgcagatggccattgccgcggagggtgcgtctagtgtatgtgtgtgtggagaggggggcgggggcgccaaccagcaagaggggcccaagcgtcccgccatcaggctgtgcacatggctctga

SEQ ID NO: 8590 - DNA, 1068 bp, Chlorella protothecoides
atggtgtggcaggccacctccagcaccatcctcaccagcatccatggcaactttgtgcgttgtggggctgagcagcagagcgcaactggttctcagttttggcgtaggcgcttgctccattttcagtcatggcgtctatacatctacattgaacaggagccgcctgcagcaccgctcgcctttcgatctcccgtctctcccaacccatgcaggaaagggagggcacgaggggggaggatgaggaccgctcctgcggttcctgcagccgccaagttgccccctccccggcccccttcctctcctccctgctccagcagtcataccgtgtggagcggccggggacgggggacatgcggcatggtgcagagggctggcgggctctggaaacctccttcaaggtgccactggcttggagctgtccatccgtcgtctcttcacatcgcagcggccacctcaccggactgccaccaacacatgacggcagcaattgcacgtcatgcagttttccacacatcagcttcaacacccccccaaaaaaaatcaaccacccaggccatgcacggggtcatggccggcaccgggccggccttcgccccatgcctggacccggagctgcacggcgtgctaatgcgcgcggcggtgcacgccaaccgtttcgtgcgcgaggcggcccacaacgcgttggccgacgcctgcgtcgtgctggccgcgcgcgacgtgtcgcgtctggaaagcgcggcgggcgactacgccggccgcatcgcgctgggcctggctgactcctggaaccgggttcggtacgcggcggtggcggcggcgcgggcgctgcttgcgacgctgccgcgggacggctggcaggccgtgctccccgccatcctcccaggcctggcgctgaaccgacactgcgacgcggagggcgtgcgcgccgcggcgcaggcggcctggcgcgaggcgctgggcgaccagggccgcgcctggctggcgcgctgcgccctcggcgtggccacttactacgtggagcaggcacgcgcggccagccatggggtgcgcgaagcggcctgcgcctgc

SEQ ID NO: 8591 - DNA, 1185 bp, Chlorella protothecoides
  modified_base (867)..(952): a, c, t, g, unknown or other
atgccacgccggtcctcacacttttccggcgcagcgcccgcgctcaccgctctctccatcctccccacaggctgcccgaggacgactttttcccctccgagggcgacccggcgccagagggcctgccgcccctgccccagaggccgcaggtgtgaggatggtttggcgtcgtgggttttggtttggccggggtttggcggcgggcggactggcgctggcagggtagatggcagtgtggttgccacactcccttgcaaagcactagccccacgtaaaggcagcgcagggactcctgctccttcaggcaatcaaagggcccttctcacctgccaacccacaacccaccccccaaacaaaaccaaaacacagtggccgcctgctgacgtggccctgattccggccttcccgcctgagctgggcgggaccgaggccggccccggcctcctggaggcctggtccttcctcacctccttctctggtgagctggggctggagcctgcccccctggactccctgctggcggcgctggcccgcggctcgcgctcgcccgcgctggccgccgtgcactgcggcctgctgcgcacgctgcaggcggacgcggaggaggcgtgggcggctgggcccgcctccacctacggcgggctggagtccagcgcggccgcggcgcgcctgctggaggaggcctgggcctggggcttcgaccccgacgcctggcgcgcgcacctgggcgccgccacctggcccgaggtcgcgcgccagctggccacggccgcaggcctgggccggccgcgcccgcgcccacgccgcgaggagaagcccaagatgggacgtgagggcgaggacgtggccgacgacggcgcggcgggnnnnnnnnnnnnnnnnnnnnnnnnnnnnnnnnnnnnnnnnnnnnnnnnnnnnnnnnnnnnnnnnnnnnnnnnnnnnnnnnnnnnnntcggcctgggcacggtgaaggccgcggcctgggccgtgctggccgaggtgggcgccgcggggctgaaggtggacgagatcgcgcggcgcatccagcgccggggcctgcgcgacctgcgctccagccgcacgcccgaggcctcggtggcgggggcgctgggccgcgacgttctcttcgcccgcgtggacctgggcacctacgccctggccgccatcgtcgcctacgaagcgtga

SEQ ID NO: 8592 - DNA, 1521 bp, Chlorella protothecoides
  modified_base (41)..(50): a, c, t, g, unknown or other
  modified_base (613)..(643): a, c, t, g, unknown or other
  modified_base (1081)..(1090): a, c, t, g, unknown or other
atgcccatcgtacgcctgtccactccttacagtcaccgtcnnnnnnnnnnacccagcctggaggcgaggacgccgcggaacccgccgccgcggaggaggaggagtactcggacgacgacgaggacggccaggtgggcaggttgtgctggctcgaaacgcagtgaagcaggggaaggtcgggaggggcggctggcaagcgccctgcccatgcccatcatacgcctgtccactccttacagtcaccgtccccgccgcccccccaaaaaaaaatttcatccaggacaagaccgaggagggctccggcgccggctgggtggaggccctgcagcgctgcgactacgacgcgctttcctgggagcaccgtgtggacatgctgcgctcgctgtgcctgctggcgatgcagacgccctgcatccgcgacaccatggagcggcggcaggaggagcagcagcgcctcaagcgccaggtctgggaggacgccaaggtggagaagcggcggcgccaagtggaggccgccgcgcgagcgcgtgccgcggccgaggaggcggcgagggccgtggagcggtaccgcctcgccggtggcggcggcgcggccagcacagcgggctcggcnnnnnnnnnnnnnnnnnnnnnnnnnnnnnnnctgcacccgtgccgggtgagatggccgggccgccacaggaggagccgcacgcgggtgcggaggccgcggatgcatacgcagggcaggccgtggaggccaaggccggggagcctacgcggcaggagcaaagcgacggcccggcgcccatggaaatcgacggtacggcgcccgaggctgcgagtgcagcgcttgtagaagcctcccccgtgaaggccgaggacggggctggagggaacgccccggcgccgcagcagcgactgccggagggggcttccccgcccgccgccggcgcgcgggaggaccctgcgtccgaccaggacccgggcgccgtcgcggagcgggagcgcgtggcggcggccatcgcggccgcggagcgcgcggcgacggagcgcgagacagaggaccgtgaggcggcgcgcgcgcggcagggggcgcggnnnnnnnnnngcgacatggagcgctgcgctgtgcggctggagcctctgggcgcggaccgccgcttcaaccactactggcgcctggtgggggccggcggggcggcgcacccctcggcgtgctgcggtgcggggtacctgcgcgtcgcagggcttcgaccagccctcgtccctccccacaccaccaccaccgcccactgcacgtccatgtcccgagccgcagctcccgggatcagcggaccacggcacatccatcacctcgcccgaccccggcgcgggccgcatcttcttcgagtcgggggaggacggcgcgctcagcatcgtgcgcgacgcggcgagcctggacgcgctggtgggcgcgctggagcggcgcggcgcgcgcgaggcggggctctacgcctcgctgctgcgccaccgcgacgtgctggcggctgccatgccccc

SEQ ID NO: 8593 - DNA, 1344 bp, Chlorella protothecoides
atgcaacctcgaatcccagccaccttcccccacctaaacaggctagcgtcccagagggcaccccggtcgtgcccaccctggacctaccctcgcgcccccgccgcaaccggcgctcgcccagcatccgccgcgccttctcagagaccgtcctgcgtcccgacaacctcatcctccccgtcttcatccatgacggcgaggccaacatccccatcgactccatgcctggcgtctcccgcctgggctggaagtcgggcctgctggaggaggtcacccgggcccgctcctacggcgtcaactccgtggtcttgtttcccaaggtcagcgggcgagtgggtgggtgggtgggtggagattgaatgcgccacagcgcatcgcatggtcgcgaatggtggggcaattcagggaagatgtgcagctggccagctaccttatgcctgctggggaaatggacttttgacccccgaccatctgaagacgcggaccggggaagagagcttcaacccggacggcctcgtccagcgcagcatccgcctgctcaaggacaagttccccgacctggaggtgttcaccgacgtggcgctggacccctacaactcagacggccacgatggcatcgtgcgcgatgacggcgtcatcctgaacgacgagaccgtagagttcctgtgccgccaggctgtcagccagcgagccggctggtctctccgccagtgctccgcacctgcccgcaaccaggcacccactccccaccgcaccttcccctctctcactcctgcctcccccacaaccccccgtcctcaggccgcggcgggcgcggactgcgtgtcgccctccgacatgatggacgggcgcgtaggagccatccgcgcggcactggaccgcgaggggtactcccacgtctccatcatggcctacaccgccaagtacgcgtcggccttctacggccccttccgcgacgctctggcctcggcccctgcggcggcggcgccggggtcgcgccgcgtcatccccgccgacaagcgcacctaccagcaggatccggccaattaccgcgaggcgctgcgggaggccagggccgacgaggctgagggcgccgacatcatgatggtcaagcccgggatgccctacctggacgtcatccgcttgctgcgcgacaactccccgctgcccatcgccgcctaccacgtgtcgggggagtacgcgatgctggccgccgccgcacgcaacggctggctggacgagcgcgaggcggtgctggaggcgctgacctgcctcaagcgcgcgggcgcggacctcatcttgacctactacgcgcgccaggccgcgcagtggatggcgggggagtga

SEQ ID NO: 8594 - DNA, 348 bp, Chlorella protothecoides
atggatgttgatctctcagggacagatgcctctttgtctggccatcctggcatgcccttgcgttgccgtcggacccatgcctcagcacgtttggaacaacccccaccccccccaccccccgcgctaactccggctgcttacctccccttcacaccctccccctcgcaggtgcccgaggaggacctgcagcgggtggctgaagcgacgggcgctgccgtgcagaccacggtgaactcgctggatgccgagcgcgcgctgggcacctgcgcccgtttcgaggagcgccagatcggcgccgagcgatacaacatcttcaagggtgtgcaagagtgggtggtgcggccctga

SEQ ID NO: 8595 - DNA, 1242 bp, Chlorella protothecoides
  modified_base (251)..(260): a, c, t, g, unknown or other
  modified_base (744)..(753): a, c, t, g, unknown or other
  modified_base (1181)..(1190): a, c, t, g, unknown or other
ccccccccccccccccccccccccccaacagggcggagtgaccatctccaacgacggcgccaccatcatgaagaccctggacatagtgcacccggctgcaaagaccctggtggacatctcgctgtcccaggacgcggaggtgggcgacggcaccaccaccgtggtgctcctggccgccgagttcctgcgcgaggcgcggtccttcgtggaggagggtgtgcacccacgcctcatcatgcgcgcctaccggnnnnnnnnnncctggccgccgagttcctgcgcgaggcgcgctccttcgtggaggagggcgtgcacccgcgcctcatcatgcgcgcctaccgacaggccgctgagctggcggtggcgcgcgtgcgggagctggccaccgacatcgcggcggggcggggggagcaggagcggaacgagctgctggagaagtgcgcgcagacgagcctgaacagcaagctggtcagcggcgagcgcgacttcttcgcgcgcatggtggtcgacgcggtgggcagcctggaccccgccctcctggacctgcgcatgctgggcatcaagaaagtgcaggtgggtttcgatgcatgcacatggtttgggggggaggggagggttagggtgtgtgtggcaggtttgttgcagcaggaaagaggcatgggcatggtcctccttgatgggccagacttgcgttgcaatgggaggaggaggggaaggaactcaggagccggtgagaagccagannnnnnnnnnatcaagaaagtgcagggtggtgcgctgaaggactccttcttggtggatggggtggccttcaagaagaccttctcctacgccgggtttgagatgcagcctaagagctaccatgaccccaaaatcctgctgcttaacatcgagctggagctgaagtcggagaaggagaatgctgaggtgcggctggacgaccccacccagtaccagtccattgtggacgcggagtggaacatcatctacgacaagctggacaagtgcgcacaaagcggggccaagatcgtgctgtcccgccttgccgtgggcgacctggccacacagtactttgcggaccgcgacatcttctgcgctgggcgggtgagcggtttcacatatcctcaacgactgtggctggcttggggatggcgagaggggattggtgtgtttgaacttannnnnnnnnnctcaacgactgtggctggcttggggatggcaagaggggattggtgtgcttga

SEQ ID NO: 8596 - DNA, 213 bp, Chlorella protothecoides
atgccaccctccctgcccacccttgctgccgcaggctgcccccgcgcccagactgccaccatcatgctgcgtggcgggtcggaccagttcctggacgaggcggatcgctccctgcacgacgccatcatgatcgtgcggcggacgctgaagagccccctcattgtccccggcgggggcgccatcgacatggaggtctccaagcacctcaggtaa

SEQ ID NO: 8597 - DNA, 504 bp, Chlorella protothecoides
atgcggcatctgctggcggggttgcgggtgcaccggtgccaggacccgagtctccagagggcggggatcactgggtctgacaagggtggcggggaccacgcccgtgccatccccggcaaggcgcagctgttcatcaacgcctttgcgcgcgcactggaggtcatcccgcgccagctggcggacaactccggcttcgacgccaccgacgtgctgaacaaactgcgccagaagcacgcggccaaggacggcgccggcgcgcgcatcgggctggacgtgaacacggggggtgtgaccgacacgcacgccgcctttgtctgggagccagcgctggtcaagatcaacgccatcgcgtcggcggcagaggccgcctgcctcgtgctgtcggtggacgagaccatccggaacccaaggtccgaggcccctgacgcggcggccgcagcgggcggcggcggccgcggcggcagcggcatgcggggacggggacgcggccgcggccggcgatga

SEQ ID NO: 8598 - DNA, 2139 bp, Chlorella protothecoides
atgaaggggtctggagggtctggggacggcctcgatgcttggctcgggggggtggcgccttgggatgctggactggtgcagcaagtgtcccaggcacactgcagttggatgggagctgccaagcgcccaacccccgcccccttgatcgttcatgagaccgccatgcacagggtgcgacatgcccccttcccacgctcgctcactgctgccatgcgtcccacaccctccccacctccctccccaccaccccaggtcagcacctactccctgctcttcacctggcccgggtccgacccttcccttcgccccgtcatgctgtacagccatcaggacgtcgtccccgccccccccaccaactggacccacccccccttctccggcgcggtcgagggcggcttcgtctggggccgcggcaccctggacaccaaggggtccctggtcgcgatcctggaggcgctggagcagctgcgtgggagcggctggcgcccgctgcgcaccgtgctgttcgtggcagggcacgacgaggaggtgggcggcggcgagggcgccggccgcgtggcggcgctgctggccgcgcgccatggcgccctggagctgctgctggacgagggcggattcgtgctgggggacgggctgggcgcgggcgccggcgccctgctgccgccgctgcgcgtcgcggtgctgggcctggcggagaagggcaccgccacctgggacctgggggtggagggccggggcgggcacagcagcctggcgccgcccgcggggacgaccaccacggccctcaccgcgcgcctggtggccgcgttggacgcgcagcggctgcccagccggctgcagtcgcccacgctggacttcttgaaggccctggccccctacgccaaggcccggccgctgggcctgctgctcagccacgccggccacccggtgcgcaggggttctgcgagcgtctgcggggcttggctgtcggtttttcttgcccgggtggaggacacgtccacccacccacctgctcccacaacccaccgcctcacaggtcctgtcgcccctgctggcccgcctgatgtccgggagcacggtgctgaactccatggtgcagaccgtgaggggcgtggtgggtgtggtgaccgggggcctggcgcacaacgtgctccccacccacggcaacgtcaccgtcaacttccgcaccctgcaaggtgtgccagcgggggaaggggggggggagggagggttacaggggagtgcaaagctgcaagtgggaggtttgatgttctctgctgcccaccgcggccgtcccttccctgccaacattctgcctggaagtcatgctccatcccaatctcatcgaccacccatcccatcccgcccacctccatccctccaggggacggcgaggcggaggtcgccgcctacctggaccaggtgtcccgccccctgggcaagcacgtgaccaggacgcagcgtcccggcacacgggcgccctcccaggtgaccccggcgcacggcccccgcttcgacctggtgcggcgcgcggtgctggagacgctggcggccccgcgcggcgctggggacgcggaggcggaggcgtcgcccccgctgccgctcattgtggtgccatatctcgtgtccggtgccaccgacagccgccacttccaggggctggcggcggggaggactttccgcttcgagccctttgcgctggacaactcggacgtcccccgcatccacggcgtggatgagcgcatagccattcctactttcctggacggcatccgcttctacacccgcttcatccagctgtcggcgggggaggagggccgtgcaatgcagccgcacagtgtgggtgcgacactgtgcacacaatcccctcttcctatcgctctaccatcccttcaccccaaattgccctcaatccaaagtactcagaaaccaaaaatttcatcatgccatgccataaaattttgtgaggcagcaagatgcaatcagcaagagggatactttcgtcaagtgctgacagaaatgtgcaaggacactcgacagaggaagatctatggattcagggatgcacaaggaagcattgggagcagttggaggaggatggcacagcctggctcatggggggccgcacccttgcaatga

SEQ ID NO: 8599 - DNA, 1449 bp, Chlorella protothecoides
atgctggcttgggcgcagcagtacgccgcctccagcaggcatgccggcctcccccgcatcccctccggcagcgtcttccagggtgggtgcgaggcggtaggtggggactgggggccgtttcagtgctggcatcccctgctagtactgggagcacccgaaagaccaagagggacacgggtctcgcagatactatactgctactcgtttgtgactgcgctcgatgggcctggcgtcctgagcggcggttgtttgatggtgtgcaagatgcatcgatgcatgctgccatccgtcctcatcaaccccccccccctccgcaccccctccttcctcgccctcgcagcggccgacgcggcggaggtgacgcacgccgccttccacgccgcggtgcagggcgctctgtacgtgctgtgctaccacctggacgtgctggtgggcagcttccgcgcggccgcccccgcgctgggggccgcgctgcgcctgaaccccggcgcccccgccgcctccccgggccccgcccccgcctcggaccccggcgaacagctggcctgggtgctggacgcagcgctgccggcgctgctggcgcacccgctggacccgctctcctcctgcgcgcggtcggtgagcgccgagttcgggcgccaggcgcggcggctgcgcctccgagccctggctgccgcggtgtcggcctgggacgcgcgcgccgccgccgcgcgtctcgtacaccgtcccctggaggtcttcttccccttcgacccctacctcctggcgcgctcggcgcagctcctggacctggactccaccttcctggcctggcgccggggacagggtgccgaccgggtggcgggcgactcgggggacgaggaggacgtggaggatcagggatcgggccccatgcggtgggtggagagggcgtgggcgccggctgacaaacccttcaacattgaagagctcttcctgcgcccgaccaaaagacaagccacccgctttcctgatgctcacaccctccaggagatcgactccgacgcctgcaccagcgcctctgggtcggagtcggagtcggactccgactcctcgtccacctcggacgcctcctcgtccgacagcggcgcggatgaggatgaccccaaacgcacccgcttcggctccctgcccttgtcctccggcgcgtccggggagcagcggtgggagcccataaagtttgtgcggcggcctcgggccggcccgccagctcagcaccccagcaacctgcccgccgcctcccccgtcctctccggcgccatgctggggtccagcgcggaagcggcgcccggcgcgtttgtcgccggcgcgtccatgagcagcgacggcgggttcgggtccctgccggccaccgagcgcggcgcagcctgggcggccctgcgctggcccagggatgggccggtgcccatgtcctgcaccccgggcacctga

SEQ ID NO: 8600 - DNA, 1062 bp, Chlorella protothecoides
atgagccagcacgcggcggatcccctgctggcggcgggggccggcgatcccgacgccggcgtcgcgctgctgggcgtgctgcgcccgctgaccggcagcgtctcctgcgtcagcacctcggcgcacgaggcgctgctgcgcgaggcgctggacctgccgctctggcgcgtcgcgcccgaggttcgcgccgcggcgctggacctggtgctgcacctggcggcggccgtgggcgcggcagtgcagccctgcctgcagacgctggtgcacggactcctgccgccgccgggtccccccgcgccagacaccctgggccaggcctgggcccctgcgccggggtccctccagatccaggacgaggtcatcgagacgttgggcaaggtggggtgggtggatgggatgggtggccagttctgggggaggggcctgccggcgtggtgtctttggggcccaagtcggaagggggagggtgcctgccctggggtgcgccgcctgcccagaaccaggcccccccatcataattacgaccaaggaaacttggcatacctgtgcggcaccgcactgctgcctcttccacccagcctgactcatccccacccccctccccaccaggtgctggtgctcgtccccacagcggccccccgtgtcctccctgtcctcaccgagggcttcccccacgtcctgcgagaccgcgccgtgcactgcctctacgtccgcgccctcctgcgcatcagcgagggccccgccggagggttggtgcgcgaggcgctgctggccgcagtggtccagcatcttctgtccctggacgtcgagatacggtgtgcgggcggggcgatgtcgtgcgcgtgggtgggggcgagggtggtgccatggcacggcggctgctcgtcgggggctcatctgcatctccgcgccacagggtgcatctccgctccccgctgcccttgcgcacgtcgcggaggcgctctgccccctggagcagcctcgcatggtttgccctgctccgcactcatcacccaaccccctgccctgccccttccagatgggaggacatcgtggatgtga

SEQ ID NO: 8601 - DNA, 594 bp, Chlorella protothecoides
atggccatggctgagtcggccaccaccgagccccgggccgatgctgtgccacgccacgtccaagcggagcgggaggaggcccgcaagcgtcgccgggcgcagcatgccgaggcggagcacctgaggcggtgctgggacgtgcgacgccgggtggaggacgtggcgcaggaggttgaggccgtggcgtgggaggccctgcgtctgcggggcgacccccagatccccctccccccggcctcggccctcccccccgggcgccgcaccgcgctggaggcggccgcctcccggcgcatgcgcgacatcgtgtccacccactgcaagaaggtgctggccggcgtcaccgcccacaagtggtgctggcccttcctcgcgcccgtcgacgtggccgtgtaccgcgactaccgggatcgcatcgcgcggcccatggactttggcgcggtgcgcgccagcctggagggcggcgcctacgcgcaccccgacgcctttgtggcggacgtgcgcctggtgttcaacaacgcgcgggcctacaatccgccggggtcggacgtccacgtcatggccgatactctgctggtgggtgggtgggggttatga

SEQ ID NO: 8602 - DNA, 303 bp, Chlorella protothecoides
atgctcggtctacgagggcctctcgccctcttgatccctgctgttctcctgggcctgctcttcctgcccgggcagggtcctgaacccgcagcgaatccccccccggtgcacatcgatcttcgcagggagaaagaggcgatccagtccctttccgatgcgatccgctgccccacggtggggagcgagaccgcctccaaccacatttccaatcccggacccttccagcggttgcacgagactctcgagacccactaccccgccctgtggcgcacgctgacggtggagaaggtacatggaggctga

SEQ ID NO: 8603 - DNA, 834 bp, Chlorella protothecoides
atgaccgcccaagaggccgagatggggggcaggaacgccctcccagggtcgaggggcggctgggaaggcggcgccgccctcgcccctggcctgaggcgccaggtgtgtagggttgtccatgcctccgccaatcgtcccccacatctcaccaccgaccaccctcacccgacccaggactcgagcgcgtcggcacggcgcctgacctcaaacgggcagccgctgcgcgccgtgaacgagatggcggacaagctggactcgttgatggagctggtgctagaacacctagccgcgcgcgcggccagcggcggcctccctgccgcattccgcacgctgctcgccgtgttcgagcgccgcatcctccacgcccaccgctccaagttcgtgcagttcgtggtgttcgccgcggcggcgcgcgacgcgcgcgcctcgggcggcgccgcggggcagctgctggactccctgctgggcacgctgggcgatgagggcgctgcaggcatcacccgcaccgcagccgcggcctacaccgcctccttcctcgccaggcgcgctggtggtctgaggggaattgtgatacatgacagactacccttggccaagcgctttggcggggagagtgggtgccgcaaacttgcggcggcgagcgctgcaggggagtttgaaatggcactgcatacatgcgacctggcctcactctggcatcgcacgggctgcccttggccctccccacgtgcatggcaacaccccagaatcagccagccaaccaaggatactactcctcccctcccctgcgcagggcgcgcttcctgcccgagtcacaggtggtggcggcgctga

SEQ ID NO: 8604 - DNA, 963 bp, Chlorella protothecoides
atgtcggtgtgcagccccaatccggtgtggagcgcgctgtccctggacccggttgttgccacccccgccatcgccctcctgctcttttactggagcagtgcggtgtccctgggaatgggcaagtcgcccctccagatcacggccgaggtcatgctttcgtcctcctcgggggcccttgtcgccgcgggcctgtcctacctggccgtcagcatcaacggcggcagccagctggaatctgtgacaagggtgacgcctgcgctgcgtagcccactttgccttcacctgctggagccccactttctccatccttccttgcggcccctctttcctccgcaggcagcggctaccgcggcattttcgggcgcatatatattcgtgggcatggtgtgccgcttccgctggccctcgctgaacgtgttcttcacttcacacctggtagccgtcgccatgctggtcggcgcctcctaccacaatcacagcagcttcctcctcttcagccgcctgtggatcaccttctgcgccatcgccagcgcaacatcccttctggtctgttccctggtcctgcccatgacgggcggcttcctcatccgccgcggtctggccgagggactggaggcgctggggtcctgcgtcctcggcacactgcgcctgctctgcggcgaggtggacgagcggggcctgctgcgcgcgcggtcgggggacaacatcagtcactttggcatggactcgggccttggcaatgcgggggtggccgaggtgcaccgccaggcagatgccgccgccgccgctgtgacagtgagcgcggcgagatctgctttacagccgtgtggcaagaacacagagggtttgggatgtattggtggtgaggagaagagaggttgtggtcccaggaatgggcgccttggacgcaagactggaagccgcatgagtctgcagtccccttacccatcaccgcccccatag

SEQ ID NO: 8605 - DNA, 2349 bp, Chlorella protothecoides
atggagtgggtggacggccagcgcctgcgcaccgcaggtggccgcggcgggtctggggacgcaggcggcgcggccagctccgacgacctgcgtctggtggacatcggtgtgcggtgcagcctggagcagatgctggagcaggggtactaccacgccgacccgcacccgggcaacctgctgaagacgcgggacggcaggctggcctacatcgactttggcatgatgggcgagatcgacggcaccatacgcaggcggggtttggagtgtgtgttgtttgcttgtgtgggtgtgggtttgccgccccagagaccccacaagtacccctatctcaaaccctccccccaatgtccaaaccccacatatagaggcctgctgcaagccaccctgcacctgatcaatcgggagtacgaggcgctggctgacgactttgcaatgctgggcatgctgccctccgaagggagaaaggaggaggtcgtggccgcgctgacaggcgtgtttgcagaggcgctgtccggcggcgtcaacaacctgtcctttggggagctgtccaacgacctgggtgggcgtgctcgcctgcgacgcgtattcaccagcagcttctcactccattccctcactactccctgccgcagcaaacacgatgtaccagttcaagttccagatcccttcctactacaccctgctggtccgctccctgtctgtgctggaggtatggaagatgcaatcaatggttggggggactgggacttaggccagctgggtacctacaaggagtgctggacacagcagcaccctctttgtggggtcgaactcaccgtgtgccatggagttgcctcgagcggggcagactcgcgtcgttcccctccgtacatttcggcccttttcacctccacccagggcatcgctctggccagcaaccccgactacaaagtgctgggggcgacctacccctgagtccctgcatccaccgcacaacctcgcacactcacacccccctcctgcccctgcagggtcgctcgccgcctgttgttggacacctcccccgagctgcgctccaccctgctcaccctcctgtacaagaacggccgcttccagttcgaccgcctggtggcgctgctggcgcaggccgcgcagggcggcgccagccgccgcgccgcagcggcggcggcatcaggaggtgtgggcgctgccgccccaccctcggcgtctgacggtgccgccgctgccgccgccaggccccccccctcctcctcgaccgccgaggcgctgggcctgctgctcagcccgcgtggcgacttcctgcgcagcatcctggtggacgagctggccaagggcgtggactcctcctggcgcctgggcgccaacggcgtgttgggctcagcgcggcgcgagctgcgcgctttcctcctggccccggagtcgcagggcggccccgccgcactgcccttcgcctccgtggccgcgcaggccacgctgtcggtgctcttcgccatcccgccgctggccgaggaggccgacgtggagcaggtggagggcatgcgtcgcctggccgccgccgtgaacccgcagcagcccgtcgcaggggcgggggcggtggtgggtggaggcgcccggcccgcctcggcacatgcagctccggcgcacgcttcggcggcgcacgcctcggcgcacgcggcggggtcgctgccccctccgcccgaccagagcctggacggggcgtggactggggtggaggccgtggcctcggccgcgcgctggctggcgcgcgagtcggccacgctggggaaggaggagcgggcggtggccgcgcagctgccgctggccgtcgctcaggcgctgtcctcccgcctctcctcccgtgccatccagttcgtggccgccgtcgcacgggaggacagcggcacggcgccgggcgcgccacgcgggccgtcaggctcgggcgcggtcgacgcccgcgcgacggccgcagccgccgcgccgaccgtgccgaccgcctcccagggcccgccgccgccgtcagcaggccctccctcggcggccacctaccccggcatctccagggccccggtcatgaggcccctggccgcgccgggctaccgcgggaaaggcaccgcgggcacaatggtgctgacgaggccggcgccggctgacagcgccgcgccggcatcctgcgcatggtgccctggggctgcaggggcgagaagagagagtgaccgcgcgcgcctcgaccacgaagttgaggtgcacaaccctagccggaggggtacagtgcaatggccgcgcacagcaggggcccgcgcggcgattgtgcgcccatcaatcctgagtgccaagcacgagaggcagtaa

SEQ ID NO: 8606 - DNA, 1779 bp, Chlorella protothecoides
  modified_base (592)..(659): a, c, t, g, unknown or other
  modified_base (760)..(844): a, c, t, g, unknown or other
atgcgaggatcggtggatgtagatcgcagtataacgctggatacccgcattcttgcacaggcgagcatctgcggatgtctgctgtttctcggaggggcagctttgcctcggccaggggaatcagccactattgccaggcccaggaccagctgctccgatgcgatgatattgctgtacgaaccccccttcgtgacactccaattccggcccctcggcacaggtatatccacaggaagcatgcctggcgccccgcccagcctatcccatgcaaggagcagcgggctggcggcccggcgcaggggcgacccactcggtggcttcgccccccatccccatccacccaccccgcgtccgcgcgtgcgcccggcccccgccaccttccgcgtggcccccggcgccgcccccctccccgcctgcctgctggacgtgcatccggaggtggccgccgcgctggcggcgggcgaggcggtggtggcgctggagagcacgatcatcagccacggcatgccccaccccgccaacgtggagaccgctgcgcgggtggaggccgcggtgcgtgccgccggcgccgtgcccgccaccatcgcggtgnnnnnnnnnnnnnnnnnnnnnnnnnnnnnnnnnnnnnnnnnnnnnnnnnnnnnnnnnnnnnnnnnnnnccgccacggtgggcctgacccgcgcccagctggagcggctggggcgcgcggggacggcggtgcgcaaggccagccgccgcgacctggcggcgggcgcggcnnnnnnnnnnnnnnnnnnnnnnnnnnnnnnnnnnnnnnnnnnnnnnnnnnnnnnnnnnnnnnnnnnnnnnnnnnnnnnnnnnnnnccaccgtggccgccacggcgctgctggccgccgccgccggcatccaagtcttcgtcacgggggggctgggtggcgtgcaccgcggcggccacctgtcgctggacgtgtcggcagacctggcggagctggcgcgcagccgcatcgccgtggtctgcgccgggcccaagacactgctggacatcccacgcacattggaggtcctggagacggcgggcgtgggcgtggccgcgctgggcaccgacgagtttcccgccttcttcacgccgcgtagcggctgcgccgcaccgctgcgcgtcgagaacgcggcggggtttgcgcgcatggtcctggcgcaggagcgcctgggactgacctccggcctcatcctgggtgtgttgttggggggaagagggtatggaatgttggggagggggaggtcaggagggggaggtctggcagcttgtctgcatgtatgtgtattgcgacggagcgttgttttgctgcgtgctgcttaccttccagccgtacacccaccacgactcccgcccctaaaaacagttctcccaccactcatccacccaggtgtgcccatccccgaacacctggcggctgaggggcaagagatcgaggccgccacggccaccgctctggcggaggccgaggcgcagggcatccagggcgccgagatcacgcccttcatgctggacaggatccaggtgctgacgcaggggcgatccctggccgccaacatccagctcatcctgaacaacgccagggtgggcgccgaggtggcggtggagctgtcacggctgaggaggggcgggcagggccaggcgacagagggggacgcaagcaggggagcgaggaaggaggcgccggcacgtggaaatcacaccgctgtggctgcccatgcacaacctggcagaccgctgtggccaatgcaagggtatgcatga

SEQ ID NO: 8607 - DNA, 3348 bp, Chlorella protothecoides
atgggcaagagactctgtctgtgtaagtctgctacacccactgtgagcggaacactcaatccctcttcgtcacactgcaacctcatcaatcacttgccccctccccttgcctcctgcatcactacaagcacaagatcatgtccctggagcttcaggccacgcatctgggtgtacatcgcggccagccgatcagcgcagcgtgaaggaatcgagctccatcctcctaatggcacctgccaccttctgcgtcatgtcgacgaattcgttgcccatggacatcctctgacaggcctcctccagtttggtcagggctccatccatggcgtcatatgctgcgaggtacccagtgtaacgtcgggcatccaggccctctggtctccagtccttcatcgcatgcaagtggacgttgacctcgctgccagcctccctgacctcactggggtggaggggggggtagacaaccaccgcaagtccatccagcgactcacccagcttgttggtgtttgtgatcagcacctcccactctgcccagtcaaaggatccctggggctgttcgtcgagcagcggcctcagcagggacagcatcgcagcggcccggctcaggacctccaggatggccttggctacgtcggagtctgccctgctcagggccagctcctccgactcaccgccgctgccctcctgcgcctgctcccgaccaggcccctcccgctcgcactctcccccgcgcgcgcgggcgttcccggccttctgaccggcagcgcacgcctctgccagctcgcgccgggcatcctccgccatacgggcaatctgatcgcagggtgcggagcgggcggcggtgaacagcacagtctctggctctcaaagacatacgcccagacttcctccggcccttcccccccccgcccaccggaccccacctcagaaccaccacctctcgacgctcaccgtgtccaggctgcgccccagcgcctccctgttggtccatgctgcacgctccgcgtcatcgcacgactccacggcgagggcggcagcgcggagcacggcctccgggtcgggcgcgggcacgcccgtgctggccagcacccgtttggcgggctcgaccacggcggtcatcgcgcgcaccacctccttgcgcagggtcgcaccaccgcgccgcgcgcactgtgcggcggccgcccccagcgcccgcgcggcgtctcgcacctcgtgcaccagggaccctgtggccttgggcggcggcgcgggcgaccgcccgtccctgagcaccgccagcttcaccaggcccatcttgagagactgcaccgcgccccggaccgcggcgacctccagctcgctgacctcaatgcactccgacacgcggtgggtgcgctggtcgtgcacccaccccagggcctcgtccagggtggccatcacctgatcgtgcaggtccttcacggcgaccctcttgtgccccatttcgcaccccgaccgcagctggagttgaaggcttccacctgctccttgcactggtcaggaccgggcggtgggtggggattggtgaagggctggcacggcagtgccgacacgtcagctctatttccccaagcctgcgtccctcaccttgctgtggtcacccttgttcgccttcagacacttttgaagggcgtccacggcacagggactctcgaccttgatgatgctgggagcctgcgtgaggatccagggggcagaatggggcacggtggaaagagggggtgccgcaggctccggtcagggtcggcgggcctctactgccaatctccgcctgtatggagagcagcgattaccgcaccttggcgtccattaaataataaaatggaaggagttcgttgtccatatgacctcttgctggccaccaacaggaatgaggggggtgtcgtccgaagagagcgcttgcatgctgggcgtgccactgcaaattccacctgcgcacagccatgcatacgacggtgggagaacgactccaatgaccattccccatcccagagcacattgactcattcaaactttgacccggcggcaggactcgaagccatggcggaggctgcagcaccgtccggcctggcggacgccatctcccggtggcagcgccgagaaagggatcgagagctccactccgcggacagggcagtgctagcggcgcaggaggcggatccgagggaagccacggatgtctttctggctcgccatgcaagggagaaggccgctgctgaggctctcgttggggcggtgaagggcgacaaatccggggaaacccctgcgcgagacgcaatcatgggactccagcaggcatgttggggagcagggatctggggcaggcttcgtgaacccgcctggtatcacacattgttgcgtgtcattgttatgctgcgggtgctcaacatgccttgtcgctggggcctggcggaggcgtcctactggctcccccagtacgacctgcgccggttgacggccgagctgacggacatgtccgaggcgttggaggagactctgcgcgcctcgggccctcggcggcgattcgcctttgcacccacgcccgagccggcgggcacggtggagcagagcgcaaccccggcagcgcaggcagccgagggtgagcctccgcccccggcctcagccgccgcactgcagggcgccacacccgcccaacccccgcacaggccgtccacgctgcacttcaactcgtcgacgctgccgagtggctcccccttggtcgtgagcggggaggaggtgagcttgacgggactgcgggaccaggccatcatgctgctgggctgcccggccgccctgtatatcgacgatctggaacggtgcagcgtgactgcggggcccgtggccggcgcctgcctcatcgagggtgcgcgtgcggggattgctaggtggggaggggagccccattgctccacttgggcaaggaggctggggggtttcaacactgtgattgatgtagcccaagccagccaccacacctcctcgccttcccaccgacctttcccgtctctggatacctcgcaggggcgagggcgtgcaccttcaacctggcggcgcaccaggtcaggatccatgcctcgcacgacacccgatttcacctgcgctcctccagtgcgcccatcatcgagcacagctccggcctcggctttgggcccttgcagacatcgtcagggccggggccctcccaggaggcaagtgcggaggggaggcgtggaggttgcagggtgcgccatgctggggcagcgatcggctgactgggccttccgaggcatggcctacgagtacataacagtgtctgggcagcccagcgatcaaaccattgccgcggcatgctga

SEQ ID NO: 8608 - DNA, 306 bp, Chlorella protothecoides
atgtccagcgctgtttggagctcattcaggcagaagaggcccgggagcgaggctgcacggcccgagagcaaggcggggtccggcaccaagcccgctgcagcacccagcatcgagagcctcgatgccgaggaggtggaggccctcctccgccaattcgacatgacctccaagtatgggccgagcatgggggtgacacgattagaaaggtgggagagggctgttgacctgaagctgaaccccccaaaggaagtcaaggagctcctagacctcccaacctctaatccaaagagctgcttcgactggtga

SEQ ID NO: 8609 - DNA, 258 bp, Chlorella protothecoides
atggcattcgtcaatgagactgtggtgtgcatcgtcaacatggcctacaacctgaggcacgggtaccccttcagcagctacggcgatgccgccacctgtggcgtccagaacaccgtcatcctcggcctcatgttccgtcacggcgacgccctgctggcacgtgagtcacggcaggccaatgcttgtgtgggagacggtgcggtcgttgagctgcacatgcttccaccaccctctgcaacgcctctcactgcctgttga

SEQ ID NO: 8610 - DNA, 327 bp, Chlorella protothecoides
atgcctcacccacaccaccccgcccgttgccccgccacagagctccaagccagcagcgtgctcctgctggcgctcgggggccgcctgccccagatctggatgaacatcaagaacggcgggagcggggagctcagcatgggcagtgcggccctgtccgtcgctggcaacctcggccgcctcttcaccacgctcacgctcgtggacgacaagctcgtgctggtggcctcggtgtcccagctgctcctcaacgccatcctgctctggcagacggcgcagacggcctggaggaagaaacaggggaccgggcctgtctacaaagcggcgtga

SEQ ID NO: 8611 - DNA, 981 bp, Chlorella protothecoides
atggctttcagtcccatgcgaggggaccctgccacgctcgacccccacccccgggaagatgtcacgctgcggtgcggggacacctgcatcaccctgaactcccgactagccggtgccacctggtcaatgacctaccgtggccaggagctgatcctgccccagccggggaacgggggcagcctgcagtccgcctgcgccttcgacgtccggcccggcacctcccccgaggcggagaaccccacggaggcggggaacgtgaacgacaacgccggcgccacctcctccgagtggaaggtgtgtcgcgtgaacgccgaccacaccgaggcctacacggagaccctcatggcttacttctggccccccggcaggcccatggagtccggcccggaccgaggccccccccgcaacaccagcgtgctgtcccgcgtcaccctggccaagcacctcgtcttcctagccccggacctcctgcgctacaccgtggccttctgcctgccggccgacgagccgcactggtttgcgcaggttgaggcgctgacaggatacatgcaccctagcaccctcccctgccgctggaaggtggccgctgagcgggggatggggggccccttcgcggcgtggaccccggtgccctccggcgacgcccccgccgcccggccgggcacgccggcggagggcatggtgtacgcctcgcgggacggggcgttcgcctttggcgtggcggcggttgactggccgccggggggccacgtctacgccggggacgaggccgcgccgccctgggcggggacctggcaggacccctacaagtggaactacgtgcaccacttcaacgcgcaggtctcgcccgaggacagccgcatccccaccggggcgctggggtacagcttcctcctggccacgggcgacctggagcgggtgcgtggcgtgattgctcaggccacgctgctcgcggcggccaagtgccggccaccggcgtag

SEQ ID NO: 8612 - DNA, 615 bp, Chlorella protothecoides
atgggtgggctgctggaggatgtccaggaggagctctgcgctatctctgccatctacggcgatgatgccgtggacgtggacctcgactcgggcatctgcacggtacgcctctcctctggcagcgcttccttgactgccggggtgctgctgcccgcggactacccggcagtcagcccccctcaccttgaggtggccagcaccggcatggacgacgcagtgctggacgactgcatcgcaggcctggtcgagagcttttctccgggtgcgacacctggaggccacacagagggcaatgtgggcgagcccgtcatttttcaatggctcgaggcgctgcggatgtgcatggaggactgggtggcggagcaaacaccgcccagcccaggggagggcggggacgaggcaacggaggctagtgacgacgctaagcccggggacgagctcccttcccaggcccacccagaggcctcgccaggcccagacctgggcatagtccatggggagccgttcaccgagaggaggtccacattccaagcccaccttgccgtcgtgcattctagagaagaagtgaggattaggaagggtacatgggtaggggcagccctgcttggaagttaa

SEQ ID NO: 8613 - DNA, 1911 bp, Chlorella protothecoides
  modified_base (36)..(45): a, c, t, g, unknown or other
  modified_base (1144)..(1153): a, c, t, g, unknown or other
  modified_base (1690)..(1699): a, c, t, g, unknown or other
atgccaccacaacccaccccggccacacaccctccnnnnnnnnnntgtgagtttcatcaggcaccatgccaccaccacccccccgatcacacaccctcaaccacgcagggagggcgcgctgctggacctgatgcagcaaagcttcctggcgggccacgacccgggcatagactaccccgccatcgacggcgatgccgagctggacgagcactgggcgcgcctgcaggcccaggatgcagaggaccgctacttctcggactgagatatcggagcctgggggtagtggagccttggactgcgccaggcagggctggaatgcgcgcgccgtgctcgctgcaggcggagcatgtgctccgtggaggcattgcctcagggttggtcgatgctacatcacaactgctggcttggcagaggctcaggattcggcttccaaagcctggaaggaagacagccaagcctccaaggcctgaacagacctctggacctcctgacgcatatgctccagcccctcaaccaccccggctcgcggcccgcgtcaactccactatccggtccttgacggccttccggtctggggcgggcgccaggaagcccaaccgcaccggcagctgctccccgctctccagctccgcctccaggtccatgcccagctcgtccacggccagcaggagggcggcgcgcgccggcaggcgcgcgcagtgccgcaccatggcgacgcaagcctccccgtggtcggcattcatgtgccgcgcgatgggcgccgagaaggcggccaccgggtcaggtgctgtggccaggtactcctcagcgcccgcccgccccgcacgcgcgaagccgcccaccagccgcacaccgcgcaagctggccatgcgcgcctcggccgccgccgcctcgccgccggccaggcgctccatgctgcccgtcaacgtcgcccgcgcgtccggcaggccctggggttgtgcattgtgggtgtgcagtgtcactcttgtcacacccagttgtcaaataaaccagcgtcatgtgggaaaagcgatgcgactgttcccacgaggtgtaaaggaagtgacactgagtggcacggtgaggctgacacggtcgtcgcgctggacgtctcgtgtgtgggggctgagggtgctcagcgcannnnnnnnnntggtggggcacggtgaggctgacacggccgtcgcgctgaacgtctcgcgtgtgggggctgagggtgctcagcgcgaagtggggcagcccgcggtcgtccacggcatactccaccacgctgccggaggggaagccctcgctgtcggggccgctggagatggtggacagcaccccccacctggcgaggcgacatggaggagggcatgctccgcctcacgtgctgctagccaccagggtccgggcctggacggcgatggagaggcgtggagccttggactgaccgggcgtgtcaggggattctgcaggaggaggaatgatagggcgtggtcatggcatggcactggaacatcgcaccagatagacaggcgtgcgcggcgcccatgtccatgcgcaccaggaggagcggtgtggtccgcgcatgaaccttcagcatgctgtgtgccgcagcgcaagcgtactggccagtggcgatcacccagtgatatcgaaagctttgaaagtctggatcactggatgggaggcaggcagggccgttgtnnnnnnnnnntatcgaaagctttgaaagtctggatcactgaatggaaggcaggcggggcctttgctcgcgcgtggagatcgcactacatgcgtggtcagatcaagcgcgaacaaggtctaccaccggatgtgccggcaaggcaacctccatttacaaaacatgttcccatcatgaccgccaccctgtgcctggggtgtgtggtacccctgggcagtcactga

SEQ ID NO: 8614 - DNA, 1410 bp, Chlorella protothecoides
  modified_base (1073)..(1232): a, c, t, g, unknown or other
atgccatggactgtttttgattctacgagggatatatcgcagataaagtggtgctccattgccatggccactgccgcccggcagtgccgggcgctggccagcctcgcgtcgcagtcctgtgacgggctgctaggcgcccgttgcatggccaccctacccgctgccctggcctcacaagtggcaacacgcagccctgggtccatcgacctccccgccgacgtcaacgacgccctccttgctgctgccaagggtgcaagaaagaagcacctgcgcgggcagggtgccgcgctgacggacgagctgaagcatatgtcccgcagccggcaccgtggaggcgtgcaccccaacctgcatggggttccagaggcccaggcgcagcgccccacgcgtgggaaagcacggcagcagcgacgcaccctgctggccgagctggccggcgaggtgccgggcctgcctatggtgggaactctgacaggcaaccgggggccggcgcgcatgtcccgccgcgcccgcgccgcggcggaggcggcccaggagtgggaggacctggaggaggcagacgagggcggtggaatgatggacagcacggccgcagcgcggccatctgagttggctgacgccgggccggcggaactctcggacaccgtggatacacaaggagcttccggtgttgctgctctggaccagcctgtcatcggaccccccgccgccaagtcagaatccgcatcccagtgggccgcgccgccccccctcccgctggaccgccccgcgcgctcctcggcggtggcggcggggaggcggtatggcgacgaggccacggcgctggcctacgctgcgacgcgcatgccggcatgctacgccgcgctgcgccgcgctctgggcgaggtggcggcgcggcagggcgccgcctgggccccggccaccatgctggactttggggcggggccggggaccgcggcctgggcggcgcgcgacgcctggcctgcggccgcgctccgcgtgacggccgtggacgcctcgggcgccatggcctggctggggcgggctgtgcaggcggcgcggacgagaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtgctgggcgagctggacggcgacggggagcggcgccggctggtggccgacctctgggccagggtggcgccgggcggcgtgctgctgctggtggaacccggcacgccggccggcagccgcgccgtcgcagcggcccgcacccaggtcctggaggcggcagcggacggggagggtag

SEQ ID NO: 8615 - DNA, 1677 bp, Chlorella protothecoides
  modified_base (10)..(19): a, c, t, g, unknown or other
  modified_base (398)..(407): a, c, t, g, unknown or other
  modified_base (1017)..(1026): a, c, t, g, unknown or other
atgtccaacnnnnnnnnnncattgaaccctggtccccaccaacacttcacgcgcggggaagtgcagctcgggctctcaatgtccaatgacgtcgggatattccccacaaagccccacctcgcgcttggcgatgcacatgacctcgtccatggtgttgaacgagtcgtcccccctgacctcatctttctcccagacccccagatggttgtcggtggagatgaggatgcggagcacatcctgcctgcagggagtgggaatgtgctcggcaatgaggcaagcaaaagcctgatgaccatgccatcacatggtcgggctacggaagtgatcttgggtgcacttgacagccgatgcgccctcaaccgcatggaggtatcatcggttaccatgcacagctatgnnnnnnnnnnacagccgatgcgccctcaaccgcatggaggcatcatcatttaccatgcacagctacttcagcttgtaatgcgctccattaatggcggatcgtggtgtgtctgtgcgccagccagtggtccgcgaatcgaaaccccttgctcccgagagtcggcgcatgattcgggagtgccacggtggaataccctctgtcatggacgacacctcccatcccggcaatcgtaccttgggacaggaggcgatcaagtgccattttccctcacaccaatccgctatgtcatgacatcgccggggttgcacaccgctcttgctggatgtgcatacctggtggtgtacgtgctccccctgtatgtcgtgcggggtcccagggactcgcctcccgtgatcaaagctcgcctggctgccactgcgataacatcggccttgctgacatgggtgccgattatcctcgctttttcgcagtcgaacgggcgggtgagccgttgtttgcttcaggcgcacggtgcagtgcgagccgggatgcggctggcctgcctttgtgggttgatcccccaccaaaattggaaagcggacatcgcaatcacaagccactcccggccttgggttgacctnnnnnnnnnntgccctgctgggcctgacggcccacggcttttggagcagcgtcgcccagggccttgggttgaccgccctcctctttgctgggccccttgcgtaccgggcgctgggcgctgtgccggcgcatgggcccccccgccacgtcagccggcgcagtgcgctgcaggtcctgcgcgacctctgcctcgcccccctcagcgaggagctcgtcttccgcgccagcctgctggccttcctgcgccagcggggcctgggcgccgccgcggcggtggctgcctccctggccctctttgccgccgcacacgttcaccacttggtggaccgggtctggcacggcgggcacagcgtgcgcgtcgcgctgcgcgccgctgcgctgcaggccgcctacaccgccgccttcggcctgcacgccgccgcgctctggacggcggggcgcagcgtggccgggcccgtggcggcgcacctggcctgcaacctggcgggcctgccgcccctgggcgccatgctgcgccaccgccaggccccgctcctgctgctcctgaccgtgatgggcgtggccgggtgggcgcgcagcatcgcctggctcttccgccgccacgcctggtagcggcgcggcacactcccggcgccgacaccccctgtgcccgtgagccctga

SEQ ID NO: 8616 - DNA, 699 bp, Chlorella protothecoides
atgcaaagccagagtctcacgcttttcatcacgttccacgtgccccaccctcatcgccttgccatttggatgcacaggatccgtccggccgacacgccagactaccccagggacgagtggttcaatctctttgtcctgcatcagaatcggacccctcactcacagtcacagcatttgccagggcttcgtgcgacacgcatccggccggttgccctcaaaccattgctctcaccaagccccacttgctcgtgtcagggcgccaaaaattacgtgaaggagagccacttggcgcgattcctggacctggtcatttggggccatgagcacgagtgcctggcagatccttgggtgtgtggactggtggtggcctggcggggagtggagggcaggaggtttgtgtcctctgtctcacctcatgttggtgatgtgaccgacctgtggccaaatgaacaagcaggcctaataccaccacccccatactcggtggggcggcacccagcagccacaccatcccctcaccgcatcgatccgctgccgagcgcaggactcggtggagacggggggtgccttcagcgtcctgcagcccgggtccagcgtggccaccgcgctctcagagggcgaggccaaaagaaagcatgttgtggtgctcgagatcatggggcaccatgtgaggaggcgtgggatggggcaggcttctga

SEQ ID NO: 8617 - DNA, 795 bp, Chlorella protothecoides
  modified_base (760)..(769): a, c, t, g, unknown or other
atgtctaccgcactctccactgagtcccatcagctgcaccccctcctcacgcacatgcagtggcggacaataaagcacccgctggagacggtgcggcggtttgaatttgagactgtggtcctggcggagcacaccaagaagctggacccggaagatccagagctctcaagggaagaagtgggtgatcagcagaacgctccagaactgtctgatttcctgccttcctgtggcacattgaccagccacctgcgccgcacctgtgccaaagcccttttggtggcttgcccggctcagatgtatagcagcttgaaatcgaacaccatcgccctcccaccgcagacggtgactgccttcctggatgcccgggtgtcggccatgatcgcccgagcagtgcgcgggcggccgccagcttccccgaagcttccgctggtgcgcctgcgcgtggattacaccggcttctccaccatcaacacccagcgttttgggaccaggtttgtggggcaggtcgccaacccacatgacatcgtcctgtggcagaagccgcctgccagacgtgccagggtgggtgaggggaatggtggaggaaggaggaaggggtggtgtaggccaggactgccaatggttgattccgtgacaccccaaaactccacaccgaccctcacccatatgcgctctgtgcaggaggaaagcgccacccgagccggcaatgcccctgtcgtgcccattcgtcccgaggcgttggacgaggcccacatcgagnnnnnnnnnntaatggagcatgggacaatcatgtag

SEQ ID NO: 8618 - DNA, 1920 bp, Chlorella protothecoides
  modified_base (889)..(898): a, c, t, g, unknown or other
  modified_base (1643)..(1652): a, c, t, g, unknown or other
atggcctcgacctgggagagcgcccaccctctatcgcacggtccgagctgggatgcggcacccagccttgacatcgctgctgcgccgccccagtctggagtgtcagggttgtatgctctggccctccagggccagtggcgtcaggtcattgggaggtgcaaggaactccgcccggcgagtagagccgattcgctcaccattgctaccttccatgtccttgcgctcgcccagctgaaccagaccatggacgccctccaggagctggagagggttgggaacctggacggaagtggatcccacgcggcccgcaggaggcatgcagtagtctcacggccccaagacgttggttgggacaaagggaacgcactgagtgcatgttttgcaaggactgaccacctgttccctcgcatgctttacagcatgtttcccctcacccatacgctttcctcggcaggtaagcacagcgcacccgacgccagcgaggtgccctttgcgctgcggtggctcgcggcggagctgcccggccgggcggggcgctggatggaggccgtctcggcgtttcaggcccttctgggcctgtgcgtcacgcagagcgggatcgcggagcgggagggcgacgccgaggcgtcgcgcatgtggggtgggcgccgggcccgggcggcggctgccctcgctaatgtgcacgcccatgagtgcccgcgggtatttgagcggggatgttgtgtcctcggagttgggtgtgtccatgcccagacaggatcttgggtgactcgtatgggctctttcaactcagggaatccatgccaacatatcaaaatcccggatgacgacctcttccctgcatcctgccctgcctcgatttcaggcccaacccgcccctcgccacccnnnnnnnnnnctatcacaatcccggatgacgacctcctccctgcatcctgccctgcctcaatttcaggcccaacccgcccctcgccaccctctttcaccagacagcagcagtaccccgccgcgctggcggtgctggacgcgcagctgggcgccgatccgcggcgcatcgacacctggctgcatgcggcccaggtccagctgcgggtcggggacctgcccggcgcggaggccagcgtcgcctcggccgccttcctggccggggaggccgagggacctgccgccgcgtacagcgcgcgcgccgtgcgtcacgcgcggggcctgctggccgtcgcgcggcaggactggccggcggcggctgccgccttctcctcctgcctgcgggaggacgcgcgtgacgccgaggcggtgggcgacctggccgtctgccagctgttcaaccgcaacgtggagtcgggcgtggcggtgctggaggccgggttccaggcccagccctgggctatgctcaaggtgtgcgcgtgggtggtggaaagaaggaaaggacgagcggggggagggagcattcgaggacggtggcgcagaagaggggtccttgcagagcacggtgactcttgcttgggatcctgcccctgccgaggagcatgtcggtgctgtgcaataattcctggggtttgggccttcagggccgaggagtcaccagggcagcctgctgtcagaggtgaccccccctcaccagcaccatcagcaagaacttcctnnnnnnnnnngcgtcagtgctgcgcagtagttcctggggtttgggccttcagggtcgaggagtcaccagggcagcctgtcgtcagaggtgaccccacctcaccagcaccatcagcaagaacttcctaccaccatctcatccaggcgccgctggtcagcagcctggcgctcatgtacgacctggcacgccccgactccggcgccaaggagcgattcggcgcctgggtggcccgcatggcgcccgatgacctggacatgagctgcctgagccccggctga

SEQ ID NO: 8619 - DNA, 684 bp, Chlorella protothecoides
  modified_base (106)..(115): a, c, t, g, unknown or other
atgttcactcgacgaatcctggcaagagtgccctggagactctttgcgaaacccacaggggtcacgctccagccccaaatagtatgcatgaggcatttctgccttnnnnnnnnnncaagagtgccctggagactctttgcgaaacacacaggggtcaagctccagccccaactagtatgcatcaggccattctgcctgctgaacgatgtcggcgtcaggaggctgagcagccccgctttcagcttgcagccaggaaggaaagtggttgcagcggtggcacagaagcagcaacaagcaacagccagccctagctccccccccgtcatcaacctaccgtcccactgtatcggatgtggtgtcaagctacaacagaacgaccctgccgccccagggttctttcaagtgccgaagcgactcttggaacagtcttcgccccggtttgacaatgctgaggttttggaggaggaggagttggtggcacaccctgagctggcagcaagctcatcatcgcctgaggctccagatgatgcaccccctgcgcccaagagggactcccagatggacttgtttgaccaaattattgatgagtgggtggtgagtgtgagagacctgatgtgggatgggtggtgttatactgttgcacaggcattcgagaggttgccgaggatctgtcaaacaggatag

SEQ ID NO: 8620 - DNA, 1041 bp, Chlorella protothecoides
  modified_base (274)..(283): a, c, t, g, unknown or other
  modified_base (838)..(847): a, c, t, g, unknown or other
atggagacgatacagtgtatttcacttttgagagtccaagtaaggatggtggtgatgcacagcgggtatggttggaagcatccgctgcctgggtcagaatgttttgcacatcatctgcgtgcaagcattgttcctcaatgtcacgcagtcagctgtgctcccggattcctgttgcaaacagaacacctcagcaccaatccccccttcccacacgcgccagctcaagacaaggtctctgagttcgagctcaagctcatggacatcagtagcgagnnnnnnnnnnctttgagagcccaagtaaggatggtggtgatgcaaagcgggtatggttggaagcatcccctgcctgggtcagaatattttgcacatcatcttcatgcaagcatcgttcctcaatatcacgcagtcagctgtgctcccagattcctgttccgaccagaacacctcagcaccaatcgccccttcccacatgcgccagctcaagacaaggtctctgagtttgagctcaagctcatggacatcagtagcgagaaccttggcatccccgagacagagtacgccgcctccgtgcgcatgccctctgctgagttccagcgcatctgtcgagatctcagctccatcggcgacacaggtggggaggatgtcaaggaagaggtgtgtgcaagcagacttgccttgccgctgatggttaatgatgttctcatcgccggcccaatctacccattgtctaattgcagtggagatgagcgtgacaaaggacggcatcaagttctcgaccacgggacgtggtggcgaggacctggaaccttgcgccatatcttggctggatgggctgtgnnnnnnnnnncatctacccattgtctgatcgcagtggagatgagcgtgaccaaggacggcatcaagttctcgaccacaggtgacatcggcaatgccagtgtcatttgcaggcagaacactgcgattgataaggtgggcaagctactaggtcgtggtggcgaggacctggagctttgcgccatatcttggctggatgggctgtga

SEQ ID NO: 8621 - DNA, 2691 bp, Chlorella protothecoides
  modified_base (71)..(80): a, c, t, g, unknown or other
  modified_base (1231)..(1240): a, c, t, g, unknown or other
  modified_base (2026)..(2035): a, c, t, g, unknown or other
atggttggttgtttgtaccagagcatgtgcttgtacatcagtgggcttgctcaggtgaaacaaccatcggnnnnnnnnnncagccgcaccgcgcttgccgcttctccacttacttccccagcttcctcgcccaccgcaggacacatgcagctccacattcaaagcaattcccagtgcaatgtaaggcgtgtgttttgttccttatcttgggaagggctgcgcgcggcaccggggacgttcctgtccgcacaaagcccttgcgcactcggctcctgccgggccccaacgtgcttcgttcttcacagtatcggacgtaatctttacctgctgagggatgacagtgcagatgtcgtttgcaagcacttcggctttagcaaggctgggtcagttcgcacagccaatttcgagttcatgggcaacacgaactttcacaccgccatcagtgcacataccttcgaggtcgtgttttacacgaccgcacagatcatcggggccgtggagtgcctcgagtcgggccagaagccctgcacggcagacagcaacggcaacatcggttccggcaacaagggcaagcgcaattttggcaatgataacgtttgggatgacaatagagggaactccaatgagggcaacgccaactggggagatggcaacagaggcaataataaccgctgttttggcagggtaggagacaccagttatatcaacaagtgcagcttgcgtgtggtgagcaggaatcaattcaggctctacttcccggctcctgccaactcgccgcctcccgacatgtctccaccaccccctcccgccatttctccaccgtcccctccagccaagaagttcccaccatttcccgccatgcactttccacctcatccacccaagaagtctccctcgcccccggccaagaagtctccaccgccccccccaaagaacaagtcgccgctgcccgccaagaagaagtctccacctccacccgtgaagaagtctccatcgacccccgccaagaagtctccaccggacccccccaagaagatgtcgccgccgcccgccaagaggaactctccacctccacccgtcagaaagtcacctcctccgctcaccaagaagccgccgccgccccccaccaagaacatcccacccccgtactcctccatccctatctccacccagcacccctcctccacccagcacccctcctcctcccagcccctctccacgtcccagcccnnnnnnnnnnagttccggaagtatgcatgggtccttggatttccaccgcccccggccaagaagtctccaccgcctcccgccacgaagtctccaccaccccccgccaagaagtctccaccgcctcccgccaagaagtctccaccgcctcctgccaggacgtctcctcccccacctgccaagtcgtctcctcccccacctgccaagacgtctccttccccaccttcaagcccgagccctccacctcccagcccctctcctcctcccagcccctctcctccacccagcccccctcctccacccagcccccctccatcatcacttccaccacccccaccaagtccctctcctccaccctcaccgccacgtacgtcagccacagtcgaattcagtgctgcctcgaggggtatggtggacatcacttgtgttgtcaccacagtggtcgaattcagtgctgcctcgagtgactcggtggacatcacttgtgctgtcaccacagtgggttatgtacccaacttcatgaagtggggactgtacacatcagccttatcctatcttggcggtgatagtagggtgagtacttccgctgttaccaccatcattctgaaggaacaacctcaggagatagcaacacagtattccattggctccgcaagtacctttacttctgagctcaaggaagttctaccgcttactctgttgaatccttccaccccccctccgggaccctctccaccaccaccaatattcggggccatcaccgggagtgtttccaacgacgggaatgacttctcattcnnnnnnnnnngggtgagtacttccgctgttaccaccatcactctgaagggacaacctcaggggatagcaacaaagtattccattggctccgcaagtatctatacatctgagctcaaggaagttctaccgcatactctgttgaatccttcacccccccctctgggaccctctccaccaccaccaatatttgggtccatcagcgggaatggtgttcctttgcgagttgtccagaaagcttatgagagcacgccgatgacttggaccatcacgctggaatccagtgagatagttcttgcatcctatgcccaagtagtggcgtacaagctaggggttggcgcttcggatgctctaaccctgaaatgagccatccatgcccttgcgcaggcttacttacccacctgtccctgcattcctcctaaagtattgcctgatcgtgtttccaggcttgcctgcattggcagattaccccgtctgttcgtcattgatacggtgaaacttccagtgcaagggcatggagcgcagtctgcacatatcgatcatgcgcactgccccctatcggctattaggagccaaaagattctccctcgcgcttctttgggcccagatggagctccaccccccacccacccacacacgctgcctgcctggatgctgtctagatgctga

SEQ ID NO: 8622 - DNA, 672 bp, Chlorella protothecoides
atgaattccttgcgtcaattcacagaggacgatgagagcctgactgctgacgaaaaggcgttgctccgtttccagaagcagcggatgcaggagctcgcaggtggcaagtttgcactccctgacgacacccaggaggtggagctgacgcatctgggtcgcagcctggccgagtcccagggactgggcgagggacaggggcatgtacaagagtgcggcctcagcagcaaatgccccgttcccaaggcatggtgctcattgcactggccacaacgcacaatgccggtatccttgggcacccagcatgcactctcgttcattgccccatcccaggactggcaaagggatgacgaggacgacggcctgcccgactacgacgtctccgcgcattttggcggcggggacggcgagggcggcgaccttttccagctcaagccccgcagcgagtccgccgaagtcgagggtggggatggcgacgacgcgcccgtcccacgccgcagcaaggcggaggtcatggaggaggtgatcgccaagtccaaggccttccgtgcggccaagcaacagcagcgcgaggaggacgtggaggaggtggaaaagctggactccgtcttccgggagctgggcgctgcaggggccctctcccgcctcgtgcggcccaagggcgccaaggggtga

SEQ ID NO: 8623 - DNA, 687 bp, Chlorella protothecoides
atgtggtccatcagctactttgacagcaaggagtatgactggagggggatgagccagcagccttccctcctggccaaggcccgccgatccctgctccagttcacgcccaagtccttttcaaacctgaagtggcaggcgtttgccagccccaagcgctgcctccaggtaggtgctttgggattccgcggaggggccgcaggcgggagggcatgcggcattgagcgggcaaccgctgcacttctgatgggtcatgccagggccctgttctacagtcaccacattcgctcaccggccctacgttccatggatgcacaggagtgttatgagtacatcgaggcgtctggctctccccagggagccgacatgctgaagctgggagcctttgcgtggctgggtctcgccctggccctggagaggagggaggggaagtgctgtgcggcggtggatgccgggctggcacgcctggtgcgggagcctgtgcaggggatgtctcggtcgggcgtttgcccccctccacatttgccctcctctccattcccacgacgcagcatgttcccggcaccctggcccacgcacatcctgatcgggtggggcctggcggccgcctgcggcctcaccctgttcacggtgtggtcgctgcggtactactcgaggcagcgcgcaggcacaaaggccaaggcggcctga

SEQ ID NO: 8624 - DNA, 708 bp, Chlorella protothecoides
atgggccaggatcggagcggtatatctggggagactgtcacctccatctcgggtcgactggcggacctgcctgatctccgcctccccggccagctgacgcgcaatggcgaagtcggggtcgcaaagcgccgggagtatctgacgcgcaatggcgaagtcgggtccgcaaagcgccgggagtacgttgcggccctgctacaaagggaccctggcgtgttcctcgagaggcatggggtacacctgtcggcagacgagctgatgcactttgagtcccttcggagcgatcacgaggtagatttctatcttaaagccctgggagatgcgagaggtgactccaagagctcagccctcatccgcaaccggcgactggcgcacatgcagcggctcatggcggagggacagtatttttctgagagtgccatggagcagcgccagccctggctataccaccagtacattggccagtacaggccgagtgcagacgcttctgaccaggcatcgaccggtgtttctccaggcctcgcctacgccgaccggctgctggaccatgcgcgtgaggcgacgctggcagaggcgcgagaggaggagcagctcgcatacgacgctgccaccgaggaggaggacggggaggacgggcacgaggaggtggacgaggacgggagggaccagcagagtccggcacctgtcgagcctttaccggagcggtga

SEQ ID NO: 8625 - DNA, 465 bp, Chlorella protothecoides
atggagcgcctggccggcggcgaggcggcggcggccgaggcgctgtaccgtgcgcgccacccgggcagctactgggtgggatttggggactttgccatgtaccgcatggccagcttgcgcggtgtgcggctggtgggcggcttcgcgcgtgcggggcgggcgggcgctgaggagtacctggccacagcacctgacccggtggccgccttctcggcgcccatcgcgcggcacatgaatgccgaccacggggaggcttgcgtcgccatggtgcggcactgcgcgcgcctgccggcgcgcgccgccctcctgctggccgtggacgagctgggcatggacctggaggcggagctggagagcggggagcagctgccggtgcggttgggcttcctggcgcccgccccagaccggaaggccgtcaaggaccggatagtggagttgacgcgggccgcgagccggggtggttga

SEQ ID NO: 8626 - DNA, 996 bp, Chlorella protothecoides
atgcgggtggcgtacgagggcgagcgcctgacgcccagccgctgtgggcgcatggaccaggcggttgcgctgggcagggccccagccctcatgacctttgatggggatgcgatgcaggtggagagcgtggccctgagggagcccctccacctcgtcctcgccgacctgagggcggggaaggacaccgtccagatcctgtcctgcctgcaggtggagtggcgggcaatgcttgggttgggtatctgctggggggggggggtgagcaggcagaggaccaaaaggagggggctgtacagcgtgaaagtcctcggaaggagacctcgccttccgggaaagcaaggaccctgggtggcctgcaggtcccctttctcattcaggcttcttcggctctggcagcttgagactttccaacgcccaagcctgccccacgcccttccccccccccacccctttcctccacccccttttgcgaagcaagcgtaccccgtccccagcacttcagcacaccatgccctggtgcgctgcttggggcccctgaacgagagcctcaccgcctcggccgcggcgagcatggtccgcggcgacgtcgccgagctgggccggctgatgactgccgcccaggccgagttcgacgctgcggcggggccactgtgtccctcgcagctgggcgaggccgggtcccccgtcctgcaccgggtgctgcgcctccctgccatccagccgcacctgctggggggaaagggggtggggtcccagggcgacggcaccgcccagctgctgtgcagggacgcggacgcccagcgcgccgtcgtggccgtgctgacccaggagctggggctggagtgcatcgctttcaccgtgcccgccaccgcggcgggggaggcgggggaggggcgccgggagtcctcgcatcgggaggcgggcgggcggcggcggctcgcgagccgtgacccaacccccaaaacgtatccgggcaggccatgctcggcaccgtga

SEQ ID NO: 8627 - DNA, 240 bp, Chlorella protothecoides
atgagcgctcaaggctcggacgtccccgacattgtgtctgcccagtggctcaaggacaggctggcggatgtcaaggtgctggatgcgagctggtccctgccggtgcacaagcgtgatgctgtcgaagagttcaaagcctcccgtctccccggtgcccaattctttgacctggatgccatttcggacacctctgtgggtgagccaggaaggggttgtccaggtggtgagactgtcacctga

SEQ ID NO: 8628 - DNA, 600 bp, Chlorella protothecoides
atggcgtgggcggatgacgacgctttcctcctgcggctggccgagggccggggcctgctcagcgacctggatgaggacacgctgcagctcatcagggacagcatcggcgaggatgcggagctggggaccgaggatatggagctgcggcggattgggaagggggagcttgggaacgaggtgacagcagccgatgcgccacactcacctgctgacatcagagggagccagaggcaaactgcagactctctgcccacctcccgacctgcccccactgtgccggcgtcatctagcaacgggcacgaccccgacctcgacctggagaccctggcgcaggcctccgcctccacctggtcgcgggtgctgcgcccacccctgaagcgaggcgggcacgtggtgctggacctgtgctctgccgtagaaagcgggacgcggggcgaggccgtgcgccagaccgtgtcgcgcctgggcagcgagcgggcgctggggggacggggggcctaccgcctggcgcgggggctgggctggggcgacctctggcccgcagactaccaggacaggctgccgctgcagagagggggggcttggaagaagggcgagtga

SEQ ID NO: 8629 - DNA, 426 bp, Chlorella protothecoides
atggcccccagcaacgccgtggtcctgtggaccgtgccccccggcctccgggccccagccatgagtttctcggtggtggcgctgcacgtgctgggggacgtgcccagtccccccgccctgggcttcctgcagggccgcctgcgcgactggcggctgtccctcagcctggcctccctcctgctcgcggcgggggcggcctgctacgccctggccaccgcccccgcccggtcagcgacagactaccgggctcaggacgcggccacccggccaccgctggaggtccaggacctgcgggacgcctccctcgcggactcgacggcgggggctggggtggggggggtggagggcatgcgcctgcgcctcctggcggggcagtccacgcccaacctggccatgctgcgggagctggaggagaacagggagtga

SEQ ID NO: 8630 - DNA, 633 bp, Chlorella protothecoides
atgtccaccatacccctcgaggcagcactgaattcgactgtggctgacgtacgtggcggtgagggtggaggagagggacttggtgggggtggtggaagtgatgatggaggggggctgggtggaggaggggggctgggtggaggagaggggctgggaggaggagaggggctgggaggtggagggctcgggcttgaaggtggggaaggagacgtcttggcaggtgggggaggagacgacttggcaggtgggggaggagacgtcctggcaggaggcggtggagacttcttggcgggaggcggtggagacttcttggcggggggtggtggagacttcgtggcgggaggcggtggagacttcttggccgggggcgacttcttggtggggggcggcggcggcttcttggtgagcggaggaggtgactttctgacgggtggaggtggagagttcctcttggcgggcggcggcgacatcttcttgggggggtccggtggagacttcttggcgggggtcgatggagacttcttcacgggtggaggtggagacttcttcttggcgggcagcggcgacttgttctttggggggggcggtggagacttcttggccgggggcgagggagacttcttgggtggatga

SEQ ID NO: 8631 - DNA, 1950 bp, Chlorella protothecoides
  modified_base (92)..(101): a, c, t, g, unknown or other
  modified_base (1000)..(1009): a, c, t, g, unknown or other
  modified_base (1133)..(1142): a, c, t, g, unknown or other
  modified_base (1744)..(1753): a, c, t, g, unknown or other
  modified_base (1840)..(1872): a, c, t, g, unknown or other
cagccccacccccccgctccccgaccaccagcgcgctcagtcgaagccgcggtggacgcgggcgcgggtgacgcgctgcagcgctttgacgnnnnnnnnnnggcgcgctcagtcgaagccgcggtggacgcgagcgcgggtgacgcgctgcagcgctttgacgaaggccgcggtgcgcaggttgagcccgtcggcctcgtggatctcccagatggccttgaaggcgtcggtcatgaccacgtccagcttggtgttcacctccgcctcggaccacttgaagttctgcaggttctgcacccactcgaagaaggagacggtgacgccgccgccgttggtatagatgtcgggcagcgcgacgatgccgcggtcgcgcaggatctggtcggcctcgggcgtggtggggccgttggccgcctccaccaccaccttgcactgcaggtccccggcgttggcctcggtgatgacgccgccgatggcggcggggatgagcacgtcgcagggcacggtgaggatggcctccttgggcacagtggaggcgcccgggaaggtggtcagcgcctggcggtcggccaggtgctggcgcagcgcggggacgtccagccccgtctcgcagtggatggcgccggagacgtcggagacggcgatcacccgcccgccgtgctcgtgcaggatctgggcggcccaggcgcccacgttgccaaagccctggatgacaaaggacttgccccggatctcgcccatgcggatggcgcgcaggagctcacgcaccgcgaacaccgtgccgcgcccggtggcggcttcgcgccccagagacccatgcagccacaccggctgttggagtgggtgggagacgggggcggaggcgagggaggtggtgcagaaggaggcgagggaggtggtgcagaaggaggcgagggaggtggtgcagaagcagggagtgctgcatggcccagccgcgcatgccgtagtagcacccacctctacacacgcatgtacgccnnnnnnnnnncagctgcacggcccagccgcgcatgccataggagcacccacctctacacacgcatgtacgcccaccaacccctttcactcctgctcccccccacccccttccccccctttcctaccttgccggnnnnnnnnnngccaacccctttcactcctgctcccccggcccccccccttccccccctttcctaccttgccggtgacgatgcccggggagtagccctcgaacttggtgtactcgtcgaagatccaggccatctcgcgcgcacccgtgttcatgtccggcgcggggatgtcctcgtaggtgcccaggatggggcgcagggcctgcaccagcttgcgggtcaggatctccagctcgcgctcggagagggtggaggggtccacggtgacgccgcccttggcgccgccaaaggggatgtccatcaccgccgtcttccaggtcatgagagaggccagcgatcgcacgtcgtcgatgtcgacgtcggggtggaagcgcaggccgcccttgtaggggccgcgggagttgtcgtgctgcacgcggtatgcatcaaaggtcgccacctcgccgttgtcgcgcaggatggccagctccacggaaacctcgcgctcgggtgtcagcagcagcttctgcaggcgctcagggtactccagatcgagcacccagcgcggagagtgctggatgggggcatctgcaacaaaggtaccactgctgggagcagtgaaagggagcgtgcgnnnnnnnnnnggatcgagcacccagcggggagagtgctggcagggggcatctgcaacactgatacaactgctgggagcagtgaaagggagcgtgcgnnnnnnnnnnnnnnnnnnnnnnnnnnnnnnnnnacgtttggccccaacagcaccgttgccgtcctacgacaccaccccaactcaggtatgcggcaagataaaatcacctag

SEQ ID NO: 8632 - DNA, 1569 bp, Chlorella protothecoides
atggccctgatgctggcccgccgctccctcgcccgctccctgctgtcccgcatggcccccgccatgagcggaggtatgcagcagggcgggtccctggatccgcagaactcgcagacccgttacaagagctcccacgcggagaacaccaacaagttcatcgtggaggccctgcagcacctggagtaccctgagcgcctgcagaagctgctgctgacacccgagcgcgaggtttccgtggagctggccatcctgcgcgacaacggcgaggtggcgacctttgatgcataccgcgtgcagcacgacaactcccgcggcccctacaagggcggcctgcgcttccaccccgacgtcgacatcgacgacgtgcgatcgctggcctctctcatgacctggaagacggcggtgatggacatcccctttggcggcgccaagggcggcgtcaccgtggacccctccaccctctccgagcgcgagctggagatcctgacccgcaagctggtgcaggccctgcgccccatcctgggcacctacgaggacatccccgcgccggacatgaacacgggtgcgcgcgagatggcctggatcttcgacgagtacaccaagttcgagggctactccccgggcatcgtcaccggcaagaggtgggtgctactacggcatgcgcggctgggccatgcagcactccctgcttctgcaccacctccctcgcctccttctgcaccacctccctcgcctccttctgcaccacctccctcgcctccgcccccgtctcccaccctcccccattcccgtacaacctcccacccacccctacccctcacccctacccctcaaccactccaacagccggtgtggctgcatgggtctctggggcgcgaagccgccaccgggcgcggcacggtgttcgcggtgcgtgagctcctgcgcgccatccgcatgggcgagatccggggcaagtcctttgtcatccagggctttggcaacgtgggcgcctgggccgcccagatcctgcacgagcacggcgggcgggtgatcgccgtctccgacgtctccggcgccatccactgcgagacggggctggacgtccccgcgctgcgccagcacctggccgaccgccaggcgctgaccaccttcccgggcgcctccactgtgcccaaggaggccatcctcaccgtgccctgcgacgtgctcatccccgccgccatcggcggcgtcatcaccgaggccaacgccggggacctgcagtgcaaggtggtggtggaggcggccaacggccccaccacgcccgaggccgaccagatcctgcgcgaccgcggcatcgtcgcgctgcccgacatctataccaacggcggcggcgtcaccgtctccttcttcgagtgggtgcagaacctgcagaacttcaagtggtccgaggcggaggtgaacaccaagctggacgtggtcatgaccgacgccttcaaggccatctgggagatccacgaggccgacgggctcaacctgcgcaccgcggccttcgtcaaagcgctgcagcgcgtcacccgcgctcgcgtccaccgcggcttcgactga

SEQ ID NO: 8633 - DNA, 1301 bp, Chlorella protothecoides
  modified_base (110)..(119): a, c, t, g, unknown or other
  modified_base (976)..(985): a, c, t, g, unknown or other
gagcaggggcccggcaaggaggttctcagggtggcgggcgtggggcgtcgaggcggcgagcgggagcggtcagggcggggtggcctccctgcatgcgccctctggctcgnnnnnnnnnnaggagggtggtcggtggggtgcccttgtgatcgcaggaacaggggcccggcaaggaggtcctcagagtggcgagcatgggcgtcgaggcggcgagcaggagcgctcagggcggagtggcctccctgcatgcgccctctggctcgcgatgtgtcgccactccagcccgacgtccccctccccaacactgcaggcacctcgccgacggggaggtcgctggggtcggcgcacgcgccccaggcggggtcgtatatggagcgctttgcggcggggcggcagcacgggcgcgccccgaacggcgcctcccttcacgaaggcgccggcggcagtgcgccccggcgcggcgacagcagccccctgctggggaccagcccggggtccagccccggtcccgcccgcctcctgggcacgcccgggaacgctggcgctggcgcggccggcgccgagggcgacgcgccccccgagatcctgcccgagcgcgtgaaccggctgcccggggccacggcggtggccgtgggcgagaagcacacgctcgcgctgcacgagtggtacgccctggagctgccggacgccgacggggacggtggcagtggcggtgcctgcaccgagcgcaggggggcggacgcgtgtcgaggcgctccgggggcgctcgacgagaccgccggcggcgaggcagaccccccggtcggtgccgaatcgggggatgcgctgggggctgcccgagccacgtgccctggggcccctggggcccccacgccaagttccagggacgtggcatcgagtcctgcgcaggggggtgagggcgaggagtccagcaccgcgcggggtccgccccccctgcagcacctctgcgagcggnnnnnnnnnnccgggggatgcgctgggggctgcccgagccgcgtcccctggggcccccacgccaagccccagggacctggcaacgagacctgcgcagggggtggagggagaggagtccagcgccgcgcggggcccgccccccctgcagcacctctgcgagcggctggtgggcgcggcctacgtgaccccggccagcgcgctgcgcgtgctgggcacggccgacggcatgggcgcgcgcctgctgcgcgcgcacgcgctgtctgtggcgctgggcagcctgcacgcgtgcctggcggccgacgccgcgggcctggcccgcctgccgc

SEQ ID NO: 8634 - DNA, 4296 bp, Chlorella protothecoides
cgggcaggtgctgggcggcgcgctggccacgggcgcggcgcaggccctggtcgcggccgccggcctggccgcgcggcacgacgtccgcgaggttgtcgtggagctggtgcgccccggggtcaagcactttgtcgtgtcggtgctgggcgccgaggggcgcgaccccgtggcgctgccaatcacccaggtgggccactacgacctgctggaggagatggtgcgcgccgacctggcactccacgccttcaccgccgtgcggcagcggcggggtacgctgcacctggacaccctgatcagagcgggaagtggagggccagaccggctcagggtcggcccatgaggctggagggtgtggttgaccgagggtcgccagggactggggcggacgtcacggccgaggccctgggtccccgggccgccctgacgcacaggaaaggcgccgacccgggggagatcggggaggtggtgtcggcgctgcggagggaggcggccgtggacccctgctacctgggcggccccgcgcgccccacccaggagctgcgccactccacgcccgcggtggatctggcggacgaggtgcaggcgcgcgtgcgcgcagctgccctgaagctgtacgccgagctgggcctgcacggcccagcccagttccgcggctgggtgaccacgcccggagggggtggggaggaggaggaggaggtggaggtgcacgtccccgcccccgccgagctggaggcggtgcggagggccggcgccgacgcgcaggcgcggcggcctcgggcctttggcgacctgctggagtttgatggcctggtgcgagcggagccggcgcagcgtgcccccgcgcccgagtccatcaccccgctgcgcatcgtggggtccacggccatgcaggcggcggcggccaacccggagctggcgcgcgcgatgttgcgcgaggagttgaccgaggaccggccctcccgcgcgcgctacggcgcctggcaggggctggagctggacgaccgcgtggccgtggggggcgaggcggcggaggaggggccgtgcgaggaggacgccgtggcggggctggccacggaggagcccctgccgcccgtcgtcgagcgcctggtgccgccgagcgagctggacgccctgcccgccctctgcgcgccttcgggcgacggcgccggcgcgcatcgcatcggcttcagccggctgacgctgggcctggacctgtccggcgcgcgctcgatctggctgcagcaagccgcggcggcggggctggccccgggccgcctggtatgcgcaggactggcccagggcgagctggaccctgctgcgctggcgggcggcgcggagggggggacggtcggcgccctcgcagcaggcgccgccacccgcggcgggcaggtcgcggcggcagctggccagggcggcgacgacgacggtgcctcgccgggcgcctgcgtgcccgccgccgcaccctggccgccgcaggactgggcggcgcagctgcggggcctgggctccttcctggagaacctggaggtggacgatggggaggggttcgaggccgccatggcggccgccggcgtggaggtgccggccgcgccggggtctgcgccggcgctcccggactcctacgacgcgctgctggacgagcgggaggggtgggacgagcgcgagaccatctggggcggggacagcgtctgggtgtcggggcgggaggggtccctgctcccccgccccgaggacgcggggccgggcgacgccggcgccggcgaggcatggagcggtgagggcggccaccaggccacgccgccggaccccgctccagccgcgcgcactcccctctgggtcctgtttggcggggacggcgcgggcggcgaggccagcctgcgctcgggcctggaggccgccgcggcgctggggcagacgggggagtacgatgtgcgctccttcttcctggagccctgcaacgcgggggagcaggcggagggccggcgctccgcgctcctgcagcgccgcctccagatgctcaagctgggggcggacgacgacgagctgctgcgggagatggggcccctgcatcccacccgcatcaagggcctggaaggcaagggacagctgtcgtgttgctcatgcatccattgttggacctcgtcagtccacctcacgatcacgaccacacgttcctccacacacagcatgccgccaaaatcagagctggtggcactgcagcgcggcgtctgggagctgaccggcacgggcctcctgcgccagacccccgccgagctccagcacgcctgcgaggtgggggaggtgctttactggccatgtggcacttgtactgctgctcctgtggttgcatggccactgcccgccagggccatgacagtctgcctggcccgtttctctgttccccacaccccccacccaccatcacctctcgcaatcccctcgtcaccgtgtcctccccaccgcctcacaccaaaacaacagagggcgctggcgcagtacaacacgccgtggagccagaggggccccgaccggctcgtccccggccaggccgcggcctcgcaggccgcgcaggagctggtgctgggtggctgggcggcgcccgacgaggcggcggccatctggggcgcggggctggaggccggggagcggacgccccagccaagctaccgcttcctggaccgctgggcggccgccgcccacgaggccggggccgtggtggtgctggcctgccaggcccagcctgttgccctggggccgattcagcgggtgctggagggcaagggcgtgccgtgcacgctttccagctccgccaccctggaggcggtcacggaccgcgccgtcatgatgcgccaggtcagcgtctgtttgagcgatgggacggtggtcgatggcaggggtttcagagatgtgaatggcaggatgggggtgcatactctggatgaacgaggaaacaggtggatggccttgcggttcaggaatgagcagggatctgtctctgcatgcccccccgcacccctgagagcacttgcccaaaccccccaccccatgcccactcctccaaactcacagctggccgacctggagccgcacggcgtgtctgcggcgccctggcacaagatgtccctggcggagctgagcgccaaggtggagggcgaagcggaggccgacgcgctgtttgaccagctgcgcggattcctgggcgcgggcgaggcggacctggtgctgcgccccgcctgtaccacgcgcggcccagagctgggccaggtcaccatcacctgcggtgctgacctggcgatcgtggccgccgcgctttcccagggccgcgaggccatcgaggcgggggagctggggcagggcgacggggtgcgtctgccgcagccgccgcccagccacgtgctgctggagccggacgtggcggtggaggacctgatcctgatgcgggagccggagggtgggagtggcgatgggagcggcggacacggagcctggagtcgtgggagcgtgtcggcgcggctggcgctgccggaggggtgggaggaggcggagcgctcccttcccccgccggaccctgcccagcccggcgcgcggcgccaccccgccgcgcgcttcgtgcactggccgccgggcgagccgtcctgggtggccgtgcgcgcttgcctggtgggcggcgcggggcacatggtctgcctgggccccacggccgacgtgctggaggtggcgccacgccccgcgggcctcccgcgtgccacgcgcgaggccctgacccacgtctcgcgcctcgcggcgaaggaggcgcgcgccgcagcgcgcgccctgggcaacgccgctgcggaggttgcggatctggaggacggggcggacgcggaggccgctgacgtggaggcttccagcgacgaggaggaggaggccgcgaccgtggtaggctgctaccagttcacgccgccgcccgagcgctgggtgtcgggcgaggcggcggcgcaggcgcggctgcgcctgcagctggtggcggggcggctgggcctgtccggcgccgcctccatggaggcctttgtgcacacggccacgggggaggtggtggtcacggaggtggacccgctgccagacctgtcgctgggggggctgctgatgaagcaggctgctgcgggggtgccccaacccctcactcccgcccaggtctggcgggaggtggtccgcgccgcgcagcagggcggcgggggggcggggggcgcgggcagcgcgacccagggcgaggccgactacggcttcttcgacgtggccgacatggcaggtgggtgg

SEQ ID NO: 8635 - DNA, 1086 bp, Chlorella protothecoides
  modified_base (354)..(363): a, c, t, g, unknown or other
  modified_base (548)..(557): a, c, t, g, unknown or other
  modified_base (758)..(767): a, c, t, g, unknown or other
gccgcgcctgccccacgccgccccgcgcccgccccccggtcgggcgccggcgcgcgcaagccggccggcaagctcgggggcggactgggcatccgcaaggccgccgtgcgagtggatgactcgctgttcgagcaggagccagccgcgccggaggaggcgcccggcgcgaccaacggcgagggccgggcgaccgggcccaagggtcaggcccacggcagcaaggactttgacgacgaggactttggcggcgcacaggcgccctcgtcgcgcttcgacctggacgctatggaggagcgggcccgcccccctgctcagcgctctttgagaagcaatggtctcgccatgccccagggnnnnnnnnnnactccagtttttcggttgggatggtggcagcgctcttcgagaagcaatggtctcgccatgccccaggggatctgtctgccattgtctcaagcagccactgtctctcccctgagtcgcatccctgttgagaaggcctcccccccccggccagccactcatcacttgagcaccaccctgtcgcagcnnnnnnnnnngtgtctctcccctgagtcgcatccctgtcgagaaggccttccccccccggccagcctctcatcacttgagcaccaccctgtcgcagcgcgggcaagacggccacctgaagctgaccggctggggccgagcctcccgctccgtgcccgctggccccccgcccaccacctcggacgcgtcggggtcggccgcccaggcccgcnnnnnnnnnnaggctctagcggctggggccgcgcctcccgctccgtgcccgccgggcccccggccaccacctcagacgcgtcggggtcggccgcccaggcccgcttcgggtcggccaaggccatctcctcggctgcctatttcaaccaggacaagggggagaacgactacgagaagcaggcccggctcgcaaagttctcggtgagcggcggcgcatgcggggccgaaggcagggcgggcggggcggagggcatggaagagggaacgcatgtgaatgataatgctcctcggtccatttctgtctggctctcccttttcacttggccatga

SEQ ID NO: 8636 - DNA, 1056 bp, Chlorella protothecoides
  modified_base (39)..(48): a, c, t, g, unknown or other
  modified_base (108)..(117): a, c, t, g, unknown or other
  modified_base (575)..(584): a, c, t, g, unknown or other
atgctcagttctggcccgccatggcgaggcatggacgtnnnnnnnnnnaaggcccctggaatgagattttgggacggctgcatggggtcgtgccaggcagtcagggtnnnnnnnnnngcacaagtgtatcggaggagatggagctgccccggaacaaggtcatctgtcatgtggatttggatgcgttctatgcgcaggtggaggtgcggaggccccgggaatgagattgtgggaggactgcatggggtcgtgccaggcagtcagggtttctcctactccctcccgagcgtctcgtccaaagcccgacgccttcccctctctgccccgggctcccaggccaagcgcgaccccaacaggctggcaggcaagcccctggcggtggtccagtacaacccccagggggacctgaggacgctgctgccagaggacgaccgtgtcatacctgcctcctccaactccatcatcgccgtatcgtatgtgagaccgcctggcctgccccaatcattgacgaatgctacttccccttcctggcagaccccaggcgaggtggccccttgccacccagatgcatggtnnnnnnnnnngatcattgacgaatgctacttcccttctctggcagacccctggcaaggtggccccttgccacccagatgcatggtcattgttacagcagcccaggactctggcaatgtaccggcccctcaaatcgattctctccaacctcacacgcatgcacgcgtgcaggaggcccgggcgcagggcgtccggcgcaacatgcgcggcgacgaggcctgcgcgctctgcccggatttgatcctggtccaggtgcccaccgcccacggtaaggctgacctgacgctctaccgcgcggccgggcggcgcgtgctggcgctgctggcggcatgcgccggcgcctgcgagcgcgcctccatcgacgaggcgtacctggacctgaccgaggcggccgccgcgcggctggcaaagctcggcccgccgccctttgcgccgccgcccggcgcggagcgcatgcacgtcggcgcggaggcccccgcggcg

SEQ ID NO: 8637 - DNA, 783 bp, Chlorella protothecoides
  modified_base (201)..(259): a, c, t, g, unknown or other
ccagccgccccgacgcggtcgacgagcccgccgcggccccggccgcccagtcccgccgcaacgcctcgggcctcctacgcgaggccctggagggtaggggcgccgcgccccccgccccagccgacgacaatccgaccggcggcgaggcggacgccggtcaggactgccggccggagcggcgggggcctgggggggggtccnnnnnnnnnnnnnnnnnnnnnnnnnnnnnnnnnnnnnnnnnnnnnnnnnnnnnnnnnnncgcgcgagcccccaccccccactgacgcccccgcccctctgtcgagcacgctcaagtcggcggtgtacatcgacctgctgctgggcgcggcgcgcgcgctggggcccgtggtgcgccagttcacctccctggggctgaaccgcgtgtggctgcacgcaggggacgtggtgtaccgccagggcgacgtggcggagtgcatgtacgtggtgatctcggggcgcgcgcgcctgctgcaccgcgcctcgcgcgggcgcgaggtgggcgtggaggacgacgtcggccgcggcgagtccatgggcgcggtctgggcgctggcgggcgggcgccacgatacctccgccatctgcatccgcgacgcggagctgtgccgcctgacgcgcggctccttcgagctgctctgcgcgctgcacccgcgcgccgcggcgcgcgtgctgcagggcatggccgagcgcctggccgcctcccagagcaaccgcgggcggggcggggtggcgggggtccagcgcgagacgctcgacgcgtga

SEQ ID NO: 8638 - DNA, 849 bp, Chlorella protothecoides
atgtcctccccgtcggccgccacgtacatgcatcaggtggagaaccacgagggcgtgaccaacttcgacgacatcctggacaagtcggactcgatcatggtggcgcgcggcgacctgggcatggagatccccaccgagaagatcttcctggcccagaagctgatgatccagaagtgcaacctggcggggaagccggtggtgacggcgacccagatgctggagtccatgaccaagaacccgcgaccgacgcgcgcggaggccaccgacgtggccaacgcggtgctggacggcacggactgcgtgatgctgagcggggagacggcggcgggggcctaccccgtggccgcggtggcagtgatgaccaagatctgccatgaggcagaggcctccatcaactacaccgcgctgttccgggccatcatgaagcgcgtgccgctgcccatgagcccgctggagtctctcgcctcgtcggcggttcgcaccgcgcacaaagtcggcgccagcctgatcgtggtgctgacgcgcggcggcgccaccgcgcgcctcgtcgccaagtaccgccccactgtgcccgtgcttacggtcgtcgtccccgtgctcaccaccgataacctcacctggcagtgctccagcgagagccccgcgcgccagatgctcatctcccgcggcctgctccccatcctggccgaaggctccgccagggccagcgacagcgacaccaccgacgagctgctgcatgcggcgctggaccacgcgcgcgactcgaggtactgcgcccgcggcgacactgtggtggccatgcatcgcatcggcaacgcctcggtcatcaagctggtggacatcaagtag

SEQ ID NO: 8639 - DNA, 216 bp, Chlorella protothecoides
atgtccgctttcagcagggttgcgcgtcagctgtacagcaccggcagcaaaaccctgcacgctgcaccaaagtccaacaccaacgccctacagcagcgaagctttgcctcagggcatggccacgggcacgatgtaacgtatgagggcctcacactgcacaaggcctctccctggcacgtcaacatcgggcggggcatggccggtgtcatgtggtga

SEQ ID NO: 8640 - DNA, 675 bp, Chlorella protothecoides
atgaacgtggcgcgcttcaacttctcccacggctcccacgagtaccaccagggcgtgctggacaacctgcgcgaggcgtgccgccagacgcgcatcatgtgtgcggtgatgctggacaccaagggccccgagatccgcaccggcttcctggaggacgagcgccccgtcttcctggacgccggccaggaggtgaccatcaccaccgactacggggtgcggggcaacaaggggctcatcgccatgtcctacgccaagctggcgcaggacgtgcggcccgggctggtcatcctggtggccgacggctccatctcgctggaggtgctgtccaccgacccggcggcgggcacggtgcgcgcgcgctgcctcaactctgccaagctgggcgagcgcaagaacgtgaacctgccaggtgtgatcgtggacctgcccaccctcaccgacaaggacatcgacgacctgcagaactggggcgtgcccaacgagatcgacctcgtcgccgcgtcctttgtgcgcaagggctccgacctggactacatccgcaaggtgctgggcccgcgtggtcagtacatcaagatcatcagcaaggtgtgggggggctgttcatggttgcaaggggtgaaggagggagggacgacgatggggcgtcgtcagtgcggggtgacaacgtgggggtga

SEQ ID NO: 8641 - DNA, 555 bp, Chlorella protothecoides
atgaatgggcaagagcaccgagcgatgcatcagtttctaaaaccaccctggcacctgatggagggactgctgttgccagcactcatcatgccccctcatccacaggctgtgctgttagagctagaaagggtggcgggggcgtaccgccaggctcaccaggagcaccaggacctgctgcgagccgtggaggttgcccgcgccgggctgaaagaggctgatgcctcgctggaggcccggcacgccgaggtggcacgctctagaaaggacgaacagggcggcagggcggcggccgccgctgcgcaggcgaggctggacggcttgaggcaggaagcagctgccagggagcatcagattgccgctgcagaggcccagcgggctcagcgggctcaggaactgcatgcagctcagcaggcggagcaggacgctcagcagagggtggaggaccttcggctccagctctccagggtgagtaggcctggtatgggtggctcgggtgctgatggacaggcagaatgtatgcagggcttgccatgtatccaccccaagtggctgtag

SEQ ID NO: 8642 - DNA, 1113 bp, Chlorella protothecoides
  modified_base (20)..(29): a, c, t, g, unknown or other
atggaagaggacggagttannnnnnnnnnccccacgcaattgtgtcggaacggggtcccgagggcccacaactcgatggaagaggacggagttattcgagcgactacggctgagaacatggcggcagcaacggagcacttcaaccgggggaatggggcgaccggcagtgaggtacggaagtcggcctcgttgtcggggatgggtgcagaggggaaatgcacgaccacgaatccgatccacatgattgtaggatgcattgtatgtgtatgccacctccccaagatatccccgagggtgacctcgagtgccaatgggaagctgaccgtggtgtctacaggtgccagatgggagaatgaagtcggctactcccgggctgtgaagcgtggaaacttcatcgccgtctcaggcacgtcgtcggtggagcagagcactggcaacgtgctgcacaagcgcgacccatatgcccaggccaggacggcgctggagatcgtggcgcatggcctggaggccctcggcgccaccttggaggacgtggtgagtggcaatggggcattggttgctgtagacgtcctgtgcaaggggtgcctgcgcgctgcagggtcagcagcctctggcacggtgaccgtaagcgcgtgggcacggacctgcccacctggactcctgccccccccacctatatgtgccgtggtacatgccatgctcagtcacgccgacatccctagaactccaaaccccatgcagattcgcacgcgtgtctaccttcgcaacatgggccgggactccgcggcggtcagccgggcgcatggcgaggtcttcggcgccatccgccccgccagctccatgatagaggtgcaacgcctagtgcatgatgacatcctggtgctcatcgaggtggatgccatcgttgcactcgagcacagaaaactggacatgtgcatgggtggaggtagtctgtgcggaccccgagatgtcttctgtagccccttcgccgcagcagggagccagctgactcatcgtcaccaaagccgatggtcaccatctcagttcacggtacagcccgcagctccgcccccggcggcatcatgttcggcctgggtgctcgccttgcagtga

SEQ ID NO: 8643 - DNA, 603 bp, Chlorella protothecoides
  modified_base (424)..(433): a, c, t, g, unknown or other
atgtacgaccggcggctgctggaggagcgcaccgcgtacctggcatcggtgcgcgctgcgggggacttgccggcctccgcgctggccatccgctccgacctgctgcgcaacctgggcaacctggccagccccgacctgcacgagacctgccgggcggtgccagagcccatccgcgcctactccgccgaggtgcagcgtcacgtgcgcgccatcgccgaggcgccaggtgtgatttgggggggaaggacagaaattgagaaggaattctgtggcaaggagcagtgtggaaggcctgccagggggtgggaagacatcgagcggtgcaagggcgtgtttgggttaaatttgtgtgtgtgcatggggcgagggttggtcgtgttgacggtctgcatgattgatgtaacacagttcggcatggcacagnnnnnnnnnnccgcgcctactccgccgaggtgcagcgtcatgtgcgcgccatcgccgaggcgccaggtgcgatttgggagtaaaggagaggaattgagaaggaattctgtggcaaggagcagtgtggatggcctgccggggggggagacatcgagtggtgcaagggcgtgtttgggttag

SEQ ID NO: 8644 - DNA, 1143 bp, Chlorella protothecoides
  modified_base (386)..(395): a, c, t, g, unknown or other
  modified_base (644)..(653): a, c, t, g, unknown or other
atgaaatccgcaggtgccgatccttcgagcgaaggcatcgacgggcacagttctgacgagattagttactttaggatggctgcaatgggcctgacctcgctggcatcaccctgtgccttcaccaccgcccggcctaccacccgccgggcccatgctcgccctggcatgctccccgtgcgggcagccgcagcggctcccagcatggtccctgacgaggccaagaggacgaccatgaacctgctgcttgccggatccgttggcctgcccgtggtggccatggccattcccttcttctccttcttcgtgcccgtcaaaaagggcatagaaggcgcagcgccgttcgccatcccaccccgtgatcgtgtctggagtctgatgttgttgcnnnnnnnnnnaggaacgttgctgcgacaacgtagggtaatcgcggatgctgaccgacagggcatagaaggcgcagcgccgttagccatcccaccctgtgatcgtgtctggagtctgatgttgttgccccctcctgcaccatgggagctaccctgtctctcctcatatgctgcctccccctttaccttcccccctcttcccgactcccatctccagggctgctgggactggcgcgggcctggtggccaaggacgccctgnnnnnnnnnntcacactgcgtcctccttcaccttcccccctcctcccgactcccatccccagggctgccgggaccggcgcgggcctggtggccaaggacgccctgggcaacgacgtgaagaagtcggagtggctggccaagcaccagccgggggaccactccctggtccagggcctgaagggcgatgccacctacctcatcgtcaccagcgccggcgacgtggagaaatacggactgaacgcggtgtgcacccacctgggctgcgtggtgccctggaacgcggtggagaagaagttcatctgcccctgccacgggtcccagtacaacgcagagggattcaaggtgcgcggtcccgccccgctttccttggccctggcccacgtggacgtggtggaggacctggtgtccctcacaccctggaccgagaccgacttccgggatggcggcaagccgtggtggtcctgagcgccggcgggtacccctccctgcgccggggctag

SEQ ID NO: 8645 - DNA, 474 bp, Chlorella protothecoides
atggtatcccttcgcgagggcagcgagtctttgacctcgtcccttctccaggctcaggctgagctggatcaaatcgggcaccggctggagcaggagtttagcagcagatatcgggactcggaggtcaaccccctggtggtactcaaccgcctgcacaagctgcgcaggtgcagggcaggattgggctgtgctgggggttctgttcttgagaggatgccagatcagcagggcggagtcccagcacccacacctgtcgccatgttccagcccaagggtcgaccctttcactcgtatgccctctcccccagggacatcagcgccgtcgcagaagatgccgaggacttggccggcacgagggataccctggcggccgaactgagcgggctcttagcctccaacgtcgccaagctgcatgccttgcagcggaaggcaggcatccacccatccctggagctgcctggtgtaccagcctga

SEQ ID NO: 8646 - DNA, 492 bp, Chlorella protothecoides
atgccagctccccccagccccgtcagagggacactagccccggcgcagggaggggtacccgccggcgctcaggaccaccacggcttgccgccatcccggaagtcggtctcggtccagggtgtcctccaccacgtccacgtgggccagggccaaggaaagcggggcgggaccgcgcaccttgaatccctctgcgttgtactgggacccgtggcaggggcagatgaacttcttctccaccgcgttccagggcaccacgcagcccaggtgggtgcacaccgcgttcagtccgtatttctccacgtcgccggcgctggtgacgatgaggtaggtggcatcgcccttcaggccctggaccagggagtggtcccccggctggtgcttggccagccactccgacttcttcacgtcgttgcccagggcgtccttggccaccaggcccgcgccggtcccggcagccctggggatgggagtcgggaggaggggggaaggtga

SEQ ID NO: 8647 - DNA, 633 bp, Chlorella protothecoides
atgggacgaggagatgtggcggggcccgcaccacccaccgagtccggcattgccgatgctggggtgcactctggagccaggaccaagggtgtcgagtgcggcgcatgcaaagtccagccggcactcgagcacctcacccactccaacaccccacccccagcgctgggcctggggcacgcccacaacaagcgccccggcgtcatctgggccaagctggcggcctgcctggtgctcacccacctcctctggatgaaccgctcggtgttcgacctggtctggcgcccgctgcgccccctgctggcgtacaccaaccccgcccggcccgagggcgaccccctgcacgaatggttcttccgcaccggcctggaccgctacgtctgggtgcacggaatggcctgcgccgccctgctcccgcgctgggaggcggcgctggcggcgctggaggcgctggggtggaaagcgcggcgcggcgcccgggccgccgtgctggcggtctgcgccctggtggggtacgcatggtatgcgcacgtcttctccaagcccaagctggagtacaacgcgctgcacccctacacctcctggattcccatcactggtgggtgggtgtgggttgcgtgtgggcgggaggggtga

SEQ ID NO: 8648 - DNA, 333 bp, Chlorella protothecoides
atgttcctggccctggccacatgcgcggcgctggccagccagcggcccacggggcggccgcctgctgtgctgaaccgcgggcagaccgaggagtggaagggctggatgcaggtactcttcctcctgtaccactactactcagccaaggaggtgtacaatgccatccgcgtcttcatcgccgcctacgtgtggatgacggggtacggcaactttgcctactactacaagacctccgactttgggatgggcaggtgggaggagggtttggggagggggcaggtgaagtggagactctgccctgccggcatggtcatggatgcatgcgtgggctga

SEQ ID NO: 8649 - DNA, 798 bp, Chlorella protothecoides
atggagcccaactcctcggtcaaggaccgcatcggcctggccatggtggaggacgcggagcgcgcggggcgcatcgcccccggcaagaccacgctggtggagccgacgtcggggaacacgggcattgcgttggccttcgtggccgccgcccgcgggtacaagctcatcctgaccatgcccgccaccatgtcgctggagcggcgcatcgtgctgcgcgcctttggcgcgcacctggtgctcaccgacccggccaagggcatgaagggcgcgctgctgaaggcagaggagatcgcggcggccacgcccgactcctacatcctgcaacagttcgagaaccccgccaacccgaaggtccactatgagaccacggggcccgagatctggcgggacgctggcggcgacgtcgacgtcttcgtcgcgggggtgggcaccggcggcactgtgtcgggggcggggcgcttcctgaaggagaagaacccggggctgaaggtattcgccgtggagcccaccgagtcccccgtcatctcgggtggctccccaggcccgcacaagatccagggcatcggggccgggttcatcccgaagaacctggacgttcccatcctggacggcgtggagaaggtggggtgggggaggtgtggttgtggaagggaggggcgccatgcagaggtggtgtttggggggtggagagcgcggagggatgctcaccatgcatcctgcatcgtctgcttccaggggccgcagccacccccgccttctaagaaggaaaggaacaccaggcattcaccggtccactga

SEQ ID NO: 8650 - DNA, 1734 bp, Chlorella protothecoides
  modified_base (391)..(400): a, c, t, g, unknown or other
  modified_base (746)..(755): a, c, t, g, unknown or other
  modified_base (1538)..(1547): a, c, t, g, unknown or other
atgttgagtgcaattcagggaaggtgtgtgcgcctgggcccatacactcagcggtgcagcgggcaactctggagggcagtctggcatgtaggaagcccgccaggttgctgcactcggcgaccagaccctgggcacccctacgcgtgggtggcactcttcaggcccacccacccctcagcgttcccacctgtcatagatcgagcggtgcggcttctcgtatcgcccggccgccacctcgtcacccccgatgatgacataatccaccaggttgcgggcgccgcaggcctccagcttggacgcctggacgtcagagtggccattggtgatgatgacggtggtgaggcagctggaccgcagcgtgcccagcatcgacgccacagcggaggtgctnnnnnnnnnnatagggggcggaggaaggttgaattcggggactgtacggcggcaaacgattatctgaccacaaaggtgcgatggggcggcaagatcaccattcaactcaagagaactagttcatccgcaggggggcacaaatcggcatgcgatactggcgggagtcacaccaaatggcatgattcgtactcatccccgggtggcaggggcttgagggggaggccgctgtcagcacacaggccggggctggccagggacgcagtactctccaataccaacccccggtgcacccacctggtgtgtcggatcccagggcgcctccttaaagagctggcgccagtcagccagcaactttnnnnnnnnnnagcacacaggccggggctggccagggacgctatactctccaataccacccccccccgtgcacccacccggtgtgtcggatcccagggcgcctccttgaagagctggcgccagtcagccagcaacttcgtcgggtccaccgctggacagtgctgcgacgctgcctgggccacttcctccaaggccctcacatcacccttggatgtaaggtgtcatcaaggtctgcaatttagagatgggtccggatctaatactgcattcaggtacccagtcaccgacggcagcgcgcgccaagtcggagatttctcgcttcaggagcgagcgaagcctgtgccagcaaaatggggacgtacctcccaatcccacgagatctacccctcgttccgaccagaccctgcaataaacccactgaaacattctttcgctcgtgtccaagcgcacattggcgaaccggcactatgggcggatcacacaggtgcgacttcgtccgcgcgatgggtggtgggaaactcgcgatgccggaatgcgaccggtgttcgtgccaatgcgatgaggatctcatggcctttgatgaatttcccgtgcagtaagaaggccggggcgcctgccgaccccctcgtgactgttctggagaacaagccatccaggaacctgggcgccaccgacaccgcggcggtgccggccaagaaacacggtgtggccagcaacgtcacccagctcatcggtgagtccccggtcacggccggcgcgagcccgtcccccccgtcatgtgggcgccacgcgannnnnnnnnngagtccccggtcacggccggcgcgagcccggcccccccccccgtcatgtgggcgccacgcgcccgagccacatgacggcatgtgcccggaggccctggcgccacccgccctctctcgccgcagggtgccgatgcacacccatcctcacggcccactcccacaggcaacacccccctggtgcgcctga

SEQ ID NO: 8651 - DNA, 822 bp, Chlorella protothecoides
atggacaccatgtcggcccactggcgggcttggaccgatgtgacccgtgagcttggcctgaccataacccccgagcaattcctgggatttgctgggcggcccacctccggcatctttgccagcctctgtgaggagcaggtgaggcagacgagggggttggggttggagggatggcaattcgatgagggtacaaatttgccgacaacgggctgggtcatcccccagcctggtgctctttgtgctccctatgtgcggctgccggctgtcgatggcaagacgatcgacatccctgctgcggttgagctgaagaacgccaggtaccatgaggttgccgacgacaccaagctggtgaagccggtcgtagagatcctgcaggctgccctcgccaggggtgagtgggtgggattgggggtcatggggcgggcggtgaggtgctggagaggtcgccacccgacgtcctcccgcctggatcacaaggcctgtcgatgtacgacggggccaacacatgatcaagcccgtcctcaccgcaaaccagggctgccctgtgcgatagccacgggcggggaccggttccaggtgtacccctccctggccaagtcaggcctctggaccccagacaacacctccaacttcaaggcggtggtgacctgcaccgacgtgacccacggcaagccgcacccggagacctacctcaaggccgcagcgctgctgggagtcgacccggctgactgtgtggggtacgaggatgcccccctgggaatggagtccatccgaagggcaggcttcctggcagcggtggatgtgacgaagatcccagggtga

SEQ ID NO: 8652 - DNA, 645 bp, Chlorella protothecoides
atgaggtttgacggacccgcccccgagcgcatcaacggcaggctggccatgctcgcagtcatcaccggagtcttggaagagctgaggagcgggcatggcatcatctggcaggcgcagcaccccaaccccctgatcgctgtgtccttcctcgccatcatctacgccagcctcgtgcccatcctcaagggagccgtgtacgaggacttcggcatcttcaccgtggtcgccgagaagctgaatggaagggctgccatgatcggatttgcgagtctcctggcactggaggtgtacattgacttgttctggggtggagaccgagaaatcgctttcaaactaggaaaagtggcgcatgggattctcgagttgccacagcttcgtactgtccactgtgtccggcaccgtcttagcaaggcccacgcacgccacgttcggcgctccccgcaacgcctgccgacggcaaaaccccgagctacaacttcgtgtcaggcgcagatcagtctccgtcatggcttcccaaattcccgaggagtatctccctgcagccgcaaagggtgggtgcgcgggcatcaaatagctgtgccgcttacctccaaagggtttggtgctgtcgtgattgtggcttcaggaacccgagctgatgcgtga

SEQ ID NO: 8653 - DNA, 1551 bp, Chlorella protothecoides
  modified_base (1131)..(1198): a, c, t, g, unknown or other
atgattgccacgcctgattttatgaccttcccttgcccggctttgtcacacccccgcccacaattgtgtggacgttcacagcccaccgcctgccagtccacagcatcgttgccaatccccaaggccaggatcatgctgggttacgaccctggccccgcgacactcttgggagctcagcatcagcctccaggcgctcagcgtgagcctccaggcattcgtccaggcactggacctggaaggagcatgtgtgggggacccggggaggggtcatgccggggcccctgcccgcacaggcctccaccgcatccactgcgacagagagttggccatggagtgagcgtgtcggtgcccctccatcccatagccccgagccagctcaccctcagaggggcatacactgcgcaccgcgcaccagcccgccgcggcactgagctgggagcaaacctccggttgccgagggtgcttgcgactgcagtcctcgagtgctcggaagactcggtcacaggagggaactggcgcgggcatccgaagccatggagggtgcctccaggctgcgacaaccttgatcggcgccctcaccacagcacagcccctatttcaattcggagatcgctacaagctcctgcgcgcgcgcagggccgagacgagacatatgcggaaacacaggttattcgacaggacacatgcaagcaggatttcggctgccattttctgcaagaatactacttggtgtcacctcgaatcatggcaactaagaatttgaaagccgtcgtcgtcggcgccacaggcgcagtcggaggggagatcctgggtcagctgctcgtgaaccccgcatggggagaggtcgtggtcgttggacgtcgagaggcacctgtccctcccgagtacaagggctgggacccagccaagctgcaacataaggtcatcgacatggacaacttggcatcggaggcgagctcagcttttgagggggccgacactgtgttctgcgccctgggaaccacccgcgcgacagccggaagtgccgaggctttccagaaggtggacctcgagtacgtccgggccgctgctgaggccgcgaagcaggccaaggtgtcccacttctccctcatctcggctcaaggggccaannnnnnnnnnnnnnnnnnnnnnnnnnnnnnnnnnnnnnnnnnnnnnnnnnnnnnnnnnnnnnnnnnnngcccactcactcctatacatcaagaccaagggactggtgaggaggttgaccactgaaaacatccacagcagcacctccgaccccccctccccatccaaccacaggcagaggaggctgtcaagagtcagggttttgcctacaccaccatccttcgtcccggcctgctggcccgtggtgacaaagcgcgcactgctgaacgcgccttctccttcctcctcaagggcgtcccagtgagtcaggtggcgcacttggcagtacaagacagcacgtcctttcatgcagccaagggtggaggaaagccaggcgtgcgggttgtagagaatggagagatcaaaagctggcgcgatgcataa

SEQ ID NO: 8654 - DNA, 714 bp, Chlorella protothecoides
gccacgcgcctgggcctgcccgtcgacggcgtcgccttccacgtcgggtccggggcgggggctgacgcggcgggggcttacgagaacgccatcgccgtcgccgccgacgcggccgaggtcctgcgcgccgcggggcacgccgtctccatcctcgacatcggcggcgggttcccgggcggcgcgctgggcggcatcgcgccggccatcaacgccgcgctggaggcgcgcttcccgggcgtggaggtggtggccgagccgggacgcttcttcgcggagcgcatcgccacgcttgccaccgccgtgtttggcgcgcgcgagcgcagcgcgggcggtgacgccagggacgtggacgccatcgccacccccaccgtcgaggaccccaccctccaccccaccacgcgcgagctcttcgtgaccgatggcatctacggctccatgaactgcatgctgtacgaccacgccagccccctgccgcgtgcgctggccaccgacgaccgcgcgcgcggcggtctggtccccaccaccgtgtttgggcccacctgcgacgggctggacacgctggtgcggggccacccgctgcctgccgggctgggcgtcggctcgtggctggtgtggcccgacatgggggcctacaccatctgcggcgcctcggccttcaacggcatggacgcggtgaatgttccccgtttctacgtctggtccgtgaagccgtga
